United States Patent 10,750,711 (STREPTOMYCES ENDOPHYTE COMPOSITIONS AND METHODS FOR IMPROVED AGRONOMIC TRAITS IN PLANTS) - sequence listing, part 2

SEQ ID NO: 1878 - DNA, 2187 bp, Glycine max var. Williams 82
atggaaactgggtcgaactcagaatcattgaacagaaacgtggcgatgagtgtgaggggtagcactgggaagaagaaacagcagggaggtgttactctagcaggcaaaaaagtggacccttttgtgccgagaagcgagcacaacccgagagagttacggtcgtgggcgaaaagaacaggttttgtgtcagattactctggggaagcagggtcaagtggaagtgcaaagtttgaagctttagagaggagaggaggagggtcatctccgaagatagagatagatccggtggtggggagaacgaggcaaaacgagatcgaacaagagactcatggaggagcaatgaggggtgagaatggtgctgttttggatgggagagggaggaaagagaaggagaatgagggttgtgagaggaaagttggtttcaatgggaatgggaatgggcatggagtttctgcagtggctcctgtgaatgaggaaaaggagggggaggagggaaatggggatgttaaggtcagtgtgcttcatgaaggggaggaggttgctgatggagggtggcagggaccgttgggattgaagtgcgggctcaaagagaatcccgggattgtacctcttatctattatggcctgcagcactatctatcgttggttggttctcttgtattgattccattagtcatggtacctgtcatgggtggaacagataaggatactgctaccgtaatttctacaatactgtttctttctggcatcacaactatactgcactcctactttggtacccgactgcctttagttcaagggagctcatttgtgtatttagcaccagcattagttatcataaatgctcaagaatatcggaatcttactgaacataaatttagacacataatgagggaactccaaggagctataattgttggttcagtattccaatgtatcctgggatttagtggtttaatgtctattctactcaggttaatcaacccaattgtggttgccccaactgttgctgctgtaggtttagcattcttcagttatggttttccacaagcaggctcatgccccgaaattaccattccacagatagcgctggttctaatattcactctgtatcttcgaggaatatctatctttgggcgccacttatttcgaatttatgctgttcccttgagtttgacaataatttggatatatgcatcctttttaacagctgggggagcatataattacaaaggatgcaatccagatataccaagttcaaacattctgttggatgcatgtagaaaacatgcgtataccatgaagcattgcaggactgatgtttccaatgcattgtctactgctgcatgggtcagaattccttaccctttacaatggggtatccctattttccattttaggacttccataatcatggtcatagtgtcactggttgcctctgtggattcagttggaacttatcgtgctacatctctgcaagttaactcgaggcctccaactcccggagttgtgagccgaggaattgcacttgagggtttctgtagtatattggctggtctttggggttctggtaccggcgcaacaaccttgacagaaaacacgcacacaattgacatcacaaaggtggcaagtcggaaggtagtggtagttggagcagctttcgtgatcctgttctcatttatagggaaagtgggtgcccttcttgcttccattccacaggccttggctgcttctgtactgtgtttcatgtgggctcttactgcagcattgggcctctcaaatttacagtatagtaaatcagccagctttaggaacataacaatagttggcgtttcgctgttccttggcatgtccatccctgcttattttcaacaataccaggccgagtcaagtctgatactgcccagttatctggttccttatgcagcagcatcaagtgggccattccgttcaggcattaaacaacttgattttgcaatcaatgctcttatgtccttgaacatggtggttacactgttggtggcattcctactggacaacaccgtccctggcagtcaagaagaacgaggggtgtatttatggtcgcaagctgaagacattgtcactgatccctcactgcaatccgaatattcgctgccaaagaaagttgtgcggtgttgttgttgcttcaaatgcttgggagtctaa

SEQ ID NO: 1879 - DNA, 1095 bp, Glycine max var. Williams 82
atgtcgaacgtgttagcaggagaagaaagcgaaaaagttgttacctatgggtgggcagctagagacacctcgggaattctctccccattccactttatcagaagggcaaatggtgataatgatatcacactcgacatactctattctgggatttgccacaccgatctccacatggtgaagaacgactttagaatatccatctatccaatggttcctgggcatgagattgtgggtaaggtgacaaaggttggtagaagagtcacaaaattcagtgttggtgacattgctggtgtgggtggctctgtgggttcgtgtggctcatgttcggactgcagcaacggcttctatgtatattgtccaaaaatgattttaacctacagtgcacactattatgatggaacaataacccaaggtggatactcaaataacatagtggttgatcagaactttgtcgtgctaatcccaaaatctcttccattagatggtgcagccccgttgctatgtgctggaatcacagtatacagcccaatgaaatattatgggcttgctcagcctgggttgcacttgggtgtggtgggcctgggaggcctaggtcatgtggctgtcaagtttgctaaggcttttggtatgcatgtcactgtgataagtacatctcccagcaagaaagaggaagcattggaaaagcttggtgctgatgaattcttggttagtctggaccagcaacaattgcaggatgccaggggcacaatggatgccattattgacacagtttcagctaatcactctatccaaccactaattgctttattgaaaacaagtggaaagttgattttggtaggtggaccaccctcgcctcttgaggtattagctatgcctttgcttttggggagaaagatcattgctggtagtgcaggaggtgggagagaagagattcaagagatgatggattttgcagcaaagcacaatatcacagcagatgtggaagtcattccaatggattacgtgaacactgcctttgagagactggaaaaaaatgatgttaaatatcgctttgtcattgatgtggcaaatacaataagctgcatgtccaattag

SEQ ID NO: 1880 - DNA, 852 bp, Glycine max var. Williams 82
atggctttctccaactcaaaacctaacctccttcaatctctaagtccccttataaaattcctcatccctttcctcttgctacaacatagtgtcaattcacaacaacccccatccccaatgtcagcatacgaaaccgttggcttcggcttcggttttttcgacaaagatgacccaaacgtatttttgttgggcaatgcctcagtatctggtggggcactaaggctaaccaacaccgaccaacttggcaaaccggtcccacacagtgttggaagagcattgcatgtcacaccgatacacctctggaacaaaaacaacggagaactcgctgacttcagctctggcttctcctttgtcgtgaaccctaagggttcaacccttcgtggtgatggctttgccttctttcttgcaccagccaaccttaacttccccaaaaattcaagtggagggtatcttggacttttcaacccggaaactgcactggacccttccaaaaaccaaatagtggctattgagtttgatagtttcaccaatgattgggaccccaattcaccaaaccagtctcctcatgttggaattgatgttgactctattaagtcagtggcaactgtgccatggcctagtgaacttgaacctgataacgctgtagcacatgcgagcctgaactataactccgagtccaagagcttgagtgtgtttgtgggttaccctgacaataggaatgccactgtctctactattgttgatttgaggaatgttttgcccgaatggatcagagttggtttctctgcctccactggtgacttggttgaaacacatgacattcttaactggtctttcgaagcagccttgtag

SEQ ID NO: 1881 - DNA, 852 bp, Glycine max var. Williams 82; identical to SEQ ID NO: 1880

SEQ ID NO: 1882 - DNA, 2193 bp, Glycine max var. Williams 82
atgactcaagccaatggccaccatcgtgttgatcaaacagtgattgacataaagaaaccgccggtgagcttcactgggggtctggtgttcgagtgcctcacttacaccgttacaaagaagaaaaaggttgaggggaagtggtcgaatgaagaggtggatttgctgcatgatatcaccagctatgcaccaaagggttgcatcactgcagtgatgggccctagtggagcaggaaagtccactctcttggatggccttgctgggaggattgcgagtgggagcctcaaagggagggtctccttggatggtgcgactgtgagtgcaagcttgatcaagagaacttctgcatatatcatgcaggaagacaggcttttcccaatgctcaccgtctatgagactttgatgtttgctgctgattttcgtctggggccactctcacttgctgataagaagcagagggtggagaagctcattaaccagcttggcttatcgtcatctcaaaacacctacataggagacgaaggtacaagaggagtctccggcggagagcggcgtcgggtttcaatcggcgtggacatcatccacggcccatccctcctcttcctggacgagccaacctcggggctagactccaccagtgcccacagcgtgatcgagaaagtgcatgacatcgcccgcagcggtagcacggtgatcctcaccatccaccagccctcatccagaatccagctcctcctcgaccaccttatcatcctcgcacgcggccagctcatgttccaaggctcgccccaagacgtggcactccacctgagtcgcatgccacgcaaaattcccaaaggagagagccccatcgagcttctcattgatgtgattcaagagtatgaccagtctgaggttggagttgaagcacttgctgagtttgcacgcactggagtgaagccacctcctttgtctgaacaactacactctctgtcttctgttgcaccctcacctgctccgtcctcgcaccttggccataggtatggggagaaatctcaggacttttcttactcgtcgcaagtgagtagaagggtcgtggatgattttgatcacagtctcagaagtccctataacaacaatacatcaatgtcgtggagcactgggaatagtgcggcgtttttgaaattcactccttcgcggcttaagaatgatcacaagctgcagaataccgcaagaagcaatgcttcacctggctactacacatactcgagtgaaatcctccaagccactccaacaccccatagcagtgactacacagtgaatgagaatgactacatcactgcctcaaacgccacacacgaacaccttggcccaaagtttgcaaattcctacataggagagatttggatccttatgcgtcgcaacttcataaacataaggcgcacccctgaactcttcctttcaagactcatggttctcaccttcatgggcatcatgatggccacaatgttcttcaagccaaaagaaacattgcaaggaatcaccaaccgcctcagcttcttcatcttcacagtgtgcctcttcttcttctcttccaacgacgccgtcccggccttcatccaagaaaggttcatcttcataagggaaacctctcacaacgcctatagagcttccacttacaccattgcaggcataatcactcacatgccattcattcttctccaagcaacttcttatgctgtcattgtttggtttgccctaaaacttcgaggcccttttctttacttcttgcttgttctcttcgtttctcttctttcaaccaattcatttgttgtgtttgtgagctcagttgttccaaattacatccttggttatgctgtggttattgccttcactgccttgttcttcttgttctgtggatacttcttaaacagccaggacattccccatttttggcgttggatgaacaaaatttcaaccatgacgtacccttatgaggggctcttgatgaaccagtatcagaccaatgatacctttgggtttgggtatcttgatggtgcagccattactggttttgatatcttgaaaagtctacatattgacattcttgaacgtaggaagaggacaattgtgcttataatgtttggttgggctgtgctatatagggttttgttttacttggtccttcgttttgcatcaaaaaaccagaggtcgtag

SEQ ID NO: 1883 - DNA, 1626 bp, Glycine max var. Williams 82
atgcttatgctattaatcactgaccaatatgttcttttgagtgtgcagagtcgatgtggaatctgtatgcagagcgcgaggagtgggcaaggaacagcaattttcacagcggaatgctctcacacgtttcacttcccttgcatagtgaagaagcacccgatcgtcacgtgccccgtgtgcaacactagctggaaggagcttccgagcgacaagagaggcttcaaggtctacaacgacgacgagcctctcatgtctccaacttcactctctcgcttcaatcctattcccgagtcagaaaacgaagacgaagaacaagaacaagataacattaacacggagaggaacctccagctatcgttgctgccggaggcggccattgtcgccgccaaccgaaactacgagagttacgtcgtcgttttgaagctcaagccgccgcacgtgacgaaaacgtcgcgtcgtgctccaattgacctcatcgccgtgctcgacgtcggtggcgccatgtccggcagcaagctccgtctcatgaaaagctccatgcggcaagtgatctcgtcgctccgtccaaccgatcgtctttccatcgtcgcattctcggccggatccaagcggctgcttccgctgcggcgaatgaccggtggcggccagcggtcagcgcggcggatcgtcgacgcgctcgccgcgattgatcaaacaagagaaggaactccggtgaagaacgacgccgtgaaaaaagccgcgaaagttctcgaggatcgccgcgagaagaacgccgtggcgagcattgtagtcctctccgatctgaacgactcacgcgctggaaacaacatgcacaaaccctcgcttgtttccaccacgcggcttgcccacctcgaagtcccagtgcacgcggtgcggttgggagagtgttcccacgcgctctcagacgacgcgctggcgaatttcgtgggaggtttgttgaacgtggtggctcaggacgttaggattcagttagaggtggtgtcgcgatcccgcgctgtggagattgctggcgtgtattcattatcgggtcgacccgtttctctcgggtcatcggattggatccgactcggtgatctctacgcggaggaagagagagaattcctcgtggaactcaaagtgcctgcggcttccgctgggtcccaccacgtcctgaccgtacgatcctcctatcggaaccccctcactcgtgagcctttgattcccgttgagcaggcaatgctcgttccgcgtccccacgccgtacgatcctcgtgcgccaagatcgaacgcttacggaacctccacgtcactgcgcgagccgtggccgaatcttcccggctcgctgaacataatgatctctctggagctcatcacttgctctcttcggctcgcgcgcttctcttgcagtcaagtaagccggaagaggagtttctccgctggctcgaagccgagcaagccgagctgcaacggcgcagacagaggcaaacacagagaaacagtcgtgttgaagagaaggtggagccgcttacgccgacttcggcttggcgggctgctgagaggaagaatttaaaatcacaacatctccctcttgtttttccccttcggtcaccatatccacctaattaa

SEQ ID NO: 1884 - DNA, 1986 bp, Glycine max var. Williams 82
atggcgtcgaacgggaatggcagcgttgcgaacgggaacgggaccgctaggaacggactggcgaagattcagacgcacaagaagcataacggaatttgtcacgacgacagcggtccgaccgtaaaggctcaaaccattgatgagcttcactcgctgcagaagaagaaatccgcgcccaccactcccgttacggggtttcaggctccgttcgccaccctcaccgaagaagaacgtcataagcaacaactccagtcaatcagtgcatccctggcatcactgactagagaaactggaccgaatctggtgaagggagacccagctcggaagtcagatacccagaaggttactcacgtgcaccaccatcatgtcagtactcccaccattgctgtcagcgacagtgctttgaaatttactcatgtcctctacaatctctccccagctgaactttatgaacaggcgattaagtatgagaaaggatcgttcatcagttccaccggagcattggcaacactttctggggccaagacgggtcgctctccaagggacaagcgcgtcgtcaaggatgatcttactaagaacgacctttggtggggaaagggttctcctaacatcgagatggacgagcacagtttcatggtgaacagagaaagagctgttgattacttgaactccttggacaaggtcttcgtcaatgaccaattcttgaattgggacacagagaacagaatcaaagtccggattgtatctgccagagcttaccattcattgttcatgcacaacatgtgtatccgccccactcctgaagagctggagaattttggtactccggacttcactatatacaatgctggacagttcccgtgtaatcgttatactcactacatgacatcctccactagcatagatcttaatcttgctaggagggaaatggtcatcctcggcacacaatacgccggggaaatgaagaagggtcttttcagtgtcatgcattatctcatgcctaagcgccaaatcctctccctacactccggatgcaatatgggcaaagatggggatgtggcactcttctttggactctcaggtactgggaagaccactctttccaccgatcacaataggtatttaatcggagatgatgaacactgttggggtgacaatggtgtctccaacattgaaggtggttgctatgccaaatgcattgacctctcacgggagaaagagccagatatttggaatgcaatcaggtttggcacagtgttggaaaatgtggtgtttgatgagcatgatcgagaagttgattactctgacaagtcagttacagaaaatactcgtgcagcttatcctatagagtacattccaaatgcaaagttaccttgtgttggccctcacccaaagaatgtcatacttttggcatgtgacgcatttggtgtactcccacccgttagcaagctaaacctggcacagaccatgtaccatttcatcagtggatatactgctttggtggctggcacagaagaaggtattaaggagcctcaggcaactttttcagcttgttttggtgcagcattcattatgctacaccctacaaagtatgcagcaatgcttgctgaaaagatgcagaagcatggtgctactggatggcttgttaacactggttggtctgctggaagctatggtaatggaagccgtattaaactacaatacacaaggaaaatcattgatgctattcactccggaagtctcctgaatgcagagtacaagaagactgaaatttttgggcttgagattcccaccgaagtggagggtgtcccttcagaaattctggatcctatgaacacttggtcaaacaaaaaggcctacaaggagacactattgaagttggctggattgttcaagaacaattttgaaaccttcaccaactacaagattggcaagggaaacaacaacctgacagaagagattctcgcagctggtccaatcttttga

SEQ ID NO: 1885 - DNA, 1227 bp, Glycine max var. Williams 82
atggggtgcatggtgtctcagctagccgcgaaattcgcattctttccgccgtcgccgccgacgtaccagctcaagaagaacgaggacggcaagctcacggtggtctccgcggcggcgccgattccccacgccgatgacacctccctcgacgttctccttgttgacaccaagcacgggaacaagattgtggcgttttatctgagaaacccctacgcgcgcctcactctgctttattctcatggcaatgccgctgacttgggtcaactctatgatctcttcgtgcaactcaaggtcaatcttagagttaatctcatgggatatgactactctggatatggggcatctactggcaagcctagtgaatccagcacatatgctgacatagaggcaatatatgaatgccttgaaactgagtatggagttagccaagaagatgtaatcttgtatgggcaatcagttggaagtggaccaacactgcacttggctgctaaattgcctaggttgagaggtgtggttcttcacagtggcattctttctggtcttcgagtgctctgccatgtgaagttcacattttgcttggacatttataagaacatcaacaaaataaagaaggtcaagtgtcctgtacttgtaatacatggtacagaagacgatgttgtcaattggttacatggtaatggactttggaagatgtcaagggagtcatatgatcccttgtggatcaaaggaggtggtcactgcaacttggagctttaccccgattacatccgccatctttgcaaattcatccaagaaatggagagcatgacaactgagaagcgcctcaaaaagattcggcaaagtgcgaaccaatccaagtcaaacactggttgcacctgtagtagatgctgtagagtgaagtgttgtagagttaaatgtcctgaatgctctaattgctgttgctgcatgaatgtttcctggtctatcaactgtcctgaatgctgttggagacctagctgcaagtgttgccgcctccccaagttccctagttgtttcagatcaatctgccgcacaaaatggtcgtggcctagctgttgtgcaacaaaatgttcattgtcattgcctagctgctgctgctgctgctacccgaagcgtgcaagaccaagttgctgttgcatgaattgtttctgttggcaatgttgtgtaggaaaacacagtgatggcacaaatggaaaacagaatggctaa

SEQ ID NO: 1886 - DNA, 1689 bp, Glycine max var. Williams 82
atggaagaattcaagcaagttcatgcccatattctaaaattgggtctcttctatgattctttctgtggcagcaatcttgttgccacgtgtgctttatccagatggggcagcatggagtatgcttgctcaatcttcaggcagattgaggaacctggtagctttgagtataataccatgattagaggaaatgtcaatagcatgaatcttgaagaagctttgttgctttatgttgagatgcttgaaagaggaattgaacctgacaacttcacctacccttttgtgctcaaggcatgttctctattaggtgctctcaaggaaggagtgcaaattcatgctcatgtttttaaggcaggtcttgagggtgatgtctttgtgcaaaatggcttgatcaacatgtatggcaagtgtggggcaatagagcatgctagtgttgtgtttgagcaaatggatgaaaagagtgtggcttcatggagttccatcattggtgctcatgctagtgtggagatgtggcatgagtgcttgatgcttcttggggatatgagcggtgaggggcgccatagggctgaagagagcattctagttagcgcgctttctgcttgcactcatttggggtctcctaattttggaaggtgcatacatgggatcttgttgaggaacattagtgaactcaatgttgctgtgaagacttcattaattgatatgtatgtcaagagtgggagccttgagaaagggctttgtgtattccaaaacatggctcagaagaatagatattcttacactgtaatcatcacggggcttgccattcacgggcgtggtagggaagctctaagcgttttctctgacatgctggaggaaggtttggcaccagatgatgttgtctatgtgggtgtgttaagtgcttgcagtcatgctggtcttgtcaatgagggtcttcaatgtttcaaccgcctgcaatttgagcataagattaaaccaacaattcagcactatggttgcatggtcgatcttatggggagagctgggatgctaaagggggcctatgacctcataaaaagcatgccaattaagcctaatgatgtggtttggaggagccttcttagtgcttgtaaggtacaccataacttggaaataggggagattgcagctgagaatattttcaagttgaatcaacacaatcccggggactatttggtgctagcaaatatgtatgcaagggctaaaaaatgggctgatgtggccagaatcagaacagaaatggcagaaaaacacttggtgcaaacacctgggttcagtttggttgaagcaaataggaatgtctacaagtttgtttcacaggacaagtctcaaccacaatgtgaaaccatttatgatatgattcaacaaatggaatggcagttgaaatttgaaggttatacgccagacatgtcacaggtgttgcttgatgtggatgaagatgaaaagaggcagagactgaaacatcatagtcagaagttggcaattgcttttgcactaatacagacatcagagggatctcgcataagaatatcaagaaatattaggatgtgtaatgactgtcatacatatactaagttcatttccgtgatctatgaacgggaaattactgtaagagaccgcaatcgcttccaccattttaaagatggaacttgctcatgtaaagattattggtga

SEQ ID NO: 1887 - DNA, 1689 bp, Glycine max var. Williams 82; identical to SEQ ID NO: 1886

SEQ ID NO: 1888 - DNA, 2847 bp, Glycine max var. Williams 82
atggctgagagtgcagtgagttttcttctcgaaaggcttaaacctgtttttgtgaataagttgaaattgttcacaggggttgaagcagaagtgatatatctgaaaggacagttggagttgataagagccttcttaagggctgcagatgcatttgaagagagtgatgaggaactcaaagtttgggttaggcaagtcagagatgttgttcatgaggcagaagatcttcttgatgaattggaactggttcagctacataaccatacaaatggactctctaattatctcagtatcaggaatatgaaagctcattatcggattgcacacgagttaaaagccatcaactcacgcatgaaaactatttctttaactcgcaagagattcctcagtaaacttgacactgcttctgaggcttcaaattccacttatacagttaacgcgtggcatgatcaacggggagacgcccttctcctggacaacactgatctagtaggaatagacaggcctaaaaagcagctgatcgggtggttgattaatggttgtaccggacgaaaagtgatttctgtcactggaatgggagggatgggaaaaactactttggtaaagaaagtattcgatgatccagaagtaagaaaacacttcaaagcctgtgtttgggttaccgtttctcaatcttgtaaaactgaggagcttctcagagacttggcccggaagcttttttccgaaataaggcgaccgattcctgagggacttgaaagcatgtgtagtgataagctgaagatgatcatcaaagacctgctgcagaggaagaggtatctagtggtatttgatgatgtgtggcaaatgtatgaatgggaagctgtcaaatatgcattgcctaacaataactgtggcagcaggatcatgatcaccacacgaaaatccaatttagcctttacttccagcatagaatccaatggtaaggtgtataacttgcaacccttgaaagaagatgaggcttgggatctattttgtaggaacacttttcagggtcattcatgcccctcacatttgattgacatatgtaaatacatcttaagaaaatgtgggggtcttccccttgcaattgtggcaatcagtggtgtcctggctacaaaagacaagcacaggatcgatgaatgggacatgatttgccgtagtcttggagctgaaattcaaggcaatggtaaacttgataatttcaaaacagtactcaacctcagtttcaatgatttaccttaccatttgaaatactgtttcttgtacttgagcatctttcctgaggactatctgattcagcgcatgagattgattcgcttgtggatagcagaaggattcattaaagccaaagaaggaaaaacaaaggaagatgttgcagatgattacctcaaggagctcctgaacagaaacttgatacaggttgcagagataacatctgatggaagggtgaaaactttgcgaatccatgatcttctaagggagattatcattttgaagtccaaggaccaaaactttgtatccgttgtcaaagaacaaagcatagcatggccagaaaagattcggagactttcggtgcacggcacattaccatgtcatcggcagcaacatattcataggtcaggctctcaactccgttctctcttaatgtttggtgtaggagaaaatttatctcttggcaaactgtttcctggtggttgtaaactgctaggtgttttagattatcaagatgcacctttgaataagtttccagtagcagttgttgatctatatcatttaagatatctaagcttaaggaacacaaaggtgacaatggttccaggttacataatagggaagttgcataatctagaaacactggatcttaagaaaacttctgtcagagaattgcctttagatatactaaagcttcaaaagcttcgccatctccttgtgtataaatttaatgtcaaaggctatgcacagttctactccaaacatggttttaaggcccccactgaaataggaaatttgaaggcactacaaaaactttgttttgtggaggcaaaccaagattgtggaatgataataaggcagttaggggagctaagtcaactaagaaggttaggcatcttgaaacttagagaggaagatgggaaggctttctgtttgtccattgagagattaaccaatctccatgctctttctgttgcttctgaaggtgagaataaagtcattgatcttgcgttcctttgttcgcctcctccgtttcttcaacgcttgtatttgtccgggcgtttacaagagttaccaagttggatacagtctctccatagccttgctaggctatttctcaaatggagctgtttaaaacatgatccactagtatatctgcaggatctgccaagccttgcacatcttgaactagttcaagtatatgatggtgacacattgcattttgtgtgtggaaagttcaagaagctcaaggttttaggccttgacaaattcgatggactcaaacaggtgacagtgggggaggatgcaatgccttgcctagaaaggctgagcatcggacgctgcgaattgttgaagaaggttccatcaggaattgagcacttgagtaagctcaaagtccttgagttttttgatatgccagatgaactgatgaagacaatatgtccacatggtccaggaaaagattactgtaaagtttcacatataccaaatgtttattctacctattggagagatgatggttgggatgtttatgctctagacagtttcagcagagattgttctccccggtctggcacagtcatgagaagtcatgaacctcgcactctgtggaaggtctag

SEQ ID NO: 1889 - DNA, 1224 bp, Glycine max var. Williams 82
atggcagcctgcactgtctactcaacacaatctctgagcacaaattgctccatctcaaccccatcaaagacacagctgagtttcttccaccaaaagcaggtagttttctggaggaacagcaacaggggcagcagcagcagcagaagaagctatgtgataacatgtgcagcaggtgactcccagacagtggtgattggtcttgctgcagactcagggtgtgggaagagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggagaagggtgtcactgcccttgaccctagagccaatgattttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacccaactcattccagatgacaacgagggtaagattttgagagtgaggttgatacagaaagaaggggttaagtactttagcccagtttacttatttgatgatggctctaccatttcatggataccatgtggaaggaagcttacatgctcctaccctggcatcaaattcttctatggaccagagacttactacggaaatgaggtgtcagttgtagaaatggatggacaatttgacagactagatgaactaatatacgttgagagccacctaagcaacctctctacaaagttctatggagaggttactcaacagatgttgaagcatgctgatttccccggcagcaacaatggaacaggtctcttccaaaccatagttggtttgaagataagagatttatatgagcagctaatagccaccaaggctgagactccagtggctgcaaaagcttag

SEQ ID NO: 1890 - DNA, 957 bp, Glycine max var. Williams 82
atgggaaagagcaaggttcttgttgtgggtggaactgggtatgttgggaggagaatagtgaaggcaagtttagaacaaggccatgaaacctatgttcttcaacgtccagagattggtcttgacattgagaaggtgcagatgctgctttcattcaagaagcaaggtgctcaccttgtggaggcttctgtttctgatcaccagagcttagtggaagcagtgaagcttgtggatgttgtgatttgcaccatgtctggtgttcattttcgctctcacaacttgttggtgcagctcaaacttgtggaggccatcaaggctgcagggaacgttaagcgtttcttgccttcagaatttggcatggaccctgcacttatgggacatgcacttgaaccgggaagagtgacatttgatgagaaaatgaccgtaaggaaagcaattgaggatgccaacatccctttcacttacatttctgctaactgctttgcgggttacttcgctggtaacctctctcaaatggggactctcctccctccacgagacaaggtccttctctatggtgatggcaatgtcaaagttgtttatatgaatgaagatgatgttgcagcatacacaataaagacaatcgatgatcctcgaacattgaacaagacggtatacctaagaccaccagaaaacattctcactcaaagacagctaattgaaaagtgggagaaactcataggaaaacaactagagaagtccagcataaatgaacaagactttcttgcttccatcaaaggtttggactatgcagctcaagtgggggtggggcatttctatcatattttctatgaaggttgtttgacaaactttgaaataggagaaggtggagaagaagcgtcagagctttatcctgaggtgaagtacacccgcatggatgaatacctaaaagtttataagcatgaaaaattatgtatttga

SEQ ID NO: 1891 - DNA, 939 bp, Glycine max var. Williams 82
atggaaaagagcagagtgcttattgttgggggaactggctacataggaaaaaggttggtgaaggctagtttagctcaaggacatgaaacatttgttcttcacaggccagagattggtgttgatattgagaaagttcagcttctattgtcattcaaggagcaaggagctaggcttgtttcaggttcatttaacgaccataagagcctagtgaatgctgtgaaacttgttgatgttgtcatttgtgccatttctggtgttcacatccgcagccaccaaattctactccaacttaaacttgttgatgcaataaaagaagctggaaacatcaagagatttttgccctcggagtttgggactgatccggcaagaatggcgcatgcattggaacctggaagagtaacatttgacgacaaaatggtagtgaggaaagccattcaagaggctcacataccattcacctatatttctgctaattgctttgctggttactttcttggtgggttgtgtcagcctggctttataatcccccctatggattctgtgatcttatttggagatggaaacgtaaaggctatctatgtggatgaagatgatatagctatgtacactatcaaaaccatagatgaccccagaacacggaacaagacagtttacataaggccacctgaaaacatattatcccagagagaggttgtgcaaatttgggagaaactgattggtaaagagttgcacaaatcttcaatttcagcacaacagtttctgagttccatggaaggacaaccatatgagcagcaagtgggaatgggacattattatcatgtttgctttgaaggctgcctcacaaattttgagataggagaagaaggggttgaagcttgtggattgtaccctcaaataaagtacactaccgttcaagacttcatgaaacgctacgtataa

SEQ ID NO: 1892 - DNA, 1062 bp, Glycine max var. Williams 82
atgtttacatgcattgcgtgtacgaagcaagcggcggaggagaaggaagaagaagaagagggtgagagtggcacaacgagtacaaataaagaagccgtcaaaagcctgagtgctcagttaaaggatatggcactgaagttttcaggtgcctacaagcagtgcaaaccttgcacagggtctagtacctacaagaatggacagaggtcatatcctgactttgacaccatttcagaaggggttccatacccttatattggaggtgcaagctcaacttcaacccctgcttgggacttcacaagctccaatttccctggtggtagatcagaccaaagatttatggggagattcagtggtgataggacccctagagggcctcaatcagcaccagcctctgatgtagtagttgttgaggatgaggatgaaaccaaggagtggatggcacaggtggaaccaggggttcacattacctttgtgtctcttcctaatgggggaaatgatctcaaaagaattcgcttcagccgagagattttcgacaagtggcaagctcaaaaatggtggggtgagaattatgacagaatcatggaactttacaacgtgcagagattcaatcgacaagctctcaacactccttcaagatctgaggatgagcgaagagattcttcttactcaagaatgacatctggacaagatagccccatgcactccatgtctttaaagggttggacaccaaggaatcactataaaccctcagggaataacccttctgaagctatggaacaaggtagtggtggtggccaagacttccatgcagcagcttcatccgtggaagcatcaaggacaaccacctcttctagagacgagcgttcaatgagcaatgccagtgacttggagactgaatggatagagcaagatgaacctggagtctacatcacaatcaggcaattagctgatggaacaaaggagcttcgccgtgtcagattcagccgggagagatttggggagggacatgcaaagaaatggtgggaagacaacagagaaagaatacaagctcaatatctttga

SEQ ID NO: 1893 - DNA, 1350 bp, Glycine max var. Williams 82
atggagaatgcgagaataagccagtggttgatccttctggtgtgtgcgctgctgttgctgatatcagaagcttcttatgtgccaatcactattgttcagaacgcggtagcaaaaggagctgtttgtttggatgggagtccaccagcttatcattttgataggggatttggatcagggattaacaattggttggttgcatttgagggaggaggatggtgcaacaatgtcactacttgccttgctcgcaagaccaatcgtttaggttcatctaagcaaatggccaagctaattgccttttcaggaattttgaataacagggaaatgtttaatccagatttctacaactggaacagaatcaaggttaggtattgtgatggttcatcatttactggtgatgtggaagcagtgaatccagtgactaagttgcacttcagaggaggtaggattttcaatgctgtcatggaggatttactagcaaaaggaatgaaaaatgctcgaaatgctattatctcgggatgttcagctggaggattaacatcagtactgcattgtgatcgatttcgagctctattacctaggggagctagagtgaaatgcctctcagatgctggttactttatcaatggaaaggatgtcttgggagaacaacacattgaacagtacttcagtcaagttgttgccacacatggctctgctaggaatttgcctcaatcgtgcacttcaagacttagcccaaggctgtgctttttcccacaatatttggtgtcacgtatcactacaccaatcttctttgtaaacgcggcttacgactcatggcagattaagaacattttggcaccgggtgttgctgatcctgaaggccattggcatagctgcaagcttgatataaacaactgctcacctgatcaacttgatctaatgcaaggcttcaggacagaatttttaagggctataactgtgctaggcaactcttcatctaaaggaatgttcatagactcttgctatgcccactgccaaactgaaatgcaggagacatggttgagaagtgactctccagagctgaaaaagacaacaattgcaaaggctgtagcagattggttttatgaaagaaggcctttccatcagatagattgcccttacccttgcaaccccacttgtcacaaccgtgttttcgatccacaagacgaccatccaggaaaaaatgtgaccgcgaaaggaacatcagatgcatcagctacaaagcccaattttcccaaactaacaaacaaggcacagtggattgaacttgtgtgcattagtcgcgggatcagtgggcttctactaacgttggttcttctggtcatcctataa

SEQ ID NO: 1894 - DNA, 186 bp, Glycine max var. Williams 82
atgattaaaaatcaggaattgaagattaatacttatgtcaataacaatagagataacagagcagggtcacagagactagaaagagaacagaagcgagcaggggctttgctagaaaatgctgaaagatgcctgaatacatgttggagaaaagtgagtgtttgtccagaggatgatataaaggattag

SEQ ID NO: 1895 - DNA, 1537 bp, Glycine max var. Williams 82
aggctttacgtggcaggtcgaggacgctttcattgccacctatgtcatgcactcccttaaaactcacatcacactcttcctactaccacattacatacattatctttctttgcacgctcttactcgtttcctttgtctttgtctttctctttcggctttttcttctgctccactgtttctatcccttcctttctgtatgcaatgtctttttctctacttagattggcatgcttgtttggtatcagaatcgcattaactgtcatatatacttggacggagttgatcaggacttcaattagcttccatgtaaacataatattaagaatgatcacatggacatttgggcttatctccctgcctgcaagagttgtgaatgcctttcaaagggagaggcagctggaacaaaaactacatgaaatgcacatagagttggagaatctagtgtgggataagaaggaacttcaagaacattttcaaatggctgtcaaagagcgcaaaatgatggagatactactggcagagcttgaagaggagcatgatatggccattgcaaatattgaaaagttagagggaaagttgcgggatcagacaaatgaaaatcttcggctgaaagaaattcaaggaaagggatactggagctccaaagaccacaacaacactgacagagtccaaaccatagatgacagcaactacaacatttctcatcctatactctcactgaactccaactacaacggcagtggaatcacccttcaagatcttctaatgcgcaaagatatttggcaagatgagagcaaaaccagaagtgagttgcttaaactcttgaaagctgtaccaaagtccgggcaagttaagtccgaaatgagggaagcactagaccatcatcgagacatagctctttcacaatcacttttcagtgcccttatgtcacttgtggttggagtcactgcgtgggaagctgaggacccttgcatgcctcttgtggtggctctcttcgccgtagtaggcatgtccttgaagagtgtggtgcagtttttctccaccattagaaataagcctgcatctgatgctgttgctcttttaagcttcaattggtttgttcttggcactctaacctaccctaccttaccaagggttgctcgcatgctgtctccactagcgcaacgccttatggaccaaaccatgatccggtttggtctcctttccttagcttgacactgctttttttcttttctgttgtgttatattattatgtgcagtataatctgaattttgagtcctatttactgtggtgtgcgtttcttactgcttgtaaaatatgatgaggaatctctgtaatttggttgtctgtgatgagatattctgctttctctgtttcaagctcacaaacatgaaaaggagataggaaatcagtttttgttttctttaccatttttcagagttcagtaagagctattattgtttttgttaactttgatcaatgttctgcaggattatttaaggatcgtgcatgtttgatttatttacattgggagag

SEQ ID NO: 1896 - DNA, 2424 bp, Glycine max var. Williams 82
atggaggacagaagtataggaagaaagggtagctttaggttggggttgggaatggatgggaaaaaggatcacagtgtggttgagcttggtagcatcgacacacaaagacttcttctaagcaatggagagagagaaaaaaaattgcaacccctcaccaactctctctctccaaggcaaatgaaatctctcactgctctctgtgacactatcttaccttctgtcgccgaccactttgtggactcctctgatgaatctgtcaccaagttttaccagatttcagcttccatgactggaacacctgaacgttttgggggcatgataagtgagagattgaagcacccattgacagggttactgaagtttgtgttatggctgttgtcaacgtggtatgggacattaattttctgtggcattgggtgcctctcaacccaattccccttcatccacgcctatcctcacttatctctacagaaacgccaaaagattatgcgttcatggtctctcagttaccttcgtcactttagaatgctcttcaggaccatcaaacttctcactctcctaatcttctttactcagatagatgaatcagaagacaacgttgcatggaaagcaataggatactgcggacctgatccagaattcaaagctcagttgaagaaccactttttagatggaacatctaaaggaggagggcaagaggataaggaagaagatgaagatgctgaagagatgataggacccctttacaaaggtctagtccatctgaactacccacaagacatcactgcagatgctctaagacgattcggattccctgtatcggtcatccgtaggaagcataaagctgctgccgcaaacttgtcatgtccttctttggtgatacaatgtgatgcagtggtggttggttctggctcaggaggtggagttatcgctggtgttcttgcaaaagctggttacaaagtgctggtgttggagaaaggaggctattctgctaagaacaatctttctcttcttgaaggaccaaccatggatcaaatgtacctcaatggtggtttggttgcaagtgatgatatgggtgtgtttattctatcaggatccactgttggtggagggtcagcaatcaactggtctgcatgcattaaaaccccacagcatgtgtgcaaggagtggtgtgacaaacatggtctagagttgtttgagagtgaattgtatagagaagccttggatgctgtctgtgggaagatgggagttcaatctgagattgaagatgaaggattcaacaatgcaatactaagaaaagggtgtcaagaaatggggtatcctgttaataacattcctaggaattctccttcaaatcactactgtggctggtgttgcatgggttgtaaggatgggaggaagaagggtacctcagaaacatggttggtggacttggtgaaatctggcaatggagcaattcttccaggttgtgaggcaataaaagtattgcacaagaaaaaggaaggaaaggatagaaagattgcgcgtggagtggcgtttgagtttgaatataaaggaactaaagacgtttgtgtggtggaatccaaagtcacaattgtagcatgtggagcactgagtactccagcattgcttaaaagaagtggcttgaggaaccagaacatagggaagaacttgcatcttcatccagtggtaatggcatggggctacttcccagatgcacctgaatctgaggtgtggccagaggcatataagaagagctatgaaggagggataatgacagcaatgtcaactgttgttgcagagtttgaacaatctggatatggtgcagtgatccaaacaccttcattgcatcctggtatgttctcaattgtcacaccatggacttctggaattgatataagagaccgaatgcggaagttttctagaacagctcatatatttgcactggcaagggatcaaggatcagggactgtaaaagcaccagaccgtatcagttataagcctgcagatgtagatgaagagaatttaaagaaaggaattgagaaggtgctgagaattctggcagcagctggtgctgaagaaattggaacacatcataataaggggaggaccttaaatgtaaagcaggtgagctatcatgagtttgagaaatttgttaaagaggaaagttcaaggtcattgacagaccttacaacaccattgtgctcagcacatcaaatggggagttgccggatgggttctaatccaaagcaatcagtggtgaatccaacaggggagacatgggaagtggagggcctttatgtggcagatgcaagtgtcttcccaacagcattgggtgtgaatccaatggttactgttcaagctattgcttattgcacagcacaatctgttgttgaagtacttaaaaggaaaagaagtaaatga

SEQ ID NO: 1897 - DNA, 261 bp, Glycine max var. Williams 82
atgggcttccgcatacccggtatcagaaggtcatctttagctgtaaccaaagcagttcccaaaggctgccttgcagtctatgttggggaaaaaatgaagcgttttgtgattcctatttcatacttgaatcaacctttatttcggcaattactgagccaagttgaggaagaattcgtgtatgatcatccaatgggtggtctcacaattccttgcagggaagatgctttcctagacctcacttctcgtttgaatgggctataa

SEQ ID NO: 1898 - DNA, 1326 bp, Glycine max var. Williams 82
atgtttccacaaacgccaactatctcacttttcattgtcctcgcttcatttgtcttatgtaatggctattacatacaggaaccattttataaaacaaatgttaaacactaccttgtgcatgatgggagattgatcaagacaaaacatgaacattttggacttttaacaagggctaatagagctatccatctttcttcttctaggcctcgtggaacagttagtgttgatgactttggagccaaagcagatggaagagatgacagcgaggcatttgggaaggcatggaatgaagcatgttctagaggggctatcctcgtggtacctgaaaataagatctatcgtcttaagccaataacattttctggtccatgtcgacccaacactgcctttatgctctatggaacaatcgaggcatggactcaaatgtcggcataccaagaagatagacaacactggattgtgtttgatagagtttcaaatttcagagttggtggtggtggcacattcaatggcaaagggaaaaagtggtggcaaagctcctgcaaagtcaacactaaccatcaatgcaacgacggaccaagaccaaaagccgtgactttctatcaatgcaacaacttgaaagtgacaaacctgaggtttaaagatgcacctcaaatgcatgtaacctttgaaggatgcttcaatgttattgtttcgaatctcgtcatcagagcaccaggtgacagccccaacactgatggaattcatgtcgcagacacacaaaatattgtcataagcaacactgatattgggacaggtgatgattgtatttcaataataagcgggtcccaaaacgtacgagccacagatattacctgcggacctggacatggaataagcattggaagcttgggagctgataactcagaagctgaagtctctaatgtggtagtgaacagagcaaccttaataggaacggctaatggggtgagaattaagacttggcagggaggttctggctatgcaaggaacatcaaatttttgaacatagcgatgcaaaatgtgacaaatcccataatcgtagatcaatactactgtgatcaagcgaagccatgccaggagcaggactcagctgtgcaattaagcaatgtgttgtaccaaaacataagaggaacaagtgcctcagaagtggctatcaaatttgactgcagccgagccgtcccttgcagacaaatttacgtgcaggatgtgattttagaaccccaaggccacggtggcaccattgctacatgtgaaaatgttagatatgtcaacagaggaaatttttttcctcaatgcactccatga

SEQ ID NO: 1899 - DNA, 771 bp, Glycine max var. Williams 82
atggcaaatgctttgagagttggtagtgttatctcactctgctcccttcggaacacgagaccccatcttccccttctctccaacgccacgcgcttccgttccaagttcccatttttcaccctctcatcgtcgccaaatccatctgggtatccaccatttcgcacactctcttcttcttctgcttccacagatgaggcagtgaccaccgaagccatcactagcaataatgcaagtggtgaagctgagaacagtattaaggatgcggcggggttgcttgacatgagggttgggtgcattctgagagcatggaaacatgatgaagctgattctctctatgtggaagaggttgatattggtgaacctgaacccagaatcatatgcagtggccttgtcaaatacatccctctagaacaccttcagggcaaaaaggttattgtcctttccaacctgaagccaagaaatatgcgtggtgtcaagtcctgcggaatgctgatggctgcttctgatgcaaaacatgaaaatgttgaacttttgttccctcccgaggaagcaattcctggtgaaagaatctggtttggaacggaagatgaaaaggataatcaacctgatgctgccactccgaatcagctacaaaagaaaaagatatgggaattggtgcagccgcatctcaagacagatgcttcttgtattgcaatgctaggggagcatgtcatgcgttcatctgtaggttcagtagcttgccagtcattgcagaatgcaaatatctcctga

SEQ ID NO: 1900 - DNA, 1173 bp, Glycine max var. Williams 82
atggaaagaggcgcattgttagcaacgtgtggtctgctgttgcagcataaaacggagtggttggtgagaatgtcagagacattcatattcacactttctctggttatgctatgtgctgcttcagcttttgcagcagttccacacaggttgccagaagtttacctcaagaatggtaactttgaggagaatccaaaccccaaatacctcaagaaaacgacactgattgggaaatatgctcttccaaaatgggagatcagtggtcatgttgagtatgtctcaggggggccacaacctgggggtatgtacttcccagttagtcatggagtgcatgctgtgaggcttggaaatgaggcctcaatctcacaaaccattaaggtcaaacctggcaagtggtacgctctaattctaggagcctcaaggacttgtgctcaagatgaggttttaaggatctcagtgcctccacaatctggagaggttcctttgcagaccctttatagcctcaatggtgatgttatcgcttggggtttccgtcccacttcttctgttgccaaagtgatactccacaaccctggaattcaagaagaccctgcctgtggtccactcttggatgccgttgctatcgcagaattctgccctccaaagcctacaagagctaatttggttaaaaatccggggtttgaggtgggtccattccctattttcaactctacaaacggtgttctacttcctcccgaacaagaagatcatgtgtctccactccctggttggatgattgaatccctcaaagccgtgaagttcatagatgcaaaacatttcaatgtaccatttggacagggagcagtagaacttattgcaggcagggaaagtgtcattgcccaaattctcagaacagttcccaacaaaatttacaacatgaagttcacaattggagacgccagaaatggttgtcatggatcaatgatgattgaagcgtttgcagcaaaagataccctcaaagttcccttcaaatctgagggaaagggcgaattcaagactgtgagtttcaagttcagagcgattgaaaacagaacaagaatcacattctatagctccttctaccatacaagaattcatgactacggatctctttgtggccctgttattgatcaagttatagtgtatcctgtcgcctga

SEQ ID NO: 1901 - DNA, 1395 bp, Glycine max var. Williams 82
atgggtgttgtggagggtctcttagcattggctttggttctgagtgtttgcgtgatgtgcaatggaggctcaagcagccccttcattaggaaagttgagaagacagtggatatgccacttgacagcgatgtctttgctgttcctcctggttataatgctccccagcaggttcatataacgcaaggtgaccttgtggggaaagcagtgatcgtgtcatgggtgacagtggatgaaccggggtcgagcgaagtgcattactggagtgagaacagtgacaagaagaagattgccgaaggaaaacttgttacttataggttcttcaattactcatctgggtttatacaccacaccaccatcagaaatttggagtacaaaaccaaatactactatgaggttggacttgggaacacaacacggcaattttggtttgtgactcctcctgaaattggtcctgatgtgccatacacatttggtctcataggggatcttggtcagagttttgattcaaataagactctttctcactatgaattgaacccaagaaaaggacaaactgtactgtttgttggagacctctcttatgcggataactacccaaatcatgataacgttaggtgggattcttggggaaggtttacagaaaggagtgttgcttatcaaccatggatatggactgcaggaaaccatgaaattgattttgccccagaaattggtgaaaccgtacctttcaaaccttatacccaccgttaccatgttccttataaagcatctcaaagtacttcacccttctggtattctatcaagagagcttcagcacacatcattgttttggcctcatattcagcatatggaaaatatacaccacaatataaatggcttgaagaggagctaccgaaagttaacaggacagagactccttggttgattgttctgatgcattcaccttggtataatagctacaattatcactatatggaaggggaaacaatgagagtaatgtatgagccctggtttgtgcagtacaaggttgatgttgtttttgctggtcatgttcatgcctatgaacgatctgagcgtgtttccaatgttgcatacaatattgtaaatggtctttgtgctcctgtaaaagatcaatcagctcctgtatatataaccattggtgatggaggaaaccttgaaggtttagcaaccaacatgacagaaccacagccagagtattcttcattccgagaggccagctttggacatgccatttttgacataacgaaccgaactcatgctcactacagctggcaccgaaatcaagacggagttgctttcgaggctgattccgtttggtttttcaacagatactggcacccagttgatgattccacggctcatgtttcacattaa

SEQ ID NO: 1902 - DNA, 1993 bp, Glycine max var. Williams 82
tttctaacaaaaatctttttcgtatgagatggaagaaaaagtaagtgagagagcgaaactgaaagatacatacatgatgtgacgtgaaaagaagatagattatatgcatgaatattatatcattattgttgattttctatcattattttaatcagttcaccacctcaacttaactgaagccgaatattcattggtttgttttctgagtcttggcaattaacgtaaacacaatcgtattttgtctttcgaagaaaacgatgataaatgttgcttgcttcacggaccctcctctgtctcgttgacctctaatgtgaatattcctcatcatatgccattccattcattaacagttaatagtacttattatcatagagattagagagtgcattggaataataaataggcgaccctggatcacgggttttgagcaaaacaaaatgggtgttgtggagggtctcttagcattggctttggttctgagtgtttgcgtgatgtgcaatggaggctcaagcagccccttcattaggaaagttgagaagacagtggatatgccacttgacagcgatgtctttgctgttcctcctggttataatgctccccagcaggttcatataacgcaaggtgaccttgtggggaaagcagtgatcgtgtcatgggtgacagtggatgaaccggggtcgagcgaagtgcattactggagtgagaacagtgacaagaagaagattgccgaaggaaaacttgttacttataggttcttcaattactcatctgggtttatacaccacaccaccatcagaaatttggagtacaaaaccaaatactactatgaggttggacttgggaacacaacacggcaattttggtttgtgactcctcctgaaattggtcctgatgtgccatacacatttggtctcataggggatcttggtcagagttttgattcaaataagactctttctcactatgaattgaacccaagaaaaggacaaactgtactgtttgttggagacctctcttatgcggataactacccaaatcatgataacgttaggtgggattcttggggaaggtttacagaaaggagtgttgcttatcaaccatggatatggactgcaggaaaccatgaaattgattttgccccagaaattggtgaaaccgtacctttcaaaccttatacccaccgttaccatgttccttataaagcatctcaaagtacttcacccttctggtattctatcaagagagcttcagcacacatcattgttttggcctcatattcagcatatggaaaatatacaccacaatataaatggcttgaagaggagctaccgaaagttaacaggacagagactccttggttgattgttctgatgcattcaccttggtataatagctacaattatcactatatggaaggggaaacaatgagagtaatgtatgagccctggtttgtgcagtacaaggttgatgttgtttttgctggtcatgttcatgcctatgaacgatctgagcgtgtttccaatgttgcatacaatattgtaaatggtctttgtgctcctgtaaaagatcaatcagctcctgtatatataaccattggtgatggaggaaaccttgaaggtttagcaaccaacatgacagaaccacagccagagtattcttcattccgagaggccagctttggacatgccatttttgacataacgaaccgaactcatgctcactacagctggcaccgaaatcaagacggagttgctttcgaggctgattccgtttggtttttcaacagatactggcacccagttgatgattccacggctcatgtttcacattaacacaaagattcactggtcttatgagaagaaataccaaatgtgatgccaataaattcatgagtcggcaattgattgtatgccaataccaccaacattgattttagcagtgtctttgtatctttcacatttgataaatgcaaattgcttgcttatattctaaa

SEQ ID NO: 1903 - DNA, 1893 bp, Glycine max var. Williams 82
atggcagccatgaaccctgatcttgagcatgctccacaaattcccttgctgaatcctccaacaggggaaagtggaaggagaacgcaaaagggtacccttgttttcattgtctcgattgttttcctattgtcatttatcatcataaaccttcagagccatgagcccagctttgaaaacaatatcacaacggtgccattactacctatagctagaggggtcgctgagggtgtatcagccaagtcaaatccatatctatcacagaaagcttcatataattggacaaatgccatgttatcttggcaaagaacagctttccattttcaacctcaaaggaactggatgaacgatcctaacggtccattgttttacatggggtggtaccatatattttaccaatacaatcctgattcagcagtgtggggcaacataacatggggccacgctgtatccagagacttgattcactggctctaccttcccattgcgttggttccagataagtggtttgacatcagtggtgtatggtcagggtcagcaacccttttgccagatggcaaaatcctaatgctctacacgggtaacaccgatcgaaacgtgcaagtccaaaatcttgcgtaccccgccaacctatctgatcccctcctccttgattgggtcaaatacgctaataaccccgtcttggtgcccccaccaggcattgggccaaaggattttcgtgacccaaccactgcgtggattgggccagatgagaagtggaggatcactattgggtcaaagctcaacaagacaggtctttcgttgctttataaaacccaagatttcatccactatgagcaaagtgatcgctatttgcatcaagtcccgggtaccggcatgtgggagtgcgttgacttttacccggtttcagtaaacgggcctaacggtttggatacatctgaaaatgggccagatgtgaagcatgtgttgaaggctagtttggatgacactaaggtggatcattatgcaattggaacctacttcattgaaaatgatacatgggtgcccgataacccgaatgaggatgtgggtatcgggttgaaattggactatgggagatactatgcgtcaaagacattctatgaccaacaaaaacaaagaaggatcctgtggggttggattaatgaatcagatagtgaaaccgctgacttgaaaaagggttgggcatctctccagactattccaagaacagttgtgtttgacaagaagactagaactaatttgcttcactggccagtggaagaagtagaaagcttaagacttagcaactccgaatttgaaggagttgtggttaaacctggctcagttgtgccactggacataggcccggccacacagttggacatatttgctgaatttgaaatcgaagatttagcatccaaaggaattggcaaggacaatgtagactgtggaaatggagctgttgacagaagtgcttttggaccattcggtattttggctattgcagatgaccaactttctgaactaacaccaatttatttccatctttctagtactactaaagatggcagtttaaccacttccttctgtgttgatgaaactaggtcatcaaaggctcctgatgtttcaaagctcatttttggaagcaaagctccagttctcagtgatgaaaaattatcaatgagggtattggtcgaccattctatcattgagagctttgctcagggagggagaacagtgatcacatctagagtttatccaacagaagcaatatatggagctgcaagattgtttctgttcaacaacgcgacggacataaacatcaaggcctcgctcaagatttggcaattgaactcagctttcatacgccccttcccctttgaccagaagttgtga

SEQ ID NO: 1904 - DNA, 624 bp, Glycine max var. Williams 82
atggaggccatttgttccaagcaccttatgacatcccttgtcataattcttgcttctagtttgaccttatcacagggtgccaagaaaggcagtgacagtgaaaggccataccaagaagcgagcacggtgttcattagaacatcttgcagctccacgacctatccaagactctgctacagctccttagtgaagcatgcagacttgatccaaacaaaccgtgtggttctgacaggcacagccctgaatgtgacccttgcgtctgccaagtcgacctcggcaatgatgtcgacgctggcaaagaggcaaggcctgaagccaagagaggttgcagcgatgaaggactgtgtggaggagttggctgactctgttgatgagctcagaaggtctatttctgagatggctcaactaacaccctccaattttgagatgacaatgagtgacgtagaaacgtgggtgagtgctgctttgaccgatgagagcacgtgcaccgatggcttccaagagacggctgctgctggtggttcaaatgtaaagaacacggtgagaggccaaattcttcaggtggctcaattgactagtaatgccttggctttgataaatcagctggccaattctcatgcttaa

SEQ ID NO: 1905 - DNA, 966 bp, Glycine max var. Williams 82
tcacacaagaaaattaataatcccaatcatcaagataggaaaagaatggaggccatttgttccaagcaccttatgacatcccttgtcataattcttgcttctagtttgaccttatcacagggtgccaagaaaggcagtgacagtgaaaggccataccaagaagcgagcacggtgttcattagaacatcttgcagctccacgacctatccaagactctgctacagctccttagtgaagcatgcagacttgatccaaacaaaccgtgtggttctgacaggcacagccctgaatgtgacccttgcgtctgccaagtcgacctcggcaatgatgtcgacgctggcaaagaggcaaggcctgaagccaagagaggttgcagcgatgaaggactgtgtggaggagttggctgactctgttgatgagctcagaaggtctatttctgagatggctcaactaacaccctccaattttgagatgacaatgagtgacgtagaaacgtgggtgagtgctgctttgaccgatgagagcacgtgcaccgatggcttccaagagacggctgctgctggtggttcaaatgtaaagaacacggtgagaggccaaattcttcaggtggctcaattgactagtaatgccttggctttgataaatcagctggccaattctcatgcttaactactccatcttgtgctatatatagaacatcgcctaccctgtttttttgtctcatttagatgctctgcaactgtgaaaactagtaaatatctcagtagtttcttgagatttatgtccccgctagtgttaaactgttcatgtctcgttccagctagcggctggacccatcccaattttcagtgttgtgaatcaggatcttgtattgtcttttttagttggtttgttgaatcacttgtataattaatataaagtgaagttgttatggctatataaaagattttgaacttactggctgat

SEQ ID NO: 1906 - DNA, 798 bp, Glycine max var. Williams 82
atgttgagtcacctctatttattccttcccaatttcctcctccatttccacaaacaacttctttcaaggaaaatggctcttcttggatttcttctgggacttttcttaatggtcactcatgtcaaggggtatggttttggaggttggaccaatgcacatgccaccttctatggaggtggtgatgcttctgggacaatgggtggggcttgtggttatggaaatctgtatagccaaggttatggaactgatacaacagcactgagcactgctctgttcaacaatggcttgagctgtggtgcatgctatcaaattaaatgtgtgaatgatccacagtggtgccttcctggctccatcatagtcactgccacaaatttctgtccacctggtggttggtgtgaccctcccaatcaccactttgatctgtctcaacctgttttccagcacattgctcaatacagggctggaattgtgcctgtagtttacagaagggtgaggtgcaggagaaaaggtggaatcaggttcaccatcaatggccactcttacttcaatttagtccttgtaaccaatgttggaggtgctggtgatgtgcattctgtgtccatcaaaggttcaagaactagatggcaagccatgtcaaggaactgggggcaaaactggcaaagcaattcctacttgaatggtcagagtctttcctttgtagtcaccaccagcaatggacacagtgtggtgtcatacaatgttgccccagctggttggtcctttgggcagacctacactggaaggcagttcaactactaa

SEQ ID NO: 1907 - DNA, 1281 bp, Glycine max var. Williams 82
atgacagaaaaactttccaacaatccatccttgaacgtgcctttactatccgagtggaatcaccatgatgaggagaaagccatagcctctcatccttctaccaaaaatactgtgtccttctttcgcacatgccttaatggactcaatgcaatatcaggtgttggaatactgtcagttccatatgctcttgcatctggagggtggttaagcttggttcttctatttgctattgccgctgcagcattttacacaggcacgttgattaaaagatgtatggacaagaattcgaacattaaaacctacccagatataggtgagcttgcatttggaaagataggaaggctaataatatcagtgtccatgtacacggagctctacttggtttcaatagggttcttgattctggaaggcgataacttgaataacttgtgccccattgaagaggttcagatagctggcttcgtaattggtgggaagcaactgtttgtgatattggttgcccttatcatcttgcccacagtttggttggacaacttgagtatgctttcttatgtatctgcaagtggagtgtttgcttctgctgtaatcatcctatcaatatcatggactggaacatttgatggagttggttttcatcaaaagggaactcttgttaattggcgcggaatccccacagctgttagcttgtatgccttttgctattgtgcacatcccgtcttccccaccttgtacaattccatgactaacaaacatcagttctctaatgtcctattagtatgctttctgttaaccactgtgggttatgcatccatggctataattggttatctaatgtttggtgctgacgttgaatcacaagtaacattaaacctgccactgaacaaagtaagctcaaaattagcaatatatacaaccttggtcaatcccatatccaagttcgctttgatggcaacaccaattaccaatgcgttgaaagatttacttccaagggcgtacaagaatagagcgaccaacatcttagtcagcactgtcttggtaataagcgctaccattgttgccctcagtgttcctttctttggggatctcatgtctctggttggagcgtttttaagtgtcacagcttctattctgcttccatgcttgtgttacttgaagatttcaggcacttacaatgaatttgggtgtgagaccatagccatagtgacaataatagtagcagctatagcaatgggaatatctggaacatatacctctgtcatggaaatagtacatcatttgtaa

SEQ ID NO: 1908 - DNA, 1116 bp, Glycine max var. Williams 82
atgaccaagatcttctttgtattgctgttatgtctgatcatagcagcttcttctgggtttgtgaattgctttgatgttgaaaagaaggaaaagattggaatatttgagctcaataaaggtgacctttctttgaaggtcaccaactggggtgcttcaattttgtccctggtgattcctgataagaatggaaagttgagtgatgttgttcttggatatgattctgttaaggattacactaatgatacaacatattttggagcaactgttggccgggttgctaacagaattggaggagctcagtttactctaaatggaatccattacaaattagttgctaatgaaggaaacaatacacttcatggtggagccagaggatttagtgatgttctttggaaagtgaaaaggtatcaaaaagaaggtccaagtcccagcattaccttcagttaccacagtattgatggtgaacaaggattccctggtgatctcctagtaactgtgagctacattctaactgggaaaaaccaattggttatacttatgaaaggaaaaactctaaacaagccaacaccagtgaatttggcaaaccatgcttactggaacctaggaggccacaacagtggcaacatcctaaatgaagtggtgcagatctttggttccaaaatcacacctgtggacagcaaactcattccaacaggcaaatttgcttcggtgaaaggaacagcttatgatttccttaagccacaaactgttggaagcaggatcaatcaattggctgaaaccaaaggctatgacatcaactatgttcttgatggtgagaagggccaaaagatcaagctagcagctatagtgcaggataagaaatcagggagagtgttggagttgttcacaaatgctcctggtttgcagttctacactggtaactatgttaaggatttgaagggaaaaggtggatatgtgtaccaatctcattcaggactatgtttggagtctcaagccttccctgattcagtgaatcagcctaatttcccttcaacaattgtgacaccagaaaagccttacaagcattatatgctttttaagttttccaccaaaaatccctacattagttcaaagtga

SEQ ID NO: 1909 - DNA, 1362 bp, Glycine max var. Williams 82
atggtgcactgtgtgatcttaccatatccagctcaaggccacattaaccccattcatcagttctccaaactcttgcaacgagaaggggtgagaataacacttgtcaccaccctttcctactgcaagaacttgcagaatgcacctgcttctattgcacttgaaaccatttctgatggttttgacaatggtggtgttgctgaggcagggaactggaaggtctacatggaacgtttttggcaagtagggccaaagacccttgctgagcttcttgagaaacttgatagatcaggtgaccctgttgattgtgttatttatgactcattcttcccttgggttcttgaggttgcaaagggttttgggatagttggagttgtttttctcactcaaaatatgtccgttaatagtatatactaccatgtccagcaagggaagttgcgtgttcccctcacagaaaatgagatttcccttcctttcttacccaaacttcaccataaggacatgccctcgttcttcttccccacagatgtggataattcagttttgcttgatttggtagtgggtcagttctccaatatcgacaaagctgattggatcatgtgcaattcattctacgagttggaaaaagaggtaactgattggacggagatgatttggcccaaatttagggccataggaccatgcataacctctatgattttaaacaagggacttacagatgatgaagatgatggcgttacacaatttaagagtgaagaatgcatgaaatggttagatgataaaccaaaacagtctgttgtttatgtttcttttgggtctatggcaatactcaacgaagagcaaataaaggaattagcttatggtttgagtgacagcgaaatttactttttgtgggtgctcagagcctcagaagaaactaagcttcccaaagattttgaaaaaaagtcagagaagggtttagtagtagggtggtgctcacaactaaaagttttagctcatgaagctatagggtgttttgtaacgcattgtggctggaactccacattggaagccatgagtttaggagttccaatggttgcaatgccatattggtccgaccaaagtacaaatgctaagcaaattgttgatgtcttgaaaattggaatcagaaccacagttgatgagaaaaagattgtgagaggagaagtattaaagtgttgcataatggaaataatgaagagtgagagaggcaaagaggtgaaaagcaatatggagcgatggaaggctttggctgcacgagctgttagcgaggaaggaagttctcgtaaaaacattgcagaatttgtcaatagcttgttcaatttacaacagggaattgcaaattaa

SEQ ID NO: 1910 - DNA, 1486 bp, Glycine max var. Williams 82
aaaagcatagtcagtatggtgcactgtgtgatcttaccatatccagctcaaggccacattaaccccattcatcagttctccaaactcttgcaacgagaaggggtgagaataacacttgtcaccaccctttcctactgcaagaacttgcagaatgcacctgcttctattgcacttgaaaccatttctgatggttttgacaatggtggtgttgctgaggcagggaactggaaggtctacatggaacgtttttggcaagtagggccaaagacccttgctgagcttcttgagaaacttgatagatcaggtgaccctgttgattgtgttatttatgactcattcttcccttgggttcttgaggttgcaaagggttttgggatagttggagttgtttttctcactcaaaatatgtccgttaatagtatatactaccatgtccagcaagggaagttgcgtgttcccctcacagaaaatgagatttcccttcctttcttacccaaacttcaccataaggacatgccctcgttcttcttccccacagatgtggataattcagttttgcttgatttggtagtgggtcagttctccaatatcgacaaagctgattggatcatgtgcaattcattctacgagttggaaaaagaggtaactgattggacggagatgatttggcccaaatttagggccataggaccatgcataacctctatgattttaaacaagggacttacagatgatgaagatgatggcgttacacaatttaagagtgaagaatgcatgaaatggttagatgataaaccaaaacagtctgttgtttatgtttcttttgggtctatggcaatactcaacgaagagcaaataaaggaattagcttatggtttgagtgacagcgaaatttactttttgtgggtgctcagagcctcagaagaaactaagcttcccaaagattttgaaaaaaagtcagagaagggtttagtagtagggtggtgctcacaactaaaagttttagctcatgaagctatagggtgttttgtaacgcattgtggctggaactccacattggaagccatgagtttaggagttccaatggttgcaatgccatattggtccgaccaaagtacaaatgctaagcaaattgttgatgtcttgaaaattggaatcagaaccacagttgatgagaaaaagattgtgagaggagaagtattaaagtgttgcataatggaaataatgaagagtgagagaggcaaagaggtgaaaagcaatatggagcgatggaaggctttggctgcacgagctgttagcgaggaaggaagttctcgtaaaaacattgcagaatttgtcaatagcttgttcaatttacaacagggaattgcaaattaatccttgttaaaccaaatagttattgtttgtttgtatactatgcggcatcattattttctctgaagacttactggactgatatggaatgatcgagtcctaattaattcaa

SEQ ID NO: 1911 - DNA, 546 bp, Glycine max var. Williams 82
atggctctgaatctttgtatctcacctaactgtaaatgggtttcatctcctgcttccttagatagtgcatcttctttgagatcttcacttggttcttgttttggtaacataaacattgctagtgtgagtttaagcactagtagaagtttgagtttgaggaggagtgggagtgttagtgtaagatctagtttggaaactacggggcccacagttacagtgggacaggtcactgaggttaacaaggataccttctggccgatcgttaaggctgccggggataaaaccgttgtccttgacatgtacacacaatggtgtggcccttgcaaagtgatggctccaaagtttcaagaattatctgaaaagtatctggatgttgtctttctaaagcttgattgcaaccaagagaacaggcccttggcaaaagagctgggaattaacgtggttcccacttttaaaattctgaaggacaacaaggttgtaaaagaagttactggagctaaatacgatgatttggttgatgccattgacaaagttcgatctagctaa

SEQ ID NO: 1912 - DNA, 1134 bp, Glycine max var. Williams 82
atgatagggtgggaagaagtatacaaagtagtggtagcagtggtaccactctattttgctctactattagggtatggttcactgaagtggtggaacatcttcactagggagcaatgtgaagcaataaacaagctagtttgttacttcactttgccactctttatttttgagttcactgctcacatagaccctttcaagatgaactattcgttcatagcagcagacaccatatcaaagttcatcatcatggtcgtgcttgcactttgggccaagtgcactcccaaagggacctttagctggtccataacgagcttctcattgtgcaatctcaccaacgctcttgttgttggggttccaatggtgaagcccatgtatggagccctaggtgtggaccttgtggttcaggcctcggttattcaggccaccatatggttccctttgcttctctttgtgttggagttttggagaacgggaagtgagggcaccaccatcaccaccaccaccacgttaaaaccaagaccaaaaacaatgatcattgataatgaaagtggaggagggaaagatgtggaggctactactgtagctattgatgtgaaagaggaaatgatgttggaagagagtgttactagtagtaggcttcctttttgcaaggtgatgaagcttgtgtggcgcaaacttgcaacgaaccctaactcctttggctgtgtcattggcatttcctgggcttttatatcaaacaggtggaacttggagatgccaagtatgttagagggatctatacagatcatgtcaaaggccgggaccgggactgccatgtttagtatgggtactttcatggcacttcaggagaaggtgattgcctgtggaccaagtatgactataatcggtttggttttaaagttcattgcgggcccagcggctacggcaattggtgccatcgttgtaggattgcgaggtgacgttttgcgagtcgtaatcattcaggctgctgtgccacagtccatcacatccttcattttcgccaaagaatatggattgcatccagaggtcctcagcactgcggtgatctttggtatgattgtttcacttcccgtcttagttgcctactacgcaatattggagtttgtacattaa

SEQ ID NO: 1913 - DNA, 720 bp, Glycine max var. Williams 82
atgtataatatcagcggaaagtttggcaatgctgaaaggaaagacagggaaatgggtcatctctatgctttggactttgatggagttatctgtgatagctgtggggagacagctatctctgctcttaaggctgccaaattgagatggcctcccttgtttgatggtgtggattcaaccataaaagattggattgttgaccagatgattacagtacggccagtggtggaaactggatatgaaactcttttacttgtgaggttgttgcttgagactagagttccatccatcaggaagtcttcggtttcagaggggctcacagttgaggacatattggaaaactggttcaaactgaagcctattattatggaagaatggaatgagaatagagaagaactgatagacctttttgggaaggtcagagatgactggttgtatagcagcaaacagagccgctttgctgatgctttactaagagagcttgctggagtagaagtgttaaagaagcttcagaaaatgccagaacaccaagggctgacactacactttgtggaagataggcttgcaatccttaagaatgtcgtcaaagagccagagttagataactggaatttatatctagtgaattgggggttcaacactcagaaagagagagaagaagcagaagccaaccccaggattcaagttattgagctctctgacttcagtagcaagctgaagtag

SEQ ID NO: 1914 - DNA, 720 bp, Glycine max var. Williams 82; identical to SEQ ID NO: 1913

SEQ ID NO: 1915 - DNA, 276 bp, Glycine max var. Williams 82
atggggttgagcatgaaagttattgcttcaatattgcttttgctcttgggattcactgcaatcactgttagcggtgatgccaacaactactatatcaaatccacaaccaaagcgtgttgtgataaatgttattgctcaaaatcaatccctcccaaatgctactgtgcagatgttggaataacatgtcactcagcctgcaaagtatgcctttgcattcacccacagtgtcgttgcgttgacacaaccgacttctgttatgaaccttgtaaccactag

SEQ ID NO: 1916 - DNA, 885 bp, Glycine max var. Williams 82
atgggggaagaagcaaaaaggtatgctgttgtgacaggagcaaataaagggattggttttgggatgtgtaagaaattggcttcaagtgggattgtggtggtgctaacagctagagatgagaagaatggcttcaaagctgttgaaaaattgaaagagtttggtctctcggaccttctggtttttcatcagcttgatgtggatgaccctgctagtgtttctgccttagctgatttcatcaaaaccgaattcgggaaacttgatatcttggtaaataatgcagctgttactggaggcaaattattagatgctgatgctttccttagaaagagaaacggcgaacaaattgattggaatgaagtaggatatgaaacttatgagttagctgaacaatgtgtggaaacaaacttctatggtgtgaaaagggtaactgaagccctacttccccttctccagctatccacttctccaagaattgtaaatatctcctccagagcagggctcttcaagaatataccaaatgagtgggctagaacaatgttgagtgacattgaaaatcttacaagagaaaaaatagatggggtacttgaagagtttcagaaagatttcaaagaggggtcattggagatcaaaggttggccagcttttgcttctgcttatacaatgtcaaaagcagctttgaatgcatacacaaggattatggccaagaaataccctcgttttcacataaactctgtgtgccctggctttgtcaagactgatatgaacaacaacactggacaattaagcattgatgaaggggctgaaactcctgtattgttggcactgttgccaaatggtggtccttctggctgtttctttcatcagggtgaagtaatacccttttga

SEQ ID NO: 1917 - DNA, 984 bp, Glycine max var. Williams 82
atggagcctgttcttcttccaagtctagtaataatgcttgttcttgttctgtgctttgaatcacttcctagtgttagggctcagtctactactacttctcccgggtcatcttcaacaagggaagaagcaaaggctcttgatgcacttctccaacaatttgcttacaaggacttggtgaatccaaaaacaggtatcatttacaatgcaactcaacttccttccaatttgactgggattgaggttgcagcattgagattaaggagtggaagtctaaggagaaaagggttccaggcatacaatgagtttgaaattcccaagggactcattgtgagtccttatgtggaaaggcttgtgttggtgtaccaaaatctggataataggtccagcagttactactaccctttgcctaattatacttatttggctccagtgttgggactactagcttatgaaggttcaaatttgtcggctacaaatttatcagaactagacatagatgcatctgagagccctatattggtcaagtttagggatgtaaaaccagctcctcatggtgctgttgcaaaatgtatttggtttgatttgcaaggttcttccaatttcagcaatgtaacaggaggcaacacatgttctactactcaacagggtcatttctctatagtggttaaatctattgctcctttagcaccttctccagctccggcaggtgctgctcctaaaggggaaggtgagaaggggaataacaataatgagaaagtgtggatcattgtagggtctgttgtgggtggactagtattgcttgtgttgttgtcacttctagttttgtggatgagcaagtacaaacagaagatgaaaatgcaacagatggaaagggctgcagaggtgggagagcctcttcaaatgtcttcaattggggatacaaaagcacctgctgcaacagtaacaagaacacaaccaacccttgaacatgaatatgcgccatga

SEQ ID NO: 1918 - DNA, 756 bp, Glycine max var. Williams 82
atgcaaactaatgtaaaaagaaagctatgcaacataatggctagacttccttctattttggtaaaattcatgctacttttgttcatgaccaagttttcttcagctcgaactcttggcaatccatcctctaaccataaccatggccatcacagaataacatttttaatgagggacacgttcaataatggtagtgcacaatattcagagaaaccagccactactaaagtcactggtcaactacctttcccaaaacctctaggctttcttcctcctaaaggagggattccaataccacaatccactccaacaacaattccactcacttcatcgtccactcaaacacttgatctatctagtattggcttctcttttcccactagagcaacactccaagagctagagtatggatcagtagcatcaatagatgaggaactacttatagatgatggagatgaactacacaaacttggaaaagcacaaggggtgtgtgttgctagctcagaggatggaagcagccatatggtggctatcacagcaaactttttgaagggtgagtttgaggatggactgaggctttttggaatgcacaagactgatgtttttgagtcacatgttgcagttattggaggcactggaaagtactatggtgctaatggatatgctgcagttaaggttgtggacaaagtaggatctagtgaaaaagaagggaaagtgacaagttcaaagttcctcttgtttgatgtgtatcttagttaa

SEQ ID NO: 1919 - DNA, 1383 bp, Glycine max var. Williams 82
atggagcagaagggaagtgtgcttatgcaaagatatgaacttgggagattattaggccaaggaacctttgctaaggtctaccatgctaggaaccttataactggcatgagtgtggccattaaggtagttgataaagaaaagattttgaaggttggaatgattgatcagattaagcgtgaaatttcggtgatgagattaatcagacatccacatgtggttgagctttatgaggtaatggccagtaaaaccaaaatttactttgtcatggaacatgcaaaaggtggtgagctcttcaacaaggtagtcaaaggaaggctcaaggtggatgttgctcggaaatattttcagcaactgattagtgcagttgactactgccatagcaggggtgtgtgtcatcgagatttaaaacccgaaaatctactattggatgaaaatgagaatttgaaggtttctgactttgggttgagtgcacttgctgaatctaagtgccaagatggattgctccatactacatgtggtacccctgcctatgttgctccggaagtgataaacagaaagggctatgatgggattaaagctgatatatggtcatgtggggtaatcttgtatgttctattggctggtcatcttccattccaggatacaaatctgatggagatgtacaggaagattggtagaggggaattcaaatttcctaaatggtttgcaccggatgttcgccggtttttgtccagaatattggatccaaacccaaaggccaggatatcaatggccaagattatggaaagttcttggtttaaaaaggggttggagaagcctgctattactgtgaccgaaaacgaagagctagctccccttgatgctgatggaatatttgaagcatgcgaaaatgatggtcctattgccgagcctaagcaagaacaggccaagccttgtaacttaaatgcttttgatattatctccttctcaactggttttgatttatctggtttgttcgaggacacttttctcaagaaagagacacggtttatgtcaaaaaagcctgcctcaatcatagtcttgaagttggaagaaatttgtaagcggctttgcttgaaagtaaagaagaaagatggaggcttgctcaaattggaaggttccaaggaaggcaggaaaggaactttgggtgttgatgctgagatttttgagattaccccacacttccatatggtggaacttagaaagtccaatggtgacaccatggagtaccagaagctttttaaacaggatataagaccagcgcttaaggacattgtttggacctggcaaggagaaaaaccacagcaagagcaagagcaacatgaagtagtccaggaagagcaccaaccttctcatactgcttag

SEQ ID NO: 1920 - DNA, 1488 bp, Glycine max var. Williams 82
atgaagacagatttgcatgccaaccaactcaatttaatttttctaccatatctatctcctggccatttgaaccccatggtagatacagcaaggctttttgccaggcatggtgctagtgttaccattatcactacccctgctaatgctttgacattccaaaaagccatagacagtgacttcaattgtggataccacattagaactcaagtggttccattcccttcagcccagcttggcctccctgatggggctgaaaacctcaaagatggcacttccctagaaatacttggtaaaatcatgtatggaatatccatgctccaaggtcaaattgagcctctatttcaggatcttcaaccagattgccttgtaaccgatgtgctttatccttggacagtggagtcagctgcaaaactaggcatcccaaggctttacttttacagcgcaagctacttcgcaagctgcgccacatattttatccgaaagcataagcctcatgagaggttagtttctgatacgcagaagttttcaattcctggccttccacataatattgagatgaccaccctgcagctcgaagaatgggaaaggactaagaatgaattctcagatttgatgaatgcagtatatgaatcggagagcagaagctatggaacactgtgcaacagttttcatgaatttgaaggtgagtatgagcttctttatcagagcaccaagggggtcaagtcttggagtgtaggaccagtttgtgcctcggctaacacaagtggtgaagaaaaggtctataggggacaaaaggaggagcatgcacaagagtcagagtggctaaagtggcttaactccaagcagaatgagtcagtactttatgtaaattttggaagcctcaccaggctctctcttgctcagattgttgaaattgctcacggactagaaaattctggtcatagtttcatctgggttgtacgaataaaggatgaaaatgagaatggagacaattttcttcaagaatttgagcagaagattaaagaaagcaagaagggttatatcatatggaactgggcaccacaacttctcatattggaccaccctgccatagggggaattgtcactcactgtggttggaattccattcttgaaagtgtcagtgctggattgccaatgatcacatggccaatgtttgcagaacaattctacaatgagaagttgctagttgatgtattgaagattggagtcccagtgggatcgaaagaaaacaagttctggacaactctgggcgaggttccagtggtcggaagggaagagattgcaaaggctgtggtacagttgatgggaaaagaagagagcacagaaatgaggaggagagcaagaaaacttggagatgcttccaagaagactatagaggagggtggatcatcttacaacaacttgatgcagttgttagatgaactaaagtcattgaaggcatctaaggcaattgagaaagaaacttga

SEQ ID NO: 1921 - DNA, 1488 bp, Glycine max var. Williams 82; identical to SEQ ID NO: 1920

SEQ ID NO: 1922 - DNA, 1749 bp, Glycine max var. Williams 82
atgggttccgaagaagtagtagaagaaccaactccaaaaactccaaaccaaacaacaacaccggaaacgacgtcgtcgagttccccccgaaaaattaaaaccaacactcccaccgaaaacggtcacgtgtccgttactcccaccacgctctcaatcgtgcagccacattcacttctcccaaagccagtgcctccaagaacgacttacactcaaaacgacgtcgtcgtttcctccaccacattcggaaaattcctccgcaagcgcagcaacgacctgtcgtccgcgatcagcaaggggatctccacgctgaagcactccatcaacgaccaaaacgacaacaacggcgtgacggagttcaacctgtcggggctaaaggtcttcgtgacggtgaaaaacaaaaacgacgcgtcgtctaattcgcttgcgcgaatgaaaatcagcttcttctcgcgctcgaactgcagagagtgttgtgcggtgagaaggttcttcagagagagagcgctgaggttcgttgagataaacgtcgacgttttcgcggagcgggagaaggagctgagagagagaacggggagcgcgacggtgccgaagatcttcttcggcgagaggctgatcggaggcttggtggagctgaacgcgctgaggaaggacggcggcgaggagttggagaggcggctgaaggaagcgggtggccaagggccggcggcgccggcgttgccaattcaggatcggttgataaagatgaaaattgcaaggaactgcttcgcggggagcgagttggtggagcttctcgttcgacaccatggctattctccttccaatgctgttgagattggaaaacagttatgcaagaagcactttatccatcatgttttcgggaaaaatgattttgaggaaggaaaccacttctatagattccttgagcacgaaccgcttatctccaaatgctttaacttccgcggtgccacaaatgatagtgaaccgaaggctgcagctgcagtgtgtgataggcttaccaagattatgtgtgccattcttgagtcttttgcttctgaagacaggcgacatgttgattatgtggccattagcaaaagcgaagaacttcggaggtatgtaaacatgacccaagatcttcagcgggtgaatctcttggaactatcagaaaatgagacgcttgctttcttcataaatttgtacaatgccatgatcgtccatgctatcattagagtagggtgtcaagaaggtgtaattaataggaaatccttctttgattttcactatttgattggagggcatccttattctcttggtgcaattaaaaatggtatcctcagaagcaatcgtaggtcaccatattccttaatcaagccctttggcacaggagataggcgcttagagcatgctcttgtcaaaatgaatccgttagttcactttggactttgtaatggcacaaaatcgagcccaaaggtgaggtttttctcaccctatagagttgctgaagaattgagaagtgctgctagagagttttttgagaatgatggaattgaagtggacttggagaagaggaccattcatctcactccgattttcaagtggtactctgcggatttcggacaagagagaaacatactgaagtggataataaatttcttggatgcaaataaagcaggtcttttgacacatctcttaggtgatggtggtcatgttaatatctcttacatgagttatgactggtcaataaattcctga

SEQ ID NO: 1923 - DNA, 662 bp, Glycine max var. Williams 82
atgcttatttttcaatgctttcagggcatttactactatttctatcaagtttttaagaataaggcagtgaccattgcagctgcgcagaaagtgaaagggcgtggagatggtactgttgggatgtttggttggcttgttgtggctgcaattgctgggtccctgaatgtgttgttcacaaacccaatatgggttttggtgactcggatgcagactcatactcaagcacaaaggaaaatcatggaggaaaagaaagaagctttaaggaaggctgcttctgaaagcaccatagcagactcaacattgcaagacaaattggctgaactgaactctataaaacctcggccatatggaactatacacgcagctaacgaagtctacaatgaagcgggtatagttggattttggaagggagtcatccctgcccttattatggtatgcaatccatcaattcagtttatgatttatgagagctcattaaagcatctaagggaaaaacgagctgctaagaagcaagggaatacaagtatatctgctttggaggtctttttggtgggagcaatagcgaaacttggagctactgtctcaacatatccattactagttgtcaagtctcgagtcttaaacgcacatgcatcataacactgttgtaaatacctgatgac

SEQ ID NO: 1924 - DNA, 627 bp, Glycine max var. Williams 82
atggcgctatgttcctcactctcacttgtctctcccatcaaactcacttccaagtccttcttatctccaacaccagtcagttggcatggcatcttgataaagaataacacctcaacaagattcttgctgaaagctggttttaatgagattgaacctgacctcagtgaagatcctagagaccaatttgccaccaatggcgttgacgctgatgattttgtgtatggaatatatgatgaccaccacacttaccatgaaggagaacagaaaggaacattttggggctcaattaaagaagagatggcagaagcagaaccccccacaggattccaggggcttatttcatggctcttcccaccagccattgctcttggggtgtacttcaatgttccgggggagtacttatacattggagcaggcatatttacaatcatattttgcattattgagatggataaacctgataaaccccatcactttgaacctcacatatacaatatggaaaggggagctcgagacaagttgataaatgactataatacaatgagcatatgggaattcaatgaaaaatatggggacctatgggatactactattcctatcaagaaggatgacattatgaagagataa

SEQ ID NO: 1925 - DNA, 3237 bp, Glycine max var. Williams 82
atggcagatctttctagctacgggagtcatgagcgcgatattgaacaagcattcattactttgaaaaagggcactcagttagtaaagtatagtcgaaaagggaagccaaaactctgtacattcaggatctcatcggatgaaacgaaactgatttggatatctcatggaagggaaaagaatctaaaattgtcttctgtttcacgcatcatcccaggacagagaacagctgtctttagaagatacttgcgccctgaaaaggattatctgtcattttcacttatttataaaaagggggaacggtcacttgatctgatttgcaagaaccaagctgaggtagaggtatggttttcaagccttaaggcattaatttcccctggagagcgtattaggcgtggaacaagtgatttatccaatgatagtgttgacttaattccaaatgatcgtccttatgctggaacactagagtttgcatcaagcattgcccgtggcaggttttcttttgaatcagtgtctcatgaatctacatcatcttggtctagatcagaaacaaatatgccagtaaggacaagttgtggagatggttcgcgtgttagtgtatcaagtgttagtcactcaagtagcgtaggatcaggactagatgacatagaatctctaggtgatgtttatatatggggagaggtttgggcagatggcaattcatttgatggattggggagtcaacttcaagccttttgtaagacagatgtgctgactcctaaaccgttggagtctgatgttgttcttgatgttcatcagattggtcctggtgatcgtcacattgctctagttacaaggcaaggagaggtttttacttggggagaggattctggtggaagacttggtcatggatttgaaaaagatttcggtcgacctcatcttgtggaatccctggcaattaccaatgtgacttttgttgcgtgtggcgagtatcattcttgtgctgtgtccacatctggtgacctattcacctggggtgatggtacacatggtgcaggacttcttggtcatggcactgatgttagctactggataccaaaaagggttagtggccctttagagggacttcaggttgtagctgtagcatgtggaacatggcattcagcattagcaacctccaatggtaagttgtttacctttggtgatggaagatttggtgtattgggccatggaaaccgagcgagtgtggcatatccaaaggaggtacaattattgagtggatacaaggctattaaggttgcatgtggagtgtggcactcagcagccattatagatgttatggatctttctggttcaaaggcttcagccaagaggctcttcacgtggggtgatggtgaccaatatcgtttgggtcatgctaacaaggaaacttaccttgaaccaacttgtgtagctgcagttgctgaatataattttcaccaggttgcatgtgggtacactatgactgttgcactcactgcatctggtcatgtttttagcatgggaggcacaacatatggtcaactaggaaatccaaattctgatggaaaagtgccgattctagtgcgagataagttagtaggagagtttgtggaggaaatatcatgtggtgccaatcatgttgctgtgttgacttcaagaagtgagctatatacttgggggagaggtgccaatggaagactaggacatggagacacagatgataagaaatctccaacattggtggaagccttgaaagacaggcatgttaagaacatctcatgtggctcgacctttacatcttgcatatgcttacataaatgggtttctggagttgaccaatctgtttgctctgattgtcgacaaccatttggtttcacccgaaaaaggcacaattgctatcattgtgggttggtatattgccatccttgtagttcaaaaaaggcatcaaaagcagcactggctccaacacctagcaaaccacatcgtgtgtgtgatgcttgttatgctaagctaaaaggttctgatagtgcttccgattttaatagggaaattagtcgtccttctagttccgtatatggaagggaaagttttcaccggggagaggtaaggtcttcaagagttctcttgcctcctaccacagaaccggtaaaatacctagagattaggactaataagcctggaaatatgcatgacttttcttccatagtccgagctgctcaagttcctaccagtttacaattgaaagatgttgcatttccaatttcgttgagttctgcgcagaatgtttacaaacctgttatacagccaactccaccaacaccggctactccaatacctatgtcaccatatgctagaagaccacccagtccaccgcgttctacctcccctggattttcaagaagccttattgataatttaaggaagaaaaatgatcatttgaatcaacaagtctcaaaatggcaaaacaataatcaaaatttgaagcagaagagtgacatgcaagacatgaagattcgggagcttcagaaaaatattgaagaagccgtgtcacgagttggagaggaatcttctaagcttagaaaagcaaaggaattaattaagtccttgacagataagttgagggaagtgactgagaagttgccacttgagattccggacaacgagaccttgagaaccatgcatgctcaagctgaagaatttcttcatgaagaaaaagattttgaatcttcttcctccccacagagccttgagtctgagcaacaaagtgcacctgatgtacctgcctcagaaagcgactcttcaaaactccaagagcaaagaatggaaggaaatgatgatgcttttggggttgttccatctatagatggagaaaatattcttgaagaaagcagcaactcatctgtatctggtccagtagtgacttcgccaagctcaggaaatggttcaaaattacgtgacactggtatacctgtgacagaaggagaaaaatcagtcattgaacaatttgagcatggtgtttatgtcacactcgtagtactacctcgtggttacaaagttttcaaacgaattagattcagtaaacggagattcaacgagaagcaagcagaagaatggtggaaccaaaacaaagataaggtgcatagtaaatacaatttaccaatcacaaagaatgcaactactggatcatctatcatacctccacaagctgaagaaaaatgtgaggcattaccttcttcctaa

SEQ ID NO: 1926 - DNA, 970 bp, Glycine max var. Williams 82
ttatctttgcttcattattacctcttcaattttgagcctttcctttttttttcagtctaatttgttgtgttgtgcccacccagattcaaaattcatcttggaatctctgatttgtcttctttttccactctggctctctatttctgtgtcttatcttcctgtttgcttgtgactttgtgtggtgtgtgtgatgtggctgtgaagtggttgttaaaagtctcaccttttggggttctttggtgatttgtttttgttgcattggactggaatctgaagatgggttttcattgttaggtatttgagggtttctgagcattgatttgatttggaagagaaagatgaaggatttctctgggacacctggcactgttcttgggcttgttcttaggatttcacagttcatttttgctgctgggtctattgcttccatggctaccacaaccagtttctttaatttgactgccttttgttacttgatagcttcaatgggtttacaaatcatttggagttttgtgcttgctttaatggatttgtatgctttggtgagaaagaaggtcctcctcaacccggtaacagcaacactatctcttgcagcagcttctgcctcggctggtattacagttttgtactttcatgatctgggacactgccactttggagaagagtgccaaaagtaccagatttctgtggcatttgcattcctgagctggatttcaacttcaatatcatctctaattatgctttggctattagctgcagggtagctaacttttccactagaattccctcatccaaccaaaattagtcttgttgaaaattttattttcaaattgttaacaggaaaggaatcactgtagagttgtactctgaaatttaattgggatagctgcagaatgcagattgtaaaggggacaaaaaatgtataaatgattttgctttgcaaagatataaacctatatgtttacgtgaa

SEQ ID NO: 1927 - DNA, 2268 bp, Glycine max var. Williams 82
atggaaactgtgtgtttaaaatctgggatggttcccacgatctctattagtgggtcgctggatgcacgtgccaatccttctcaggtgagcacggtggggcgcgccgccggggataaaccgccgcagaggtcggtgttttcgaggttttccttttggtaccctttggaatctctctggcctcgggggaacaacagcaggtacaaagggctggccctcgacgacgccgttttggcggacaacaacgccgaagcgaaggccgttagagatgacggccagggtgacggaacggaaaggcagaccggaaactgggttttgaagattctgcatgtgaagtccgtgtgggaagggaaacagcgcaatgaagaggatggtacggttcatgatcaaactcaaaccaatttcgacgaggaggaggtgtgtgaatgtgatgcttgcggggttgatgaagatgacggctactgtgaagaagaagaggctgaattcgatagaggctcgttttcgagaatgcttcggagggtatcgttaggcgaagctagattgtacgctcagatgtcacacttggggaacttggcttacgatatacctagaatcaagccagggaaactcttgaaacatcatggtctgcgctttgtaatttcatcgatagagaagaaggaattggcagtggcagcaacagctgaaaaggatccccagaaagttggatcttcaatagagaagaaggaatttgcagcaattgctgaaaaggatccccagaaagttggatcttcaacagagaagaaggaatttgcagcaattgctgaaaaggatccccagaaagttgaaactgatgagaaggtagaagaaaaagaagaaacaaaggatccaaagaatgctggatacaagataagtgcaactgctgcttataatattgctgcctctgctgccacttatctgcattctcagactagtagcatatttccattcaaatcctcaaatgctgtgactggtgaaggttcacttgaaggaagcaatgaaagccttgacactgttaacatgctaaacacagaggtggcatctttgatggcaactactgattcagtgacagcagtggttgcagcaaaggaggaagtaaagcaggctgttgcagatgatctgaactctgcacattcaacaccctgtgaatggtttgtctgtgatgatgaccagagtgctacaaggtttttcgttattcagggttctgagacgttggcttcatggcaagcaaacctactctttgagccaattaaatttgagggtttagatgtacttgtgcacagaggtatatatgaggctgctaaagggatatatcaacagatgttgccagaagtacgtgctcacctaaaatctcgaggttctcgtgcaacttttcgtttcacaggccattctcttggtggaagcttggcattacttgtgaatctcatgctattgataaggaatgaagtgccggtctcctctctacttcctgtgataacatttggttccccatccatcatgtgtggaggtgatagtctgctaaaaaaattaggtttgcctaggagccatgttcaagcaatcacaatgcacagagacatagtaccacgagcattttcttgcaattaccctaatcatgttgcagaactattgaaggctgtcaatgggaacttccgtagtcatccttgtctcaataaacagaagctactatatgcaccaatgggtaatctgctgattctgcagccagatgagaaattttcaccaagccatcatctcctaccatctggcagtggtctatatcttttgtgttgtccattatcagaatccgatgacacagagaagcggctccgagctgctcagatggtcttcttaaactcacctcatccacttgagatattaagtgaccgatctgcttatggatctggaggaagtatacaacgagatcatgacatgaactcttacttaaagtctttgagaactgtgattcgcaaagaacttaaccagatccgtaaagctaagagggagcaacggcgtaaggtgtggtggcctcttctgttatctcgtggagctgataccagcattgttgctgggaggtccatgatatcaatcaatgtgggtcaacgccagtcacccttctccagcgtgatacaaacagggagagagtccctgaaaaggttcagtaggattgttacatcccaacatatgcatttgtttgtgttgcttttgttccctgctcggttgttgctcttgggaacatatagcgtaattaacctcaaatga

SEQ ID NO: 1928 - DNA, 561 bp, Glycine max var. Williams 82
atggctcttaatttttctcttgtgttcaccttgtactccattatttttctcctaacaacagcttcatccaccaccaccacccaaactactacttcaacagtgggaaaagaccaagttccacgcataatgtgcaatgagtgcgagcttccacctccacccccacaaccaaaagagtgtccaccgccaccgtcacctccaccgccgataccaccatcacctccaccaccgttgcctgcatcacctccacctccggttattattaaatgtccgccgccgccaaaaccactaccaccaccaccacccgtggttattgaatgtccaccaccgccaaaaccaccgtgtggtggaggtgctgactgcttgctccccactttgccggagacaccagaggaaccccaatacctacaaccgccgccgcagcttccgtcgtcgccgggaacgatagatcttgacgatattatcagcggtgctaacatgattaatccactgctacgctacttcacattgaactccttcacttttctcctccttctttgccttccctattacttgttcatttga

SEQ ID NO: 1929 - DNA, 1311 bp, Glycine max var. Williams 82
ctgaccggaaacagatagttaaaattacttctagaataaactttaaccgttgcatgaaactattacatggttatgagacgatatcgtagaagattaaacaccgacaaatggtgcggccagcaatacacaactacacaagcatatatctcgctccccctcgtaaccaaaggccttcattctcttgttccttcctttctcgttatcttgccttcagtttcattctttctggaacaaaccatttctagctaatttgttcttacctgtcaaatgctatcttctccttagtccgagttccttctccgatacacaattcaaaaacatggctcttaatttttctcttgtgttcaccttgtactccattatttttctcctaacaacagcttcatccaccaccaccacccaaactactacttcaacagtgggaaaagaccaagttccacgcataatgtgcaatgagtgcgagcttccacctccacccccacaaccaaaagagtgtccaccgccaccgtcacctccaccgccgataccaccatcacctccaccaccgttgcctgcatcacctccacctccggttattattaaatgtccgccgccgccaaaaccactaccaccaccaccacccgtggttattgaatgtccaccaccgccaaaaccaccgtgtggtggaggtgctgactgcttgctccccactttgccggagacaccagaggaaccccaatacctacaaccgccgccgcagcttccgtcgtcgccgggaacgatagatcttgacgatattatcagcggtgctaacatgattaatccactgctacgctacttcacattgaactccttcacttttctcctccttctttgccttccctattacttgttcatttgatacatgcattattgttacttgagcaagtggactcggatgtttgcatgagaaaaataaatcaaaagagagagaaagaatgaactagcttagcttgtcgtagaaattgagcgtgagattaatttcagagaaaaagaagagggaagaaaatgaaaaaaaaatctcttctgactgagccgttaaagtgtctattgttgtttagcttcgtacccttgattagtgttgaattaacgatcaaataaatattggtgcaatttattccctgattaatatgtatgcactatgcttaattccagagtgacggcctctttgtaatttcttatatatattttgcagatatagattgagcattagagcttcaattcatttgcttaattatgtgagcgacatagagtgtatattcgtttttagagtaaaatggacgaaggctatcg

SEQ ID NO: 1930 - DNA, 915 bp, Glycine max var. Williams 82
atgtgtggcggtgccatcatagccgacttcattccccgccgtggaggccgccgcctcacggcctccgagctctggcctaactccttcggcaaagacggtgactttgacttcgattactcccacatcgccgatcaacaacgttccactctcaaaatgtccccacctcccaaagctagcgagcaagtggagaataagccggtgaagaggcagaggaagaatctctacagagggattcggcaacgtccgtggggaaaatgggccgcggagattcgcgatccaagaaaaggggttcgtgtctggttgggcaccttcaacactgcagaagaagccgcaagagcctatgatcgtgaagctcgaaaaatccgcggcaaaaaggccaaggtgaatttccccaacgaggacgacgaatattccattcaagcacgtcatccgattccaccccttcctttcacaccacaaacacaaaaccctcccctgtaccagcaacagtaccgttgcgatctcaacattgcccctaaaaatctcaactttgagttcgggtacgacctgaaccacgcgggggcatttccgtcccacgtggacgccgtcaacgctgactcggtggttgtctccggcgatgaaaattcagggttagcgtcgggttcagagggtgcttattcgacaacggagtttatgggatccagtcaaaacgggaacgggtatctgggtgttaccgcaatggagaagaatgagaaagagacagaggttattgaagctcaagaagaaaagaacaaagtgcaggagctttctgaggagctgatggcgtacgagaattacatgaagttttatcagattccgtactatgatggacaatccacggctccaccgaataatgttcaggaaagcttggtcggggatctctggagttttgattaa

SEQ ID NO: 1931 - DNA, 201 bp, Glycine max var. Williams 82
atgatcgtcatcttgtgtcgccgtcaacgaacgagcagtgaaccgtcaatctcgctttcgcctctgtcacgccgcgacctcgaagcatttcatccaggtgttgcattgcaagaactagttcagaatttgcatcttgtgtcttatttaactgtaattggagattcgcattcagctccttctcatacttcaattgttgtctaa

SEQ ID NO: 1932 - DNA, 4506 bp, Glycine max var. Williams 82
atgtcttctgcggcagcttcaacttggatcacgtccttctcgtgttcacccaatgcaactccaaatttacctcactggctgagattcattttcctctctccgtgtcctcagagggctcttttgtctggtgttgacattcttctcctgttgactctctttgtgtttgcgctaataaagctctattctaggttcacttccattggcaaccacaactcagagctcgacaagccccttatcagaaacaacagagtttctaaccgaacaacagcatggtttaagttaactctaaccacaaccgctgtttggactattttgtacacggttgcttgcattctggtgtttaccagttccaccgatgggacgtggaagcaaactgatgggttcttttggttacttcaggctataacacaactagtccttgcagttttaatcatccatgagaaaaagtttcaagctgttgttcaccctttgtcgcttagaatatactggattgcaaatttcatcttggtttctttgttcacagcttctggggtcatacgtttggtctctgtgggagtggaagatgggaaacacttcagcttcctggttgatgacacggtttctttcatttctctacctttgtctctttttctgctttgcgttgctgttaaaggttccaccgggattgtgtccggggaagaaacacaacctcttattgatgaggaaacaaaactatatgacaaatccaacgttactggctttgcttcagcttctgcaatatccaaggccttttggatttggataaacccgttgctgagtaaagggtacaagtcaccgttgaagattgatgaaattccatacctttcacctcagcatagagctgagaggatgtcggtaatctttgaatcgaagtggcctaaatcagacgagaggtcaaagcacccagttcgaaccacgttgcttcggtgtttctggagggagatagccttcactgccttcctggctgttattaggctatctgtaatgtttgtagggccagttctaattcaaagttttgttgatttcacggcagggaaaggtagctctgtgtatgaagggtactacctcgtgttgattctcctgtgtgctaaattcgtagaagttttgacaactcaccatttcaacttcaactctcagaagcttgggatgcttatcagatgcaccctcatcacttctttgtacaagaaggggctgaggctaaccggttccgcgagacaggatcatggagttgggcctattgtcaattacatggctgtcgatagccagcaactctctgatatgatgcttcagttgcacgccgtgtggatgatgccatttcaagttggtattggtttgttcttgctgtacaactgtctaggagcctcagtgattacggctttacttggacttcttgctgttattgtatttgctgtggtgtctacaagaaagaacaagcgttaccagtttaatgccatgatgagccgtgattcaaggatgaaggcagtgaatgagatgctcaattacatgcgtgtcatcaagttccaagcatgggaggagcatttcaatgggaggattttgggtttccgaaagtccgagttccagtggctttccaagttcatgtactcaatctgtggcgttattattgtgttgtggagcacgccattgttgatatcaactctcacgtttggtactgcgcttttgcttggagttcgactcgatgcagggacggttttcaccaccacaactgtgtttaagatcctgcaggaacctattaggaccttccctcagagtatgatatctctttcacaagcgctggtgtcacttgggaggttggataggtacatgtctagcagggaattgatggatgattcggttgagagagaagaagggtgtggtggacacactgctgtggaggtcaaggatggaaccttcagctgggatgatgatggccaacttaaagacttgaaaaatattaacttgaagattaataagggggagcttacagcaattgttgggactgtaggctcagggaagtcttctctccttgcttcaattcttggcgagatgcacaaaatttctgggaaggttcaagtttgtgggagtactgcttatgttgcacaaacatcttggattcaaaatgggaccatcgaagagaacattatctttggtttaccaatgaacagacagaagtacaatgaagttgttagagtttgtagcttggagaaggacttggaaatgatggaacatggggaccagacagagattggagagcgcggaatcaacctaagtgggggtcagaagcagcgcatacagcttgccagggctgtgtatcaagactctgatatatatcttcttgatgatgtttttagtgctgttgatgcacacactggcactgaaatattcaaggaatgcgtgaggggggctctgaaaggcaagaccgttattcttgttacacaccaagtagacttcctacataatgtggatcttatagtggtgatgagggacggaatgatagtccaatcggggaagtacgatgatctacttgcgtctggaatggattttagtgctcttgttgcagcacatgacacctctatggaactagtggagcaaggtgcagtcatgactggggaaaatttgaacaagccattgaaatcaccaaaggcagcttcgaataacagagaagccaatggtgaaagcaactctcttgaccagcccaagtctggcaaggaaggttctaaactcatcaaagaggaggagagagagactggaaaagttagcttacatatctataaactctactgcactgaggcttttgggtggtggggcattatagcagtaatctctctttctgtgttgtggcaagcatcaatgatggcaagtgattattggctggcatatgaaacatcagaagagcgtgctcagttgttcaatccttccatgtttatttccatctacgcgattattgcggtagtttcagttgttttaattgtgctaagatcctactctgtcacagtcctggggttaaagacagcacagattttcttctctcaaattctccacagcatcttgcatgcccccatgtctttctttgacaccacgccatctgggagaattctaagcagggcatccactgatcaaaccaatgttgatgtctttatccccttgttcatcaattttgtggtggctatgtacattacagtgatcagcatcttcataatcacgtgtcaaaattcttggccaacagctttcttgttaattcctcttgcttggttaaacatttggtaccggggttattttcttgcttcatctcgcgagttaactcgtctggattcaattacaaaagcaccagtgattcaccatttctctgaaagcatttccggggtcatgacaattcgcgcattcagaaagcagaaggaattttgcggagaaaacattaaacgggtgaatgctaatttgagaatggatttccacaacttcagttccaatgcgtggttgggtttccgcttagaattgcttggaagcttagttttttgcctttctgcaatgttcatgatcatgttacccagcagtatcataaagccagaaaatgttggtttgtctctctcatatggcttgtcattaaatgccgtgatgttctgggctatatacatgagctgtttcattgaaaacaaaatggtatctgttgagaggatcaaacagttcacaaatattccatcggaagcttcatggaacattaaggatcgcctgcctcctgcaaattggcccggggaaggccatgttgatatcaaagacttgcaggtcagatatcgtccaaacactcctttggttcttaaaggcatcaccctaagcatcaacggaggggaaaagattggagttgttggtcgaacaggaagtggaaaatcaactttaattcaagttttcttcaggctggtggaacctacaggaggaaaaataatcattgacggcattgacatatccgccttggggcttcatgatcttaggtcacggtttggtatcatccctcaggagcctgtcctttttgaaggaaccgtcagaagtaacattgatccaactggacagtacacagatgaagagatatggaagagtttggaacgttgtcaactaaaagatgcagtggcttctaagcctgagaaacttgacacttcagtggttgataatggagataactggagtgtggggcagaggcagttgctttgtttagggagggttatgcttaagcaaagcaggctgttgtttatggatgaggcaacagcttctgttgattcccaaaccgatgctgttattcagaagatcatcagagaggactttgcagctcgtaccatcatcagcattgctcatagaataccaacagtaatggactgtgatagagttctagttgtagatgcagggcgggccaaagaatttgattcaccagccaacttgctccaaaggccatctctctttggggcattagttcaagagtatgccaaccgttccagtggcctataa

SEQ ID NO: 1933 - DNA, 6495 bp, Glycine max var. Williams 82
ttaaaaagttttaagaaaatctttcacactaattttatgcatttcaataaaattcattctctttttaattctttaacaaatactatgagaacaacatttgtcttcctatactaataggagtacaagtagaggttactacattaaatctctaatagttagagattctcgtgacttgaatattacgttcaatttgtgattgtaattaatgctggactattattgcctattaatgtgttactgtatgtgttctctttgatttcattattattacggtcaacgtgattcaacctttgtgtttagtctattattattattgctcagttgtaaaagaagaattttctttgtgcttctcgtggtttgacaatagagccttcttggacttggctggaacaacagggaagcttgcacgctgtttcctaaaaataatagcgaatttatctgtagaccaggctgctatagtttttttcttttcacaatagttggtgaagatagaagcctcgctgaaattaaactagacacaatcatgtgacatggtaggcgggtatagttgcaaatttcaactcaactaactagtttttctttccacaagagttttgtttgttccggagatcacgtagctaagaagagtaaacattaaacaagaagattggtaattttttattttagtgcgcgaaaaccgaaaagggtctttgttttctttcatactataaatgtattatcaagttgcatagaaaagcttcaatagccccaagtccagagcgacttatcggttgttcgggacaaccttttagtttttggcttcgacttttttaagattctgttttctgggttgcggggtcgtaactcatccagaagaaagggggagcagagaaacaaggtcgatgagagttgagtttataaggttgcagcaatacgagtgaagtttcttcgttggtgctataaataattaaacatgtcttctgcggcagcttcaacttggatcacgtccttctcgtgttcacccaatgcaactccaaatttacctcactggctgagattcattttcctctctccgtgtcctcagagggctcttttgtctggtgttgacattcttctcctgttgactctctttgtgtttgcgctaataaagctctattctaggttcacttccattggcaaccacaactcagagctcgacaagccccttatcagaaacaacagagtttctaaccgaacaacagcatggtttaagttaactctaaccacaaccgctgtttggactattttgtacacggttgcttgcattctggtgtttaccagttccaccgatgggacgtggaagcaaactgatgggttcttttggttacttcaggctataacacaactagtccttgcagttttaatcatccatgagaaaaagtttcaagctgttgttcaccctttgtcgcttagaatatactggattgcaaatttcatcttggtttctttgttcacagcttctggggtcatacgtttggtctctgtgggagtggaagatgggaaacacttcagcttcctggttgatgacacggtttctttcatttctctacctttgtctctttttctgctttgcgttgctgttaaaggttccaccgggattgtgtccggggaagaaacacaacctcttattgatgaggaaacaaaactatatgacaaatccaacgttactggctttgcttcagcttctgcaatatccaaggccttttggatttggataaacccgttgctgagtaaagggtacaagtcaccgttgaagattgatgaaattccatacctttcacctcagcatagagctgagaggatgtcggtaatctttgaatcgaagtggcctaaatcagacgagaggtcaaagcacccagttcgaaccacgttgcttcggtgtttctggagggagatagccttcactgccttcctggctgttattaggctatctgtaatgtttgtagggccagttctaattcaaagttttgttgatttcacggcagggaaaggtagctctgtgtatgaagggtactacctcgtgttgattctcctgtgtgctaaattcgtagaagttttgacaactcaccatttcaacttcaactctcagaagcttgggatgcttatcagatgcaccctcatcacttctttgtacaagaaggggctgaggctaaccggttccgcgagacaggatcatggagttgggcctattgtcaattacatggctgtcgatagccagcaactctctgatatgatgcttcagttgcacgccgtgtggatgatgccatttcaagttggtattggtttgttcttgctgtacaactgtctaggagcctcagtgattacggctttacttggacttcttgctgttattgtatttgctgtggtgtctacaagaaagaacaagcgttaccagtttaatgccatgatgagccgtgattcaaggatgaaggcagtgaatgagatgctcaattacatgcgtgtcatcaagttccaagcatgggaggagcatttcaatgggaggattttgggtttccgaaagtccgagttccagtggctttccaagttcatgtactcaatctgtggcgttattattgtgttgtggagcacgccattgttgatatcaactctcacgtttggtactgcgcttttgcttggagttcgactcgatgcagggacggttttcaccaccacaactgtgtttaagatcctgcaggaacctattaggaccttccctcagagtatgatatctctttcacaagcgctggtgtcacttgggaggttggataggtacatgtctagcagggaattgatggatgattcggttgagagagaagaagggtgtggtggacacactgctgtggaggtcaaggatggaaccttcagctgggatgatgatggccaacttaaagacttgaaaaatattaacttgaagattaataagggggagcttacagcaattgttgggactgtaggctcagggaagtcttctctccttgcttcaattcttggcgagatgcacaaaatttctgggaaggttcaagtttgtgggagtactgcttatgttgcacaaacatcttggattcaaaatgggaccatcgaagagaacattatctttggtttaccaatgaacagacagaagtacaatgaagttgttagagtttgtagcttggagaaggacttggaaatgatggaacatggggaccagacagagattggagagcgcggaatcaacctaagtgggggtcagaagcagcgcatacagcttgccagggctgtgtatcaagactctgatatatatcttcttgatgatgtttttagtgctgttgatgcacacactggcactgaaatattcaaggaatgcgtgaggggggctctgaaaggcaagaccgttattcttgttacacaccaagtagacttcctacataatgtggatcttatagtggtgatgagggacggaatgatagtccaatcggggaagtacgatgatctacttgcgtctggaatggattttagtgctcttgttgcagcacatgacacctctatggaactagtggagcaaggtgcagtcatgactggggaaaatttgaacaagccattgaaatcaccaaaggcagcttcgaataacagagaagccaatggtgaaagcaactctcttgaccagcccaagtctggcaaggaaggttctaaactcatcaaagaggaggagagagagactggaaaagttagcttacatatctataaactctactgcactgaggcttttgggtggtggggcattatagcagtaatctctctttctgtgttgtggcaagcatcaatgatggcaagtgattattggctggcatatgaaacatcagaagagcgtgctcagttgttcaatccttccatgtttatttccatctacgcgattattgcggtagtttcagttgttttaattgtgctaagatcctactctgtcacagtcctggggttaaagacagcacagattttcttctctcaaattctccacagcatcttgcatgcccccatgtctttctttgacaccacgccatctgggagaattctaagcagggcatccactgatcaaaccaatgttgatgtctttatccccttgttcatcaattttgtggtggctatgtacattacagtgatcagcatcttcataatcacgtgtcaaaattcttggccaacagctttcttgttaattcctcttgcttggttaaacatttggtaccggggttattttcttgcttcatctcgcgagttaactcgtctggattcaattacaaaagcaccagtgattcaccatttctctgaaagcatttccggggtcatgacaattcgcgcattcagaaagcagaaggaattttgcggagaaaacattaaacgggtgaatgctaatttgagaatggatttccacaacttcagttccaatgcgtggttgggtttccgcttagaattgcttggaagcttagttttttgcctttctgcaatgttcatgatcatgttacccagcagtatcataaagccagaaaatgttggtttgtctctctcatatggcttgtcattaaatgccgtgatgttctgggctatatacatgagctgtttcattgaaaacaaaatggtatctgttgagaggatcaaacagttcacaaatattccatcggaagcttcatggaacattaaggatcgcctgcctcctgcaaattggcccggggaaggccatgttgatatcaaagacttgcaggtcagatatcgtccaaacactcctttggttcttaaaggcatcaccctaagcatcaacggaggggaaaagattggagttgttggtcgaacaggaagtggaaaatcaactttaattcaagttttcttcaggctggtggaacctacaggaggaaaaataatcattgacggcattgacatatccgccttggggcttcatgatcttaggtcacggtttggtatcatccctcaggagcctgtcctttttgaaggaaccgtcagaagtaacattgatccaactggacagtacacagatgaagagatatggaagagtttggaacgttgtcaactaaaagatgcagtggcttctaagcctgagaaacttgacacttcagtggttgataatggagataactggagtgtggggcagaggcagttgctttgtttagggagggttatgcttaagcaaagcaggctgttgtttatggatgaggcaacagcttctgttgattcccaaaccgatgctgttattcagaagatcatcagagaggactttgcagctcgtaccatcatcagcattgctcatagaataccaacagtaatggactgtgatagagttctagttgtagatgcagggcgggccaaagaatttgattcaccagccaacttgctccaaaggccatctctctttggggcattagttcaagagtatgccaaccgttccagtggcctataagaaagttccatgcatgtgtctctctcagccattcagacaataacagaaaaccaaacttaggctaagccttttaagttttgattgatcttccaagtgccacgagaaaggagaaaggcattttactttagagaggtgcaattaccatcctgcataattgctgtttggacaagtgaagaatgagcaaaccttgtgaatggtttttctaattacctctggcttaagtagctctagtatacaaacaaaatatagccttttttaggtcctaatttatataacacagtgcccagtgtacaattacacagttgctccactgcctttatattgaattatgcatcatcagtaatatactttggacttctcgttgagcattagcttacagcattaaatattgttgaccttgttcatgtcgcgaaaagagttctaaatggaagatgcattttagattatcttataatttatgggattttattaatggtaaaattctattgttgattttgttgttttttaaaaaagaaaaagtttatagttgcttgggaagaaattagatgcatgagattctaaaaatgttgaaatgtgagttgattttaatctcacacacattgactgatactggtatcaatttttatacttataccacttaatattattcttgtagaatagaatacaaaattagtcaattaaaccaccgaattatttgatattatcttttttttttatcatgtatatcaaatattacataaatcatatttattggtatagtatctatcaatgaacatttacttatattctaaatagcatataatatgtcaaaacaaagtcatgttcggaaaggaacaatccacagtttttatcaactaaacatcaagttgttaagtattgagtcttaaaagacatacatcgtccaatggatatagtcattacatatgcatgacatgtttgtatgttacatattttatttctgtgaatcacgtgttcaaatagtttcatttctctgttgtaatatttatgttcatagattttttttaaaaaatatttgc

SEQ ID NO: 1934 - DNA, 306 bp, Glycine max var. Williams 82
atggacaaggttacgaggttggcaacagaaaagggtgtggtggttttcaccaagagctcttgttgcctctgctatgcagtcaacattctgttccaagagcttggagtgatccctgtggttcatgaaattgacaaagaccctgagggcaaggaaatagagaaagctataacaaggttggggtgtcctacacctgttcctgcagtcttcatcggagggaagctggtggggtccaccaatgaagtcatgtccctccaccttagtggttcactcactcaactgctgaaaccatatcgagctttgtcttaa

SEQ ID NO: 1935 - DNA, 399 bp, Glycine max var. Williams 82
atggagaggaaggagactattgatttttcttcttatttttatcttgaagcctctggtgactctgaagaagctgattttgatcacacctttgcttgtgaaatggccaaagcagatggtggtggcgaagttgttgatgataatgatgatgctctatcttgcaatggatctggtgcttgtaatgttgctgaatccgatgggtgtgacgagtcttgtgatgagcatgatggtgggattgagaagaaggaggaggaggatggtgtttatggaatgtcatattgtgaagatgatgagatgcaagaagaacagatgaaatcctatgtgtcttttgattcaggccacaaatctctggatgaaatggaaaagaacaggctcttctgggaagcttgcttggcatcttga

SEQ ID NO: 1936 - DNA, 903 bp, Glycine max var. Williams 82
atgagggagtttccttcttgttttggagaaaatggtgttcaggttgctgactcatcctcatcaagcaccacaagagcagcacaaaatgtggtcacgtgtgtctatcagtgcaaattaagaggccattcaagcttgattacagtctcgtggacaaaaactctgattggtcaaggcttgagtgtggaaattgatgacttgggaaagcattgcctctgcaaggttgagataaagccatggctcttctcaaagagaaaagggtcaaagaatttggaggtccaatctggtaaagttgacatcttttgggatttgagtagtgccaagtttggttcagggcctgagccaatggaggggttctacttagcggttgtgttcaacaaggagacggtgttgctcctaggggatctaaaaaaagaggcatgcaagaagattgagagtgattgtgcttgcttttctcactctggtgctattttcattgcaaagagagagcacatttttgggaagaagttttatggtgcaaaggctcagttttgtgacaaggggcaggtgcatgatgtcacaattgagtgtgacacgttaggactcaacgatccttctcttgtgattcgaattgatagcaagacagtgatgaaggtgaagcgtctcaagtggaagttcagagggaatcacaccattttggtggatggtgttcctgttgaagtgttttgggatgtgcatagttggctctttgggaatgctatgggcaataatgcagtgttcatgttccaaacatgcatttcaaatgacaaaatgtgggaagggcaatctgtttctgatccctcatgggcttcttctcagcagtttagggattcccaattgcaaggccttgggttctctctcattttgtatgcttggaaacatgagtag

SEQ ID NO: 1937 - DNA, 387 bp, Glycine max var. Williams 82
atgatgttcgccaagaaacgttcccggcgaggcgtcgtttcatcgttgccgagctcgaacgcgaagaagctattgagactgccgcacgtgttcgcgaaaatactagagcttccttttccttcagaagacgacgtttccgtggaggaaacgccgcagttttttcggttcgtggcgtcgtgcaatgccgatggtggcgtgagagctctggcgatcgacatttttccggggataacgaaaatcgtgataaagagaatggacggtggtgacgtggcggttccgggtcagcagcagcagcaggttccttctggctttggactgtggcggttccggcttccgcctggacgcagccggagatggttaccgccgtgtgcagcggcgggaagctga

SEQ ID NO: 1938 - DNA, 639 bp, Glycine max var. Williams 82
atgggacacctcagctctaattctcaaatgacactcatattattattagcccttgcaattttcacttcactaaatttggtcacagcacaggttattaccacgccctgcatgacctctatgattaacactatcaccccttgtgccaacttcatcactggaagcattaacaatggtttaactccatcagctacgtgctgtgattcatttctgtctttgataaccactagcgtggattgtgcttgccttctagtatcagctaatgttccattgcaaatacccgttaacagagttcttgccctcttccttccacaggcatgcaacgtgggtcaaatgcctgcactgtgcaaagcctctgcttctcctttaccggctccaggcccagctctacttggatcaaatgaccaaactcctccgcctattgctttttctcctttaagcccacaagtttctaacaccattttcgaagttgaagctccgaaatctgagattctgcaaccagcattggcaccagcatcagtagaatctacaccaatgaagcagaagcacccacgaaaagttcaggaattagacaaagtgcagaaacatcctgtatgggttggaaagcagctgagaaactcattaggcgctggaaaattctaa

SEQ ID NO: 1939 - DNA, 1680 bp, Glycine max var. Williams 82
atgagagatgacaactcgaagaaaagcaagctttcatggcccaaaacgttggtcaagaagtggttcaacattaaaagcaaaaacgaggactttcaggcagatgatgtcctctacgcaggtgtcaatcaagagtggaggaactgctcacagagggaggaagacactatcaagagaagcaaaacagagagagcaaagaggagacactcagatagaatgcggcgaggtagaattgaccgtgatgcagctccggttacagatgtgcataactatagaatctttgctgccacttggaatgtagctggaaaatctcctccaagttatttgagtctggaagattggcttcactcttctcctcctgctgatatctatgttcttgggtttcaagaaattgtacctctcaatgctggcaatgttttgggcacagaagataatggccctgccagaaagtggctatctcttattaggaagaccctaaacagtcttcctggaacaagcggtgaatgccacactacttcaccgctccctgaccctattgtagagttagatgctgattttgagggatcaatgaggcagaagacgacctctttcttccatcgccggtcattccaatccttgagtcatagtatgagaatggacaatgacatgtcactaccacaagcatgccttgatcgtcgtctcagcgtatgtgatagaatgatgtttggtcacaggccaagtgactatgacccctgttatagatgggcttcctcggatgatgaaaatggccctggtgactccccagttgtaacacattattcaccaatgacatatagaggttgcttctctatggaggatagatttagacagacaggacagtcaagatactgtttggttgctagtaagcaaatggttggaatatttctaacagtttgggtgaaaagtgatataagagatgatgttcacaatatgaaagtgtcttgtgttggcagaggattaatgggatatcttggaaacaagggttcaatatcaattagcatgtctttgcaccaaacaagcttttgcttcatctgtagtcatttgacttctggacaaaaggaaggtgatgaactaaggaggaattcagatgtaatggagattctcagaaagacaaggtttccccgagttcaagacatgggagatgagagttctcctcagacaattctggatcatgatcgaataatttggctgggggatttaaattaccggatagccctttcttaccgtgcagcaaaggctcttgttgagatgcataattggaaggttctgttggagaatgaccagctacatatagagcggagacaaggtcgagtctttgaaggatggaatgaggggaaaatatatttccctcccacatacaagtattcaaacaattcagatagatatgcaggcgatgaaagacagtcaaaacaaaagagaagaactccagcatggtgtgatcgtatcttgtggtatggaagaggcctccgccaattatcgtacgttcgtggggagtcaagattctcagatcatagaccagtttatagcatgtttctggcagaagttgagtctgttagccgtaaccgaatcaaaaaatgctctagctgctccagttcaaggattgaagtggaagagttgttgcctcattcacacggttacagttacactgatttgagtttcttctga

SEQ ID NO: 1940 - DNA, 411 bp, Glycine max var. Williams 82
atggcaaccatctccgctgctatcacaaccccatcgatcacccgcgcatgtctagtgcaaaaacgttctcttgggttctcatctcccgttcttggtttgccagcaatgggtaaggtgggaagagtgagttgctccatggaggaaaagccttcttctgtgaaggaaagcagctcaagcatgttggggatgggggcatctttgatggcagcggccagcgccgcagccatgtcaggcccagccatggccttggtggatgagagacttagcactgaaggaaccgggctacccttcggcctcagcaacaaccttctcggttggatcctgttcggcgtcttcggactcatctgggctctctattttgtctacacttcctctcttgaagaggatgaagaatcaggactgtccctttaa

SEQ ID NO: 1941 - DNA, 2285 bp, Glycine max var. Williams 82
acaggttagctgacacagccgtgtcggaacgataaacatggataaagctaagcttcgttttctcactttctgtatatctttcttctctgtctcgctaacagtaacacggtaaacacagagtaagtgaaatcctacgtacgtgctcattccggtggaactatcatatcctctccgggatctgaatctgcgaaatgtaatgtacttcttcttctcgagaaggatccagaagaagaagaaccacactcaccaatgagcaaaatccgtctctgccagaggattctcctcctctctctcttctttctctccgtcgtcgctcctctcgtcttcgtctctcaccgcctcaaccttctcactcttctcgggagaagagagtttctcgaagatttatatcgcgctacatacaggggagatactttgaagttaaatgctgtagaacagattcaggaaggtgctgacggattagaagagccaaatcaagttgtttatacggaaaaggattttgcttcaacaattagttactattcagaaaagaataatgattttaaggaatctggaattgcaggttacagaactaccactttggaaagaaatggattcaacccagataaaggacaacgccagggagctcagcagaatgaattatccttcatggctcaaggtaggaacatacatgattcacagagaatgtcagagaagaatattcaagttacaaataagaaggttcaagagattaaggatcaagttattttagccaaagcatacttgaaaattgcaccaccaagcagcaatttacgcttgagggatttggagcagctaacgagagagatggaattagcagttggagaagccacccaggattcggatctgtcaacgagtgctttgcagaaaatgagacacatggaggcttccctgtctaaagtctatcgtgctttcccagactgctctgctgtgggtgctaagcttcatacaatgctgcgtcaggctgaagagcaagtccgttctcagagacatcaagcaacatatcttgttcatcttgctgcaaggactgccccaaaaggcctacactgtctttctatgcggttgactgcagaatactttgccttgaggcctgaggagagaaagcttccaaatgaaaataaaatttatcatcctgacctttatcattatgctgtcttctctgacaatgttctggcatgtgcagcggttgttaattctactatctctactgccaaggaacaggagaaacttgttttccatgtattgaccaaatcactcaacttaccagcaatctcaatgtggttcttaataaatcctcctgccaaagctacagtccacatactgagcatagacaactttgaatggtcgtccaagtacaatacctaccaggaaaataattccagctatccaagattcacttctgaactgaactacctgcatttctaccttccagacatttttcctgctttaaataagattgtacttttggatcatgatgtggtggtgcaacaagatctcagtgaactatggaatatcaatatgaagggaaacgtaattggagcagttggaacttgtcaggaaggaaaaatcccattttataggattgatatgttcataaacttgtcagatccattaattggaaagcggtttgatgccaatgcttgcacatgggcctttgggatgaacttgtttgatttgcaacagtggaggagacataatttaactgctgtctatcagaattatgtgcaaatgggtttgtggaacattggaagtctacctttaggctggctgactttctataataagacagagttgttggatagacagtggcatgttcttggccttggttatagttcggatgttgatcgaaatgagattgagcaggcttccgttatacactatgatgggcttaggaagccgtggctggatattgcaatgggaagatataaaagttattggaccaaattcttgaattttgacaacatttttttgcaacagtgcaatctccaggcatagttcaaaattcaaagttccctctacctgacatgacggggattctgttgtcgacaagcttgatggcacattcatgactttcttcacgttaatatttctgcaatcgattaaagttctccatatctctgaccaccccaaaatttccatgcacttctttctcgaaacttagcatatttatcgttacaacttacaatcaagatgaagagtcagtgacgtgcattttacctgcttgcagatgcaattggttgttgttgtgtatataatctttggcgtct

SEQ ID NO: 1942 - DNA, 1566 bp, Glycine max var. Williams 82
atggggaaggagcaagttcaggtgctgaatgccctggacgtggcaaagacacaatggtatcatttcacagcaatcatcattgctggaatgggcttcttcactgatgcttatgatctgttctgtatatcactagtcacaaagctacttggtcgcatttactaccacgttgatggggctgcaaagcctggttcattgcctcccaatgtgtcagctgcagttaatggtgtagcttttgttggaacactttcagggcaactcttctttggctggctcggcgacaaaatgggccgaaaaaaggtctatggcatgacccttgcgcttatggttatagcttccattgcttcgggtctatccttcggacacgatgcaaagactgtgatgacaactctatgcttctttcgcttctggcttggttttggcattggtggagactaccctctttcggccaccataatgtctgagtattctaataagaagactcgaggtgcctttatagctgcagtgtttgccatgcagggttttggaattttggcaggaggtgtgtttgctattatcatagcatctgtgttcaagtccaagtttgattctccaccatacgaggttgatccgttgggttcgactgttccacaagcagactatgtttggaggataattctcatgtttggagcaattcctgctgcaatgacttactactcgcgatccaagatgccagaaaccgctcgttacactgccttggttgccaagaatatggagaaggctgcagcagatatgtctaaggttatgaacatggagattcaagccgagccaaagaaggaggaggaggcacaagctaaatcatatggattgttctccaaggagttcatgagtcgccatggactgcatctgctcggaacaacaagcacatggttcttgcttgacattgcattctacagccaaaatcttttccagaaggatatcttcagcgcaattggttggattcctccggcaaaaacaatgaatgctcttgaggaggttttctttattgcaagggctcaaactcttattgctctatgcagtacagttcctggatactggttcactgtggccttcattgataggataggaagattcgccatccaattgatgggattcttctttatgactatcttcatgtttgctcttgccattccctatgatcactggactcttagggagaacagaattggatttgtggtcatttactctctcacattcttctttgcaaactttgggcctaatgccaccacatttgttgtgccggcggagattttcccagctagatttagatccacttgccatggaatatcttcagcatctgggaagctcggggctatggttggtgcattcgggtttttatatttggcacagaatcaggacccgagcaaagcagatgcagggtaccctgcaggtattggtgtgaggaattcactgcttgtgttgggtgtgattaacattttaggcttcatgttcactttcttggtgcctgaggccaagggtagatccttggaggagatttcgggagagcaagaagaggagaccaaggtgtaa

SEQ ID NO: 1943 - DNA, 2059 bp, Glycine max var. Williams 82
ggccactctccattcacctcttagtgtgtaaccaattcttctcttttgctttctctctccaaattcatcacaacttctctcgtacctctgcagagaagtaaacatataggagtgagagggagggagagagaaggaaagcttggtagcgatggggaaggagcaagttcaggtgctgaatgccctggacgtggcaaagacacaatggtatcatttcacagcaatcatcattgctggaatgggcttcttcactgatgcttatgatctgttctgtatatcactagtcacaaagctacttggtcgcatttactaccacgttgatggggctgcaaagcctggttcattgcctcccaatgtgtcagctgcagttaatggtgtagcttttgttggaacactttcagggcaactcttctttggctggctcggcgacaaaatgggccgaaaaaaggtctatggcatgacccttgcgcttatggttatagcttccattgcttcgggtctatccttcggacacgatgcaaagactgtgatgacaactctatgcttctttcgcttctggcttggttttggcattggtggagactaccctctttcggccaccataatgtctgagtattctaataagaagactcgaggtgcctttatagctgcagtgtttgccatgcagggttttggaattttggcaggaggtgtgtttgctattatcatagcatctgtgttcaagtccaagtttgattctccaccatacgaggttgatccgttgggttcgactgttccacaagcagactatgtttggaggataattctcatgtttggagcaattcctgctgcaatgacttactactcgcgatccaagatgccagaaaccgctcgttacactgccttggttgccaagaatatggagaaggctgcagcagatatgtctaaggttatgaacatggagattcaagccgagccaaagaaggaggaggaggcacaagctaaatcatatggattgttctccaaggagttcatgagtcgccatggactgcatctgctcggaacaacaagcacatggttcttgcttgacattgcattctacagccaaaatcttttccagaaggatatcttcagcgcaattggttggattcctccggcaaaaacaatgaatgctcttgaggaggttttctttattgcaagggctcaaactcttattgctctatgcagtacagttcctggatactggttcactgtggccttcattgataggataggaagattcgccatccaattgatgggattcttctttatgactatcttcatgtttgctcttgccattccctatgatcactggactcttagggagaacagaattggatttgtggtcatttactctctcacattcttctttgcaaactttgggcctaatgccaccacatttgttgtgccggcggagattttcccagctagatttagatccacttgccatggaatatcttcagcatctgggaagctcggggctatggttggtgcattcgggtttttatatttggcacagaatcaggacccgagcaaagcagatgcagggtaccctgcaggtattggtgtgaggaattcactgcttgtgttgggtgtgattaacattttaggcttcatgttcactttcttggtgcctgaggccaagggtagatccttggaggagatttcgggagagcaagaagaggagaccaaggtgtaaaaataatggcaacagaataattcagtgtctttctctagtttattagtgatctgttactagaataaagccgtgccttaattcggctagggaattgttgccaaagctttcccttcccgtttgattatttctttttctatttggttctgctctatcttgttgtaatgatagggacctgaggtactgcttgttctttgaattttgagaaaatagatattggaatgtgtagttcttcctataatcttcctgctgaattagatcattagagtaattattcttgaccacgaagtttaattcattcttctacattctttcagaaatttagacttctgcactgaatatgttctc

SEQ ID NO: 1944 - DNA, 510 bp, Glycine max var. Williams 82
atggagcaagcatcccaggttgcacaaagagctgcagaagctttacgtcagtcacgaatggtccgaagccatgatagcaaagcatctaacgaattacccaacaagggaactaacaagatcaatggatttgctgctggggaatcttctggtaaagcattatcttccgccgaactattggctcaaattcgaggtaaccaagagaaagccattggtgccgggcttgaacatcagtttggtgtgttgtcaagttccactaatcaagcaagatctgtagatgctagatcttccatggctactgaaaattcatccgtacaacctgaagtattgattcggaaaatctgtacttttatacaacaacgaggtggtagttccgattcagccagcatagttcagtatttcaaggaccgtattccctcaaaagatgttgtgctgtttaagaatctgttaaaggaaattgctactctgcataaaggatcaaattgggttctgaaaccagactaccaattctga

SEQ ID NO: 1945 - DNA, 540 bp, Glycine max var. Williams 82
atggcaaccctccactctcttgcattgtcctctccactctccaactcacttcagaagccgcactcatatgcagtcccatcttcaattgttcatcaaagtacaaactcttcattcaatggtcaaactttacgcatgccatgtttgaggttacctgtgctaagacaaagtactcccatgcacatgccagttatcatgatggccaaaccaaaaatacagttcatccagggaactgatgaacaaacaatacccgatgtgaggctgaccaaatcaagggatggaacaaatggcatggctatcttcacatttgatcaaccctcggtattcgattcttccggtgaaataggtgatatcaccgggttttacatgattgatgaggaaggagtccttcagtcggttgatgtaagtgctaaatttgtcaatgggaagccctcaataattgaagccaagtatgtaatgcggagtccaagggagtgggatagattcatgagattcatggagcgatactcaaatgcaaatggtttgcaatttgtcaaaaaatga

SEQ ID NO: 1946 - DNA, 327 bp, Glycine max var. Williams 82
atgtttttgtggctctctaatttcatccgttcttggcctctactaatctatgctgccacttgggttactgtaatgacgtttacggtggcagtggcttcactctccacagaggtggcatttgtctccgccatatcttcctctgagaagtgcaagagtgatgggtcccttgttagagttagggttccggtggaggagacaccgtgtttcccagctcatcttttcaccaagtcccacatcgatgtcatcgttccaccgatctttgcagcgctcgttgtagctgcttctgcttgcgtagtaaaagttgtgggcctatgggagcatgattaa

SEQ ID NO: 1947 - DNA, 651 bp, Glycine max var. Williams 82
atggctccaccaattgagaccccaaccaaggtttccagctatcagcactccccaaaccctcgtcttaacgagaggattctttcatccatttccaggaaacatgttgctgctcacccgtggcatgatcttgagataggacctgaagctccaaagatcttcaactgtgtggttgaaattgggaaaggaagtaaggtgaaatatgaacttgacaaaagaactggtcttattatggttgatcgtatcctttactcatcggttgtgtatcctcacaactatgggtttatcccacgtactatttgtgaggacggtgatcccatggatgtcttggttatcatgcaggagccagttcttccaggttgctttctacgggccaaagctattggactcatgcctatgattgatcagggtgagaaagatgacaagataattgctgtctgtgctgatgatcctgagtataggcattacaatgatatcaaggaccttcctcctcaccgtttagctgaaattcgtcgtttctttgaagattacaagaagaatgagaacaaggaagttgcagtgaacgactttcttcctgcttcagctgcctatgaagctatcaagcattccatgaccttatatgcggaatacgttgtggagaacttgaggcggtag

SEQ ID NO: 1948 - DNA, 843 bp, Glycine max var. Williams 82
atgaaacgcatagacatgttctgtgcttctcaagcctcaacagccatatgtctgagcatggaacaagcctcatgctcctcttccaacagcattctactaggaggccgaaccatggaccgccacaaccccattatcaatgactcaagaaggagcacttccaaatccctcactgctccatgttcctcttctcagtcccccatcaaccccaagccttaccatgagctccacaaggccaagaaaaactcttcttcaaaaaatgcagcaaagggtcatgataatcatcatcagaagaaaagtacagcagaaaaactcactgaacatgtcaccaacacttctaaaccagttgatggcattgttcgtaggggttggcttaaaccacctgctaatttaatcactcctcctggttcaactagatctttgctcagtgacactgccttattggatggttcgtcagattttgatccagttttggctttaactactacggttaataacaaaacttctcaagttggtcatcaagatgaagctaatcctgtttcgaaactttcaagctcttctcatccaaaatctggttcctcagaccagcaggttgtagtattgagggtatctttgcattgcaaaggctgtgaagggaaggtgaggaaacacctctctagaatgcaaggagttacttccttcaacatagattttgcggcgaagaaggtgacagtggttggggatgtgactccattgagtgtcttggctagcatatcaaaggtgaaaaatgcacagttatggccagcatctgcctcagcagtgggatctggtactgttgaaacaaagagaaaaactttatcttattaa

SEQ ID NO: 1949 - DNA, 1869 bp, Glycine max var. Williams 82
atgagattcatttgcttcgagccgaaaacgcagtcgttttccttttcccgccacactccgccaacgagttcatcatcaccttctacaagcactaaggagagctttgaagaagcagaaactctgatactaaaatggaaccctgaaacctctgcgtacggaagagtaacctctctcttctacaacgacaaagctgaagccatgcactacatccactgcgttaacatgcttcagaaaaccatgcactctttgatctctcagaacgcttcctcgcagaaactcattctcgcccataacctaatgcaaatggccatgaagacactccagaaagagttctatcagatattatcaatgaaccgggcccaccttgaccctgaatccgtctccaccagatcctccaccacttcaacaagaacctctttctgttccgacagttacgacggcggcacagcggaagaagatgttcgcgaatcgggggattgtatctccgaagtcgaacgtgtttcttctgaagccatggcggatctgaaatccatcgcggattgcatgatttccaacggttatgcgaaggaatgcgtcagcgtttacacgaccatgagaaaatcgatcgtcgacgaaggcatttatcgcctcaacgtggaggagtttagttcctcgaaggtgaacaagatgcactgggatgtgctcgagttgaaaatcaagagctggttggaggcggttaagatcgccgtgaggacgctcttcgcaggagagaggatcctctgcgatcacgtattcggtgcgtcgcaatccatcagtgaagcttgcttcgccgagatttctagaagcggagcaaatctgctgttcggattccccgaactagtcgcaaaaacgaagaaatcgccgccggagaagatcttccggatgattgatatgtacgctgcaatagccgggatgtggtcggagattgaatcgatattctcgctcgattcaacaacagctgttaaatctcaagcctacggtcttcttctcggactctccgagtctgtacgaacgagtttatcggactttgcgaccgcaattcagaaagactcttccaaatcgacggcgaacttcgccggcgttcattccctgacagtgcaagtgatgaatcacttgactactctcgcggattacagcaacgtgctctcggaaattttcttcgacgtgccaccgccgccgaggtcgccgttgccggaatcttacttatacagtccagaatccgacaacaccaccacgacggagacggagttttcagtgcagatggcgcggcttattctgattcttctctgcaagatcgacgggaaatcaaggtattacaaggaagtttcgttgtcatacctgtttctcgcgaacaatctccggcacatactggccaaggtccgtgcgtcgaacttgcattacgttctcggcgacgattgggttttgaatcatgatgcgaaggtgaagaggttgacggcgaactatgagagagtggcgtggggcaaagtgctttcgtctttgccggaaaatccaacggcggaaatgtcggcggcggaggcgagggttatgttcgggaatttcaattttgaattcgagaaagcttatcggagagagaacacgttcaccgtgccggaacaggaatttcgagaagaaatcaaagcgtctcttgtgagaaaaataaccccaatttaccgcgaggcgtatgaaacgcaccgtattgtaatgggaacggtgagggaaataagagagtatgtcacatttgcccctgaagatgttgagaattacatgatgaatcttttctctgagggaagagcgagctccggtagcggaggaaacaagtcatgttttgtaaagtgtaaaaaatgcaaatga

SEQ ID NO: 1950 - DNA, 2372 bp, Glycine max var. Williams 82
aagtaaagtccataattgcaaacaaaatcaaatgcttactgtgagaagaaaaccaactagtcttaaacttgaaagtcaaataaatccccacatttatatttctagaaagagaaacggcgtcgttttcttcgcacgcaactgtgcctctatatataacccttccgctgccctttgcaagcacccttcatcattcatcaaatacttgcagtgccacggaaaacattattcgtcttacccgaaaacaaacacacacttcctattactgctaaaacgccgtcgtttactgaaaatatgagattcatttgcttcgagccgaaaacgcagtcgttttccttttcccgccacactccgccaacgagttcatcatcaccttctacaagcactaaggagagctttgaagaagcagaaactctgatactaaaatggaaccctgaaacctctgcgtacggaagagtaacctctctcttctacaacgacaaagctgaagccatgcactacatccactgcgttaacatgcttcagaaaaccatgcactctttgatctctcagaacgcttcctcgcagaaactcattctcgcccataacctaatgcaaatggccatgaagacactccagaaagagttctatcagatattatcaatgaaccgggcccaccttgaccctgaatccgtctccaccagatcctccaccacttcaacaagaacctctttctgttccgacagttacgacggcggcacagcggaagaagatgttcgcgaatcgggggattgtatctccgaagtcgaacgtgtttcttctgaagccatggcggatctgaaatccatcgcggattgcatgatttccaacggttatgcgaaggaatgcgtcagcgtttacacgaccatgagaaaatcgatcgtcgacgaaggcatttatcgcctcaacgtggaggagtttagttcctcgaaggtgaacaagatgcactgggatgtgctcgagttgaaaatcaagagctggttggaggcggttaagatcgccgtgaggacgctcttcgcaggagagaggatcctctgcgatcacgtattcggtgcgtcgcaatccatcagtgaagcttgcttcgccgagatttctagaagcggagcaaatctgctgttcggattccccgaactagtcgcaaaaacgaagaaatcgccgccggagaagatcttccggatgattgatatgtacgctgcaatagccgggatgtggtcggagattgaatcgatattctcgctcgattcaacaacagctgttaaatctcaagcctacggtcttcttctcggactctccgagtctgtacgaacgagtttatcggactttgcgaccgcaattcagaaagactcttccaaatcgacggcgaacttcgccggcgttcattccctgacagtgcaagtgatgaatcacttgactactctcgcggattacagcaacgtgctctcggaaattttcttcgacgtgccaccgccgccgaggtcgccgttgccggaatcttacttatacagtccagaatccgacaacaccaccacgacggagacggagttttcagtgcagatggcgcggcttattctgattcttctctgcaagatcgacgggaaatcaaggtattacaaggaagtttcgttgtcatacctgtttctcgcgaacaatctccggcacatactggccaaggtccgtgcgtcgaacttgcattacgttctcggcgacgattgggttttgaatcatgatgcgaaggtgaagaggttgacggcgaactatgagagagtggcgtggggcaaagtgctttcgtctttgccggaaaatccaacggcggaaatgtcggcggcggaggcgagggttatgttcgggaatttcaattttgaattcgagaaagcttatcggagagagaacacgttcaccgtgccggaacaggaatttcgagaagaaatcaaagcgtctcttgtgagaaaaataaccccaatttaccgcgaggcgtatgaaacgcaccgtattgtaatgggaacggtgagggaaataagagagtatgtcacatttgcccctgaagatgttgagaattacatgatgaatcttttctctgagggaagagcgagctccggtagcggaggaaacaagtcatgttttgtaaagtgtaaaaaatgcaaatgaaaagatatttcacaacaagggtgcaaaaattatttttttctggatcctcttatctaatcattttcactgaagagggttacaacttacaattacaacagacacatattattatatgattctttccttaattgaaaaaaaaaggacataaagattacaacagtgatggtgtgattgatatatatagaaatttcaagttatatacgtaaattttt

SEQ ID NO: 1951 - DNA, 861 bp, Glycine max var. Williams 82
atggaatccttcttcatgataacaccatttcaaaaccacacattccaccagcatgtttccttcacgggaacggatttgtcatggatggtggagtttctgaagggcatggtgaagcccgtggctgccaccgccgtcgtgcttctggccgtgctcttgtcctttatgcagaaactgggactcgagggtgagatggtgtatgccatgttcagagcatttcttcagctttctattattgggtttgtgttgcagttcatattcaaccaaggcaacgctggctggatcattctagcttaccttttcatggtgtgtgttgctggttacactgcaggtcaacgtgcgaaacatgtccctcgtgggaaatatgttgctggagcttccattctgacaggaactgcagtgaccatgttccttctagtgttactaaacgtgttccctttcacccccagatacatcattccagtagcaggcatgatggtcggaaatgccatgacagtaaccggtgtcaccatgaaaagactccgcgacgacatcaaagcacaaatgaacttagtagagacagcattggcacttggtgcgagtccacgacaagctacgtatgaacaagtgaaaagggctttggttatagccctttcacctgttgtggacaacgccaaaacagtgggtttgatatcgctgcctggggctatgactggtcttattatgggaggggcttcgccacttgaagccattcagctacagattgtggtgatgaatatgttgataggtgcgtccactatcagcagcataatgtccacgtatctatgctggccagcgttcttcaccaaagcctaccaattagagacccaagttttctcaaagtga

SEQ ID NO: 1952 - DNA, 318 bp, Glycine max var. Williams 82
atgcttaggtcgtttgttgggaagatagaaaagggtgtttcactactctttgttcacagaagaccaccattgaatcacttcaatgaagccacaagtgtggtgccagatgatgttagggaaggatattttgctgttcttgcaataaagggtgaagaatccaaaaggttcattgttggcttacattacttgaatgatcctgctttcttaggattattggatcaagctgaggaagagtttggtttcgggcaaaagggagctcttgcaatcccatgtcagcctcaagaactacagaagattctagatggtcgaagagtgtaa

SEQ ID NO: 1953 - DNA, 786 bp, Glycine max var. Williams 82
atggctccaaccatgcaaaactcaccattgcacctgcaaaacgagaagtatccaacaatgactaccacccgtgttgctatctgtctttgctttgcattcctttactacgcggctgaaggagccaaggttagtttcaataacaagtgctcatacacggtatggccaggaaccctaaccggtgaccaaaagccccaattatcaacaactggtttcgagttgggtccaggagcatccaactctgtggaccttccatctccatggtccggtcggttctgggcccgaacaggatgctccaacaacaacggaaggttcagctgcgccaccgccgattgcgcctccggtcaagtcgcatgcaacggtgccggtgcaatcccgccagctactttggtagaaatcacagttgcagcaaacggagggcaagatttctacgacgtgagcaacgtggatggcttcaacgtgcccatgtccgtaaccccacaaggtgggagtggcgattgcaaaacctcaagttgccctaagaacattaactctgtgtgccctgcggagcttcaagtcaaagggtccgatggcaacgtcatcgcttgcaagagtgcttgcgaggcttttaaggaagatagatattgctgcactggacctaacaacaccgcagaaacatgtccacctacgaactactctcagattttcgaggagcagtgtcccgatgcttattcctacgcttacgatgataagagcagcactttcacttgctccaacaggcctgattatgccatcacattctgcccttga

SEQ ID NO: 1954 - DNA, 702 bp, Glycine max var. Williams 82
atgaaactctctgttttccaccatcagcaccatcctatgattctcaattgcccccttaccttgacaagaacacacaaaagacttaacaacaaaggttcatataggtggttaccatgccactgctcacattcttccacaaataaaattgctgctgaaccagttacggtgtctttaagtattgaaggaaggagagcattactcagttgtctcctcacaactgttgttggagtctatgcatgtgatgtggctggagctgttagcacaagtagaagagctctaaggggagccaaaattcctgaaagtgattatacaaccttgcccaatggtttgaagtactatgatttgaaggttgggaatggagctgaggctaaaaagggatcccgtgttgcaattcactatgttgccaaatggaagagtatcacctttatgactagtagacaaggaatgggcgttggaggaggaacgccctatggatttgatgtaggccaatctgagaggggaacagtccttaaagggttggatttaggagtacaaggcatgcgggtaggaggccagcgactgttaattgttcctcctgaacttgcctatggaagcaaaggagtccaagaaatccctcccaattcaacaatagagttggacattgaattgctttctatcaaacaaagtccattcgggactccagtaaagatagttgaaggttaa

SEQ ID NO: 1955 - DNA, 1350 bp, Glycine max var. Williams 82
atggcgtcgaggcaacaaaaagaggatcgagctgaggcagctgcgaaagttgctgcgaaagaactcgaacaactcaaccgagaaaaagaccgtgatttcagtgttggtgttgcagaccaacaccaacaagaagaacatcagttagatcaacaaaagcgtggtgtaatcggatccatgttcaaggcggtgcaagacacctacgagaacgccaaggaagctgtcgttggcaagaaagaaccttcgacgacgactaactcgtacagtaccagagaggttattcacgacgttgacattcaacccgatgacgcggctgcagcgagggaagtgagagacaaatcagcctcaaagtcaccaggtatctacaattctgccactgctgacaacaaaaccggttccaaggtcggagagtacgcagattatggttctcagaaggcgaaagaaacaaaagatgcaacgaaggaaaaagctggagagtacacagattatgcttcgcagaaggcgaaggaaacgaaggacaagacaatggaaaaggctggagagtacactgattatgcttcgcagaaggcgaaggaaacgaaggacaagacaatggagaaggctggagagtacacagattatgcttcgcagaaggcgaaagaagccaaggacaagacaatggagaagggaggggaatataaagactatgctgcagagaaggctaaagaaggaaaagatgctactgtgaataagatgggagagtataaagattatacggcggagaaggctaaagaggggaaagatacgacgttggggaagcttggggagctgaaggactctgcggctgatgcggcgaagagggcagtgggttacttgagcggcaagacagaggaaaccaaagagaaagtctcggagacggcagaggcgacggctaataaggcggcggagatgaaggaggccaccagggagaaggctgccgggactgcggaggcggccaagaacaaggccgcagaggtaaaggacagagctgcagaaaccgcggaggcggccaagaacaagactgccgagactgctgaggcagcgaagcagaaaaccgcacaggcaaaggacaacgccaaggaaaatgtgagtggtgcagatgaaggagcaaggaggaaaatggaggacctaaggcttcgaggtaaagggtatggaagtcatgaatctgcaggggggcgtggagataaggtggtggtgaaagtggaagagagtcgaccaggggcaattgcggaaacactgaaagcagcggatcagattgcgggacagaccttcaacgatgtgggacgcttcgatgaagaagagggtgtcgtcaatgtggagcgccgcaagaaataa

SEQ ID NO: 1956 - DNA, 1660 bp, Glycine max var. Williams 82
atatcttacacaaaacttccacttgagagaaaagtagtgtattaagactacaaattttcaatttttcaatggcgtcgaggcaacaaaaagaggatcgagctgaggcagctgcgaaagttgctgcgaaagaactcgaacaactcaaccgagaaaaagaccgtgatttcagtgttggtgttgcagaccaacaccaacaagaagaacatcagttagatcaacaaaagcgtggtgtaatcggatccatgttcaaggcggtgcaagacacctacgagaacgccaaggaagctgtcgttggcaagaaagaaccttcgacgacgactaactcgtacagtaccagagaggttattcacgacgttgacattcaacccgatgacgcggctgcagcgagggaagtgagagacaaatcagcctcaaagtcaccaggtatctacaattctgccactgctgacaacaaaaccggttccaaggtcggagagtacgcagattatggttctcagaaggcgaaagaaacaaaagatgcaacgaaggaaaaagctggagagtacacagattatgcttcgcagaaggcgaaggaaacgaaggacaagacaatggaaaaggctggagagtacactgattatgcttcgcagaaggcgaaggaaacgaaggacaagacaatggagaaggctggagagtacacagattatgcttcgcagaaggcgaaagaagccaaggacaagacaatggagaagggaggggaatataaagactatgctgcagagaaggctaaagaaggaaaagatgctactgtgaataagatgggagagtataaagattatacggcggagaaggctaaagaggggaaagatacgacgttggggaagcttggggagctgaaggactctgcggctgatgcggcgaagagggcagtgggttacttgagcggcaagacagaggaaaccaaagagaaagtctcggagacggcagaggcgacggctaataaggcggcggagatgaaggaggccaccagggagaaggctgccgggactgcggaggcggccaagaacaaggccgcagaggtaaaggacagagctgcagaaaccgcggaggcggccaagaacaagactgccgagactgctgaggcagcgaagcagaaaaccgcacaggcaaaggacaacgccaaggaaaatgtgagtggtgcagatgaaggagcaaggaggaaaatggaggacctaaggcttcgaggtaaagggtatggaagtcatgaatctgcaggggggcgtggagataaggtggtggtgaaagtggaagagagtcgaccaggggcaattgcggaaacactgaaagcagcggatcagattgcgggacagaccttcaacgatgtgggacgcttcgatgaagaagagggtgtcgtcaatgtggagcgccgcaagaaataaaataaaacgtcgtctatgatacaaatatagacgcagtttatattatagtatattatcatgatgtatgttgtttactttttggtttgcttctttacaaaaaatgtgtatgtgtatggttttgaagattggttctagactcgtgggaaccatttcagcaataaaaattttgcgcgttcttgtacacttagtgatgagaagagatatcttctgcccactatatatcatttaaaacttctcttcat

SEQ ID NO: 1957 - DNA, 2208 bp, Glycine max var. Williams 82
atgagatctttttctttagagcaatggacaacagcaatcattcacacaaccattccctacctttatattgtttcaatttgtttgcacttcccgcctcatagacaacaaaggaaaaatatgaacttggctcctcttcatcatcttcatcacatgatgatgaagcattaccatgtcttgttcatgtttttatttttcttaccgattttcacgttaagtctccaccacaatgacactcatgcacttacactttttcgtcgtcaaagtgacctacatggctaccttctttcaaattggacaggcggcgatgcttgtatcgccgcctggcgcggcgttctttgttctccgaatggccgcgtcaccgccctctccctcccttccctcaacctccgtggagccctagaccctctcactcccctcacccacctccgcctcctcaacctccacgacaatcgcttaaacgacaccatttcgctgttattctccaattgcaccaacctccaactcctctacctcagcagcaacgacttctctggtgagatcccgccggagatatcctccctaaaatccctcctccgccttgacctctccgacaacaaccttcgcggcaaggttgatgtgatatcaaacttaacacaactcataacactaaaactccagaacaaccttctctctggcgaaatccccgacctttcatcctccatgaagaacctcaaagaactcaacatgacaaacaacgagttctacggtcacttaccatcccccatgctgaagaaattcagttccacgacgttctctggtaacgaggggttgtgcggtgcaacaccattaccaggttgctctttcaccacaacccctcctaaggataatggtaataataacaacaatgaaaaggaaccgtcgtctcagacaacggttccttcaaaccctagctccttccctgagacaagcgtgatagctcgtccagggaaagagcaacgacacaggggtttgagtcctggcgccatcgtggccatggtggtcgcgaactgcgtggcactgctcgtggtggcgtcgtttgtggtggcgcattgctgtgctagagggaggggttcgagcttggtggggagtagagagagctatgggaagaggaagagtgggagcagctacaatgggagtgagaagaaggtgtatggtggtggtgagagtgatggaaccagtggaactaataggagtaggcttgtgttttttgatcggaggagtgagtttgagttggaggatttgcttcgagcttcggcggagatgcttgggaaggggagtttggggacagtttatagggtggtgcttaatgatgggtgcattgtggcagtgaagaggctcaaggatgcgaacccttgtgcaaggcatgagtttgagcagtatatggatgtgattgggaagcttaagcattctaatgttgtgagactcaaggcttattactatgccaaggaggaaaagcttcttgtctatgattatctctccaatggatgcttgcatgctcttcttcatgggaaccgtggtccgggaagaattccattggattggactacaagaataagcttggtgttaggagcagcaagaggtctagccaagattcatgcagagtacagtgcagccaaagtgcctcacgggaatgtgaaatcctccaacgttcttctagacaagaacggtgttgcatgcatctcagacttcgggttatcactcctcctaaacccggttcacgccattgcacggttgggagggtatagagccccggaacaggaacagaacaagaggctatctcagcaggctgacgtatacagttttggagtattgttgttggaggttctcacaggaagagctccttcattgcagtacccttcaccggctcgtccccgaatggaggaagagccggagcaggctacggtggaccttccaaaatgggttcggtcggtggtgagggaagagtggactgcagaggtgtttgatcaggagctgttgcgctacaagaacattgaggaagaacttgtgtccatgctgcatgtagggttggcttgtgtggcggcgcaaccggagaagaggcctaccatggaggaagttgtgaagatgattgaggagatcagggtggagcaatcacctcttggggaggactatgacgaatcgcgtcattcactttcgccttccattcccaccactgaagatggtctagcttag

SEQ ID NO: 1958 - DNA, 1383 bp, Glycine max var. Williams 82
atgaaccccaacgatggcaacaactctcccagtcccaagcccttggagatggtcaacccggttcctccgtttctttctaagaccttcgacctcgtcgacgccccgactctcgacccgatcatctcgtggaactccacgggcctcagcttcgtcgtgtgggaccctctcgagttcgcgagaattgtccttcctcgacatttcaagcacaacaacttttccagcttcgttcgccagctcaatacttatggattccgcaagattgacacagacaagtgggagtttttcaacgaagctttccagcgagggaagaagcacttgctgaagaacatccaaaggcgcaggtcatctcaatcccagccggttggtagctatattggaatcggatcttctaccgaggcaggggggtcagaggttgagattgagatagaaaggcttaggaaagaaaagactatgctgatggaagaggtggttgatttgcagcaagagcaacgaagaacagctcaccacgcaggagaagtgaatctaaggctccaatctgcagaacaaaggcagaaacaaatggtttctttccttgccaagttgatccaaaaccccgcctttttagcccgccttagacataagaaggagcaaaaggaaatagattctccaagagtggtaaggaagtttgtcaaacagcaccatgaaactggaacaacaacaacagcagaaactctccaagaagggcagatagtgaggtatcaacctgattggagaaatatagccatgtcttctgaaactccaaaactaagttcagtttccattgaacaatctcctcactacctttcacagggtttggcaggagaaatgagtgtagtaggtgcagaagaccttactgctcaaattgacaatattgtatcagatgatttggctgcagtgcacgggattacgccgtctcaagaaatgatgattggagaaggatcatctacctttggagctgaagaccccctcttcaaagggaagagtgtcatgagtccaattctagaagttcctccagagtattttccttccttcccagagggtttgaccaaggagaagaaagactttcaagatttttctgctcttggaactgaaggcatgataaagctagaagatatatgggactctggcctcaatgttagtggtgctgctttaagcagtgggaatgagctgtggggcaatcatgtcaactatgaagagtttccacaatttggagtcacaagtggtatgtctgactcagatatctgggatattggcttaggaagttttggaattgatacgtggccaactgatgaaccttctcttggtgaaacagatggtcaatctggtcagccaaatgaagataggtctaagaattttgatccatag

SEQ ID NO: 1959 - DNA, 1077 bp, Glycine max var. Williams 82
atgtcttccttcaagagcaaattccaagatgagttgattgccaatgctagttacattggcaccccaggaaagggtatccttgcggctgacgagtcaacagggacaattgggaagcgtttggcgagcatcaacgtggagaatgttgaaacaaacaggcgcattcttcgtgagctcctattcactgcccctggttgtcttgagcgcctcagtggtgtcatcttgtttgaggaaaccctctaccaaaaatccgctgcaggagtacccttcgtggacatactaaagaaaggaggagttctcccgggcatcaaggtggacaagggaaccgtggagctcgccggaacaaacggcgaaaccaccacgcagggcctggacgaccttgctcagcgctgcaagaagtactacgaagccggagcaaggttcgccaagtggcgcgcagtgttaaagataggtccaaacgagccctctccgctctgtatccatgaaaacgccaatggtcttgctcgctacgccgccatctgccaagaaaacggcctcgtccccatcgtggagcccgagatcctctccgatgggccccacgacatcgcgaaatgcgccgacgtaacggagcgcgtgctggccgcatgctataaagccctaaacgaccaccacgtgctcctggagggcacgctgttaaagcccaacatggtgactcctggatccgaaagcgcacgtgtgaaggctgaggtcatagcggagcatacggtgagggcgctgcagaggaccgtgcctcctgcggttccggcgattgtgtttctctccggaggacagagcgaggaggaggcgacagtgaatttgaacgcgatgaatcagctgaaggggaagaagccctggtcgttgactttctcttatgggagggcgctgcagcagagcacgctcaaggcgtggggtggaaaggacgagaacatccccaaggcgcaaagcgcgttgctggtgaggtgcaaggcgaattctgaggctactcttggaacttacaagggggatgccacgcttggggaaggggcttctgagtctcttcatgttaaggattataagtactaa

SEQ ID NO: 1960 - DNA, 1011 bp, Glycine max var. Williams 82
atggacttgcagttgaagcaatggagaaaccagcatgagtcagagcaagaacaagaacattattccccaaacatggcaaaatttctatctcaacaacaacacccaccaccatttccctctgcactccctctctttgtacctgaacaacccaacaccaaagtcagcaccttgtcagcattttctgattccacattaccctcttctcccagatttcccagaatggagagttgcttcagctttgcacaatggcaagagcttgagttgcaggctctgatattcaggtacatgctggccggtgctcctgttcctcctgagctccttctaccaatcaagaaaagcttccttcaactttatcaccctcctaatttgttggaatcagggtactactggcgaagagaagcactggatccggagccggggcggtgccggaggaccgacggcaagaagtggcggtgctcgaaggacacggtggcaggtcagaagtactgcgaccgccacatgcaccgtggccggaaccgttcaagaaagcctgtggaacaacgtgaaggatctctttctgctatagactctgtttcttcttcacactctgcttcattcaatctccttcacctcggtcaaagttccgctgtggccaagagtgacagcaagagcttgtctagaaaccgtgatcatgtggatggggatggcaaatcaaatggccatgtcttgaggcatttctttgatgattggccaaggacactgcaagagcctgacaatggtgaaagcaatggaagccagaacaacaactcaggaaaatgtctttctatgtcaacaccaggaatcgatccctcggatgtgtcgttgaaattgaccactggctatggagaggacgcgtgccaggcagcttcggtgggaggaccacttgcagaggcattgagatcatccaccaccagctccacttcttcaccaaccagtgttctgcttcagttgcctcctagttctgcttgtgagaccagcttcattagcacctaa

SEQ ID NO: 1961 - DNA, 543 bp, Glycine max var. Williams 82
atgaaagagaaaaccctctcaatggctcaccaatattcctcctctaatgaatctgatagccagatcattcctcctcaaccattcaaattgaagaaaccccaccaacccaaaggcaaacaaatggggcaagaacaagaaaacgagtctcagtatctcgaggaattagtctctgactctcggccacgaaaatatagtggcaaagataataacaacatacttgggcaaatcccatctgcttcgaaaatccacaacaaggtggaaattgcattggatcacaatgctacaaaagaaggaatcacaagtgttgaaggtgatcatcaagatagtggacgtgagaagttgaagaggcatagagtggaagttgctggaagggtttggattcctgacatatggggacaagaggagatcttgaaggattggattgattgcacagcatttgatgctcctttggttccaagcagaatcgttatggcacgaacggctttggttgaagaaggtagaagagccacatcgggtggattgagaatcgagaacaggtgttga

SEQ ID NO: 1962 - DNA, 489 bp, Glycine max var. Williams 82
atggggaactgcatagttctacaagaaaacgtggtaagggtcatgaaaagtgacggcaaaatcctcgaatacaaagcacccatcaaagtccatcaagttctgaaccagtttccgggccatgcaatatccaaatccctaccagtcttacaccatctccaccccaacacaagattgctcaagggccagttatactacctcgtgccgccgccacaaccttcgccgaaaaaagtgaacaaaaagagggtgaggtttgctgaacctgatcatgatgatgatcaagtggaagataagggtgatgaggtggttaggattaagcttgttcttagtaagcaagagctgaaggacatagtgcaaaaaggagggatttctgttagagaggtgttgtctttggtacaaggaaagggaatggatggtgatgtagatgtgtgtacaagagttaacgatggttctcatgggtggaaaccagcgttagaaacaataccagaataa

SEQ ID NO: 1963 - DNA, 1014 bp, Glycine max var. Williams 82
atgtccataaaccactactccatggaccttcccgaaccgacactctggtggccacacccacaccaccaacaacaacaactaaccttaatggatcctgaccctctccgtctcaacctcaatagcgacgatggcaatggcaatgacaacgacaacgacgaaaatcaaacaaccacaacaggaggagaacaagaaatattagacgataaagaaccgatgttcgagaagcccttaaccccgagcgacgtggggaagctgaaccgtctcgtaatcccgaagcagcacgcggagaagtacttcccactgagtggtgactcgggcgggagcgagtgcaaggggctgttactgagtttcgaggacgagtcggggaagtgttggcgcttccgctactcgtactggaacagcagccagagctacgtgctcaccaaagggtggagccgctacgtcaaggacaagcgccttgacgcgggcgacgtcgttttgttcgagcgtcaccgcgtcgacgcgcagcgcctcttcatcgggtggaggcgcaggcggcagagcgatgccgccttgccgcctgcgcacgttagcagtaggaagagtggtggtggtgatgggaatagtaataagaatgaggggtggaccagagggttctattctgcgcatcatccttatcctacgcatcatcttcatcatcatcagccctcgccataccaacaacaacatgactgtcttcatgcaggtagagggtcccaaggtcagaaccaaaggatgagaccagtgggaaacaacagttctagctctagttcgagttcaagggtacttaggctgttcggggtcgacatggaatgccaacccgaacatgatgattctggtccctccacaccccaatgctcctacaatagtaacaacatgttgccatcaacacagggcacagatcattcccatcacaatttctaccaacagcaaccttctaattccaatccttcccctcatcacatgatggtacatcaccaaccatactactactag

SEQ ID NO: 1964 - DNA, 1401 bp, Glycine max var. Williams 82
atgtccagcgccgccggagctcccgatcgccgcgcctctccgccgcgggtggctgccggcgcccccacccgcccgccgctcaagcgccacctcgccttcatcacgaaaccgcccttcgccccgcctgacgagtaccacagcttctccagtattggctcccgccgcgccgccgatgaagccgtcgtcgttagatctccgtacatcatgaagcggaagagtggaatgaatgacagtgaaggggagtcactagcacaaaagtggagtaacagtcctggatacactaatgttagcaatgtaacaaataatagtccctttaaaactcctgtgtctgcaaaagggggaaggacacagaaggcaaaggcttccaaaggcagatcatgtcctccgacacccatctcaaatgctggttccccttctcctcttactcctgctagcagctgtcgttatgacagttccttaggtctcttgacaaaaaagttcatcaatttggtcaaacatgcagagggtggtattcttgacctaaataaagcagcagaaactttggaggtgcaaaagaggagaatatatgacataactaatgttttggaaggcattggtctcattgaaaagaagctcaagaacagaatacattggaagggaattgaatctgctacatctggtgatgtggatggtgatatctctttgcttaaggcagaagttgagaaactttctttggaggagcagggaatagatgatcaaataagggaaatgcaagaaaggctgaggaatttgagtgaaaatgaaaacaaccagaagtgcctttttgtgactgaagaagatattaaggacctaccttgcttccagaatgaaactctaatagcaattaaagctccgcatggaaccaccctggaagtccccgatcctgaggaagctgtagactatccacagagaagatatagaatcattcttagaagcacaatgggtcccattgatgtctatcttatcagtcaatttgaagagaaatttgaagaagttaatggtgctgagctcccaatgatcccacttgcttccagttctggttccaatgagcaactaatgacagaaattgttactgctgaatgcagcggaaaagaacttgaacctcaaactcagctctcttctcatgcattctctgatgcttcacaagagtttgctggtggcatgatgaagattgtcccttcagatgttgataatgatgcagactattggcttctatcagatgctgacattagtataacagatatgtggagaacagattctagtgtcgattggaatggtgtagacatgcttcatcctgactttggagtcatttcaaggcctcaaactccatcatctgggtttgctgaagtgccatcaacagcagcaaactctattcagaagtga

SEQ ID NO: 1965 - DNA, 645 bp, Glycine max var. Williams 82
atggaagagaccaaatccaagttcaagaggatttgtgtgtactgtggaagcagttctggtaacaaagccagttaccaagaagctgccgtggaacttggcaaggagatggttgagagaagaattgatttggtctatggaggtggtagcgtgggtttgatgggtctagtttctcaggcggttcatgatggtgggcgccatgttctgggcgttatcccaaaaagcctcatgccaagagagataactggtgatcctattggggaagtgagagcagtatctgatatgcatcaaaggaaagctgagatggctcgtcaagctgatgcattcattgcccttcctgggggatatggaacactcgaagaattgctggaaatcattacatgggctcagcttgggatccacagcaaaccggtgggcctattgaatgtggatggattttacaattccttgttgtctttcattgacaaggccgttgatgaaggctttatttcaccaaaagcacgtcgcattatcgtgtcagcacccacagctaaagatttggttagggagctagaggaacatgtacctgagagagatgaagttgtatccaagttggtgtgggaagacaggctaaattacgtggtgcctgaatcagaagttgccatgtga

SEQ ID NO: 1966 - DNA, 921 bp, Glycine max var. Williams 82
atgaatgacttgttctctggctccttctcccgcaacaacgaccaagtcttgcctgaccaccaccaccatgtgatcgagatggcggccgcgtcatcaccaacagccgagggcagcgcgaaccttgaaaagttctttcaagaagttgagcaggtgaaagaggacctgaaggagctggagcgtctccatgagaatctacgtgggaaccacgagaagagcaagacccttcacagcgcgaaggctgtgaaggagcttcgctcacgcatggatgctgatgtggcactcgctttaaagaaagcgaagctcgtcaaggtccggctcgagacgctggaccggtccaatcaggtgagccgaaacttgcctggtttggaacctggttcgtcctcggaccggaccagaacgtctgtggtgagcggactgaggaagaagctgaaggactctatggacagcttcaacagcctcagacaacagatatcatcggagtacagggaaaccgtgcagcgtagatattatacggtcaccggagagaatcccgatgacaaaaccattgacctcctcatttctactggtgagagtgaaacattcttgcagaaagcgatcgagcagcaaggtagagccagcgtgatggacacaatccaagagattcaagagaggcacgacacagtcaaggaaatagagagaaacctaaacgagcttcaccaagtgttcttggacatggccgtgttggtgcaatcccagggagaacaattggacgacatcgaaagccacgtggcacgcgccaattcatacgtgcggggtggggtccagcagctgcacgtggcaaggaagcaccaaaagaacacccgaaagtggacatgcatagccatcatattgctcattattatcatcttgatcatagtcctccctatagttctaagaaaatga

SEQ ID NO: 1967 - DNA, 2088 bp, Glycine max var. Williams 82
atggttccgtcaaataccgtaacggcattcaccgcaaagccgtctccgttattaactttcgtaatgctcatcgtcctcggcgtggtgggattctattccctgcatttccctccccgtcccaccacctcccccgacccctcgcgcttccgccacgtgttcgtatcgtcttcgtcgaactccactgtcgcgagctacctccgcgccctcaccgtgcaccctcacctctctggaacaaaacccgcctcgttaaccgcacgctatgtggtgaaccatttcaccaccctcggctttcaaacaaaaacagtacaacactctgcgctgctatcctacccggtgcgctcctcgctcgccgcgcattttagcgacggcacgagtttcgagtttcagttaaccgaaccggacactgagaaggaagtggtggcgccgtaccacgcatactcgccgtcaggtgcggcggaggcggccgcggtgtttgtgaactacgggcgggaggaggactaccgtcagctggtggctgcgggggtggaggtggcggggtgcgtggtggtggcgagaggcggcgcactgccgcgcggggcggtggtggaggcggcggagaggcacggtgcggcggcggcggcggtgttcgtggagagggacacgtggcgcgaggggtttgagagagggcacgtgatgagaggggggataggggacccactgagtcctgggtggagtggggtggaaggtggtgagagtttgggtttggaagatagtgaggttttgaaaaggtttccgaaaattccatctttgcccttgtctgctgaggctgcggagaggatcttggagtcgcttggtggtgctcctctgcccttggattggaggggtaccctaaagtcatccaaggttaagaatgttggcccgggccccaccatcctcaactttacttatcagggtgaattgaaggtggctaccattgaaaacgtttttgccattatcaagggacgggaagaacctgatcgatatgttctgcttgggaaccatagagatgcatggacatatggtgctgttgaccccaacagtgggacagctgctctacttgacattgctggcagattttctattctattgcgtttggggtggactccacggaggaccatcattctatgcagttgggatgcagaggaatttggaatgataggatccactgagtgggttgaacaaaaccttgtcaatcttcgttccaaagctgtagcatacctcaatgtagactgtgctgttcaagggcctggtttctttgctggctcaactcctcagctagatgatcttcttgtcgaggtcataaaacaggtcaaggatcctgacactgaaggtactacaatatatgagaattgggcagctgctggtggaaactctaatattcaaaggctcagtggtgttgattctgatttcgctccatttgtgcaacatgcaggggttccatctgttgatgtatattatggaaaagattatcctgtctatcacactgctttcgattcctataactggatgacaaagtttggagatccattctttcagcgccatgaagctgttactggaatttgggggcttctagcccttcgccttgctgatgattccattatacctttcaattatctttcttatgcgaatcagttacaggtctacaataacatattgagcaacttgttagacaagcagattactctacatccactaaatacttcgattcaagaatttgcttctgctgccaaagaagctaatgatgaatcaaagaaattaaaatggcaagaagcttcagatcgttctatagatatgaaaatgcgagcattgaatgatagactaatgcttgcggaaagaggcttcttggacgttgatgggcttcaaggaaggcaatggttcaagcatcttgtttttgggcctcccagcgaccatgaaagcaagttggatttcttccctggaatcgctgactctctgtctgggatggataaaatgagtgaaaaagaaaggcttgctgcaattcagcatgagatctggagggttgccagggccattcaaagagctgcttcagcactaagaggggatttggcttaa

SEQ ID NO: 1968 - DNA, 315 bp, Glycine max var. Williams 82
atggcatcattcaccatgacagcttccatccttggctgcccagccgtcaccaaccggtcggcagcggcgacgcagaggagatcagtggtagtgaatgcagccagcaaatctgttgaaggggaaaaggtcagttatgacaacaatggtagcaatgcaaggaggaacttgatgttcgccacggcggcggctgctgtttgctcttttgctgcagggatggcattggcagatgagcctaaaccaggaacctcagaagccaagaaaaagtatgccccggtttgtgtcaccaatcctacagctaggatttgtcgcaattga

SEQ ID NO: 1969 - DNA, 180 bp, Glycine max var. Williams 82
atggacatgaagaaggttacctgtgccgttctcatcgctgccgcctccatgagtgcagcactggctgccacagaggtccctgcgcccgcccctggccctagcagcggtgcctcagccgcggccgctgtcggctccttggttggtgcctcagtcttgtccttctttgccttgttccactaa

SEQ ID NO: 1970 - DNA, 789 bp, Glycine max var. Williams 82
atgcatggattctcccatgttgatggttttgtggaaataagcaactgcttggcggaaatgattaaatacgcagccaatgaaccgtctgccggtctcttctttatccaacatcacactcaaaatgcagtgccaaatgtcatcaaacttaagaacaacattattgacaagtctcacgaaacaactttgcagaccgaagatttggaggattccgtcgcaatggtgagatcaatgaaagagtgtggattccccatagctgatgagatgatcggagacataaaaaaatcactggtaatcatgacagccaagcatccaaaaggaagaaggcttatccatcagtcaacatcatattttcagacagacagagctaaccctgcagtttattcccaggagggaataagtgaaatgaggggtaactatttttcaagtgtttttagcttttctaaacagaagactaaaactaaaagtctcaacaagtggccacaacttgattctatgggatcggtaaattccaacaccgagaagcaactgatgtaccatagcatgtcattgccagatgcatctgcaaatagtactgcatcttcacaagctgacaagccggtatcaagccaggttgaaggtgaatctcgacctgaaccaagtgatattggggataagttattgtcactatcagaaaattttgatgacttcaaagctagtaaacaagctaagctggaggattggcttgaaggaactagcaaccatggggagaattgcctgccaggtgatgagaaaatggctctgagaaaatga

SEQ ID NO: 1971 - DNA, 1395 bp, Glycine max var. Williams 82
atgcctctacacattgcaatgctcccgtggctcgcagtgggtcatgtgaacccttatttggagctgtcaaagattcttgctcaaaagggacactttgttacctttataagcactccaaaaaacattgatggcatgcccaaaatcccggaaaccttacagccatccatcaaattggtgaggctacccttgccacacacagatcatcatcatcatctcccagaagatgctgagagcacaatggacattccctcaaacaaaagctattacctcaagctggcttacgaggctctccaaggccctgtatcggagttgctcaaaacttcaaagcccgattgggttttttacgatttcgcaaccgagtggttaccaccaatagccaagagcctcaacattccctgtgcacactacaacttaaccgcagcgtggaacaaagtgttcattgatccacccaaggattatcaactgaacaactcaattacgcttcaagacatgtgtctccctcccacgtggcttcctttcaccacaaccgttcatctcaggcctcacgaaatcagaagagcaacaagttctatcaaagattcggacacaggacgcatggcaaattttgatctcagaaaggcatattccagctgcgacatgtttcttctcagaacatgcagagaactcgaaggagaatggttggattatcttgctcacaagtacaaggttcctgtggttccggtagggttggttccaccatccattcagataagggatgttgaagaggaagacaataaccctgactgggtcaaaattaaggattggttggacaaacaagagtcatcatccgtggtttatatagggtttgggagcgagttgaggctgagtcagcaggacgtcaccgagttggctcatggtattgagctttctgggttgcgtttcttttgggctttgaggaacctgcagaaagaggatttgccacatgggtttgaggagagaaccaaggaacgtggcattgtttggaagagttgggcaccccagattaagatcttaggccatgcagctattggaggatgcatcactcactgtggtaccaattctctcgttgagatgcttaattttgggcatgtgcttgtgactcttccctatttgctagaccaagctttgttttcgagggtgctagaggaaaagaaagtgggtattgaggtgccaaggagcgagaaagatgggtcctttactcgagacgatgtggccaagacattaaagttggcaatagtagatgaggaagggagtgattataggaagaatgccaaagaaatgggcaaggttttcagttccacggatcttcatagtcgatacattgacgactgcattgttgctcttcaaaagtacaagactcctaattccaactgttaa

SEQ ID NO: 1972 - DNA, 1149 bp, Glycine max var. Williams 82
atggcaacaccaaagattcacttgcttgtttcgtctttcttgttgtgtggtaccttcctgagcttgttccactgcacattgtcccttctgaaccctgaggatggggttggcattctggtgcaagctgatgatgatgttagcatggcccaaagcaacagagattctaggaagagatgtgacatttctgttggaaaatgggtttatgatgactcttaccctctctatgactctagttgtccatatctcagctctgccgttacttgtcaaaggaatgggagacctgattctgactatgagaagtggaagtggaagccaagtggttgtaccatgccaagatttgatgcactaaggtttctaggaagaatgagaagaaagagaataatgctggtgggcgattcaataatgagaaatcagtgggaatctcttgtttgcttagtgcaaggagttattccaactggtcgaaaaagggtgacttataacggacctggaatggccttccatgccatggattttgagacctcaattgagtttttctgggcacccctgttggtagaactgaagaaaggttcagaaaataagagaattttacatcttgatttgattgaagaaaatgcaaggtattggagaggagttgatatccttgtatttgattcagcccattggtggactcacccagatcaaaccagctcgtgggattactacctggagggaaacaatctcaccaggaatatgaatcccatggttgcttaccagaaaggactcagtacatgggcaaggtgggtggatcaaaatctaaaccctaggagaactgaagtcatttttagaagcatgtctcctaggcataacagggaaaatggttggaaatgctacaatcagaagcagcctctaccattttccagccacctacatgttcctgaacctttggcagtgctacaaggagtgttgaagagaatgagatttccagtatatctgcaagacatcacaacaatgaccgcgttgcgcagagacgggcatccctcggtatataggagggtaataagccaagatgagaagcagaaaccaggaaaaggccattcctctgattgcagccattggtgcctccctggggtgcctgatatttggaatgagatgctgagtgcactgctgtga

SEQ ID NO: 1973 - DNA, 1353 bp, Glycine max var. Williams 82
atggcggtttcttcttctgcaacaaaatgggtcctcttcttgcttctggcgctgctcattcgagaagaagccatggccatggctactaccccacagatctctgacctcaggaatgttgaagttgaaagacacaggttgccgagcttgacgaactcgtcaatggtggagagggcaaaagaggctgacaaattaaatgaacaagctgctgtggctaacccagaggaagtggtttcaatggttgagatgagcatccagaacagcacagagagaaggaagttgggatatttctcttgtggaacaggcaacccaattgatgattgctggcgttgtgaccccaactggcaacgcaaccggaagcgtctggcggattgtggcattggttttggccggaatgctatcggtggtcgtgatggaaaattttatgtggtgactgaccccagggatgatgaccctgtgaacccgaaacctggcactcttcgccatgctgtgatccaggacaggcccttgtggattgtgttcaagagggacatggttattcagctgaagcaggagctgatcatgaacagctttaagaccattgatgctagaggagtgaatgtgcacattgctaatggagcatgcatcacaattcagtttgtaaccaatgttatcattcatggcttgcacattcatgattgcaaacctactggaaatgctatggtgagaagctccccaacacattttggttggaggacaatggctgatggagatgctatctccatatttggctcaagccacatttgggttgaccacaactccttgtcacactgtgcggatggccttgtggatgctgtcatgggctcaacagccattactatttccaacaaccacttcacccaccacaatgaggtgattctactaggccacagtgactcttacacaagagacaagctgatgcaagtgaccatcgcatacaaccatttcggagagggacttatccagagaatgccacgttgtagacatggatatttccacgtggtgaacaatgactacactcactgggagatgtatgctattggtggaagtgctaaccccaccatcaacagccagggcaacagatacaatgctcctactaacccttttgccaaggaggtgactaagagagtggaaacagcagaaacccaatggaagggttggaattggaggtcagagggagatttgttactgaatggggcctatttcactccatctggtgctggagcctcagccagctatgctagagcctctagcttaggagcaaaatcttcttccatggttgattccatgacttccaatgctggtgcactaggttgcaaaagaggccgtcagtgctag

SEQ ID NO: 1974 - DNA, 279 bp, Glycine max var. Williams 82
atgtttagtgacctcacagtcttgctcccaagcctaacacaactcgtagtcttgcactcagtgcagcagccaatactcgagcttgctcatccttggcccgagtgggtccaactcatgaagtgcttgctcgacaagggatacttctgtcgtgaagagggaaaaatgttatgcaatgctggtatgggcatgaaggatttcaatgtcattagaaccgtgtgcctcaattttggtagagaccactttcatcttttaaggtttggccgtgatttagaactctga

SEQ ID NO: 1975 - DNA, 222 bp, Glycine max var. Williams 82
atggccgccaatactcgagttgcagccaacccatgggtggcttcggtttctcatccttggccagagtggatccaactcatgaagtgcttgttcagcaaggggatactttgtcatgaggaggaaaaaatgttccgcaatgctggtatgggcatgaaggatttcaatgtcattagaattgtgtgcctcaattttggaagagaccactttcatcttttaagataa

SEQ ID NO: 1976 - DNA, 1272 bp, Glycine max var. Williams 82
atgttgcaggatgttatccacccctcaacaccggctgagcaactccccattgatgagatttcaagcccgattagtgctcgaattttcgaactttgcgagcctgatttcttcccagacacactgcaaaattcagatgttacttccagctcaaattgttgccatgaagagaagtcctcatatgccacaaccatatctccacctttagatttagtagacaacaagatcaatatcaataacaatagcaacatagtcactactacctcatctagcactaccacaaccagcaccacaaccaacaacaacaacaacaacacaacgaacagcaataacctgtccatcctctttgacactcaagatgaaattgacaatgacatctcagcctccatagacttctcatcatgtcgatctttagttgttccaccacttctctcaatctcaactcagcaggatcagtttgatttctcttcagctcagccacaggtgcaactatcagcagcagcaggttcagttttgaagggcctctctcactaccctacagatcatgtgattgcaccccttattggatctccgttaccatctgtttttgatgaagattgcatatcttccatcccttcttatgtgcctctcaacccatcatcaccctcttgctcttatctcagtcctggcataggagtgtacatgcctcctcctggttcccttaacactgccttatctgctgacagttctggattgtttggtgggaacattctactggggtctgaactgcaggcacatgaattggactatcagggagaaaatggtggaatattttgcacagattcaattcagagggtgtttaaccccccagatcttcaggcacttggtactgagactcagaaacttgtagctggggctggaagttctgccactttgacaccagaaatctcacacttggaggactctaacttgaaagttggaaaactctctgttgagcagaggaaggaaaagattcatagatacatgaagaagagaaatgaaagaaatttcagcaagaaaatcaagtatgcttgccgcaaaactttagcagatagccggccccgggttagaggaaggtttgcaaagaatgatgagtttggagagagccatagacaaggaagtagcaatcatgaagaagatgatgaagaaataattgtgaaagaagatgatgatatggttgattcctcagatatctttgcacatatcagtggagtgaactctttcaaatgcaactattccatccagtccttgatttga

SEQ ID NO: 1977 - DNA, 1491 bp, Glycine max var. Williams 82
atggcaatggagaatacaacattgtttgtgttgctgctgaatgtgcttcttgtgttcagtgcctctcttgtgtccgcagagcaacaaagtcaagcctcagctgtaggggacccaggaatgcaaagagatggtttaagggtggcctttgaagcttggaacttctgcaatgaagttggtcaagaagctcctcacatgggtagtccaagagctgctgattgttttgatctttcaggttctctgactcacaaggtcacagaagctgataacagacttggggtgggggactcatttcctggtataaatccagaaaatatcaacaacacagacctttatgcaattgaaaaggaattgtatttgggttctctatgtgaagttgcagacaccccaaggccctggcagttttggatggtaatgctgaaaaatggaaactatgacaccaggtctgggttatgtcctcaggacgggaaaaaggtacccccttttagcccgggaaggtttccttgttttggacaagggtgcatgaaccaacccatcttgtgtcatcaatggacgcagctcaaagatggcacaatgcaaggggggttcagtggtacttatgatttggattctggttgtggaggtgaacaggatggtgtgtcttactatgaggtagtttgggagaagaaagttaatgttgggagttggatgttcaaacacaaattaaggacttcaaagaagtacccttggttgatgttgtaccttagagctgatgcaaccaaaggattctctggaggttaccattatgacacaaggggaatgctaaaaactcttccagaatcaccaaatttcaaggtgaagttgagcttggacatcaaaaaggggggaggtggcaagagccaattctaccttttagacattggaagctgttggaagaacaatggtgctccttgtgatggagatgtactaactgatgtcactagatatagtgagatgatcataaaccctgaaaccccggcttggtgcagccccaaaggcttggctaactgtccaccatttcatatcactccagacaacaaaaaattcttcagaaatgacacagccaatttcccctactcagcatatcactattactgtgctcctgggaatgctcaacacttggagcaaccagtgagcacttgtgatccttatagtaatcctcaagcacaagagatagttcagttgcttcctcaccctatttggggtcagtatggctatcccaccaaaaaaggtgatggttgggtgggggatgcaaggacttgggagcttgatgttggagggctatcaagtagactatacttttatcaggatccaggcacttctcctgccaagagaatatggacatctattgattctggtactgagatatttgttagtgacaaagatgaagtagcagagtggactcttagtgactttgacgtcattctaacacaatcagggaccaacttgatgaacaaggctgagagaaagaagtaa

SEQ ID NO: 1978 - DNA, 825 bp, Glycine max var. Williams 82
atggatacttcttataggactggtggagtcaagtacgagtgcttgctttttgatatggatgacactctttacccattgagcttaggtctcaatttgttttgtcgcaagaacatacaagagtatatgttagaactcttgcatattgaagagagtgaagtgccaaaaatgtgtttggatttgtatagggaatacgggacaactatggcaggattaaaggtccttggttatgagtttgacaatgacgagtttcatgcttacgtgcatggaaggttaccatacgagaaactgaagcctgatccagtattaaggaaccttctgctttccatgcctcagcgtaaaataatattcaccaatgcagatcatgcacatgcagttaaagttctcaacagattgggtttggaagattgttttgagggcatcatatgctttgaaacgcttaatcctcccaaacaaatcaattgcatggatgtaccaaatgataatcatgtgctcacagatttaacagaaaatggatgtttcaattcccacccacaaatcctctgtaaaccatctgtggaagcctttgaagctgctattcggattgctaatgtggatccaaagaaaacaattttctttgatgacagtgttagaaatgttgaaagtgcaaaaataactggacttaacactgttttagtgggccattcagatttggtccctggagctgatcatgccctgaacagcattcataatatcaaagaagcgttacctgaaatttgggagattgaagatggcaaccaacagcaaaagattcaacccccaacagttgaaaccatggtcctagcttaa

SEQ ID NO: 1979 - DNA, 672 bp, Glycine max var. Williams 82
atggctaaccataccatgaagctggtcaacttgctgcttctcgtgactttggctcagctcttagccaccgctatctcttcagatcctgaccttcttcaagacctctgtgtcgccgaccttgcctcaggtgtgaaagtgaatggatttacctgcaaagaagcaaccaaggtaaatgcctcagatttcttttccaacacactagccaaaccaggagccacaaacaacacctttggttccttggtgactggagccaacgttcagaaagtcccaggactcaacacactcggtgtctctctgtcaagaattgactatgccccaggtggcataaacccccctcacacccacccacgtgccactgagattgtgtttgtccttgaaggccaactagatgtggggttcataaccacatccaatgtgctcatatcaaagaccattaacaagggtgacatatttgtgttcccaaaaggcttgcttcacttccaaaagaacaatgctaaggtttctgcttctgtgatttcagccttcaatagccaacttccagggacacagtccattgctacaaccttgtttgctgccactccatctgttccagaccatgtcctgacccagaccttccaggttggaaccaaggaggttcagaaaatcaagtctaggcttgcaccaaaaaagtaa

SEQ ID NO: 1980 - DNA, 1266 bp, Glycine max var. Williams 82
atgagaatggggaacctcttctggcttggcattgttgcagcacttgttttcagcttctgggttgattccttttctgcctatgaatatcaccacttcaatgaaaccgagttctctttgttggagtctcaagaacaggtacattcatccctccttgggagaacttctctcatggttggactcacagttattcaaagtgctgctggcaaaggagcagtttgcttggatggaacattgcctgcttatcatttgcatcggggatatggatcaggagcaaacagctggatcgttaatttagagggaggtgggtggtgtaatgacgttagatcatgtgtttatcgcaagaaaacacggcgtgggtcatcaacattcatggaaaaacagataccttttactggaatattaagcaataatgttgaagataatccagattttttcaactggaacagagtgaaaattcgttattgtgacggtgcctcttttgctggggatggtgaagataaggctgcgcaactgcaatttagaggacagcgtatttggtcggcagcaatcgaagatttgatgtcaaagggaatgcgatttgccaggcaggctcttctttctggatgctcggctggtggtttggctactattatacactgtgatgaattcagaggttttttcccacagactacgaaagtgaagtgtcttagtgatgcaggattatttcttgatgcgattgatgtctccaggggacataccatcaggaattttttcagtggtgtcgtaaggctacagggagtgcaaaagaatctgccacacatttgtactagtcaccttgatcccacttcgtgcttcttccctcagaatttgattgctggtattagaaccccgctattcattcttaatactgcctatgactcatggcaggtccaatcaagcttagctccttcatcagcagatccccatggcttttggcatgattgcagattaaatcatgctaaatgtacttcttcacaaatccaatatttgcaaggattcaggaatcaaatgctgaatgctattaaaggcttctcaagatcacgtcagaatggattgttcataaattcatgttttgctcactgccaatctgagaggcaggatacatggtttgctgacaactctcctgtcattgggaacaaggcaattgctctttctgttggagactggtatttcgaccgagcagttgttaaggccattgattgtccttacccttgtgataatacatgccaccatcttgtcttcagatga

SEQ ID NO: 1981 - DNA, 3655 bp, Glycine max var. Williams 82
aagcccatagtgtcctctatatactaggacaaagaaaaaacagcatccttcactataagaaagcatttttttttcctctcttcttatttaagaaaattacaggcttaagtattgaaggaccaccttgaatcttacacagcttgagttcacaaatggggttgatggaagattccaaagatgaggggacatgtgaagggtgaaccaactcaataaataaagaagggaatgttgctcaatctgcatttattggatataatgtaacaattaatacatcatgccatcggaaagtagcgtaacatcacacacataaagttaatcaaaattatttaatatttttataccaaaataaaaaaggggagaaaaattcgaacaaaaagaggggggaggggggtaccctattatgcccaaaaagcgaacatcaataaagtgacatgaggcagcatcattttcatcgaagtgttctccacaacttggaaggtgatcatctccaattttccatcatggctactgagacttctgcatctgatcatgcttctactactgatgagcattatgtgaagaaggaaaaggacgagtccattgcacaaaagatcgcttctttagcaaatgaagatgaagtcaaacatgacaatactccttcatctaagacagaagaagatgtggtgaaggcagagcttgctgcagctgaggtcgaaaaatccgacgattctctggcgttagaggcttctgctgaagatagtgtgaaacatgacagggttgaggaagcacaaagtgcaacaccacccccaacagaaggagatgatcacaaggttgagcctgctgttgcagtagaaaagattgaagattctgtgccatcagatgaatctgtcgttgcagttgaagacagtgtaaaggaggagaaggaagtggttcctgactcacacactatcagtgacattgaaccagttcatcaggcaccatccacagaacaagctgtggagaaaacactatcacaggagctagaaaaggaacctgtggaaacagatgaagagaaacaagtacaaccgaaggcagaagacgttccagaagcatcggcttcagccgttgaaaaaccaagcaacacagatgagactagtcctctgacagaatcagaaggagaggtggtgaaagaggctcaagttttggaaacaagtgcccaagtggaagagcagcctgagactgaggctgcaccagtgcaggaaaaaccagaaaaagagcaaccgagcacggttgttgcggtatctgagccggtggctacagaagtagaggaaaaaacagaagaaccagaaaaagaattgcaagaagctgagaaaccaagcatagttgcagttcctgagcctgtggttacattagttgaggaaaaaacagaagaaccagaaaaagaatcgcaagaggctgagaaaccgaccacagttgcggttcctgagcctgtggctacacaagtggaggaaataacagaagaatcaagtgcagttggggttcctgaaccatcagctgaaaagaaatcgagtgataccatagaggaaaaagcaacaggaccctcagaagatgtggtggaagagaccaagaacagtgaaacagggcctttggaaacagtggaagcagaacatgtggttcctgaagttgatgaaagccagacagaaccagaaaagcaatcattggaacaaaaggaagaagaggagaaacaagacacatctgcagttcctgaatcctcagaagaaagtggtgatgccatagaggtaaaaacaagagaactagaatttgaggcagaggtattgaaagagactaacaactctcaaacagagaaagcagaacctgtggaagctaaagttgatgaaaaccagagtcaaacagagaaagcagagcccgtggccgccaaagttgatgagaaccaaagtgtaatagagaaaacagagcttgtggctgctaaagttgatgaaaaccaaagtgaaccagaaaaacaagaggaagaagagcagcctaagacagttgttcctgaaattgaagctgaaagtgaagagcaactagaaaatatagtggaggcttaccctcccaaagactcagtgattgaggaggtaaaagacacagacaatggcaactcagagcccaaagcagttcctgaaaaaacagagaaaccagtacttctgtcaactgaagtggaggaaaagccaagagagcaactacaagtagatgaggaagtagcagaagctggtaaggaagtggagactaagcaagaaattgtgcttgagactgccaagagtgaagaaacttcggctggcacggtcacagaagagaaaactgataaagacgaggaaactagcctcactgaaaatgctgagcaagttttatcaaatgtggaacctcaacaaaatcctggggaaacttctccagaagttgtgcttgagacttccaagagtgaagaaacttcagctgacacggtcacagaagaggaaactagtttgactgtaaatgctgcacaattttcatcaaatgaggaacctcaagcaagtattgtggaaccttctcctgaagcagcagaaaaggttgttgaagaggttgatgacaagaaagaatcaagcatcactgacgtgattgaagcagtattaaacgaagcggctgacatcaagaaaactccagaacaagcctccattgatgaggaagccaaaactgagctaaaagaagaaagagagatttctgttcctgctgctgtggaggaaaaggttgctgttgctgcaattgatgatgttgacaagaaggaacctgaagcacctaatgtttcccctgaatcctcacaagaagaagagtttgaaagcaaaagggttgaggaacagaatgaggcaaaggcagctacaactgaaacagtagagagtgtgaaagttgataatgatagctcaatagttgatgacaagaaggaagagaaaactgactcaaaggtggaagaaatctctagagctattaatgaacctgttagagaaacattggcatctaaatttgaagaggaaactgttgaacctggagcggataaggtagagaaagaacaaactgtggagcctgagaaaactgaggaggttcaagccaccaaggaaagtgatgcaacaaaaacatccaaggaccttccaaaagaaactccagcaaaaccagctcaaaagcaatcaaataacatcatatcaaaggttaagcagtcactagtgaaagcaaagaaagctatcactgggaaatctccatcctccaaaaacctttcctcggatgctaagggcgatattaaagtcaaataatggaactgagtgaacaagtttgcagcatttacgtatttgctttctttcttttttttcgttgtcgtggtgcatagcattatagcatatttgttggtttttatacattgtaatttttctcttgaatttgtttgaatgcaaaagggtgtgcagagtgtagtgtatatagaagatgaactaggccatgcattaggcagtgctgtaaaatttgattgttttgttctgttttattcttttggataatatgcattgtgctttttgtttgttgttgataaacgagaaaggcaattttaacttgtgtatagtttacttgtttgaacgttctgtaaaaagacctcataatgatctagtattgattgtttact

SEQ ID NO: 1982 - DNA, 174 bp, Glycine max var. Williams 82
atggccggtgacggtgcagctacatgcatagacatccttcttgccattattctccctcctcttggtgtctttctcaaatatggttgccaggtggagttctggatttgtttggtgctgaccctttttggttatatacctggaattatctatgctgtctattctatcaccaagtga

SEQ ID NO: 1983 - DNA, 1170 bp, Glycine max var. Williams 82
atggataccttcctgttcacttctgagtcggtgaacgagggtcatcccgacaagctgtgtgatcagatatctgatgcagtgctcgatgcctgcctggagcaagaccctgaaagcaaggttgcctgtgagacatgcaccaagaccaacttggtcatggtatttggagagatcaccacaaaagccaatatagactatgagaagattgtgcgcgatacgtgccgttctataggatttgtgtctggtgatgttggccttgatgctgacaagtgcaaggtattggtgtaccttgagcagcaaagtcctgacatagcacaaggagtccatggccacctcaccaagcgaccagaagacataggagctggcgatcagggtcacatgtttggctacgccacagatgaaacacctgagcttatgcctctcagccatgtccttgcaaccaagcttggcatgcagctcactgaagtgcgcaagaatgagatctgtccttggttaagacctgatggaaaaactcaagtcactgttgagtatgctaatgatcatggtgcaatggtcccggtgcgcgtccatactgttctcatatccactcaacatgatgaaaccgttaccaatgatgagatagcagcagacctgaaagagcatgttatcaagcctgttattcctgagaagtacttggatgaggagacaattttccatctcaacccatctgggcgttttgtgattggtggtcctcatggcgatgctggtctcacgggtcgcaaaatcattgtcgacacatatggtggttggggagctcatggtggtggggccttctcagggaaggaccctaccaaggtggacaggagtggagcctacattgctagacaggctgccaagagcattgtggccaatggacttgccagaaggtgcattgtgcagatatcatatgcaattggtgttcctgagccattatcagtgtttgttgacacttttggcactggaaagattcctgacaaggacattctcaagcttgtcaaggaaaaatttgatttcaggccagggataatttccattaacttggaccttaagaggggtgcaagtggcaggttcttgaagactgctgcttatggccactttggaagagatgacccagacttcacatgggaggtggtcaagcctctaaagtgggaataa

SEQ ID NO: 1984 - DNA, 1764 bp, Glycine max var. Williams 82
atggctattgctacggccaccctctctctccatttcgccaaaattcccattcgtcaaacgcattcatcttctccaatacgccatcgcatcccttctggtcgacggttgaatctctattaccctcgcacttcccacagatttgcgtgttttggttccaagtgttcactgacagacactgatgtgcatttggttcatgttaccacggatgaggatgaggctcagggaagaggggtggttgagcctcactgcccggtgccatttgttaaactcaatactgatattctcgagactgagtctttgaacttgctcgcagaagccacatttgtagatactctcttgactgcattgcctgttttgtccgaggaggagcagcacgccctatctgctactccggctcacccggctggtttacacgctttttatgctagttgcttaactgcaaatgtagtggagcagctttggaattttgcttggccttctgccattgccttgattcatccaagccttttgccagttgctgtaatgagtttcttcaccaaagtggctataattgttggcggtcccttggttggcaaacttatggaccattttccaagagtgtctgcatataattgcttaaccattgttcaggcagcagctcagttgctatctgcagcgatgattattcgtgcccattctgtccaacctacttcattttctacactgcttctgcgtccctggtttgtcatattggtttcagctggggctattgagaggctttgtggagtagctttgggggttgcaaatgagcgtgattgggttgtgctgctggcaggagtgaataggcctattgcattagcacaggcaaatgctgttctaaatcgaattgatctcctgtgtgagatagccggggcgatgctgtttggattccttctttctaaatttcatcctgtaatctgcttaaaagttgcttctgggttaatgatggggcttctgcctgttacaattgttttcaattatttaaccaacaagctttccaccggtgttcttgaccgacctaaaccttcacaaacctgttgcagaacatttaatgaagattctgcattagatgccagcagtatagtgtttaaaggtctggaagccatcaagctcggctggaaggagtatctgggtcagcctgttctccctgctagtcttgcatgggtgctcctctgctttaacattgttctcacgccaggcagtttgctgacagcatttttaacacagcgtggcttacatccgtcaatcataggaggattcagtggaatgtgtgctttaatgggtgttgctgcaacatttgtgtcttcaactctggtcaagcaatttggcattttaaaggctggggcagttgggttggtatttcaagcgttacttctcagcatggctgttgctgtatattggagtggaacaatttctcatcagagccctcttcttactttcctatttctgattattctgtcacggttaggacacatgtcatatgatgttgtaggggctcagattctccagacaggaatcccatcatccaaagcaaatctcattgggacgacagagattgctgttgctagtttggcggagtctataatgctgggtgttgcaataattgcaaacgatccttctcattttggatgtttagcactgttgtctcttctatcagtagttggtgctgcctggatgttctgtagatggctgttgaatccaacagatgaacaaaaaaaccttttttcttatgatcctcagttttga

SEQ ID NO: 1985 - DNA, 2447 bp, Glycine max var. Williams 82
acaaacaacactagttgcgcactccgccgaagcacacacgacgaaatttcaggctaaggctgcacgcttctttccacattacagataaggcgcttgcgaaatatccccaacgaaattttaatctcatcgcgattccgcaaaagaaaagaaaagagtgtgtggtgtcggggatgaacatacattgaggcaaaagtgtttcttttcttttcttttcttttctgcgcagttattattattttaggactgcaactgcatgagttggacaaaaccgagcaagattggtagcttgaagttctacaagcttcagcaactatggctattgctacggccaccctctctctccatttcgccaaaattcccattcgtcaaacgcattcatcttctccaatacgccatcgcatcccttctggtcgacggttgaatctctattaccctcgcacttcccacagatttgcgtgttttggttccaagtgttcactgacagacactgatgtgcatttggttcatgttaccacggatgaggatgaggctcagggaagaggggtggttgagcctcactgcccggtgccatttgttaaactcaatactgatattctcgagactgagtctttgaacttgctcgcagaagccacatttgttttgtccgaggaggagcagcacgccctatctgctactccggctcacccggctggtttacacgctttttatgctagttgcttaactgcaaatgtagtggagcagctttggaattttgcttggccttctgccattgccttgattcatccaagccttttgccagttgctgtaatgagtttcttcaccaaagtggctataattgttggcggtcccttggttggcaaacttatggaccattttccaagagtgtctgcatataattgcttaaccattgttcaggcagcagctcagttgctatctgcagcgatgattattcgtgcccattctgtccaacctacttcattttctacactgcttctgcgtccctggtttgtcatattggtttcagctggggctattgagaggctttgtggagtagctttgggggttgcaaatgagcgtgattgggttgtgctgctggcaggagtgaataggcctattgcattagcacaggcaaatgctgttctaaatcgaattgatctcctgtgtgagatagccggggcgatgctgtttggattccttctttctaaatttcatcctgtaatctgcttaaaagttgcttctgggttaatgatggggcttctgcctgttacaattgttttcaattatttaaccaacaagctttccaccggtgttcttgaccgacctaaaccttcacaaacctgttgcagaacatttaatgaagattctgcattagatgccagcagtatagtgtttaaaggtctggaagccatcaagctcggctggaaggagtatctgggtcagcctgttctccctgctagtcttgcatgggtgctcctctgctttaacattgttctcacgccaggcagtttgctgacagcatttttaacacagcgtggcttacatccgtcaatcataggaggattcagtggaatgtgtgctttaatgggtgttgctgcaacatttgtgtcttcaactctggtcaagcaatttggcattttaaaggctggggcagttgggttggtatttcaagcgttacttctcagcatggctgttgctgtatattggagtggaacaatttctcatcagagccctcttcttactttcctatttctgattattctgtcacggttaggacacatgtcatatgatgttgtaggggctcagattctccagacaggaatcccatcatccaaagcaaatctcattgggacgacagagattgctgttgctagtttggcggagtctataatgctgggtgttgcaataattgcaaacgatccttctcattttggatgtttagcactgttgtctcttctatcagtagttggtgctgcctggatgttctgtagatggctgttgaatccaacagatgaacaaaaaaaccttttttcttatgatcctcagttttgatatttatttgttcattaattgccttagtgcaaactgcaaaggcagttcgatgtaaacaagaatcaaaatatagcatggtgggtgattatccacttaatacaggagcttggggcgttttcttctcacctggccaatgatattcattgtgtggacaaaatagatggctttacctgtaattctgtaaatgtgtagcatgccatcatatttatattattagtgtacatgacaaataattagctagttgcctacgtccaacacgtacaaacgttttgtaaagcattttattcattgttaaaattctttcccgggatttaaaatatcagcagatttgttccggtgattgtgataggaggatcaatgattcttagtaaaatattaatttgaaatattttaattgg

SEQ ID NO: 1986 - DNA, 2688 bp, Glycine max var. Williams 82
atggagatccagaaaaaaggtttcaagggaagcttccttagcttctttgactggaatggcaaatctcaaaagaagctgctttgtgacaggcctatcttacctgatgtttcaaagcaaggaaaggaaaacatggacagcatgccaaagtcacaggaaaataggataaaaatggatgacaatggagtaaatcctagcaataatgcaagttgtggttttgattgtgccatatcaattaatagtgatgaagggtatgggactaaagccccagggttagtagccagacttatgggtttggattcgttgccagttttaactgtctctgagctctcctcatcatccacttcattatatggctccaactctcttggatcttctcattctcatgatgaggatgttcttcactcaatggttgactatggttgccctgtggatcccataaatatgcgacttaagccggagaagtcttcttggggtgccatgcaatcaagggctttgaaagtgggaaatccgtcaatgaagagatttcagactgaaatgttgcctccaaagtctgctaaacccattccagtttctcacaacaaacttttgtctcctatcaagagccctgcttttatgcaacctaagcatgcagctcatataatggaggcagctaccaaaataattgaggcaagtccccagccatgtaggaggaataaaatgtcttcatatggaccttcatctgtttcattaagaattcttgatctgaaagagaaattggaagctgcacaatatgaatccaagttcatggatacacacactgctaaccctctgaatggcaagcctagtgagaggagaaacaatttatataaatccactttaagtttcaaaggttcaaggcattcagtaaagaacagttcttgtcagttggcaagcaaaggaaaatctgcttcacttgcaatgccatctaaaaccaatgctcagagccgtgatgaattgactttgaatgggaataggagatatatgaggcagaaagaacataacaatataaaatcaaaccagttgcccaggagccagaagaaacaaattgcagacaggggcagggtaatgcagcagagagcttgtacaagccagaatagaaatgtgcttggaaagaataatcaaaagcagaatagtgtaaccaacaaaggtagttcagcttcaaagatggactctaataagccaacacaaacttggtcttcagaaagttctactggagcaaagaagactaaaaaaaaggtttctgtaaatgccaacattgagcccaaaaggtttggcacaaggatcactgataccataaaggagtttccagtttccaaaaggaagggtatttcccaaaagaaaaactatagcagttgcgatattcacaataagccaagaggttctgatagtgcagctaatacttatgaaaacatgcccataaaatgcaatattacgactgatggaagtattgaccaggatgcatttagcatgaaaggaagcaatggtgtgatttcatttacatttacatctcccttgagaagaaacttgcccgagttacagtcctctagcgagcaagcgatgggaacaaggaacaaaattgatgtcaattcttgtagtagtaatgacaagttttatcctcaaaagtcatcattttctcctcccaggttacatgtaatagatggtgatgctttaagtgttcttttggagaaaaaactgcaagaattgacatctagaattaacccacctcagtgctccctcacgacagaagggtcttctactggtttaagatctagtttggaagacaaatttcgaagtgtgttaagcaccacagtaagggaacaagacataagcttttacaatcaattggacagcgtgcatgacaattgttcttcaagtgatattgtggtgcttagcatgaatcagcaactgcagacatcagaatcaatggaagagcctagctgtcgcagcaacagtgaaagcaaaaatggaagttacttagatagtgcatatggcattacagtttattcttccatgcaagatgaagaggtatctaatttttctctaatgaatgaatctatgtcactcgaaaacgaggcagaatggtctgagcaaagctcttccatagtgatgggggataacatggccagtgaacaatcaagtgtaatgtcaaattcggccgaatttacaagatcagcgaggaacatggaacttgaatatgtaaaggatatattcagcaatgcagagttgatgacagaagaatttgtggtgggtgagacagacaagatcataatgccaaatctctttgacaagttggagaataaaggccttggggcagaaaactatgaagagtactctaagattgagaggagggctatatttgacactgtgagtgagtgcctagaactaaggtgcagacaaatttttgttggaagctgcaaagcatggccaaaatggttggcttcagttcagaggaagaactgtttagcagaagagttttacaaggaaatactgagctttagaagtatggaagaagaggtagaggtggatgaacttgtcaacaaggacatgagcactggatggtgtaaatggcttgactttgaaattgaagcctttgagaagggttcagaacttgaatttgatatcctaacatgtttgattaacgaattggtttctgatttattgcatgtttaa

SEQ ID NO: 1987 - DNA, 2478 bp, Glycine max var. Williams 82
atggtggagatcacgctggacgtccgcgacgacgccgtttcggtccagaacatccgcggcggcgactccgagacggcgttcctcgccagccgcctcgagatgaggccgtcgtcgttttccgatcggctgagacaggtgtcgcgggaactgaagcgcatgacatcaaacaaggccttcgatagggttgaccgcagcaaatccggtgctgcgcgcgcccttggtggtcttaagttcatgaccaaagcaggcactgaaggttggtcacaggttgagaagcgcttcgatgagttggccattgatgcaaagctccccaagactcgctttagccagtgcatagggatgaacgaatcgaaggagtttgccggtgagttattcgatgcattagctcgtcgtcgagggataacatcagcttccataacgaaggatcagttgcgtgaattttgggagcaaattacagaccagagttttgattcacggcttcagaccttttttgacatggtggacaaagatgccgatggacgaattaatgaagaagaagtaaaagagattatcaccttaagcgcttcagccaataagctgtcaaaattaaaagatcgtgcagaggaatatgctgcccttatcatggaggaactggatccggacaaccttggatacattgagttatacaacttggaaatgcttcttctgcaagccccagcacaatcaacccacataaccacagatagcagggtactgagccaaatgctaagccagaaactagtccctacaaaagagtacaaccccatcaagcgaggctttcgggcactggcatacttcgtgcaggacaattggaaacgcctctgggtcatagccctgtggctttccatttgcgctggtcttttcacttggaagttcatccaatacaagcaccgtgctgtgttcgatgtcatgggatactgtgtcacagtagccaagggcggtgctgaaacaaccaagttcaacatggccttgatcttgttgcctgtctgcagaaacaccattacttggctcaggagcaggaccaaactaggagccatcattccctttgacgacaacatcaactttcacaaggtggtagcctttggcattgcaattggggttggattgcatgcgatttcacatctgacgtgtgacttcccaaggttgttacatgcgacggacgaagaatacgagcccatgaaacaattttttggagatgagaggcccaacaattattggtggttcgtgaaagggactgagggatggaccggggtggtgatggtggttcttatggctatagccttcattttggctcaaccatggttccgaaggaacaggctgaaactccccaaaaccctcaagaagctcaccggtttcaatgccttttggtactcccaccacctttttgtcatcgtctatgtgcttttcatcattcacggttacttcctatacctcagcaagaaatggtacaagaaaacgacatggatgtatctcgccgttcccatgatactatacggatgcgaaaggctactccgtgcgtttaggtctggctacaaatcagtgaggattctcaaggttgctgtgtacccaggaaatgtgctagcattgcatgtgtctaaaccacaaggatttaagtactctagtggccagtatatatacgttaactgttcagatgtctccccatttgaatggcatcccttttctattacatcagctccgggagatgattacttaagtgttcacattcgaactttgggtgactggacatcacaactgaagggtgttttcgccaaggcatgtcaaccagcaagtgaaggccaaagtggtcttctacgagctgatatgctacaaggcaacaacaaaccaagaatgccaaggctattaatcgatggaccttatggagctccagcacaggactacaaaaattatgatgtaatccttctggtggggctaggaattggtgccacccctttgataagcatactcaaagacgtgctaaacaacatcaagcaacataaagatgtagaagaaggagaggtggaaaaggacaagagaaaaccttttgccactaagcgagcttatttctactgggttacccgtgaggaaggttcctttgaatggtttaaaggggtgatgaatgaggtggaagagaatgacaaggaaggagttattgaacttcacaactattgcacaagtgtgtacgaagaaggagatgctaggtcagctttgatcacaatgcttcagtctcttcaccatgccaaaaatggtgtggatatagtttcagggacaagggtgaagactcattttgcaagacccaactggcgcaatgtctttaaacatgcagccatcaaacaccctgaccaaagagttggtgttttctactgtggggcgcatggattggttggggaactgaaaaagctttctttagacttttccaggaaaaccagcaccaagtttgattttcacaaagaaaatttttag

SEQ ID NO: 1988 - DNA, 882 bp, Glycine max var. Williams 82
atggcttcgggtgaaaagaaattcccacctcaacaacaacaaacacagcctgggaaggagcatgctatgaatccagtaccccaattcactagccctgactacaagccttcaaataaacttcaaggaaagatagcattagtgactgggggtgactctgggattggacgagcggtgtgtaacttgtttgccttagaaggtgctaccgtgggcttcacatatgtgaaggggcatgaggacaaggacgcgagggacacgttggaaatgatcaagagggcaaagacttcggatgctaaagatccaatggcggtaccagctgatttgggttacgacgagaattgcaagagagtggttgatgaggtcgtgaatgcttatggttgtattgacattctggtcaacaatgcagctgagcaatacgagtgtggaacagtggaggacattgatgagcctaggcttgagagggtctttcgtacaaatatcttctcctatttcttcatgaccaggcatgccttgaagcacatgaaggaaggaagcagcattatcaacacgacatcggtgaatgcatacaagggaaatgcgaaactattggactacacgtccacgaagggagcaattgtggcctatacaaggggacttgctcttcagttggtgagtaagggaattcgggttaatggggtggctcctgggcctatttggaccccattgataccctcctctttcaaggaggaagaaacggctcaatttggtgcccaggtgccaatgaagagagctggccagcctattgaggttgctccgtcttatgtttttcttgcttgcaaccaatgctcctcttacataactggacaagtccttcaccccaatggtggaaccgttgtcaatggttaa

SEQ ID NO: 1989 - DNA, 1326 bp, Glycine max var. Williams 82
atggaagttaatactactacaaccactgtaccttcagggccaccaactaggaaccattcttacacacaacaccgcttacattcagaaagacatagccataaccatagccatggccatttcccctccaaaaccattctcataatcatcgcattcgtcaccttagtcacggtcctatttatcattttcgtggtcctattcttgatccgtcgccaaaaatcctccagcaagaatggaacttgcgaagaagacagcagagagcttcatgacacaagcagcaggctcatcacttcaacaacgttgaattctagcccagatgtgaaaagtgggtgtcttcatgggggaaatttgagcaggaccccagcacctaaatttcgtggagtacaagtgttcacgtatagggagttagaaattgccactgatggattcagcgaagcaaatgtgattggtagtaatggaattattggagggcatggtttgatctatagaggtgttctaagtgatggcactttggcagcaattaagttgcttcgcactgagggtaagcaaggggaacgtgccttcagaatagaggtcgatctcttaagtcgcttgcactctcctcatttggtggagttacttggctattgtgctgaccaacaccacaggttactgatttttgaatacatgcccaatggaacactccactaccatcttcacactcccaacgatcaatatcagctgttggattggtgggcccggatgaggatagcccttgattgtgccagagcactggagttcttgcatgagcatgcagtctcacctgtgatccacagagactttaagagtaacaacgttctactggatcaaaatttccgtgccaaagtgtctgattttggattggctaagatgggatcagagaagaggaacggtcgtgtgttggggaccactggatatttggcaccagagtacgccacgggtaagcttactacaaagtcagatgtttacagctatggtgtggttcttctcgaactgctcacgggacgtgtgccagttgatatcaagagggccccaggagaacacgtccttgtctcttgggctcttccaaggttgacaaacagagaaaaggtaattgaaatggttgacccagctcttcgcggacagtactctaagaaggatttaattcagatagctgccattgcagcaatgtgcatacagccagaagctgattacaggccgctcatgacagatgttgtacaatcactgataccacttgttaggaaccaatcctctcttagttcatccagctccctacgatttcagaaacaaacgccaagtcctactcattag

SEQ ID NO: 1990 - DNA, 723 bp, Glycine max var. Williams 82
atggccgttcttttctccaatctcatcagcatcaccaacaacaccaaaccctgcttctctttcacctcaaaacccataatttgtggggccaagaacctcacttccaaacggagcctcatccttcaaactcctctggtctgcattggcattggcctaactcctcaagtctcagttgcgcaagaatcgccgtccaaatcgcttctttctagcattgaaaacacgacatcttggtttcagttctacggtgatgggtttgccattcgagtcccaccggagtttaaggatatcacggaacctgaggatttggatgctggacagtctctttatggggacaaggcaaagacaaagactttttcagcacggtttgcatcttccgatggatcagagattctaagtgttgttactaagccaaccaatcaacttaaaatcaccttcttacaggctcagaatataactgatttaggttccctgaaggaagcagcaaaaatttttgttccagggggctcaaaaatttattctgcaagatcaataaaaataaaggaagatgagggttttacgacttactatttctatgaatttggtagagataaccagcacgtagcattgatggcaggggtcagcagtggaaaggcttttattgctggagcaactgcaccacagtccaagtgggacagcgatggtgtaaaacttcgttctgctgcaatatcattaaaaattctgtag

SEQ ID NO: 1991 - DNA, 906 bp, Glycine max var. Williams 82
atgaaggactttccttcatgctttggtgaaaatgcagttcaggttgcagattcttcatcttcaagttcgagcaaaactgcacagaatctggttatctgcgtttaccaatgccggatatggggtaagtgctgcttcataaccatcacatggactaagagcttgatggggcaagggcttagcgtagggatcgatgattattcttcaaatcagtgtctgtgtaaggtggatatcaaaccctgggtgttctccaagaggaggggttgtaagagccttgaggcttattcttgtaagattgatgtgtattgggacctttccaatgctagatttggtgttggtcctgaacccttggaggggttttatgtaggagtagttgtagatcgccaaatggttctccttcttggagatttgaggaaagaggctttcaagaaatccagtgctattccattaccatccaatgctgtttttgttgccaaaaaagaacatgtctttggcaagaaaatgtttggtaacaaggctgtgttttgtgacaatggtcagattcatgatcttgtcatagaatgtgacacctctggggtgtctgatccgtgccttataattcgaatcgatagcaaaaccgtgatgcaggtgaagcggctcaagtggaagtttagggggaaccacaccatcttggtggatggtcttgcagtggaagttttctgggatgtctataattggctctttggtggaacatcgcttggaaatgctgtctttatgttcagaacatgtatctctgcggaaaaattttgggctggtgaacccctttctgatgcaaatgtggtgcagtggtccttctctcagaggttttctgagaccaagtcgcaaggtgttggcttctcacatattttatatgcgtggaagaacgactag

SEQ ID NO: 1992 - DNA, 1518 bp, Glycine max var. Williams 82
atggcttctctctcttgctccgccaacgaccttgccccactcttcaacgacaccgccgccgccaactacctctgcgcccaattcgattccatttctagaaagctcgccgaaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgccgccggcggtctctcctactacctattcggctttgcattcgccttcggcggcccctccaacggcttcatcggccgccacttcttcggcctacgagattacccgatgggctcctctccctccggcgactacagcttcttcctctaccagtgggccttcgccatcgccgccgcaggaatcaccagcggctccatcgccgagagaacacagttcgtggcttaccttatctactcttctttcttaaccggtttcgtttaccccatcgtttcgcattggttctggtcctcggacggttgggccagcgcgagtcgtagcgacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggttcgtttttgttatggttcggctggtacggcttcaaccctggttcgtttctgacaatagccaaggggtatggaagtggagggtattatggtcaatggagcgctatagggaggacagctgtcacgacgacattggctgggagcactgcggctctgacgacgttgttcagcaagcggttattggctggccactggaacgtgattgacgtgtgtaacggcctgcttggcgggttcgctgccattacatcgggctgtgccgttgtggaaccgtgggccgcgattgtgtgtgggtttgtggcggcgtgggttttgattgggcttaataagcttgccgcgaaggtagagtacgatgatccgttggaggcggcgcagcttcacggcgggtgcggcgcgtggggtgttttcttcacgggattgtttgcgaagaaagtgtacgtggaggagatttacggtgttggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtagggttcatgctgcgtagaattgagcctgctgctagtaccactccctctccccccgctgcaccacaagtttaa

SEQ ID NO: 1993 - DNA, 2350 bp, Glycine max var. Williams 82
aagaaaggcaaagaagaagagttgtagcggagtgagtgagccagaaaaaaaggagaggaaagatatctaaatacgtagggttgaggaggagccaacgaatcccgaactcaatctgtaggattccaacacaatatttgaggaggatttattcgcgcatgtgatttataattgaaagattccctctgcagctctcaaaaccactaaccctaatagctgaactccaaagagataaaataacagcaagtggccctcatcaattctaagtatatatataaaatcattgccgccatcacttcttctccatactcttgtctcactctaacagccaaagcatggcttctctctcttgctccgccaacgaccttgccccactcttcaacgacaccgccgccgccaactacctctgcgcccaattcgattccatttctagaaagctcgccgaaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgccgccggcggtctctcctactacctattcggctttgcattcgccttcggcggcccctccaacggcttcatcggccgccacttcttcggcctacgagattacccgatgggctcctctccctccggcgactacagcttcttcctctaccagtgggccttcgccatcgccgccgcaggaatcaccagcggctccatcgccgagagaacacagttcgtggcttaccttatctactcttctttcttaaccggtttcgtttaccccatcgtttcgcattggttctggtcctcggacggttgggccagcgcgagtcgtagcgacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggttcgtttttgttatggttcggctggtacggcttcaaccctggttcgtttctgacaatagccaaggggtatggaagtggagggtattatggtcaatggagcgctatagggaggacagctgtcacgacgacattggctgggagcactgcggctctgacgacgttgttcagcaagcggttattggctggccactggaacgtgattgacgtgtgtaacggcctgcttggcgggttcgctgccattacatcgggctgtgccgttgtggaaccgtgggccgcgattgtgtgtgggtttgtggcggcgtgggttttgattgggcttaataagcttgccgcgaaggtagagtacgatgatccgttggaggcggcgcagcttcacggcgggtgcggcgcgtggggtgttttcttcacgggattgtttgcgaagaaagtgtacgtggaggagatttacggtgttggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtagggttcatgctgcgtagaattgagcctgctgctagtaccactccctctccccccgctgcaccacaagtttaatcaaaatgtggtttatgattttcaagcgttttttagtttcgtacctgcacatagctatgggcaaagctagccttgtcaaaaccatatacaagcaagacacgagggatgcatatatgaagtataaaaattaatgcgtgggggtcaacatttaggaaatgtcttctagagttactgtacattttaaaatgtttgttggcttggtttattattttcatctttgaattccaagactagtttggtcgactgttgtcacgttagtttgtatcctgctgcagaataacttgcttgtaattgtatactgattagttggtatatagtgatatattatatatactaaatgcattaatgcaggttatgattttgctaatcttgttatattagtgtttcaacatacatttttttcttttgatataaaataaatatcatagctgaaggtccagtaccatccatctcagcttggtatcttgaaatatgttctcagagaataagatacttcatca

SEQ ID NO: 1994 - DNA, 1518 bp, Glycine max var. Williams 82
atggcttctctctcttgctccgccaacgaccttgccccactcttcaacgacaccgccgccgccaactacctctgcgcccaattcgattccatttctagaaagctcaacgtaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgccgccggcggtctctcctactacctattcggctttgcattcgccttcggcggcccctccaacggcttcatcggccgccacttcttcggcctacgaaaattcccgaaggactcccctccctccggcgactacagcttcttcctctaccactgggccttcgccatcgccgccgcaggaatcaccagcggctccatcgccgagagaacacagttcgtggcttaccttatctactcttctttcttaaccggtttcgtttaccccatcgtttcgcattggttctggtcctcagacggttgggccagcgcgactcgtagccacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggtacgtttttgttatggttcggctggtacggcttcaaccctggttcgtttctgacaatagccaaggggtatgaaagtggagggtattatggtcaatggagcgctatagggaggacagctgtcacgacgacattggctgggagcactgcggctctgacgacgttgttcagcaagcggttattggctggccactggaacgtgattgacgtgtgtaacggcctgcttggcgggttcgctgccattacatcgggctgtgccgttgtggaaccgtgggccgcgattgtgtgtgggtttgtggcggcgtgggttttgattgggcttaataagcttgccgcgaaggtagagtacgatgatccgttggaggcggcgcagcttcacggcgggtgcggagcgtggggggttttcttcacgggattgtttgcgaagaaagagtacgtggaggagatttacggtggtggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtagggttcatgctgcgtagaattgagcctgcagctattaccactccctctccccccgctgcaccacaagtttaa

SEQ ID NO: 1995 - DNA, 2294 bp, Glycine max var. Williams 82
tataatttcactgtcaaagactaagaaaggcaaagaagaagagttgtagcagagtgagtgagccagaaaaaaggagaggaaagatatctaaatgcgtagggttgaggaggagccaacgaatcccgaactcaatctgtaggattccaacacaatatttgaggaggatttattcgcgcgatttataattgaaagattccctctgcagctctcaaaaccactaaccctaatagctgaactccaaagagataaaataacagcaagtggccctcatcaattctaagtatatatataaaatcattgccgccatcacttcttctccatactcttgtctcactctaacagccaaagcatggcttctctctcttgctccgccaacgaccttgccccactcttcaacgacaccgccgccgccaactacctctgcgcccaattcgattccatttctagaaagctcaacgtaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgccgccggcggtctctcctactacctattcggctttgcattcgccttcggcggcccctccaacggcttcatcggccgccacttcttcggcctacgaaaattcccgaaggactcccctccctccggcgactacagcttcttcctctaccactgggccttcgccatcgccgccgcaggaatcaccagcggctccatcgccgagagaacacagttcgtggcttaccttatctactcttctttcttaaccggtttcgtttaccccatcgtttcgcattggttctggtcctcagacggttgggccagcgcgactcgtagccacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggtacgtttttgttatggttcggctggtacggcttcaaccctggttcgtttctgacaatagccaaggggtatgaaagtggagggtattatggtcaatggagcgctatagggaggacagctgtcacgacgacattggctgggagcactgcggctctgacgacgttgttcagcaagcggttattggctggccactggaacgtgattgacgtgtgtaacggcctgcttggcgggttcgctgccattacatcgggctgtgccgttgtggaaccgtgggccgcgattgtgtgtgggtttgtggcggcgtgggttttgattgggcttaataagcttgccgcgaaggtagagtacgatgatccgttggaggcggcgcagcttcacggcgggtgcggagcgtggggggttttcttcacgggattgtttgcgaagaaagagtacgtggaggagatttacggtggtggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtagggttcatgctgcgtagaattgagcctgcagctattaccactccctctccccccgctgcaccacaagtttaatcaaaatgtggtttatgattttcaagcgttttttagtttcgtacctgcacatagctctgggcaaagctagcctagtcaaaaccatatacaagggatgcatatatgaagtataaaaattaatgcgtgggggtcaacatttaggaaatgtcttctagagttactgtacattttaaaatgtttgttggcttggtttattattttcatctttgaattccaagactagtttggtcgactgttgtcacgttagtttgtatcctgctgcagaataacttgcttgtaattgtatactgattagttgatatatagtgatatattatatgtactaaatgcattaatgcaggttatgattttgctaatcttgtgatattagtgtttcaatatacatttttttcttttgataaaataaatatcatagctgaaggtcaag

SEQ ID NO: 1996 - DNA, 1578 bp, Glycine max var. Williams 82
atggcttctctctcttgctccgccaacgaccttgccccactcatcaacgacaccgccgccgccaactacctctgcgcacaattcgattccatttctagaaagctcgtcgaaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgtcgccggcggtctctcctactacctattcggctttgcattcgccttcggcggcccctccaacggcttcatcggccgcccaaacttccgcctacgagattacccgatgggctcctctatctccagcttcttcctctaccagttggtcttagccatcgccgacgcaggaatcaccatctctcccttcggcgactacagcttcttcctctaccagtgggccttcgccatcgccgccgcaggaatcaccagcggctccatcgccgagagaacacagttcgtggcttaccttatctactcttctttcttaaccggtttcgtttaccccatcgtttcgcattggttctggtcctcagacggttgggccagcgcgactcgtagccacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggtacgtttttgttatggttcggctggtacggcttcaaccctggttcgtttgtgacaatagacaaggggtatgaaagtggagggtattatggtcaatggagcgctatagggaggacagctgtcacgacgacattggctgggagcactgcggctctgacgacgttgttcagcaagcggttattggttggccactggaacgtgattgacgtgtgtaacggcctgcttggcgggttcgctgccattacatcgggctgtgccgttgtggaaccgtgggccgcgattgtctgcgggtttgtggcggcgtgggttttgatttggcttaataagcttgccgcgaaggtagagtacgatgatccgttggaggcggcgcagcttcacggcgggtgcggagcttggggggttttcttcacgggattgtttgcgaagaaagtgtacgtggaggagatttacggtgttggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtaggattcatgatgcttagaattgagcctgctggtacctctccctctccccccgctgcaccacaagtttaa

SEQ ID NO: 1997 - DNA, 2410 bp, Glycine max var. Williams 82
tataatttcactgtcaaagactaagaaaggcaaagaagaagagttgtagcagagtgagtgagccagaaaaaaggagaggaaagatatctaaatgcgtagggttgaggaggagccaacgaatcccgaactcaatctgtaggattccaacacaatatttgaggaggatttattcgcgcatgtgatttataattgaaagattccctctgcagctctcaaaaccactaaccctaatagctgaactccaaagagataaaataacagcaagtggccctcatcaattctaagtatatattaaatcattgccgccatcacttcttctccatactcttgtctcactctaacagccaaagcatggcttctctctcttgctccgccaacgaccttgccccactcatcaacgacaccgccgccgccaactacctctgcgcacaattcgattccatttctagaaagctcgtcgaaacaacctacgccgtcgacaacacctaccttctgttttcagcgtatcttgtcttcgccatgcagctcggcttcgccatgctctgcgccggctccgtcagagccaaaaacaccatgaacatcatgctcaccaacgtcctcgacgccgtcgccggcggtctctcctactacctattcggctttgcattcgccttcggcggcccctccaacggcttcatcggccgcccaaacttccgcctacgagattacccgatgggctcctctatctccagcttcttcctctaccagttggtcttagccatcgccgacgcaggaatcaccatctctcccttcggcgactacagcttcttcctctaccagtgggccttcgccatcgccgccgcaggaatcaccagcggctccatcgccgagagaacacagttcgtggcttaccttatctactcttctttcttaaccggtttcgtttaccccatcgtttcgcattggttctggtcctcagacggttgggccagcgcgactcgtagccacggaaatgttttattcgggtctggagtcatcgacttcgcgggctcaggcgttgttcacatggttggcgggatagcgggcctgtggggggctttaattgaaggcccgagaatcggccggttcgaccgttcgggccggtcggttgctttacgtggccacagcgcgtctttagttgtgcttggtacgtttttgttatggttcggctggtacggcttcaaccctggttcgtttgtgacaatagacaaggggtatgaaagtggagggtattatggtcaatggagcgctatagggaggacagctgtcacgacgacattggctgggagcactgcggctctgacgacgttgttcagcaagcggttattggttggccactggaacgtgattgacgtgtgtaacggcctgcttggcgggttcgctgccattacatcgggctgtgccgttgtggaaccgtgggccgcgattgtctgcgggtttgtggcggcgtgggttttgatttggcttaataagcttgccgcgaaggtagagtacgatgatccgttggaggcggcgcagcttcacggcgggtgcggagcttggggggttttcttcacgggattgtttgcgaagaaagtgtacgtggaggagatttacggtgttggaaggccgttcggggctttgatgggtggcggagggaggctgctggcggcgcaggtgattcagatattggtggtgtgcgggtgggttacggcgaccatggcgccgttgttctatgggcttcataagatgaaactgttgagaatttcgagggatgatgagactgcggggatggatttgacgaggcatggtgggtttgcttatgcataccatgatgatgaagatggttcaagcaggggagtaggattcatgatgcttagaattgagcctgctggtacctctccctctccccccgctgcaccacaagtttaatcaaaatgtggtttatgattttcaagcgttttttagtttcgtacctgcacatagctatgggcaaagctagcctagtcaaaaccatatacaagcaagacacgagggatgcatatatgtagtataaaaattaatgcgtgggggtcaacatttaggaaatgtcttctagagttactgtacattttaaaatgtttgttggcttggtttattattttcatctttgaattccaagactagtttggtcgactgttgtcacgttagtttgtatcctgctgcagaataacttgcttgtaattgtatactgattagttggtatatagtgatatattatatatactaaatgcattaatgcaggttatgattttgctaatcttgtgatattagtgtttcaacatacatttttttcttttgataaaataaatatcatagctgaaggtcaagtaccatccatctcagcttggtatcttgaaatatgttctcagag

SEQ ID NO: 1998 - DNA, 354 bp, Glycine max var. Williams 82
atgaagttaaagatccttacaaggcacgaatgttgcatggtaaacattctctccttcacatctcctcgggatgtgcgtaggctctctttggtttcttccattttcagatccgatgctgtctgggacaagtttttgccttcggatttccacaccatgatggaatggcagatgggtccaccctttccttccactattttttctgataaggacctctatctctatctctaccaaaaaccgctcctcatagacgatggtaaaatgatgggagagttcttcaacgatggagaagaggacaagcaagtggaaatgggtgtttatgagatcaagagtggtgattggaaagactccctttaa

SEQ ID NO: 1999 - DNA, 2310 bp, Glycine max var. Williams 82
atggagcctcattttgtggttcgacttcccttgatgtttctaatcactctctggctttcactatctcaccatcatgccaatgctgaaactgaaagttccacgtatattgttcacatggacaagtccctcatgcctcaagtctttgcaagccatcacgattggtacgaatccaccattcattccataaacttagcaacagctgatgatccctctgagcaacaacaatcacagaaattagtgtacacttacgatgatgcgatgcatggattcagtgcagtgctatcaccagaggagttggagactctaaagaacactcaaggttttgtcacagcttaccctgatagatctgccaccatagacaccacacacacctttgagtttctctctttggattcctccaatggcctatggaatgcttcaaatttgggagaaggtgtcattgtgggtatgattgactcaggtgtctggcctgaaagtgagagtttcaaagatgatggcatgagcaggaacatcccctacaaatggaaaggaacatgcgagccaggacaagactttaacgcctccatgtgtaacttcaaattgattggagccaggtacttcaacaagggtgtgaaagcggcgaatccgaacatcacaatcagaatgaactcagcgagagacactgagggtcatggaagccacacgtcatccactgttgctggaaactatgttaatggtgcttctttctttggctacgccaaaggggtagcaagaggtattgcaccaagagctaggcttgccatgtacaaggttctttgggacgaggggcgtcaaggctctgatgttcttgcgggaatggaccaagccattgctgatggtgttgatgtcatttcaatctcaatgggttttgatagtgttccactttatgaggatccggttgcaatagctgcttttgcagcaatggaaaaaggggtgttggtttcatcttcagcgggaaacgaaggtcctacacttggtaccttgcacaatggaatcccttgggtcctaactgttgcagcaggcaccatagaccgcacatttggaagcttgacactaggaaatggtgaaaccattgtgggttggaccttgtttgctgctaactcaatagtggagaattatccactcatttacaacaagactgtatcagcatgcgactcggtcaaactattaacccaagtagccgcaaaagggattgttatatgtgatgccttggattcagtttctgtcttaacccaaatagattctattactgcggctagtgtggatggggctgtgtttatctctgaggatccagaactaattgaaacaggacgtttgttcactccaagcattgtgatcagcccaagcgatgcaaaatcggtgatcaagtacgcgaaaagtgttcaaataccttttgccagcatcaaatttcaacaaacatttgttggaataaagccagcaccagctgctgcatattacacttcaagaggtccttcaccgagttacccggggatcttgaagcctgatgtaatggcacctggctccaatgttctggctgcttttgttccaaataaaccctcagctagaattggtacaaatgtgtttctgtcaagtgactacaatttcttgtctggaacatccatggcatgtcctcatgcgtctggtgttgctgctcttttgaaagcagcacaccctgattggagtgcagctgctataagatctgcattggttacaactgctaatccacttgataatactcaaaatccaattagggataatggaaacccattgcaatatgcttctcctcttgccatgggagctggtgagattgatcctaatagagcacttgatcctggtctcatatatgatgccaccccacaggactatgttaacctcctttgtgctttgggatacacacacaaccaaatcttaaccatcacaagatcaaagtcctataactgtcctgctaataaaccatcttctgatcttaactatccttcgtttattgttttgtatagtaacaaaacaaaatcagcaacagtccgagagtttaggaggaccgtgaccaatgttggagatggtgctgctacatacaaagtcaaggtgacacaacccaagggctctgtagttaaggtgtcacctgagacattggcatttggctataagaatgagaagcagagctactctgttattataaagtacacacgaaacaagaaggaaaacatctcatttggggacattgtttgggtcggagatggtgatgcacgtacggttagaagccctattgttgtggcacctagtgaaattgcatga

SEQ ID NO: 2000 - DNA, 2700 bp, Glycine max var. Williams 82
ataagctgtttgttcaaaggcaaagatgtcatattcttattgttaactagctgcttaaatctccaaaaaagtcaatggagcctcattttgtggttcgacttcccttgatgtttctaatcactctctggctttcactatctcaccatcatgccaatgctgaaactgaaagttccacgtatattgttcacatggacaagtccctcatgcctcaagtctttgcaagccatcacgattggtacgaatccaccattcattccataaacttagcaacagctgatgatccctctgagcaacaacaatcacagaaattagtgtacacttacgatgatgcgatgcatggattcagtgcagtgctatcaccagaggagttggagactctaaagaacactcaaggttttgtcacagcttaccctgatagatctgccaccatagacaccacacacacctttgagtttctctctttggattcctccaatggcctatggaatgcttcaaatttgggagaaggtgtcattgtgggtatgattgactcaggtgtctggcctgaaagtgagagtttcaaagatgatggcatgagcaggaacatcccctacaaatggaaaggaacatgcgagccaggacaagactttaacgcctccatgtgtaacttcaaattgattggagccaggtacttcaacaagggtgtgaaagcggcgaatccgaacatcacaatcagaatgaactcagcgagagacactgagggtcatggaagccacacgtcatccactgttgctggaaactatgttaatggtgcttctttctttggctacgccaaaggggtagcaagaggtattgcaccaagagctaggcttgccatgtacaaggttctttgggacgaggggcgtcaaggctctgatgttcttgcgggaatggaccaagccattgctgatggtgttgatgtcatttcaatctcaatgggttttgatagtgttccactttatgaggatccggttgcaatagctgcttttgcagcaatggaaaaaggggtgttggtttcatcttcagcgggaaacgaaggtcctacacttggtaccttgcacaatggaatcccttgggtcctaactgttgcagcaggcaccatagaccgcacatttggaagcttgacactaggaaatggtgaaaccattgtgggttggaccttgtttgctgctaactcaatagtggagaattatccactcatttacaacaagactgtatcagcatgcgactcggtcaaactattaacccaagtagccgcaaaagggattgttatatgtgatgccttggattcagtttctgtcttaacccaaatagattctattactgcggctagtgtggatggggctgtgtttatctctgaggatccagaactaattgaaacaggacgtttgttcactccaagcattgtgatcagcccaagcgatgcaaaatcggtgatcaagtacgcgaaaagtgttcaaataccttttgccagcatcaaatttcaacaaacatttgttggaataaagccagcaccagctgctgcatattacacttcaagaggtccttcaccgagttacccggggatcttgaagcctgatgtaatggcacctggctccaatgttctggctgcttttgttccaaataaaccctcagctagaattggtacaaatgtgtttctgtcaagtgactacaatttcttgtctggaacatccatggcatgtcctcatgcgtctggtgttgctgctcttttgaaagcagcacaccctgattggagtgcagctgctataagatctgcattggttacaactgctaatccacttgataatactcaaaatccaattagggataatggaaacccattgcaatatgcttctcctcttgccatgggagctggtgagattgatcctaatagagcacttgatcctggtctcatatatgatgccaccccacaggactatgttaacctcctttgtgctttgggatacacacacaaccaaatcttaaccatcacaagatcaaagtcctataactgtcctgctaataaaccatcttctgatcttaactatccttcgtttattgttttgtatagtaacaaaacaaaatcagcaacagtccgagagtttaggaggaccgtgaccaatgttggagatggtgctgctacatacaaagtcaaggtgacacaacccaagggctctgtagttaaggtgtcacctgagacattggcatttggctataagaatgagaagcagagctactctgttattataaagtacacacgaaacaagaaggaaaacatctcatttggggacattgtttgggtcggagatggtgatgcacgtacggttagaagccctattgttgtggcacctagtgaaattgcatgagttcaagtttgagtaattattgttccttcttcttgtggccatcacatcttctctgggaccccccaaaatatacaaataaaagtgctagtttgtaatttcatgttgttccaatactatagctttgtccggctagtctcaaacgatagaccatatattatattagacagctgttgtataatgttgtttgagaaggatttgaagaacaattctgaataaggacaaaaactttggtatcggtgaattaatttggttgattttaggcatcaaacatgtcttttgtcgatgagtctgcttcccttggcttatttaatagcaa

SEQ ID NO: 2001 - DNA, 1329 bp, Glycine max var. Williams 82
atgggggacacttacgttttggccacaccgaagcgcaaccgttccgatgacgtggacggcggcgaggcgaagaagctgctgttgcagcagggcgaggcggacccggcggcggcgctggcgagcgcgcggcacgagttcggggagcacggcggggtgaacatgtcgatcgaggcgtcggcgacgttcacggtgatggagccggagacgatgcggcgcatgttcgccggagaactcggccccgaccgcgacttcttcatctacagccgccacttcaacccgacggtgctgagcctcagtcgcctcatggccgccctcgaaggcaccgaggccgcctactgcaccgccagcggcatgtccgccatctccgccgtcctcctccagctctgcagccacggcgaacacgtggtcgcctccagaactctctacggtgggacccacgcgctcctctcacactttctcccgcgcacgtgcggaatatccactagcttcgtggaggtgacggatcttgacatggttgatgctgccatagtagaagggaaaacaaaagtgctttacttcgaatctgtttccaaccccacccttacggttgcgaacatacctgaactgtgccacatggcacaccggaagggagtgacggtggtggtggacaacacgttcgcgcccatggtgctttcgccagcgcgtcttggtgctgatgttgtcgttcacagtatctccaagttcatcagcggtggggccgatatcattgcaggagcggtgtgcggacccgcaagactggtgaacgcaatgatggatctgcaacaagggtcactaatgctgctgggtccaacaatgaatgcgaaagtggcattcgaactctcggagagaataccgcacctagggctaagaatgaaggagcatagcaaccgcgcactagagttcgcaacgaggctcaaaaggctaggaatgagggtaatatacccgggcctggaggagcacccacagcaccagcttctgaaatcaatgcacaacaaggactatggctacggcgggctcatgtgcgtggacatggaaacggaggagagggccaaccgcttcatgagccacttgcagaactacggccagttcggcttcatggctgtgagcttgggctactacgagaccctcatgtcctgctccggcagcagcaccagcagtgaactcagcactgaggagaaggagctcgccggaatctcgccggggctcgtgaggatgtcgattgggtacattggaaccttggagcagaagtggagccagctccaaaaggcgctcactagactaaacgactctggatacaacaagatcgcttga

SEQ ID NO: 2002 - DNA, 717 bp, Glycine max var. Williams 82
atggaatggaagaaatattatttggatgtggtgctggtaccattgggatttctgataaccattggttatcacgtttggttgtggcataaggttcgaacacagccttcttccaccataatcggaatcaatactcatggaagacgctcctgggtccctgccatgttgaaggacattgaaaagaagaacatcctagcagtgcaaactcttcgtaacatgataatgggatcaactctcatggccacaacttccattctcctctctgcaggcttggcagctgtgataagcagcacttacagcgttaagaagcctctgaatgacgctatatatggagcccacagtgaattcatggtagcacttaaatacgtgacactcttaaccatattcttattctcatttttctgtcacaccctgtcgattaggtttttcaatcaagtgagcatcctcatttgcacaccacaagatgtcatgtcctcctcaatagtagtgacccctcaatatttgactgagcttttggagaagggaaccattctgagcactgttggcaacaggcttttctactcagcactccctcttctgctttggatctttgggcctgtgttggttttcttgtcttctgtggcaatgttaccgattctttataacctagactttgtttgtgggaataataatgggaagggaaagatcgtcaagaatgacaaaggggaggactatgtttga

SEQ ID NO: 2003 - DNA, 486 bp, Glycine max var. Williams 82
atggggtatgacactgatcaagttgctgttcaccgtatagaagaaagattatccgctctgggaaattgtatagcatgtaatgaccatgtggccctcacacacactgatcttgacaaggaaactgaggagatgattgcagatgttcttggagtagaagttttcaggcagactgttgcaggtaatattctcgttggcagttactgtgtattctccaacagaggtggtttggtccaccctcacacctccatcgaagacttggatgaactttccacacttcttcaggttcctttggttgccgggactgttaaccgtggtagtgaagtaatagctgctgggatgacggtaaatgattggacagcattttgtggttcagacaccacagcaacagaactttcagtgattgagagtgttttcaagctgagagaagcccaacctagtgccattgtcgatgagatgaggaaatcactcattgatacttatgtctaa

SEQ ID NO: 2004 - DNA, 626 bp, Glycine max var. Williams 82
atggggtatgacactgatcaagttgctgttcaccgtatagaagaaagattatccgctctgggaaattgtatagcatgtaatgaccatgtggccctcacacacactgatcttgacaaggaaactgaggagatgattgcagatgttcttggagtagaagttttcaggcagactgttgcaggtaatattctcgttggcagttactgtgtattctccaacagaggtggtttggtccaccctcacacctccatcgaagacttggatgaactttccacacttcttcaggttcctttggttgccgggactgttaaccgtggtagtgaagtaatagctgctgggatgacggtaaatgattggacagcattttgtggttcagacaccacagcaacagaactttcagtgattgagagtgttttcaagctgagagaagcccaacctagtgccattgtcgatgagatgaggaaatcactcattgatacttatgtctaaatttttgtcacttttcgtaccatattgtactgcttgttgctaaagatatttcagtttgtttcagtttttcgcaggtaaatagtttgtgatagttctgtcatccaaaatatgaacacgcttatttcaatcaagaatcgtgg

SEQ ID NO: 2005 - DNA, 1653 bp, Glycine max var. Williams 82
atgttctacttcctcaaaagattgtgccttttatgtttcctcttgctatcctttgatgtttcactgtgttcatgtgcttcactcagagacttggcttcttgcttggataatcacgatatcaaaaactttaccacgctcccttacaaagaacatgatcattcctctgcctataattactacaaaattctcaatttttccatccaaaaccttcggttcgcagaacccgtgattcctaagccgatagccattgtactgccagagagtttggagcagctgcagaaaagtgtagcatgctgtagagaaggcttcatggaaataagagtaagatgtggtggacacagctatgaagggacttcatatgttgctgatgatggcactccttttgtcatcattgacatgatgaatttgaaccatgtttgggtggacatggagacagaaacagcatgggttgaaggtggtgcaacattgggagagacttactatgcaatctctcaggcaagcaatgaacatggattctcaggtgggtcatgtccaactgttggagttggaggacacattggtggtggtggatttggaattttgtctagaaagtatggtctcgcggcagataacgtggtggatgcccttctagtcaatgctgacggaaaattgttcgaccgcgaaaccatgggagaagatgtgttttgggccattagaggaggaggaggtggtctttgggggatcatttatgcctggaaaatcaaggtgttgaaattgcctcaagttgtaactagtttcactgtatcaagaactggcacaaaaaggcatgttgccaatctagtgcacaaatggcaaaatgtagcaccaaacttggaagatgacttctacttgtcatgctttgttggtgctggcttgcctcaagctaaaaccaaagggttatcaacaacatttaacggcttctatctcggtcctagggccggtgccatatccatcctagaccatgcctttcctgagttgggtattgtagaagaagaatgcatagaaatgagttggattcagtcaactgttttcttctctggcctaagtgatggagcctcggtctctgacttgaacaacaggtatctgcaagaaaaacaatatttcaaggctaaatcagattatgtaaagaaacatgttcctcttgtgggcatagaaactgcactagacatcctagaaaaggagcctaagggatatgttattttggacccttatggtggaaagatgcataatataagcagtgaatctattgcttttccccacagaagaggaaacttgtttacaattcagtatctgatatattggaaagaagctgacaatgacaaaaacagtgattatgttgattggataagagggttctatgctgctatgactccctttgtctcatggggtccaagggctgcgtatgttaattacatggactttgaccttggagtgatggagcggattagcaatggtgctaatatgaaagatgttgtggaacatgcaagggtttggggtgaaaagtacttcttgagtaactatgacaggttggtgagggccaagactctgattgatcctaacaatgttttcaccaatgaccagggcattcctcccatatctttgaccatttctgatgtcaaaccacagagcaaataa

SEQ ID NO: 2006 - DNA, 2366 bp, Glycine max var. Williams 82
cttttatgtctgttagttagtcatcctagtatgtagttactctctcacgcaaaccacctacacttcagttttgtttctcagatgttccaattagtattcttgatgttattctgtttttttgtttttgtctgctttcaatgataaagtgattctatagaagtgttcatgttcactctgctaaccttccaaattccaatattaaactatggccggccacaacatatgcatggttgctacgtttctccatccttttaatttgtgtcttaaactattaaagccattctccaatggccataaacttaaactggttctgcaacaattacagaccaccttgcttctagttctagcattcaaaaatatcttaaagccatgttctacttcctcaaaagattgtgccttttatgtttcctcttgctatcctttgatgtttcactgtgttcatgtgcttcactcagagacttggcttcttgcttggataatcacgatatcaaaaactttaccacgctcccttacaaagaacatgatcattcctctgcctataattactacaaaattctcaatttttccatccaaaaccttcggttcgcagaacccgtgattcctaagccgatagccattgtactgccagagagtttggagcagctgcagaaaagtgtagcatgctgtagagaaggcttcatggaaataagagtaagatgtggtggacacagctatgaagggacttcatatgttgctgatgatggcactccttttgtcatcattgacatgatgaatttgaaccatgtttgggtggacatggagacagaaacagcatgggttgaaggtggtgcaacattgggagagacttactatgcaatctctcaggcaagcaatgaacatggattctcaggtgggtcatgtccaactgttggagttggaggacacattggtggtggtggatttggaattttgtctagaaagtatggtctcgcggcagataacgtggtggatgcccttctagtcaatgctgacggaaaattgttcgaccgcgaaaccatgggagaagatgtgttttgggccattagaggaggaggaggtggtctttgggggatcatttatgcctggaaaatcaaggtgttgaaattgcctcaagttgtaactagtttcactgtatcaagaactggcacaaaaaggcatgttgccaatctagtgcacaaatggcaaaatgtagcaccaaacttggaagatgacttctacttgtcatgctttgttggtgctggcttgcctcaagctaaaaccaaagggttatcaacaacatttaacggcttctatctcggtcctagggccggtgccatatccatcctagaccatgcctttcctgagttgggtattgtagaagaagaatgcatagaaatgagttggattcagtcaactgttttcttctctggcctaagtgatggagcctcggtctctgacttgaacaacaggtatctgcaagaaaaacaatatttcaaggctaaatcagattatgtaaagaaacatgttcctcttgtgggcatagaaactgcactagacatcctagaaaaggagcctaagggatatgttattttggacccttatggtggaaagatgcataatataagcagtgaatctattgcttttccccacagaagaggaaacttgtttacaattcagtatctgatatattggaaagaagctgacaatgacaaaaacagtgattatgttgattggataagagggttctatgctgctatgactccctttgtctcatggggtccaagggctgcgtatgttaattacatggactttgaccttggagtgatggagcggattagcaatggtgctaatatgaaagatgttgtggaacatgcaagggtttggggtgaaaagtacttcttgagtaactatgacaggttggtgagggccaagactctgattgatcctaacaatgttttcaccaatgaccagggcattcctcccatatctttgaccatttctgatgtcaaaccacagagcaaataaatgatgccatatttgtaaaagggattagcatattcatttgaattgtgtgatatcactgtgatcccctgcatttgtgagcaaattgcatttcatgttagattgagcttcaatcaattgtagtaactacatcaatctacgactagtcagttagaagttgaattgaatgtggaccatatgcaaactctagattggttgaaacatgaaatgaaatatctcccaatatcttttcttttttttaatgttatcccaacagtaaatttttacaacagtctctacaaaaaaagagataaaagaaaaaaagagaaaaaatgttataaaataagtgatgtaatgggaaaaaagtg

SEQ ID NO: 2007 - DNA, 171 bp, Glycine max var. Williams 82
atgattggcacaggaacatggacgtcttttttgcaagagtcttcatatttgtcatgttccctcatgattaatcttctttttcaatgcctctttttcttcctcctacttaacacaatccttcttgtttcaaatttgggtatggtgctaggtgggccatacttttatttatag

SEQ ID NO: 2008 - DNA, 993 bp, Glycine max var. Williams 82
atggagggaagagagaattttggtgttgtggtgggtgatgaggctccagagagcttccatgtggctcctagaattgagaacaacttggacttttcaagggcgaccgtgccggcgccggcgccaccgacggagggaaaaaagaagagagggaggccgaggaagtatgggccggatgggaagccggcgttgggagcggtgacggcgctttcgccgatgccgatttcgtcgtcgattccgttgacgggcgagttttctgcttggaagaggggtagagggaggcctgttgaatctatcaagaagtcatcgtttaagtttgaggttgaaagcccaggaccaggcgagggaatagcatactcagttggtgccaatttcacaccacatgtgctcacagtaaatgcgggcgaggatgtcactatgaagattatgtccttctctcaacaaggatcacgtgctatatgcattctatcagcaacggggacaatttcaaatgttacacttcgtcaaccgtcttcttgtggtggtactttaacatatgagggacggtttgagattctttccttgtctggttcctttatgccaactgagaatggagttaccagaagcagatctggagggatgagtgtctctttggctggtccagatggtcgagtaatggggggcggacttgctggtttgttggtagctgctggtccagtgcaggttgtggtggccagttttcttcctggtcaccagttggagcataaaaccaagaagcaaagggtggggcatgtatcaactattagcccttcacctgttaatcttatcactagtgaggaaataatagtcagtttcggtggagtaaagcctattatgacacctgctgcttttcaagaagagaatattgcttcttttaacaatggtcaagactatagaaactcatcagttgatgacaaagatcctttgcctgaaaaggagtctaacctaagccaatcaaatgctgaggctgtatgctaa

SEQ ID NO: 2009 - DNA, 3251 bp, Glycine max var. Williams 82
ttttttctcttctgtcgttctggatttgaattgcattaattaactggttcggttaattttctggttatttcttattcattatttaattttccaacacttgttttcttttgatcactttgtttatagctgagttcagctttatcaagttttttctaagtgttggtttatgcttttcttctaccatttgcatgcatttagctgtttcctctagaatctggatatctggtttcttctttctgacatcatcattccactcggtttcatcatttagagtgagtcagcactcagcatagctgccaagaatagcagtggtgttttcttgtgaagatggtactgggattaagatcaaagagtagaaaacgtgtttcaatccaagttcactacatcatccatgttctggagatcaagccgtggccaccttcacaatcactgagatctgttcaatcagtatttctgcaatgggaaaatggtgataaaaattctgggtctctgccatccactgctggcaatgggaaaattgaatttaatgaatctttcaggctttcagtgcttatgtgtagagaagcatccaagaaaggcaaacaccctgaaagtttccagaagaactgcttagagttttacttgtatgacaagacagtaaagagtcaactgttgggatctgccatagtaaaccttgcagattttggaattattaaggaaactaaagccttaagcattgtgtttaactgcaagaagagtttcaggaattcttcacaaccatttctttatgttactattcagccatttgatatagagagttccagctcatcaccaagcagcagcttatcaaaagaattgtcactagagaaggaaggaagcgaatctgtatcacagtcactaaaagatgatgacgatcttgaaattgcctcttttactgatgatgacagtgatgacatcccttcaaatacctcccaaactagcagatctgcttcagagattactggagacagcaccaaaatcagcagaggaagagaaggatctcatggagaatttgttctaccctcggaaagtactactgctagcttaaatggaaacacagagggtgaaccatccacacaattcagtggcatcaattctccctcttcgtctacagttctgagctcagatgtgggaattgctgcccatggaaggcctttattacctaaaatctccgaggaaattgttaaacttgctgatgcaagttctgaaattcaaaaaagcattcaacaatattctccttcatacatttcatcaagtatgaaacccaactttgaaagatctttacagcctcaagtgactcaagaggatagcatgactcaagaagatggcacaagagatcagagatttaataaagattctctggagaaagttagtaatgtttctaaaactggagttctggatgacaaagagaaaatgaaggagggaaggaaaggacaagaacagtttactatgaggaatgaacttttagaaaatgagctcgttaagaattcatctgatgatggttctataaagaaagggaaattcaatagtactactcttctgctaaacaagaaaacacatgaacatccaatgagtattttgatgaatgataaaacagaggatgtgacaaatgtgaagtctcctccacaatcttctgagaactatgggatgttcatcagcaatcagaactttgaaagatctttacagtctcaagtgactcaagaggatagcatgactcaagaagatggcacaagagatcggagatttaataatgattctctggaaaaagttagcagtgtttctaaaactggagttatggatgacaaagagaaaatgaagaagggaaggaaaggacaagaacagtttactatgaggaatgaacttttagagaatgagctcgttagtaatttatctgacgatggttctacaaagaaagggaaattcaatagtactacttttctgctaaacaagaaaacacatgaacatccaacaagtattttgattgatgataaaacagtggacgtgacaaatgtaaagtctcctccacaatctgctgagaactatgggatgttcagcagcaatcagacccatattcaggcagaggaaattaataccacaaatgatgttcatgttggtacttcttgccatgaagatgttaatgtgaatggaagctttcttaacaatgaaactgaattgaaggctgaagttgaaatgcttcaagaagagctaagggaagctgctgctcttgaagtttcaatgtactcagttattgctgaacatggtagctcatcaaacaaggtccatgcacctgctcgacgcctttctagattctatttccatgcttgtagagttgggtccccagatacaatggctagtgcagcccagagtgctgtctcaggatttgttttggtttctaaggcatgtggaaatgatgttccaaggttgacattttggttctcaaatttaatattgctgagagcaattgtgagcaaagaagttgaacgtgatggaaatggtaacactcttcacaaagaagaaaaaccttttcatagctgggaggatccagaaacatttttagttgcattggaaaaggttgaagcatggatattctctcgaattgttgagtctgtgtggtggcagactcttacaccatatatgcaatctgcagctgctaagagctctagctctaggaaagcctatgagaaaagatatcgtgttggtgatcaagatcagggaaatttttctattgatttatggaaaagagctttcaaggatgcatgtgaaaggatttgccctcttcgagctggagggcatgagtgcggctgcttgcctgtgatagctagattggtgatggagcagttggttagtagacttgatgtggcaatgttcaatgctattcttcgtgaatccgctgaagagatgcccatggatcctatatctgaccccattagtgattctaaggttcttcctattccagctggaaaatcaggctttggggctggtgcacaactgaagaatgctaaatgagcatgctgaggtgaatgagtgcgtacacaagaaaagagagtaggaatgaatgtatgtatccatgagtgttataatagcatcaactgaagagaagatgatggaaactcgcttagtttgatcttgtgagaagaagaccagtagaggcttcagtgagaaaagtgaatcaaatggaagttagtccaatcaaaaaaggtggagaaagacctaagaaaacttgagaaaccatc

SEQ ID NO: 2010 - DNA, 984 bp, Glycine max var. Williams 82
atgggtagcttattcctaggacaaataaaaaagcagacatcaactttcctacaagaaaagttcaaatctgctaggatgacgtttactgatgttactgaagcagaaatgctggctgaggaagcaacaaataaggatgattgcagccctgatgccaaaactatgactagaattgccgaggcatcatttgacatagatgaatattggaggattgttgatgttcttcacagaaggttgtataacattgattgggatcaatggaggcaatcttacaaagcactagttcttctggaattcttgttgacccatggtcctcgagagtttgctccagaatttcaatgtgatgcagaagttattgaagaactaggaatttttactcatattgatgaaaaagggtttaactgggggtcaagaatgctaaaactgtcagagcaaatactcaagcttttacaggatgaagaagctctcatagaagcacgtttgaaggctctcaaaataacaaatgaaatacaaggctttggaagttcattcaactctccaacttcatcatcatcatcatcatcatcaccttggtctttatcatctgaagcgtcacaaggatcttcatctttctattcattttccaccacaagtacccctgcttacacatttgattccaatgatcagctaaacaaacaccactcaccaacctccatagcaaatgatggtaatattaatatagtcctcccaccaaagaatattaatgtgaccaaaaaccatgtttggaagcgttttgcaggtgaagagaataacattttgattgattctgatgaggatgaagacatggaaaaaccaaaagggcttctaagtgaaatttgctcaaagattattggtggtagtcccataaaaggagataatcgtgaaaatattgaatttagatgcctatctgatgttgggagcaaggtgacccaaaagaaattagatcgccgatattcaatttggttttaa

SEQ ID NO: 2011 - DNA, 720 bp, Glycine max var. Williams 82
atgtccttactgagcgccagtttcaccgcctcgacgccaattgccttggcctcctcgtcgtctctgtcatcaaggccaaccgcacgctctatactgggcgatggaaacacctctgattccatctccactgtgggtgtggctgactcttctccatcttcttctggctacgcaggaaacacctctgattccatctcctctttgaagctcaatctcctggaacttgaagctggtggaggatttgtgaatctctcgcttggtcttgagaatttgcaaggaagatggaaactcatttatagcagcgcattctcgtctcgaactctcggtggaagccgtcccggtcctcccataggaagactccttcctattactcttggacaggtttttcaacgaattgacatcttgagcaaagattttgataacatagtggagcttcaattgggtgctccttggccactacaaccccttgaagtaactgccacattagcccacaaatttgaactcataggatcttcaaagataaagatagtatttgagaaaaccactatgaagacagctgggaatttgtcacagttgcccccattagaggtgcctcgaattcccgatgcattgaggcctccatctaatacgggaagtggtgaatttgaagttacatatcttgactcggatacccgcatcacaagaggagatagaggcgagctaagggtctttgtgattgcttga

SEQ ID NO: 2012 - DNA, 411 bp, Glycine max var. Williams 82
atgttgggtggtcgttctttccctcccaaatggtcagctaaattctgtgactgtggagaagatcctaagacatgtttgataacttgctgtctaccgtgcgttacctttggccaaattgcagaaattgtggatgaagggcgtagttcttgctttggacaagggtgtgcctatgggttacttatgttggtgacgtgtcactggctctactcgtgcctttacagagagaaactgagatcaaagtttgggttaccagcggaaccttgttgtgattgctgtgttaatttctgctgcgaagcatgtgccttgtgccaagagcatgctgagcttaaagcaaggggtttcgacccttccaaaggttggattgggccaccaaatgctcctccacgaatgccaccttccatgtctagatga

SEQ ID NO: 2013 - DNA, 411 bp, Glycine max var. Williams 82; identical to SEQ ID NO: 2012

SEQ ID NO: 2014 - DNA, 213 bp, Glycine max var. Williams 82
atgtcgtccgagtgcaaaggtaagagctcatggcctgagttggttggagtggaaggaacggtggcggtggctacaattgagagggagaatcctttggtggacgctaacactgtgctgaaaggaaccatagtcacccctgatttccgatgtgatagggtttgggtttgggtcaccaaagacggaattgtttatcaggttccaacaattggataa

SEQ ID NO: 2015 - DNA, 213 bp, Glycine max var. Williams 82
atgtctgacgattgcaaaggtaagagctcatggcctgagctagttggagtgcaagggacagttgcggaggctacaattgagagagagaaccctttggtggatgctatcattgtgcccgaaggaaacatggtcatcactgatttccgctgtgatagggtttgggtttggatcgataaagatggaattgtcaaggaagttccccacattggatag

SEQ ID NO: 2016 - DNA, 1347 bp, Glycine max var. Williams 82
atgaaagttaacgccgttaagaaacggcgtgtgaccgacgaggctcatataaaacgcgcgacaacacaacatagtacaggacaaaactcaaagcataaaactcaaacacaactcaccaacacagttgttgcattatttcttttttccagatccaacttcaaaattgcaatgggagtggaagatacagatatttgtatcatcaaggagccagatcatgttgtagtctattcagatggcatttctcatgattcgggtcatgaagctggaagtggtcatcacaatattacagagtcgtatgaacaaatcaatgagactactgaacatcatagttcagaggatagtgcaaaggaatatgaggtgaaggaatgcacaacagaagtttctgttaaggtctctgatgtctctaatgttaaaaaatgtgaggataagttaacctcagattctgagggtgtcgtcagtgagaaaagttttaaatctaacaaaacaaggggtaagcataagccacgagataccgggaagaatggaacaagacctcctgttacaggcagtgcccaaatcaagcccacagttccacaaccgttttccctagcaactgaaaagcgtgcttcggttgcaactcgtcctgcttttgaagaagacaacaagggcagtaacaagagaaaatctttaaacaaaaaaaatgtgctatcttccaatatgtttaaacagaatcagttgaaatctcctgtagtttcaagaaagccattgcaacctgataacaagaagcatcctgatgatgatgattcttgttcagttgcttcaataactgcagcttctgtgcgatcaatcaagtccaggacaactgttgcttctgctcctgtgtttcggtccagtcaacgtgcagaaaaacggaaggagttttatacaaaattagaggaaaagcagcaagcaatggaagctgagaagaatcaaagtgaagctaggaccaaggaagagatggaggaagctatcaagcagctaaggaagagtctaacttttaaagcaagccctatgccaagcttttaccatgaagggccccctcctaaggttgaattgaagaagctaccagcaacgcgagcaaaatctccaaagctgggccggcgaaagagcaacaatggtgcagttaatttatctgaaggggacaaggagaaaggagctggaatcaggagaaagcatcacacacttaagacagacaactatggtgataagagtgatgtaaatggcttatctgacctcaaaaacaagaccaagcatattgaagaaattgatgcgaccgaggtaactggacaagcagacttggagattggcagccagtgcagttttcagtga

SEQ ID NO: 2017 - DNA, 444 bp, Glycine max var. Williams 82
atggatgaagaagggtcaagggggagggccaaggaggacgccggagatgtccggtaccggggggtccggcggcggccctgggggaagttcgcggcggagattcgagactcgacgaggcagggtcagagggtgtggctggggactttcaacacggcggaggaagcggccagagcctatgatagagctgcttataccatgagaggtccatttgcaatccttaactttcctgatgagtaccctgtgactgctgctggtgccactaatgctgccacttattcttctgcttcatcatcatcatccttggcctcttcttctcggcatgccgatgtggaagctagaggaagaagtgagcaaggaagagaagtgtttgagtttgagtacttggatgataagttgttggaggagcttcttgattgtgagaacaaaaagaaaagaggaccctga

SEQ ID NO: 2018 - DNA, 387 bp, Glycine max var. Williams 82
atgatggatggatgggatcttgggcttcattgttatcttcttaatgaagacttggtctgtgatgaacttgaggatgttatggaagcggggggaaacattgtggactaccatggctgcgttttctttcctgagcgatggtttaattgtgtggttgtacttcaaactgataacaccattttgtatgatcgtttgagtaggagagggtacaaagattcaaagctttcaaacaatattgaatgtgaaatcttccaagttctgcttaaagaaagttactcggaggagaaagtgattgcaatgaagagtgataatattgaagacattagtagaaacgatgcaactctgacagattgggtcagaaattggtccttaccctcacaaacttcttaa

SEQ ID NO: 2019 - DNA, 762 bp, Glycine max var. Williams 82
atgacgatgaagataatggtagcgattaagcgagtggtggactacgccgtgaaaatcagggtgaagggcgacaagacaggggtggtgacccataacgtgaaaatgtcgatgaaccccttctgcgagatcgcgctggaagaggccctccgcatcagggagtctggcttggcctccgaggttgtcgccgtcaccatgggaccctctcaatctgtagacactctccgaaccggtcttgccatgggagccgacagaggcatccatgtcgagtcaactgcttctctctaccctctctctgttgccaagattttgagaaaactcgtcgagattgagaaacccggtcttctcatccttggcaaacaggccattgatgacgattgcaatcaaacaggccagatgatagcaggactcctcaactggcctcaaggcacttttgcttctaaggtggtccttgacaaagagaaacaggttgccacagttgacagagaggttgacgatggtattgaaaccgtgtgtctaaacttaccagcagtaataaccaccgatctgagactgaaccaaccaaggtatgctactcttcccaacataatgaaagcaaagtcgaaacccataaaaaaattcactccggaggagttgaatgtagaaatcaaatctgatttggagatagttcaagtcacagaacctcccaagagaaaagcaggggttattctttcttctgtggatgagctgattgacaaactaaaacatgaagctaatgtcatctaa

SEQ ID NO: 2020 - DNA, 2583 bp, Glycine max var. Williams 82
atgagagttgcagttgttggtgctggaattagtgggttagcttctgcttatgttttggccaaaggtggagtgaatgtggttctctatgagaaggaggattctttgggaggacatgctaagactgtgaatgttgatggggttgatattgaccttggtttcatggtcttcaaccgggtcacctatcctaatatgttggatttttttgagaatcttggagttgacatggaattatcagacatgtctttttctgtaagtttagacaaaggccgtggatgcgaatggggaagcagaaatggtttgacaagcttgtttgcacagaagaggaatgtactgaatccttacttctggcaaatgataagggaaattgtcaagttcaaagatgatgttattagctatcttgatatgcttgagaataacccagatattgaccgcaacgaacctctaggggaattcatcaagtcaaggggttactcagaattatttcagaaagcctatcttattccaatttgtggttctatctggtcctgctcttctgaaggagttatgagcttctctgccttctcagttctttcattctgtcacaaccaccatctacttcagctctttggcagaccacagtggctaactgtaagatggcggtcacaaacttatgttaataaggtcaaagaagagcttgagagggaaggtagccaaataataactaatcgtgaggttcagttggtttcgacatctgaaaaagaatgtgttgttcactgcaaagatggttctgaagaaatgtatgatggatgcataatggcagtgcatgcacctgatgccttgagattattaggagatgaagcaacatttgatgagcgaagaatactcggagcttttcaatatgcttacagtgatatttttcttcatcgtgacaaaaatttaatgccccaaaacccagcagcatggagtgcatggaattttcttggtagtaacaacaacaaagtttgtctgacatactggatcaatattcttcagaatatcaaagaaacaagtcaaccctttcttgtaactctcaatccagatcatataccagaaaataccttgcttaagtggtcaactggccatccagtcccatcggttgctgcattcaaagcttcattagagctagaccatattcaagggaaaagaaaaatctggttttcaggggcctacctaggttatggatttcatgaagatggatttaaggctggcatgatcgcagcacatggccttcttggaagctgttgtgtccttcaaaccaacccaaaacacatggtaccttcttggaaggaactgggagcacgcatttttgtgactagattcctgagttactatatcaatactggttgtttaatgttattggaagagggaggaacaatgttcacctttgagggaactggaaaaaactgcggtctgaagagtgttttgagagtccacaatccacaattttattggaaggtgatgacacaggcagatttaggccttgcggatgcatatatcaacggggacttttcatttgttgataaagatgaaggtctcttgattcttattttgattctcatagccaacagagattcaaatgcatccaatttaaaactgaagaagaatagaggttggtggacaccagttttccttacatctgctttgacatctgcaaagttcttcatggagcatgtttcaaggcgaaatactctcacacaggctcgcaggaacatctctagacattatgatctgagcaatgaactctttgcgattttcttggatgaaacaatgacatactcatgtgcactgttcaagaataaagatgaagacttgaaagatgcacaaaagagaaaaatctctctcctgattgaaaaagctaggatagataagacacatgaaattcttgagattggatgtggatggggaagtttagccattgaagttgtcaaacaaaccggctgcaaatacactggtatcacgttgtctaaggaacaactgaaacttgcagaacaaagagttaaagatgccgggcttcaggaccgcatcaagtttcttctgtgtgactaccgccaattgcccaaggcatataaatacgataggataatatcttgtgaaatgatagaagctgttggccatgaatacatggaagagttctttggttgttgtgaatcagtattggcagataatggacttcttgttcttcagttcatatcaatcccggatgagcgttatgacgaatataggcgcagttctgattttataaaggaatatatatttccaggaggttgcctaccttctctaagtaggataacatctgccatggcagccacatccagactttgcggggagcacgttgaaaacataggaattcattactaccaaacactcagatgctggagaaaaaacttcttggaaaggcagaatgaaattatggctctcggatttaatgaaaaattcatcaggacatgggaatactattttgattactgtggtgcaggttttaagtctctcacacttggaaattatcaggtggttttctcacggcctggtaacgttgctgcattaggcgatccatacaaaagctag

SEQ ID NO: 2021 - DNA, 693 bp, Glycine max var. Williams 82
atgaactcaaaaaaccaaacaccgattagggttttcgggcagcgaaccattgcttcaacgttccgcaatcttccaccacgcaatcctccttctgaaggaaacgagagaaatcaagcttcacgcaagagcgaaaccgcgcatcactcgctttcgcacttcctcaccctcaagccgcaaaaatctcctcaaacagttccggggaaatcgacgccttttctgtcaccactgggtttaaaaggtgaggagggtggagctgtgaaagaagttgaaaaagagaaaaacggtggcagtgatgataaggtgatttttaaaagctttaagcacactgaagaggacaaaagagactttgttgatcaaattgaggttggtgaattggaaaattcagttgcggaggatattcaggagtcaaataaaaggaaaactcctttcgaaggtgcaaatgagagccaaactgcacgaaacaatgtggtagttcttggaggagcatcaaagttgaagccaaaaaaaggacaaattggaaatgacactagcaacaaaaggccaagacctcattataatcactcagatgcaaatggccgtggctggtgggattacgacatggaaggtgttgataatgaggaattgggcttcagtgatgaagtatgggagggggtgggatccaccacacttggtggaatagtagattggcattga

SEQ ID NO: 2022 - DNA, 672 bp, Glycine max var. Williams 82
atggcagaggtgaagcttcatggattttggtatagtccctacactttgagggtggtatggaccttaaagttaaaggatataccatatcaaaacatagaagaagaccgctacaataagagtcttcaacttcttgaatacaacccagtatacaagaaaactccagtgcttgtccataatggaaaacccttatgtgagtccatgcttattgttgaatacattgatgagatttggtcacataattcattacttcctgctgatccctacgagagagctctggcaaggttttgggttaaatatgctgatgatgacatgttttctgcagttattgcattcttccttagcaataatgatgaagagcgagaaaagagcatagagaagatatgggagcatctcagggttgttgagaatcagtgttttggtgatcagaagaaattttttgggggagacattattaacattatggacatagcttttgggtccatattcaaaattcttgtggttgcagaagatattcttgacgcgaaggtcctggaagatgagaaattccctcacttgcattcatggtataataatttcaaggatgttgcagttattaaagaaaacctcccagaccatgagaaaatggtggcttttgctaagtttattagagaaaaacgtttggcatgtacctaa

SEQ ID NO: 2023 - DNA, 783 bp, Glycine max var. Williams 82
atggaatatgaatgtagccctcttggctgggaattctaccaccaggaagagggattagaggacttgagacattctcttttgtacacaaccttggagctagatgcaacaattgcatcagctaaggaggagattacaagaagagaatgtgaattgatccatgtgaatgacctcttaagcagggtcatcaaggagagagatgaggcacaagcaaaatgccagaagctaatgctggaaaaactagaactccaacagaagcaacagctagaacaacaccaatttgttcaaacacatcaaagagataccatatcacaaagtgaagaagagcagcaagaaggcttctctgaaaagcattctgcatcttctgactgtgaagaaaacagcagcatgccctctcctggtggaagttcaaccccacatcaatcaacaccactgcaggtggtaatggagttggcagaaaagaaaccattgcctgaaaaagggaaactcttaaaggcagtggtggaagctggaccactgcttcagacacttctcttagcaggaccactcccacagtggcaacaccctcctccacaactcaactccattgagatccccccagtggccatttcaccccaacaagactcttcttctaccaaaagtgcttctttccctttcaataagaagaagagggaccttcttgtcctctcaaggagtagaaaggtcattcagcacatgccaacaacacctaccactaccattgctgctgcttcacatcattccctaccacacccatcattttcataa

SEQ ID NO: 2024 - DNA, 1713 bp, Glycine max var. Williams 82
atgtcaggtgaggaaatcttgtcatccaatgaagaaaaatataatagatctcaacctccatttggtagcaggagtggctacaattcaagaacaggcatttatcactctctaattaagcttggcatcaagcatgaaatcccaacaaggcctgatcttaacactgccaattttgtgctgtcacagtttccacaagcacaccttgctgaggcaagaattgcattcattgatgcgagaactaatctgagtgttagctatggtgagctaagacggtctatttactcccttgcatcagctttgttccatggacttgaggttaggaaaggtgatgtggtatttgtattgtcaccaaactcaaccctgtactcaaccatatgcctagctgtgttatcagttggagcagttctgaccactgccaaccccatcaacaccgcaacggaaatcgcgaaacaagtgcacgattcgagtgctaaactagccatctcagcacctgaggagctacacaagttggtcccaactggggttcctaccattctcacttctcattgttctgatggcaacatgttatcagttgaagagttaataaaaggctgttgtacttcaccagagttgcctcaagttcccgtggcacaatcagacactgctgctatactttactcttcaggaaccacaggggtaagcaaaggtgtggttctgacacatgcaaatctcatttccataatgagactactcttgtggtctgcagatgtaagtggatcccaagatgatgttttcttggccttcattccaatgtttcacatctatggacttgtgttctttggattaggattgttgtgtgttggtgttacaacaattttgatgcagaaatatgacttccaagctatgcttgatgccatccagaagcacaaggtgaataacttaccagcagtgccaccagtgatccttgcactagtaaaacatgcaaggaaagctacgtgtgacttatccagcctaagaagggtggggtcaggtgctgcacctttgagcaaggaagtggcactagagtttagaaggatgtttccatggattgaactgaggcaaggttatggcctaacagaaagtagtggtggagcaacattttttgcctcagataaagatgctaaagctcatccagattcatgtgggaagttgattccaactttttgtgcaaaagttgtagatattgaaaaggggaagcctttgcctcctcacaaagagggagaattatggttcaaaagtcctaccattatgaaaggatatctaggaaatttggaggcaacaagtgcagcaattgattcagaaggttggttgaggactggtgatcttggttacattgatgagaatggatttgtttatatagtcgaacgaataaaggagctaatcaagcacaatggttatcaggtggctcctgcagaattggaatctgtgctgctaagtcacccccttatagttgacgcagcagttataccggttgaagatgaagaaactggacagataccaatggcatatgtggtgagagcagctggttctgaactctcagaaaaccaagtcattcaatttgttgcaggccaggtggctccatataagaaagtgagaaaggtgagtttcattgacactattccaaagtcagctgctggcaagatattgcggaaggatcttgtttctcaaagcaaatatcaacttgtctccaagttatga

SEQ ID NO: 2025 - DNA, 1713 bp, Glycine max var. Williams 82
atgtcaagaaaggaagaacggtcatccagaaaagatgaatataacaaatctctgcctccatttgataccaggagtggatacgattcaagaacaggcatttaccactcgctagttaagcttggcacaaagcatgaaatcccaacaaagcctgaccttggcactgccaattttgtgctgtcacagtttccacaagcacaccttgctgaggcaagaattgcattcattgattcaggtactaatcggagtgtaagctatggcgagctaagacggtctatttactcccttgcatcagctttgttcaatcgacttaaggttaggaaaggtgatgtggtatttgtattgtcaccaaactcaaccttgtactcaaccatatgcctagctgtgttatcagttggagcagttgtgaccactgccaaccccatcaacactgaatcagaaattgccaagcaagtgcatgattcaggtgcaaaactagccatctcaacactagaggatctacacaaattggtcccaactgggattcctacaattctcacttctcgtccttttgacggcaacatgttatcaattgaagagttaatagaagactgttatggttcaccacagttgccacaagttcctgtggcacaatcagacactgctgctatactttactcttcggggaccacagggagaagcaaaggtgtacttctgacacatgcaaatatcatttccataatgagactactcttctggcaagttgatgtcagtggatcccaagatgatgttttctttgccttcattccgatgtttcatatctatggaatgattttctttggattaggattgctgtgtatcggtattacaacagttttgatgcagaaatatgacttccaagctatgcttgttgcaatccagaagtacaaggtgaataacttaccagcagtgccaccagtgatcctcgcactagtaaaacattcaagcaaagttaagtgtgacttgtccagcctaaaaagggtgggatcaggtgctgcacctttgagcaaggaagtggcacaagagtttagaaggatgtttccttcggttgaactaaggcaaggttatggcctaacagaaagtagtggtggagcagcattttttgcctctgataaagatgctaaagctcatccagattcatgtgggaagttgattccaactttttgtgcaaaagtgatagacattgaaacggggaagcctttgcctcctcgcaaagaaggagagttatggttcaaaagtcctacaattatgaaagaatatctaggaaatatggaagaaacaagtgcaacaattgattcagaaggttggttgaggactggtgatcttggttacattgatgagaatggatttgtttatatagtcgaacgaataaaggagctaatcaagcacaatgggtatcaggtggctcctgcagaattggaatccgtgctgctaagtcacccccttatagttgatgcagcagttataccggttgaagatgaagaaactggacagataccaatggcatatgtggtgatagcagcaggttctgaactctcagaagaccaagtcattcaatttgttgcaggcgaggtagctccatataagaaagtgagaagggtgagttttattgacactattccaaagtcagctgctggcaagatattacgcaaggatcttgtttctcaaagcaggcatcaacttgtctccaagttatga

SEQ ID NO: 2026 - DNA, 438 bp, Glycine max var. Williams 82
atgggtgctttcactgataagcaagaggctttggtgagtagctcatttgaagcattcaagacaaacattcctcaatacagtgttgtgttctacacctcgatactggagaaagcacctgtagcaaaggacttgttctcatttctagcaaatggagtagaccccactaatcctaagctcacgggccatgctgaaaaactttttggattggtacgtgattcagctggtcaacttaaagcaagtggaacagtggtgattgatgccgcacttggttctatccatgcccaaaaagcaatcactgatcctcaatttgtggtggttaaagaagcactgctgaaaacaataaaggaggcagttggggacaaatggagtgacgagttgagcagtgcttgggaagtagcctatgatgaattggcagcagctattaagaaggcattttag

SEQ ID NO: 2027 - DNA, 435 bp, Glycine max var. Williams 82
atgggtgctttcactgagaagcaagaggctttggtgagtagctcattcgaagcattcaaggcaaacattcctcaatacagcgttgtgttctacaattcgatactggagaaagcacctgcagcaaaggacttgttctcatttctagcaaatggagtagaccccactaatcctaagctcacgggccatgctgaaaagctttttgcattggtgcgtgactcagctggtcaacttaaaacaaatggaacagtggtggctgatgctgcacttgtttctatccatgcccaaaaagcagtcactgatcctcagttcgtggtggttaaagaagcactgctgaaaacaataaaggaagctgttggcggcaattggagtgacgaattgagcagtgcttgggaagtagcctatgatgaattggcagcagcaattaaaaaggcataa

SEQ ID NO: 2028 - DNA, 435 bp, Glycine max var. Williams 82
atggttgctttcactgagaagcaagatgctttggtgagtagctcattcgaagcattcaaggcaaacattcctcaatacagcgttgtgttctacacttcgatactggagaaagcacctgcagcaaaggacttgttctcatttctagcaaatggagtagaccccactaatcctaagctcacgggccatgctgaaaagctttttgcattggtgcgtgactcagctggtcaacttaaagcaagtggaacagtggtggctgatgccgcacttggttctgttcatgcccaaaaagcagtcactgatcctcagttcgtggtggttaaagaagcactgctgaaaacaataaaggcagcagttggggacaaatggagtgacgagttgagccgtgcttgggaagtagcctacgatgaattggcagcagctattaagaaggcataa

SEQ ID NO: 2029 - DNA, 1479 bp, Glycine max var. Williams 82
atggacactgtactaagtactacgctgctactcatgttggcatgctccatcgtgcatgttcttcgttcactacaagcaagaatgagaagaaaatcaaactacaatcttccaccaggaccctctcttctcaccatcattagaaactctaaacaactctataaaaagccacagcagacaatggccaagcttgccaaaacctatggccccataatgcgtttcaccataggccaatcaaccaccatagtaatctcctcaatagaagccacccaagaggttctccaaacccatgactcattattctcggacagaacaaaccccgacatcacaacctcgtacaaccacaaccgttacagcttggtttttctccctgtctcacccctctggcaagaactaagaaaaatctgccacggaaacttgttttcggcaaagacccttgacgcaagcacggaccttaggcgcatgaaaatgaaggagcttcttaccgatatccgccaaagaagcctcaacggcgaagtggtggacattggaagagcagccttcatggcatgcattaactttttatcgtacacgtttctctctctggattttgttccctctgtaggtgatggcgagtacaaacacatagtggggactctgttgaaagcaacggggacaccgaacttggtggattattttccagtgttgagggtgtttgatccacaagggatcaggaggcacaccaccaactacattgacaagttgttcgatgtgttcgatcccatgattgatgaacgcatgaggaggaggggagagaagggttatgccactagccatgacatgttggatatcttgctggatatttctgaccagagtagcgagaagattcataggaagcagatcaagcatttgttccttgacctattcgttgcggggacggatacaacagcctacggcttagagagaacaatgacggaactaatgcacaatccagaagccatgagaaaagcgaagaaggagatagcagaaacaataggagtaggaaaaccggtggaggaatccgacgtggcaaggctgccatacctgcaatcagtgataaaagaatctctgcgaatgcacccaccagcaccactgctactgccacgaagggccaaaacggacgtgcaagtctgcggctacacggtcccacaggggacacagatcctcatcaacgagtgggccataggaaggaacccggccatatgggaagacgcacataggttctcgccagaaagattcttggactctgacatagacgtcaagggtcgccacttcaagctcacgccgttcgggagcggaagacgaatttgccctggctcccccctcgccgttaggatgctgcacaacatgctcggttccttgatcaacaactttgactggaagcttgagaacaacattgaccccatcgacatggacttggatcagtccctcagggctatccctgttctcgtaaatgccaactaa

SEQ ID NO: 2030 - DNA, 1590 bp, Glycine max var. Williams 82
atggatcggctttcatcagcagctacatttaagagcatgcactatggcagtgcaagccaaatgggtttgatttggcaacaagccagggcacccctggtggttccattgatgaaattgctagtggttttgtgcctagccatgtcacttatgttgtttgtggagagagtttatatgggcatagtcataatctttgtcaagttgtttaggtacaagcctgaaaagaagtataaatgggagccactcagggatgaccttgagtttggaaactctgcataccctatggtcttggtgcaaattccaatgtacaatgagaaagaggtgtatcaattatcaattggagctgcatgtgggctatcatggccatctgataggattattattcaagttcttgatgattccactgacccaatcattaagaatatggtggagatggaatgccagagatgggccagtaaaggtgtaaacataaagtatgagatcagaaagaacagaaatggttacaaagctggggctctcaaagaaggcatgaagcacagctatgtgaatttgtgtgactatgtggccatctttgatgctgatttccaacctgagcctaacttcctttggcgcactataccgttcctggctcacaaccccgaagttgcactagtccaagctcgatggaaattcgttaatgctgatgaatgcttaatgacaagaatgcaagagatgtcattggattatcatttccttgtggagcaggaagttgggtcctcaacctatgccttcttcggtttcaatggcacagctggtgtgtggagaatttcagcattaaatgaagctggtggatggaaggaccgcacaacagtggaagacatggatctggctgtccgtgctggtctcaaaggcgggaaatttgtgtatcttagcgatctcaaggtgaaaagtgaattgccaagtaccttcaaagcctatcgttatcagcagcacaggtggtcatgtggcccagctaatcttttcaagaaaatggcaatggaaataatgagaaacaagaaagtctccatgtggaagaagttatatgtgatttatagtttcttctttgtccggaaaattgttgctcatgtggtcacatttgtattctactgtgtgattatgccagcaactgttctatttccagaagtggaagtccccaagtggggtgctgtgtatataccttctatcatcacactccttaatgcagttggaactccaaggtcaatccacttgctggtattctggatactctttgaaaatgttatgtcaatgcataggaccaaggctacacttacaggtttgttagaggcagggagagtaaatgaatgggtagttactgagaaattgggagatgctcttaaaacaaaatcaggtggtaaagcagctaggaagtctcgtatcaggattggtgaaaggcttcatttcctggaacttcttgtgggggcctatctctttttctgtgcatgctatgatcttaaatatgggaagaaccactacttcatatatctttttctgcaatctatggccttctttgttgcgggggttggctatgttggcacctttgttccaaattcatag

SEQ ID NO: 2031 - DNA, 891 bp, Glycine max var. Williams 82
atgcttggagtactctgcgccactcgccccaaaccttggcttctctccctcgtccacgtccacgcttccctgcctcgcctacctcattcccctctatcaccttcagcctcgccgccgccccgtcgccgccattccaccgcctgcaaactttttctctccggcggcgctgccgcctccatatggcacgctatcatgccccgaggtgatgacggattacggcgcggcgttgttgccgtccatgacttgaagggagagggatcgtggaatgtcgcttgggacgcgcggccggcacggtggctccaccgccccgactccgcgtggctcctctttggtgtctgtgcttgtctggcgccgccgccgggttgcgtggatgctgacactaattctgctggaatcgctgtggatgaaagttgcggccttctcgataaggaacgggaggaggatgaggtttctgctgattacagagtcactggggtacctgctgatggtcggtgtctgtttagagcaatagctcatggagcttgcttgagaaatggggaaaaagcacctgatgagaatcgtcagagggaattggctgatgaattaagagctaaagtcgtagatgagctgctgaaaaggcgggaggaaacagaatggtttatagaaggggatttcgatacatatctgcagagaattcaacagccttatgtatggggtggagaaccagagctattgatggcttctcatgttttgaagacaccaatttctgttttcatgagagacacaggctcggttgaattggtaaacatagcaaaatatggtgaagaatacaggaacgataaggacatttccatcaatgtgctatttcatgggtatggtcactatgacatactagagaccttacgaccataa

SEQ ID NO: 2032 - DNA, 183 bp, Glycine max var. Williams 82
atggcatcactcaaagctgagatacctgttgagaaatcttgttgctctcaaccatctgcaggacaggtgaagaaagagtcttctgccaaacctagttcaggcacttccaaagccacagcctccaaaccaaccccaaagaaaactccaagccagaataggaagaaggcaagcagcaataaataa

SEQ ID NO: 2033 - DNA, 608 bp, Glycine max var. Williams 82
ttatccctccatcatcccatggttgagtttattccattccctcaagatggtttctggaaatttggtgcatgtaattgtaataaccctatgttcaaattcagctataaatgcatgaatcttgtagcgttaaaacctgaggcaaggagaagagtagtgtaaaatggcatcactcaaagctgagatacctgttgagaaatcttgttgctctcaaccatctgcaggacaggtgaagaaagagtcttctgccaaacctagttcaggcacttccaaagccacagcctccaaaccaaccccaaagaaaactccaagccagaataggaagaaggcaagcagcaataaataagctgaagatgtgagagtgaaaagtacgaatggctaaaaaatagtagttggacttggaattatgggaggagtccataaggataatgttatatggtgctcttcaaccatgattatactaagtagtgctattgtctgtaccacttgtttatgttgtttctttgttatgtaactccaagatgccttggcctaataaataaaatatacttattctatgatgaagttgttcaaacagaaatttttattaattttgatagttgatactatct

SEQ ID NO: 2034 - DNA, 1515 bp, Glycine max var. Williams 82
atgactgaagaaagtgctggaaacacagttgcaacctctattaccccattcaattggtggtatctccaggcaaattctctttcttcctggaacgatactaatagcacatggagcaaccaaccaaaccctaactcttcctcttcttgtgaggaggatatatcagtctctacatctttcactaatgcttccaaccattcaagcctcaccgttgagtcctctcgcagactcattgagccacctgctccttcctccaccgagttgatgggagaacacgcatcagataatcaactttggagtcatgttttatcaggtgttggatcagacggcgagttacacaacagccaagaaattggagagaattttctggatgcactgtcatccaaaagcatgacaagcactatgtttcaaccagtgtgtgactacttgaagaaactagatcatacaagttgggagtataatggttcaacttcactaaatagctttgagaagcacttaaatgggttcagtgaggcgatgcttgagaataatgaaaggttgaccaagttatctaatcttgtgagcacttggtctattgccccaccagacccagaagttagtagccactttgatccacaaaaaacaaacaacatgtccttgagttctaattccatggatcatcacttcccacaatttgaacacttcaagcaaccttttgaagaagcaagtagaaactctggagtgttccctaattgctatgatcatgacatgaaggtcaagcaagagtatcatgcaagtgaagtgtcaccaggatcagtatttggaaaaccattaaatgcaaatggatatcgaaatggatttaatagcctttcagtggtagatagttgcaaactctaccatgacatgcccaatatttcttcatgcacaagaaatttctcagatgttatatcctttaatagtagattgggatggccagttattggagtccatggtcaaaagcctagtatgaagtacctgaacgtatctgaaccaaagaagcaaggtcttcagacaccatcaccaccgataagaactaatgttaatggaaaaggggaggggacaacacgtgaagtaaagaagaaaagatctgaagaatcttcagatgcaatgttgaaaaagcctaagcaagatacatcaacagcttcttcttcaaaggtgcaggcacccaaagtcaagctaggggacaaaatcacagcccttcagcaaattgtgtctccatttggaaagacagatacagcatctgtgctgtttgaagcaatagggtacataaagtttcttcaagaacaagtccagctactgagcaaccctttcttgaaagctaattcacacaaggatccatggggaagcttggatagaaaagatcataaggaggacacaaagctagaccttcgaagcagaggtctgtgtttagttcctacttcatgtactcctctagtttacagagaaagcagtggaccagattactggacaccagcatacagaggatgtttgtataggtga

SEQ ID NO: 2035 - DNA, 111 bp, Glycine max var. Williams 82
atggatctaagcagaaagtttgaaaacataaaaagccatgaacggaacgaagcacttcacaaatatagaataagaggaaacttttcatatatttcatcagtgtttaactag

SEQ ID NO: 2036 - DNA, 420 bp, Glycine max var. Williams 82
cctttttttttacctcccttttacatttccatcacataataatttatcttcttttttatttctctgtctccgtttctcggatctacgttcaccctgttacggtgtgaaaacatatatttccattaacatcatggatctaagcagaaagtttgaaaacataaaaagccatgaacggaacgaagcacttcacaaatatagaataagaggaaacttttcatatatttcatcagtgtttaactagtgtttaaattgtattttctttatttatttttattgtacgtgttcttattgtgttgaacaattgtaaggcacttgtccatccaagtacttccagttgcctgcatgcaatgtaattttcaaagttgtgtctgttcgcatatcatgctgacaaggcaacatatttaaaataacagattcgct

SEQ ID NO: 2037 - DNA, 1143 bp, Glycine max var. Williams 82
atggaggcaaagcgaggccatgccctcatgtgcttggcacgtgtttcactcttcctctgcgctctaaccctatccgctgctcacggaagcaccacggttcaagacatcgcgagaaagttgaaactcggggacaacgagcttctgcgcacggagaagaagttcaaggttttcatggagaattacgggaggagctactccacagaggaggagtatttgcgccgtttggggattttcgcccagaacatggtcagagcggcggagcatcaggcgctggaccccaccgccgtccacggcgtcacgcagttctccgatctcaccgaggacgagtttgagaagctctacactggcgtcaatggcggcttcccgtcatcgaataatgccgccggcggtattgcgccgccgttggaggtggacgggctgccggagaattttgattggagagagaaaggagctgtcaccgaagttaagttacagggtagatgtggatcatgctgggctttcagcaccacaggatctatagaaggagccaattttcttgccaccggaaagctcgtcagtcttagtgaacaacagctccttgactgtgacaacaagtgtgacataacagaaaagacttcatgtgacaatgggtgtaatggaggtcttatgacaaatgcctacaattatttgctcgagtctggtgggttggaggaggagtcttcatatccctacactggggagagaggtgaatgcaagtttgatccagagaaaatagcagttaagatcacaaatttcaccaatatccctgctgatgagaaccaaattgccgcatatttagtaaaaaatggtccacttgctatgggcgtgaatgcaattttcatgcaaacatacattggtggtgtctcatgccctctcatatgtagcaagaaaaggctgaaccatggtgtgttacttgtgggatatggtgcaaaaggcttctcaattcttaggcttggcaacaaaccatactggatcatcaagaattcgtggggggagaaatggggagaagatggctattacaagctctgcagagggcatggcatgtgtggaataaacactatggtttctgctgcaatggtgcctcaaccacaaacaacacctacaaagaattatgcttcttattag

SEQ ID NO: 2038 - DNA, 1703 bp, Glycine max var. Williams 82
gggtagaatggtcattacagattgtaacatacacgaaagaaaacagtgttaaaagcgaggaagaagaagagtgaaactgtggaagcagttgcagaccgagctagctagctagcaagcaagcacagagatggaggcaaagcgaggccatgccctcatgtgcttggcacgtgtttcactcttcctctgcgctctaaccctatccgctgctcacggaagcaccacggttcaagacatcgcgagaaagttgaaactcggggacaacgagcttctgcgcacggagaagaagttcaaggttttcatggagaattacgggaggagctactccacagaggaggagtatttgcgccgtttggggattttcgcccagaacatggtcagagcggcggagcatcaggcgctggaccccaccgccgtccacggcgtcacgcagttctccgatctcaccgaggacgagtttgagaagctctacactggcgtcaatggcggcttcccgtcatcgaataatgccgccggcggtattgcgccgccgttggaggtggacgggctgccggagaattttgattggagagagaaaggagctgtcaccgaagttaagttacagggtagatgtggatcatgctgggctttcagcaccacaggatctatagaaggagccaattttcttgccaccggaaagctcgtcagtcttagtgaacaacagctccttgactgtgacaacaagtgtgacataacagaaaagacttcatgtgacaatgggtgtaatggaggtcttatgacaaatgcctacaattatttgctcgagtctggtgggttggaggaggagtcttcatatccctacactggggagagaggtgaatgcaagtttgatccagagaaaatagcagttaagatcacaaatttcaccaatatccctgctgatgagaaccaaattgccgcatatttagtaaaaaatggtccacttgctatgggcgtgaatgcaattttcatgcaaacatacattggtggtgtctcatgccctctcatatgtagcaagaaaaggctgaaccatggtgtgttacttgtgggatatggtgcaaaaggcttctcaattcttaggcttggcaacaaaccatactggatcatcaagaattcgtggggggagaaatggggagaagatggctattacaagctctgcagagggcatggcatgtgtggaataaacactatggtttctgctgcaatggtgcctcaaccacaaacaacacctacaaagaattatgcttcttattagctatgcacttaaggaaatctaaataaatatttttcattctaggtgatgtatcatgtatgtaccaaaatattttggtacgtaagtcttttaaaaagtttgcatctcctctttggttttccttagttctgaaagttatctcctaagaagacaatcatatgtactgtacgtagtgtgaagatatagtattgtatgctgcagaatatgattgtctaataaggtggactagctgtaataaaagatatttccaggttgaaaacagagcaaatcatgttaaagagctataacattttctgcaggttagaaaagaattttggtaactgatggagttgatgagaaaagtgtaattttaagatggtgttcaaaattttatggaggattaacaacgatggcaaaagatggacctccaatccacataccaataatgccaatatag

SEQ ID NO: 2039 - DNA, 1887 bp, Glycine max var. Williams 82
atgacgcgcctcagaaaactcggcaccgtcgccacggccattgccaccgcgtacggtggcgccctcatcctgcacgagcctctcgtctccgccagcgatcacggaggcggttcccgcctcgaggcactccggaagaaggtgcacgactccgacgccgtcgtgccggccaggaaggcgcagctttcagcgctcgaggccgccggaaagtcgaatccgctcgacgttctcgtcatcggcggcggcgccaccggttccggcgccacactcgacgccgtgactcgaggactccgcgtcgggctcgtggagagggaggatttcgccgccggaacttcgtcgcgatccacgaagctccttcatggaggtgttcgatacctggagaaagctgtatttaaccttgactatggacaattcaagttagtgcttcatgcccttgaagagcggaaacaggttattgaaaatgcaccacacctatgtcatgcattgccatgcatgactccatgttttagctggtttgaagtagtgtactactggatgggcttgaaaatgtatgatttggtcgctggaagacaactgttgcacttatcaagatattattcgacaaaagagtctgttgagctctttcccactctggcaagggaggtaaatgatagaaccctaaggggcacagttgtttattatgatgggcagatgaatgatgcacgacttaatgttggattggcttgtactgctgctctagctggtgcagcagtgctgaaccatgcagaagttttatcattactgaagaatgatgatggaaaacgggttattggtgcacgaattcgggacaatttaactggcaaagagtttgatacatatgcaaaagtaattgtgaatgcgggtgggccattttgtgactctataaggaaaatggccaacaaaaatgcacaggaaatgatttctcccagcagtggggtgcatattatactccctgattattattctccagaaggaatgggtctaattgtccctaaaactaaggatggacgtgttgtttttatgctgccatggctgggaagaacagttgctgggactacagattctagtactagcattacttatcttccagaaccacatgaagatgaaatacaatttatattggatgccatctccgattaccttaatgttaaagtacgccgtgcggatgttctttctgcttggagtggcattcggccattagcagtggacccaacagccaaaaatactgagagtatctcaagggatcatgttgtttgtgaggattaccctggtttggtcaccatcactggtggcaagtggactacctatcgaagcatggcagaagatgctgttaatgcagctataaagtctggaaagctgacccccaccagtagatgtgtgaccaacaatctccggcttgttggtggtgaagggtgggagctttcttcttttacagttcttgctcaacagtataagcgcatgaaaagtacatatagtggtaaagttgttcccggggtaatggattctgctactgcaaagcacttgtctcaggcatatggaacattggctgagcgtgtggctaccattgctcagaatgaaaatttgggtaaacgacttgcccacggttacccttatctggaggcagaagtggcctactgtgctcgtaatgaatattgtgaatctgctatcgatttcattgcaaggaggactcgtcttgctttccttgaaactaacgcagcacgaaaggcattgcctcgcgtgattgaaatattggcaaatgagcacaagtgggacaatccaaagcagaaggaagagttggagaaggctacagagtttttgaagacttttaaatcctccaaaaatgctcagttccacgatggaaaacacagttag

SEQ ID NO: 2040 - DNA, 1542 bp, Glycine max var. Williams 82
aagtaggcactccactcctaaaatcaacttcttatccttcttacttcatagcaaacagtttggaaccccccaaaaatgggtgcaacgacggccattgccgcactctctcttcactgcttctccaaatcccacacacacttttcaccctttcgcactctccctcgcctcacatgctccttctcttcctccatcaaattcaacatctccttcgctccccctaagcccaagcccaagcccgaacccgacgcctcaaacgagcccgacgggccgctcctcatcccgtggatcgtccggggcgaggacggcaacctcaggctccaatcagaacctcccccgagcctcctcaatgccatcgccaccgcccaaaccggaaccaaaaaggacaataagcaaaccaaaaccaccgccgccaccgccaccaacaccactaaacctcaaaaggctcgctccacagcgccgccgcagcattcgaaggcggcgcggcggttctataaccaaaacatcaaggaatcctccgccgcgcgcctcagcaaggttctcgccgcctccggagttgcgtccaggagaagctgcgaagagcttatcttcgaagggaaggttacggtgaatggtaccgtgtgtaatacgcctcagactaaagttgatcctgcgaaggatgttatctatgtgaacgggaacaggcttccgaagaggcagcctcagaaggtttatctggcattgaacaaacccaaagggtatatatgttcatctggggagaacgagtctaaatctgtgataagtttatttgatgattacttgaacagttggggtaaaaagcatccgggagtacccacaccacggttatttactgtagggcgccttgacgttgctaccactgggttaattattgtgactaatgatggagattttgctcaaaagctttcgcatccttcatcaaatttatcaaaagaatacattgcaacaattgatggtttagttcacaagaggcacttaatagccataagcgagggaactactgttgagggtgtcctttgtgtgcctgatgttgtggagttacttccacgtcagccagagatgcaaagaactcgaattcgcattgtggttcatgaaggtaggaaacatgaagttcgtgaactcgtcaaaagagctggacttgagattcattcattaaagcgagtacgcattgtgcacactactttccggagtgtttaacgtgaagccaatatcatgctcttgcaatcagcatatatgtatagtctagaagaactgggagaagattttaaactactgcttagaagagatatgactttttccgatggacgtgaaccaacccggcggattgctggtatctttattgaaattgttgtaaacggtgattacgtgcctgtatgtaaaatgatacaagtttaacctagagcgcctgttcaaattaagggactactcggactctaatttggaaaaaaataatagaaagaatggagatcgaaatttccggaaatattattttttagactaaactcaatttttcaatgattgggctgc

SEQ ID NO: 2041 - DNA, 153 bp, Glycine max var. Williams 82
atgatgcaagaagacatcagctcctgcactagacatgtctgtgaacccttcaaatcctttggaaggagatgcactaggcttggtaaggagcaaagggcaaggttctatatcttctggaggtgcatcacaatgcttgtctgctggagagaatga

SEQ ID NO: 2042 - DNA, 168 bp, Glycine max var. Williams 82
atggcaccaatcaccacctattttttgattctcatgtcctcagtgttctatgttttctgggatgcacgtgtcgcgcttgaagagttcactgtccatgaccatcttggctttccaatgtcttcattgagttactccctcaaccaccatgaatatccaatccttctatga

SEQ ID NO: 2043 - DNA, 1392 bp, Glycine max var. Williams 82
atggattgtagtaacgagttggatatgcaagaaccgagcattgagacggataagcttagttacgaaatcttctccattctcgaaagcaagtttctcttcggctacgacgatccaaagctctggttccccaagcaaatacctcccaagccggaatctcagactccggcagctaccgccgccgtggactgcgtctccgcagtcaagaaccagcgcggcaagatatgcattctcgccatcgacggcggcggcatgcgcgggattctcgccggaaaagccctcgcctacctggaagccgcgctgaagaagaaatccggcgaccagaacgccaccatcgcagactacttcgacgtggccgctggcgccggagtcggcggcatcttcacggcgatgctcttctccaccaaagaccaccgccgcccgattttctccgccgacgacacgtggcggtttctggcagagaaaggaaacaaattctaccgcgcgggaggcagcgcaagcaaccgggggttgctgaagaggttactttccagtggaggttccggctcggtgtcgtcggcgacggcgggtttggagaaagcggtgaaggaagcgttcacggcggagaatggtggtgggagtttgactctaaaggacactctaaaaccggttctgattccgtgctacgacttatcgagtacggcgccgtttttgttctcacgtgcggacgcgttggaaacggatagcttcgacttccggttgtgggaggtatgtcgtgccacctcggccgaaccgggtttgttcgaaccggttcagatgcgttccgtggatggtcaaacaaagtgcgtggccgtggacggaggtttagcgatgagtaacccaacgggggcggcaatcacgcacgtgctgcacaacaagcaagagtttccgttcgtgcgaggcgtggaggaccttcttgttctgtccctcggaacgggtcaactattggaggtgagttacgactttgaccgagtcaaacgctggaaggccaaggattgggccaggcccatggcccgcatttccgccgacggctcctctgacctcgtcgaccaggccatcgccatggcctttggtcagtgccgcagcaccaattatgtccgcattcaggcaaatgggtcaagtatggggcgatgtggacccaatgtggatacagattcaagtcccggcaatgtgaagatgctagtaggaatagcagaagagatgttgaagcaggagaatgtagagtcagtactgtttggaggaaagagaattggggagcagagtaacttcgagaaacttgactggtttgctggagaacttgttcaggagcatcagaggaggagctgcagaatagctcccactgttgctttcaagcaagcaaccccaaaagcgacttag

SEQ ID NO: 2044 - DNA, 1611 bp, Glycine max var. Williams 82
atgagcaaagttcttcaggcgaagttggaggcaactccaacatgggctgttgcagttgtgtgctttgtgatgcttgctatttcaatcctcattgaacatattcttgaagaacttggaaagtggttaaaaaagaaacacaaaaaggctcttcatgaagcgctggaaaaggttaaaggagagcttatgctgctgggattcatatcgttgctcctagtgatgtttcaagatcacatttctaatatatgcatcccaaaaagcggtaaagaccaagtagcttttatgtctgaatatagtattcaccagctccatatattcgtctttgtgcttgctatttttcacatcctacagtgcatcatgacactgactttgggtagaaccaagatgtctatatggaggaagtgggaagacgaaacaaagagtcttggccatcagttccaccatgatcctgagaggttcaggtttgctagggatacaacgtttggacgaaggcacttgagctcatggagtcgatcaccaggttccttatggatagttagcttcttccgacaattctacgggtcacttaataaagtagactacatggcattgcggcatggattcctcgtggcacatttgactccagcaaatgaggcaaaatttgatttccagaactatatcaagagaacacttgatgaggattttgcagctgtggtgggcataactccaaccatatggttctttgctgtgctaattctgctcacaaatactcatgggtggtattcttatttttggattccatttatcccagtaattataatcttgttggtgggaacaaagctacaaatgatcataacagagatggcactaaagattcaagataggggggaagtggtcaagggtgcacctttggttgagcccggagatgaattgttctggttcaatcgaccccgcctcatcctctttttgattcatcttgttctctttcagaatgcatttcaactagcgttttttgcttggagcacatatgacaatgggttcaaaataaactcttgtttccacaaaactactgcagatattgtcattagacttacaatgggggttctcacacaagttctatgcagttatgtgactttgcctctttatgctctagtcacccagatgggttctaccatgaaagttactattttcaatgaaaatgttgcagtagccctgaagaactggcatcacactgctaaaaagcacatcaaacacaacaaggattctacttcaaatacaccattctcaagcaggccaggaaccccgacacatggcatgtctccagttcacttgcttcacaagcaccctagacacagtgacagtccagtagtttctccaagggcatacaattacgaaaatgaacagtggggtgttgaagggatacattccccaagccaccacgcaagagatcatgatcctgatcatgaaaagaccatgcagatgcagatgcagatgcagcagcagcggccagctccaacagcagaattgcctcctagtggactcaatcctattcgaactcaacatgaaatcaacattgctttatctgaattttcatttgggaggggacaccacactggtagtaatactaataactaa

SEQ ID NO: 2045 - DNA, 1812 bp, Glycine max var. Williams 82
atgggctgtgttcaggccaagtcattggatttggaagaaagtcccgaatacaggaccctagacagattgaagttggataatggctatgtcccaagtaccgactttgttgctcatagaagatccaccggtcaaagacatcatgaacctaataaggagtatgaaagactgcatcagcatcagagaagagaacaacccagaaagcaaactaataaacttattgagtctggtgttgccaatggtgaagggcttcatcttaataagggcaaggtggttggtagagaggggaggagagtcacacgtcgtgatgataagaagttggaaaacaagtgttgctttgaggatgagatggttgatggctggccaaagtggttggttgataatgttcctacacaagtgttggctggcttggttcccaggagtgctgaatcctacaaaatgattgataaggtaggacaaggaacctacagcaatgtttataaagctctggatcgagaaacaggagaaattgtggccctgaagaaggttaaattcaatacatcagagcctgaaagcattaagtttatggcaagagaaattatgatactacagagactggatcaccccaatgtattaaaactcaaaggattagccacttcaagaatgcagtacagtatataccttgtttttgagttcatgcaaacagatttggcaagagttattgctcgtcctgaagagagactaaccgaaccacaggtcaagtgctatatgcatcaattgctttcaggtctccagcactgccatgaaaggggaattctgcatcgagacataaaggggtcaaaccttttaattgataaaaatgggatgcttaagattgcagattttggtcttgccaatttttatggtccagatcgtcaccggcctctcacaagccgggttgtgacactatggtacagagctcctgagttattgttaggtgacacagattatggagttggtgttgatctatggagtgctggatgtctcctggcagaaatgtttacaggaattccaatcatgcctggcagaaatgaggttgagcagcttcataaaattttccggctatgtggcacaccatcagaggagtattggagaaaattgaaactttctacaacttttagacctccaaaatcttatagacctagccttgtagaaaccttcaaggatctccctccatcttctttaggtcttttatgcactttgcttgctttggatcctgcattccgtggcagtgcatctaaagctcttaaaaatcagtttttcattactagcccattggcatgtgacctctctggtctgcctgttatcgtcagagaggatgatgagcttgttcaagccaatgaacagatcaagtacatgaactctaaaatcaggcgttctcgtacatatctggagcgtcgtaagaattcaacatctaagagaccaatagaacatactgtatcttccaaacaggaattgataaggaatgcgaaacctgaaacttttgttccaattgaagacacggatagcactagtacctcatctagtgtaaacccaggaggggctaaggaccaatcacctttttttctatctccatttggagctttagatcaaaagctatctccaaaaacccatcaccatgttaatggtggtgaaaaaaacatcaagaaccttcctccattacccaagtcaaaaccaaatgctaccaagaaagatgatatcaaatacagaccagaccactttttcaggtcagcttccaccagagaatttagatacttaaaaagggaggaacgtttactcttggaaattgatgattag

SEQ ID NO: 2046 - DNA, 822 bp, Glycine max var. Williams 82
atgatgtcacgttttatgaatgctccttcctctccaggattgtctcctctgtttggcgttggccacaagagagcccgtgaagacgacacgggtgcgggtgcaagtgtgggtcttggtgttgttgcagcagcttcttcacaaacacaagggaatgaaagtggcggcggcgagaggaggaggagatacagaggagtgaggcagaggccgtgggggaaatgggcggcggagattcgcgatcctcacaaagcggcgagagtgtggcttgggacattcgacactgccgaggctgcagccagagcttacgatgaagccgcattgaggttcagaggtaacagagccaaacttaatttccccgaaaatgttgtacaggttcaacctcctcctccgcttccaaatttaccggcaagtgcggttgctggttccggttccggttcggttgtgacaggttttgcgccgacggtgatgcaggggacgcggtttcaggactcctctgattttctgagagactattgggggtattctcagctgctgaggagtacaggggagttccatggactcgaccactggttctttgattcgcaaatggcagcgtttcaatcttctttgccgtcttcgttgttgccatcaccgccgccgccggcgtttctgccttcctctgcttcgtatcctctgttttcttctagccagcaaatggggattttccggccgccgggagagcagggtcacggcggagaagacggtggtagcgggtcggggttcacagagcttctaccttcgacttggtcagataccagtggctatcctcctccaccacctggttga

SEQ ID NO: 2047 - DNA, 1743 bp, Glycine max var. Williams 82
ttcagttaactatgggctaatcataattcagggagcccgaaaattattaaagtatatatatatatatatatatatatatatctgctctttgtttatttttactggacataatattcaactcaaagatgatcactgtttctttgtttctgtatatctcaaaaaggaaaccgacaactcaaaggatttgcagaaagtgcagctagttagttccattttgcatcctccctccctccattaaatttcagtcaaaacaaaacctcttttaggtgtgaaattccacaagccaaaatcatctccgagacaccaacaaccgcaaccacatattctttatttattgaagtggatcaatacataaaaaaggttaattagtaaagtcacacgtgctttctaacggtggcgcaccagaggggtttaggttcaggttcggggaagttcttggcggcggaacaaggcggcgatgaggaaacggaagagagtactgtaggttcggttccgagccatgtggtctctgcagcttcggcccaaaccaataatcagtgggtcccggcaagtggttctccaatgatgtcacgttttatgaatgctccttcctctccaggattgtctcctctgtttggcgttggccacaagagagcccgtgaagacgacacgggtgcgggtgcaagtgtgggtcttggtgttgttgcagcagcttcttcacaaacacaagggaatgaaagtggcggcggcgagaggaggaggagatacagaggagtgaggcagaggccgtgggggaaatgggcggcggagattcgcgatcctcacaaagcggcgagagtgtggcttgggacattcgacactgccgaggctgcagccagagcttacgatgaagccgcattgaggttcagaggtaacagagccaaacttaatttccccgaaaatgttgtacaggttcaacctcctcctccgcttccaaatttaccggcaagtgcggttgctggttccggttccggttcggttgtgacaggttttgcgccgacggtgatgcaggggacgcggtttcaggactcctctgattttctgagagactattgggggtattctcagctgctgaggagtacaggggagttccatggactcgaccactggttctttgattcgcaaatggcagcgtttcaatcttctttgccgtcttcgttgttgccatcaccgccgccgccggcgtttctgccttcctctgcttcgtatcctctgttttcttctagccagcaaatggggattttccggccgccgggagagcagggtcacggcggagaagacggtggtagcgggtcggggttcacagagcttctaccttcgacttggtcagataccagtggctatcctcctccaccacctggttgacatggaaattggaatacacagctttttttttttttcttttttatactattttttctctttcttcggttaaagaaagaacaaggttttttttttcttactttattttattttaattaatccgtttttgtttttaaaattacttggagttcagtttgctgaatttttatgtggttttgggttaaactattatttgcaggtgttatttaaataaaattatttgaagagtgtgggggaggttggatgcatgaaaaagggagggttagaggtattagataggaattcaaattgagtttaagtggtacaaggcagcactttgaagcctagtttagagataaagacaaaacagcatttaggttggaa

SEQ ID NO: 2048 - DNA, 906 bp, Glycine max var. Williams 82
atggcggcaggactctccaccgccgcaatcttaaagccctacaatctcgtccaacccccaatccctctttctaaaccaaccacatcactcttcttcaaccccttaagatgtttccatcacagtacaatccttcgagttcgacccagaagaagaatgagcggcttcaccgtttgcgtcctcacggaggattccaaagagatcaaaacggtcgaacaagaacaagaacaagtgattcctcaagccgtgtcagcaggtgtggcagagaagttggcgagaaagaagtcccagaggttcacttatctcgttgcggctgtcatgtctagctttggcatcacctctatggcagtctttgccgtttattatagattctcctggcaaatggagggtggagatgttccttggtctgaaatgctaggcacattttccctctccgtcggtgctgctgtggctatggaattttgggcaagatgggctcatagagctctttggcatgcttccttgtggcacatgcacgagtcacaccatcgaccaagagagggaccgttcgagctcaacgacgttttcgcgataattaacgctgtccctgcgatcgctcttctctcatacggtattttccacaagggtctggtccctgggctctgttttggtgcaggccttggaatcacggtatttgggatggcctacatgtttgtccacgatggattagttcataagagattccctgtgggtcccattgccaacgtgccctacttcagaagagttgctgctgctcaccaactccaccattcggataaattcaacggggcgccatatggcctctttttgggaccaaaggaagttgaagaagtgggagggctagaagagctagagaaagagataagtaggagaatcaggtccggttcatga

SEQ ID NO: 2049 - DNA, 2318 bp, Glycine max var. Williams 82
gtctgacttttctatatatatacaccttgcatatcacagagacttacaactcccacaagaacacgatgaggagccacacattccttaggataacttcacttttggtgtttattgggtggctcacggtttggatcttgttgcctacaaaggtttacaagaacacctggacccccaaactcaaaaccaagttaaactctacatactttagagagcaaggaacaaatctcttgcttttcacattccccgttatgctcataggggccctgagctgcatctatctccatcttcacgaaaaaggaacggaaaagctaccttccaaaagcggaggagttgtaaacagatggttatgtttcttgagacgtccatttcttgtgatgtctccaataggaattgtcacatctatggagattatttttgcactcatgtttgtcgcactcttgatatggtccctttccaattacttacataccagctttggacacctccatatgcacaaggagggcgagaaagtgtggcaagcaaagttcaggagtgtatccctgagacttgggtacataggaaacatatgttgggcatttctattctttccagtgacaagaggatcctctattcttccccttgttggactcacatctgagtcaagcatcaagtaccatatctggcttggacatctatccaatgttctctttgctgcgcatactgtaggtttcttcatctattggggcatcacacaccaaatgaaagagacactagagtggagcaagacatatgtatcaaatgtagctggggtgattgcaattttaattgcattagtgatgtgggtgaccagctttccagggttcaggcgaaaaatacaccttagattcttacaatctcgccaatgtgctccgttgctatcagctcgccttttaccttgtggtgcacttgaactcaacttctccaagaatccaagtttatactataaccccacgagcatggtgtttataaatgtgcccaagatttccaagctgcagtggcacccttttacagtcatttcaagttgtaacatggaaacagatattctgagtgttgccgttaaaactgggggtagctggtcaaacaaactttatcaggaactttcctcatctgctttggatcatctcaacgtttctgttgaaggaccctatggaccaactacgacttcacaatttttaaggtacaagcagcttgtgttggtgagtggtggaagtggcatcactcccttcatatccataatccgggatctcatatttcaaaaccgacaagaacaagaatcccacgttccaaaagtcctacttgtttgtgctttcaagaattctgctgatctaaccatgttagatcttttgcttcctctttttgtttcaacaactcaattctcaaaccttcatcaattgcaaatcgaggcctatattaccagagaaaaagaagaagccccaagagattctcaaaaacaaatccaaaccaaatggtttaagcctatcctctcagactctcctatctcacttgtattaggcccaaacaactggctatggcttggtgctataatctcgtcatcctttctcatgttcctcctccttttggggattatcactcgttactacatatatccaattgaaaataactcagatgaagtttatcattggacctttaaggttttgtggttcatgtttctactttgtgcagtcatatgcatatgttctagtgcagtttttctttggtggaagagacaaaactccttggaaagtaagcaaatcatgaatgtagaatttccaacaccaacaaggtcaccagggtcatggatttatggctcagagagagaactagaaagtcttccccaccagtctctagtgcaagcaaccaatgtgcattttggtgcaagacctgatctcaagaaaattctttttgagtgcaaagacaaagacattggagtcttggtttctgggccaaggagcatgagacatgaagttggcaaaatctgtgcttccggtctagctgataatcttcactttgaatcattcagctttacatggtgatgtgtatcaatatggctgtttatatgttttacattttctgattggtctgttgttaaataaattgtgaataatatttattgtttagtgtaagcccgtttgtgtgtgtttgtgagtgggcgtcatgtgtaatattgagtggaagtcatgaaacaaataaacttgcaaaaagtatatactgtatcttttttctgttctgtatgtacatatataagtatgttttaaaaagttgttcaacaatgatgcaaaaagttgttttttattggagag

SEQ ID NO: 2050 - DNA, 2142 bp, Glycine max var. Williams 82
atggattcagagacgagtagaggtgcttctttgacggtgaagtatttgcaaatggggatatggtggttctcagtgatgatctttgttgggtatttaatggtttggattgtgatgcccaccaacatcttctttccacattggtttccagatattcaagctaaggcagattcaatatacttcggcagacaagggacaaccatactcatttacacgtttccaattttattaatagccactttagctagtctatatttccacttggagcaaaaacgttctaatcacaataccgaaagcaaggtgggattcttaggatttgcatcatggaaaagaccattgcttggaactggtcctcttgggataatcactatgacagagctctctttcattatcatgtttgttttactattaatttggtccttgtgcttctacatacatggcatgtttgcaagcgtggcactagatgcagctaaggaaagatttcatgagtgggaagtcaagctggaatattcagccctcgctttaggcattgttgggtatatttgcttagccttattgttctttccggtcacgagagggtcttcaattttgcggttcattggcttaacttcagagggaagcatcaagtatcatatctggctaggacacattgcaatgaccctcttcacagcccatggtctaggttatattattttttggggaaagacacatcaaatcttggagatattcaaatggaacaaaattggcgtctcaaatgtggctggagctgtttctctgctagctggattaatcctgtgggctgctaccttaccttccataaggcgaaaagcttttgagcttttcttctacactcattacctctacattgtctttgtaatcttctttgtgtttcatgtgggattttccaactcttgcatagtacttccaggattttacctattcatgatcgaccggtacctgagattcctacaatctcagcagaaagttcgcttagtttcggcacgtgttttgccttgtgaaactgttgaactgaacttcgccaagaacataggactgtgctatgctcctacaagtaccattttcataaatgttcctagtatttccaagttgcagtggcacccttttacaatcagctcttgcagtgatactgattctgatactttaagcattgtcatcaaaagttcaggaacatggtccaatactttgtaccagaaactatcatcttcaattccaatatcccaccttgatgtttcagttgaagggccctatggaccagcttcaaccttttactcaaggcatgagctgctagtgctggtgagcggaggaagtggcattactcctttcatttccataatccgttcactaatttttaaggccaacactgaaggcagcaaaactcctagagttcttctagtatgtgccttcaaaaagtctattgatctcaccacgatagacctcatcctcccagtttcagccacttgcaccgccttcgatatctcacgcttgcagcttcagattgaagcctatgtaaccagagagaaacagccagatatgaatgacaaaaagctaattcaaacattatggttcaagccaaatgcattggatgaaccagtttctgcagttttaggacaaaacagttggctctatcttagcattatcatctcatcctcctttatgttattccttctacttattgccatcctaactagatattacatatatccaattgaccataatactgacatgatatacccttatttctcaaggtccagtctaagcatgttattcatatgcatatctatagcctttgtagcaacatctgctttcctatggaacaagaaacagaacaaggatttggggcagattaaaaacatttacacatccaattcatcaacttctccgggttcaggatactacaatgctgacagagaattagggagtcttcccctccaatccctcgtccaaacagctaaagtacattatggagaaagacctaacataaaaaaaattctctctggctgtaatggatcaagcattggagttcttgttagtggcccaagaaaaatgagacatgaagtagcatcattatgtacttcttgttcaacagatgacctacattttgagtcccttagcttcagctggtga

SEQ ID NO: 2051 - DNA, 1548 bp, Glycine max var. Williams 82
atggattcaggagctgttcaaagtgaagtacatgagaacgatgaacattacccccacattgttgtctcagagcaagtgacacatggtgcagaagaagaccactttgatgaggagaagaagtctgttctgaataaggtaaaggcaaaggctaagaaaattaaggacacgattaagaagcatggccatcaagtgcttgatcgtggtcatgtgtataacaatgaagatcagcatacccttgatgatgatgacttagaggaggatgaagaaatggctgaagacccacaagttcatgaaacaccaattcaagaaagtgaagatgttaaaactgctatacctacatctgagcaactcgaatatttagggaagtcaggaattgattttggaggcacagcagttatgggagaagaacctcgtcatgatgcattacttggaggcatttcttcagctactgaaattgatcaaaacatagcgaaaacattttctgtggaagagaaagcagagatacctaaggaaaatttggagaggtcaataggcttggaggaagcgcctcatgctccaggaagtacaattgaggcatatacccctcccaattatgaaaccaaaatcactgatccaagtgtgataggaaaggatgaaatagaagaaatcacaccagttgaggaatcttttgcgaaaatgaatgtgcatgaaaaacctactccagaaccaatcgttcctcttgctgaaaaacatgatcagtttgtgtcacacctctctgctgcaacacaaactcggtatccttcttctgaaagtcatgatgatcagttcaagcaggaaacaacatccacaaatatcaacagaaacctggaaaatcccacagaaactggaataactttcaacaccatcacaaccacagttgaagaacaaccacactacgaagcaaacattgatgaagttgtctctcctaaagatgtcatagattctgaggcaggttcaggagagaaagttgagataaaggacaaggtggtaacaaatgaagagcaaggggatgcttctaacatgcctgactcaactgcacaacatggaaagaacattgctcactctctgtcagagaaattagctccagtttatgataaggttgcagaggtgggaggtgcagtgaagtccaaagtgactagaactagcactggtggtgttggaactgagacaaaaaatgaggtttctgtgaaggattatttgtctgagaagctaaagcctggtgaagaagacaagtcactttctgaggtaatttcagaagctttacataagaggaaggaagagccagtgaaaaaagaggatgaaaacttgaatggtggggatgacaaaatgtgtgaagagagcagtgtgaagagtccagggaaaggtgtggttggcaagcttaagggtgttgttggctcttggtttggcaaatctgaggaaaaaggtgaagatttatccaagagtacaaattctggtgctgaagtggaacaggttcatcaggttgttggtggaaacaagagtagtccatttgaagaacaagggactcgctaa

SEQ ID NO: 2052 - DNA, 261 bp, Glycine max var. Williams 82
atgagaattccaaaattctcaaccctttttctgcttctcatcgttctgatgtcttcaatacaagattcagattcaacctctcgtttagagagccatgtcgaattggaaaggagattatcagaaagaaaagtttcttccatgtttattcagagctattctgctattctctcctctttgaactcaaggaagagtaagttcaagcaaattcatgccgtttctcaccggctagttcctagtggaccaaatcctcttcataattga

SEQ ID NO: 2053 - DNA, 727 bp, Glycine max var. Williams 82
cttggcaccatgcatcatcaatgaatggattacttaggcagccactcatcgctttctgaaaagtcaagtttcgacatttggcagatgtgagtcacagaaagtgctcctcatattgtcaaattaagtatatttatatttcaagttatcttaatttttctcagtatagcctctagttttcatatcgtctaatgtctacacggttaagtatagacacgccattctgccatagacttgtattctgccaacatattcatagaaacagtatttcttcttcccatttctagctcaaaatctcaataaaaatcatgagaattccaaaattctcaaccctttttctgcttctcatcgttctgatgtcttcaatacaagattcagattcaacctctcgtttagagagccatgtcgaattggaaaggagattatcagaaagaaaagtttcttccatgtttattcagagctattctgctattctctcctctttgaactcaaggaagagtaagttcaagcaaattcatgccgtttctcaccggctagttcctagtggaccaaatcctcttcataattgatcacatatactcacaactctagatggcatgcatataaataaattaagagttggtggttgccgctaaggctttttctggagtataagagcaacttctctagtgattatagataaaagataactacaaaatacatgtttttggctctggtctctctagctgaa

SEQ ID NO: 2054 - DNA, 618 bp, Glycine max var. Williams 82
atggcttctaattctatctcccaagcagcttcaatggccacagaaatctgcacccaaatagcttccatattctcaaagcccacccatccataccctcccccactggaccttttggtcaccgaactcgcctccgttgcctcccaaaacggccgcgtttttctttacggcgtgggccgcgagggcctcatgctcaaggccctgtgcatgcgcctcttccacttgggtctctcagcccacttcgtcttcgacatgaccactccccccatcgacgctgccgacctcctcatcgcctccgccggccccggcggcttctccaccgtcgatgccctctgcgcggtggcgcgctccaacggcggaagggtgctgctcctcacggcccagcccgagacaggctcgtgcgtgaaacacgccaacgctgtggcttacgtggcagcgcagaccatggccgatgatgatgcggacgcagaaagggacgcgaaatctcggccgttacttccgatgggaagtgtttacgaagcagctctgtttgttctgtttgagatggttgtttacaagttgggtgaggccttgggtgagagccctgaatccgttcgatcgcgccacactaatcttgaatga

SEQ ID NO: 2055 - DNA, 1395 bp, Glycine max var. Williams 82
atgggctttctccggcgacttttcggcgccaaaaaaccctccgattgcaaatccggcaagaaaagatggaccttcctcaaacacaccgtcagaaacaagtcactcccgccgccaccgataccccccgcactcaacactcactttgattcctcaactcccttggatgccaacaagcatgcaatcgccgtcgccgccgccaccgccgcagtagcagaagctgctctcgccgccgcccacgccgctgccgaggtagtcagactcacaagcggcggcgtcgccgccacaagtaccagctccagaaccgctgtcacggcggcgcgtgttggcaaccttgagaccgccgccgttaggatacaatcggcgttccgtggttacttggcaaggagggcattgagagcgcttaaagcattggtgaagttgcaagcattggttaggggccacattgtgagaaagcaaagtgcagatatgctgaggcgcatgcaaacattggtgcgacttcaggcccaggcacgtgcaagccgtgcgcacttgtcagataatacgccttctttcaacttcaactcttccctactttctcactatcctgtccctgaagaatatgagcacccacctcgtggcttcagtacaaaatttgatggatcttctatccttaagagatgcagttccaatgccaattctaggaatgttgactcggaacgagtcgggttcgattccaactggttaaaccgttggatggaattagataacaagtgtagccaaactggagatgcttcattgaaaaataatggacgccctgatgatgataaaagtgacaagattctcgaagtggatacttggaggccacacttcaagtcccaccacaacagtagcagctcctctcaagcagcacattattatctgaatgctgattacaataatgagaactttgcggcggcacacgagtctccatcaaaacgttcagcaaaggctctaaaccaaagcttctcatcaagggaggtgttgcagctaagatcattgaagtttcacaaaggaaaagaagaagcaagttcaagaactgctgacaatagtccacaagcattttctgccaattctagaaacggaagtggtgcaaggagaggaggaggaccctttacacctactaggagtgagtgttcgttgggtttcttcagtggctacacgggtcaccccaattacatggcaaacactgaatcttttagagctaaggttagatcacaaagtgcacctagacaaaggctggagtttgacagatacggttccactaggaggcctgttcctttggtggggcctaattcagaccatgattcagatttaaggaacaaagtcttacctccctttaaccaaacgaacagaattgggagtagcaatttaaggtga

SEQ ID NO: 2056 - DNA, 303 bp, Glycine max var. Williams 82
atgggttcctctgctgcagattcagcatcgtggtactgtgccatggtattgctggccatgatactgttggggtcaataagggaaagcaccatggcagaagaagaaggtgagcctataaaagggaacaacctccgtcaacgaccgtgtgatgaaatatacgttgtgggagaaggggagaccctgcacaccatcagtgacatgtgcaatgacccgtttatcgtggagcggaacccacatatccatgatcccgatgatgttttccccggccttgtcatcaaaatcatccccatccaccaatactaa

SEQ ID NO: 2057 - DNA, 1398 bp, Glycine max var. Williams 82
atgacgtccatggccactttcttcgcccaaacctccttcccctcccactctctctccaaaaccttcgatacccatttcgcccctgccccgaaagtcaacgtctttgtgaacttcagggcgaggaggcacgttggggtgcgagtttcgaacgcgctgatcgaaccagatggagggaagctcgtggagcttgtggtgacggattttgagagggatttgaagaagggtgaggctctttcgttgccgaggatcaagctctcaaggattgaccttgagtgggtccatgtcctcagcgaaggatgggccacacccctgaaaggcttcatgagagaagccgagttcctccaaacgcttcatttcaactcgctccgactcgatgatgggtcggtcgtgaacatgtcagtgcccatcgtgctggctattgatgatgcgcagaagcatcggatcggggataacaaaaaggttgctctttttgattccaagggagaccccgttgcaattctcaataatattgagatttataagcatcctaaagaagaaagaatagcccgaacttggggaaccattgcccctggcctaccttatgttgaacaaactataaccaatgctggaaattggttgattgggggtgacctagaggtcattgaaccaattcagtacaatgatggacttgatcattttcgtctatctccgacacaactccgtgcagagttcacaaggcgcaatgcggatgctgtgtttgccttccagctccggaatcctgttcacaatggccatgctttgctaatgactgacacccgaaagcgccttcttgagatgggctataagaatcctgtcctcttgcttcatccacttggaggctacaccaaagctgatgatgtcccacttgattggcgaatgaagcaacatgagaaggtacttgaggatggtgttcttgatccagagacaactgtggtatccatattcccatctcccatgcactatgctggacccacggaggtgcagtggcatgcaaaggctaggatcaatgcaggggctaacttctatatcgttggtcgtgaccccgcaggcatgagccatccagttgagaaaagagatctgtatgatgctgaccatggaaagaaagtattgagcatggcaccgggactagagcgtctaaacattcttcctttcagggttgctgcatatgacaagactcagggtaaaatggcattctttgacccttcaaggcctcaggacttcctgttcatatcaggcacaaagatgcgcacactggcaaggaacaaagaaagtcctcctgatggatttatgtgccctggtggatggaaggtgctggttgattactatgatagcttagtactctcaagcaacggcaaagtgcaggaagctgttccagcttaa

SEQ ID NO: 2058 - DNA, 627 bp, Glycine max var. Williams 82
atggccttcgcaagtgccattgcttttcttcttctgcacactctttcatcagttagaagtgatttcctatctcctctaagtcctctggtcgctccattatatgaggatgtgtgcaaaaaagtggaatgtggaaagggaacttgcaagccttctcagaatagtactctcttgtttgaatgccattgtcatccaggttggaggcaaactctttctgctcatgatgagggcttcaagtttcttccttgcatagttcctaattgtactatggacagctcttgctccaatgctcctgctccagctcaacaagaaagaaaagcaaatgaatcaatatttgatgcttgccactgggttgattgcggaggtggctcgtgcaacaagacatccttattctcttatagttgcaactgtgatgctggctattacaatcttctcaatgcaactgccttaccttgcttcagagaatgtgctattggttttggttgctctaaccttggaatatcaatgacaaactcatccaccgcttcaccaccaccaccattaaatgagaatgctagcttgattctaaaaggaagctccccgtggctactcgtgctgattatattcatagctaatatgcagttgcagtag

SEQ ID NO: 2059 - DNA, 573 bp, Glycine max var. Williams 82
atggagggagctactatctgttccacaacagattccatagaagagggttttgatttgacccaaatctctcttcgacccattagtcttgatgatcttgatgatctcatgttgtggaccactgatgaaaaagttgcaaggtattgcacttgggaaccttacactagcaaagaggatggcatcaacttcatccaaaacatagcagggaaatctctatggttcagagcaatttgcctcaataaccgtgcaattgggtgtattgattttttctcatgtgagggccagcgtagaaacaggcacaaatctgttgaacttggttacgctttagcctccatatactggggaaaagggattgcaacacatgctgtgaaacaagtgattaaagttgcattcagcgagtttccacacttggagaggcttcaggctctagttgatgtggaaaatgtggcttctcagaaggtgctggagaaggctggttttcaaagggagggtgttctcaggaagtatgtggtcattaaaggaaaaagtagagatatggttatgttcagtgttctttccaacgatcctctaagttga

SEQ ID NO: 2060 - DNA, 1173 bp, Glycine max var. Williams 82
cggctagcaacttatattgtaatttagtgcatagtttttcttgatccctactccaagcataccactcctctacgtattggtttctcagcgcataataagtaggccgaagctcaaagctttttcccaagcaacatactctatctagttggtcacacatggagggagctactatctgttccacaacagattccatagaagagggttttgatttgacccaaatctctcttcgacccattagtcttgatgatcttgatgatctcatgttgtggaccactgatgaaaaagttgcaaggtattgcacttgggaaccttacactagcaaagaggatggcatcaacttcatccaaaacatagcagggaaatctctatggttcagagcaatttgcctcaataaccgtgcaattgggtgtattgattttttctcatgtgagggccagcgtagaaacaggcacaaatctgttgaacttggttacgctttagcctccatatactggggaaaagggattgcaacacatgctgtgaaacaagtgattaaagttgcattcagcgagtttccacacttggagaggcttcaggctctagttgatgtggaaaatgtggcttctcagaaggtgctggagaaggctggttttcaaagggagggtgttctcaggaagtatgtggtcattaaaggaaaaagtagagatatggttatgttcagtgttctttccaacgatcctctaagttgatttgtttgaagcatgtcaacttactggtctgccatttggaatgcacagatgacttgaatatatgaatagatgctacaagcacatttggccaataatactcttgtagtttactttgaagatgacatgatgtttttatgtgtaatgaaatgtttaatttaataaaagataaaaaagaattaattaaggatcacatgctcttgagaaaatttacttcacaaaaagaaaaacagaaaatctccatctttcaacagagtagaattggtgaaattttccgcttagacaaaaaatgttgttactggccttgtctaaacttattaacttcactactgaattgaataaagattccgaaaatcattaaagttttactcctcatttcataagtttcaatacttcatttggttaaatgttaaatattactccgacgatcatgcatacttaacgttat

SEQ ID NO: 2061 - DNA, 1866 bp, Glycine max var. Williams 82
atgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactga

SEQ ID NO: 2062 - DNA, 2106 bp, Glycine max var. Williams 82
atcatcaagaaccagttcaatatcctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgtacttcaactgtctgcttagctaatttgatatggttggcacttggcacgtata

SEQ ID NO: 2063 - DNA, 1005 bp, Glycine max var. Williams 82
atgggtgagatagctttaccaaatggcattagcaatggcaatattaatggagtcaatggacaaagccattctctgaatggctacaggaagagttgttggtatgaagaagagattgaagaggacttaagatggtgctttgctctcaatagtatattgcatacaggagctagccagtaccaggacattgcattgttggatacaaagccctttggaaaggctttggtaattgatggaaagcttcagagtgcagagacagatgaatttatctaccatgaatgtcttgttcatccggctctgcttcacaatcctagcccaaagaatgtttttattatgggaggaggagaaggctctactgcaagagaattgctcaggcataagactataaacaaagttgtaatgtgtgacatagatgaggaggtggtgaatttctgcaaatcgtacttagttgtgaacaaggaagcattccgtgatcagagacttgaggtcgtgatcaacgacgccagggctgaactagaaaccagagatgagagctatgatgtgataattggcgacttggcagacccaattgatggaggtccttgttataaactttacaccaagtccttctatgagttgattgtcaagcccagactgaagcaaggtggcatatttgtgacacaggcaggaccagctggaatatttagtcacacagaagtgttttcatgtatctacaacaccttgagacaagttttcaagtatgttgtgccttattcagctcacatcccatcctatgctgatatttggggatgggtcatggcttcagattctccattagacctgagtgcagacgagctagacctcagaatgagacataggattaagggggaaaatagatatcttgatgggaaaacattcacatcagcctcaactttgagcaaaactgttcgaaactcgctggacaatgaaactcatgtatacacagaggaaagtgctaggttcatatatggccatggcaagcatgcataa

SEQ ID NO: 2064 - DNA, 762 bp, Glycine max var. Williams 82
atgaattgtccaacaattaattcaaaacacaccggaattgacaagtgcgtcaagaaaaacatccaactctttctcatccagaaatgcggattctcagaatccaaagccttgacccaacgagttgagctcttcaaaacctacggaagcacccttgccggcttaagagcacaaggcctcgatatcactgcagaggactaccacggtttcgtgcacggaaggctaccttacgactccatcgacactgatcatcagttacggaacctcctcttgagcatcaaacaaagaaaaattgtttttactaattctgacaggattcacgcgatgagggcgctggataggcttggggtcaaggactgtttcgagcaaatcatatgcttcgagactataaacccgaaccttccctattcaacccgacccgacgaattccccatcctccttaaaccttcgctcgacgccttcaagatcgcgcttgacgctgccaacgtggatcctcgtcgtacgattttatgctatatattgcagttgtttctggatgacagcgttcgcaatattgccgcgggaaaagaaatgggtctccacactgttctggttgggaagacaatgaaaagcaaaggagctgactatgctgtggagagtgtgcataacttggcacaagtgatcccagagatatgggcaaacgaaatggacggtggtgatccaacgatgacacgttcgaagagtgaattggaggccgtactcgcttgtgctctggttggagcttga

SEQ ID NO: 2065 - DNA, 762 bp, Glycine max var. Williams 82; identical to SEQ ID NO: 2064

SEQ ID NO: 2066 - DNA, 165 bp, Glycine max var. Williams 82
atgcagaccttaacctctcccacttcatccgaaataaatagaaaccacaccacttcatccttaaactctcccaaccccgctccacaattctctgtcatctgttacacctgcagcagccatatatgtatttgcactcctccactgtcatccattagccatatataa

SEQ ID NO: 2067 - DNA, 327 bp, Glycine max var. Williams 82
atggaaggtttgatcccatatcttattcatgcaatcaagaagcaaaagcctcatcaccacaactacaggagctactctcattctgaaagctcaaaccgcagctaccacatgctattggcgtctgaatccttcacaggatcttctcacagaagaacaaggtctgattttcagccccccacaagtgagttcttagagcagagatatggtgttgatggattcttggtcagccccagagcccaagttactactgctgctcctcctgccactgtcaatgttaatgctgcccaacgctctaacaatatcaccaacatgcgcaatcgcaagtga

SEQ ID NO: 2068 - DNA, 774 bp, Glycine max var. Williams 82
atggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtcacacaaagaagcgtcaccgccgctgaaactatcacacaggtgcaccgtttgcaacaaggcttttccttcttaccaagcactcggtggacacaaggccagccaccgcaaggcctcgtcggaatccaacaccaccgcctccgccgtcgccgtctctgccacagccaacgacagcgtttccgcttcgaccgtcggcggcggaaggatgcacgagtgttccatctgtcacaagagtttccctaccggtcaggccctgggtggccacaagcgctgtcactacgacggcggaaacaaccacagtaacagcaacgccaacggcaacaacagcagcggcgtcactacctccgacggcggcgctgcctcctcctcctcccacgcgttccgtgggtttgacctgaaccttccggctccgctgacggagttctggtcgccggcggggtttgatttcggaaagaagaaggttggcgttgaacaagaggtggaaagcccgttgccggtaaccgccaagaggccgcgtttgttttcgggggaagataatgaagaggcgtag

SEQ ID NO: 2069 - DNA, 1575 bp, Glycine max var. Williams 82
atggatgtttggtcatggatatgtgagctccccaactcggtggaggggaccgagtcccactcgccacccatgaagttcgaaatcgcgagtgagaagaacgacgacaagctggacaactcaactcgttccattcacctgaaagctgagcgaacctccggctcagactcggaagctgcggtgatcttcaccgtatgcttgcaaggctttcacccacacaacgctcacaagcctctatgggtctccgaaaagtgccacctctcatcagaaaagccgttcctccctctcctcctccaactcctccaggaaatcatatcccactcccccacggcgcacgatagcacctgcccccgttcccagctccagaaactaaaacccgaccccatcgcatggatcatggactcgcacacacccgagtccctctccaccttcttcaacctcgtcttcaccatgcgcctcttctggctctgcgccttccacgctccccccgaagccggctccctctacttccactccctcctcgcccccgttctccaaacggcgtcgtccaaactcgcatcctccgtcctccgaactttcttcatcaccgtcggcgtcgacaccgaactctgcttcatgcgcaccctcggttacatcattacaaaacttcacttgatcaaagaactcgacgttggattattaggcttaaaaacgcttttgcttctccaaattctcttacgccaacgaggctcacggtctttggattctcaaaggttacgcgccagtcatgaccatgaaactgttcaaaaaactcaattctctggcatcgatgccaaggagtcgattctccgttactcactcgcgcaccaccaacttgaggcacacgtgcagctagactacaccgttgggttttacgatggtttcattcaggttcgtgcacgtgtcgataatatacgcctccacctcgcgaggttaggtttcagccaaaacgacgacgtggatgatttcgttgaggagaagcactttccgtcacgggttcgggtttgggtgggcccggagataggatccacttattgcgctgggctgagcttgggccggtccacggagaacaaagagtgcgaagtggaaacaaagaggattgtggagggtaatttcgagaagtcgcagggttctaacgtgaaagcgttagccaagtcgtcgaggaggacgcggagtaggagttggagaatggaccaagacgcggaagggaacgcggcgatattcgacgtcgttttgcatgataacactacgggccaggaagtgggctcgtggaggcccaagggtgatgacccggctcatgggctgagagggcgctatgtgagggcaaatagagcgtttaataaaagcggatcggtggttattgctggggatgaatatggggaggaagtagggtggaggcttagcaaagagatggaagggagtgtgctgaagtggagaatagggggagagttttgggttagctatttgcccaaccaagcaaagggttcttattttgaaactaggtacatcgagtggtgtgatgaagttgacttgcctcttattcatggaaaaacaacctaa

SEQ ID NO: 2070 - DNA, 2343 bp, Glycine max var. Williams 82
atgagcctttactctcagaatctccatttgtggtggagactctcatccttccttcttctacttgttcaatctgttacatctcaatttgttgcatttacatctcttaactctgatgggattcacttgcttaaattcaaatattccatcctcaacgacccgttatcagtcttagagaactggaactacgaggatgcaacaccatgttcatggcatggtgttgcatgcagtgaaattggagcccctggcacccctgactttttcagagtaactagcttggcccttcccaatagccaacttttaggttccgtttctgaagacttaggcttgatccaataccttcgccacatcgatctctccaacaatttccttaatggctctctacccaacactatcttcaactcttctcaacttcaagtactttccctctcaaacaatgttatctcaggcaaactacctgagctaattggcaaaatgacaaaccttaaacttctcaacctctctgacaatgccttttccggtttgatcccagaaaacctctctactctaccaaacttaaccgttgtttcactgaagagtaactacttttctggcagtgtcccaaccgggttcaactacgtggagattctggatctgtcatccaatttgctcaacggatctttgccaaatgaattcggcggcgaaagcttgcgctacttgaacctctcttacaacaagatttcgggaacaataccaccagcatttgcgaaacagattcctgtaaacacaacaatggacctctcattcaacaatctgacaggaccaataccagggtctgaggctttgctcaaccagaagacagagtttctatcagggaatgctgatctttgtggtaagcctctgaagattctttgcactgttccctctactatgtcctctgctccacccaatgtcaccacatcttcaccagccattgcagccataccaaaaacaattgactcaaccccttcaacaaacacatcaggaaccaccaccagttctcagaatgtctcaccaagtggcctaaaacccgccaccatagcagcaattgtggtaggagacttagctggcatggcccttttggctctcatcattctcttcatcaaccaacagagaaagaaacgatatccaaatccaaaaccaaacactaatgcttcttccgccaacaacccagaaaagaaacaagaaactgtttcaagacaagatgcggaggcgagaactataacaccttcacttccttgttcctgcttaacaatcaaagaagaagaaacttcagaagcaacgagctccgacagtgaccgcgagagcaacaccgcagtgaacatcatggcagcacaaaacgggaaccttccgagacacggcactcttgtgaccgtggacggggagacaaatttggagcttgagactttgctcaaggcttcagcgtatattttgggaaacagccacttcagcattgtttacaaggcggtgctggaggacggaagatcctttgctgttagaaggatcggtgagtgtgggattgagagaaggaaggattttgagaaccaagttcgtgccattgcaaagcttcgccatccgaatttggttacggttcgtggcttctgctggggccaagaagataaactcctaatatgtgactatgtccctaatggaagcctcgccaccatagatcacagaagagcaagtacatccccaatgaacttgtccttggaggtgcggttgaagatagcgaaaggggtggcacgagggttggctttcattcatgagaagaaacacgtgcatggcaacgttaaacccagcaacatcttgttaaactcggaaatggaacccatcataagcgattttgggctggaccggctcctcttgaatgacgtaacccaaagagcgaacggttcggcaagacaattaatggggaaccaaagaaaccaacaagacctgccattcgtaacaatgggaccatccactagcggtgtgggtcaaataatgcactatcaagcaccagagtcacttcaaaacatcaaacccaataacaagtgggacgtgtactcttttggcgtggtcttgctggagcttctaactgggagggttctctcggaccgggagttggaccagtggcacgaaccgggttcggtggaagatgagaaaaaccgggtcttgaggatagctgacgtggcaatgaagtctgaaatagaagggagagagaatgtggtattggcgtggttcaagttggggattagctgtgtttcccatgtcccacaaaagagaccgtccataaaagaggctctacaaatcttagacaaaatccccgttgctgctccagtccattaa

SEQ ID NO: 2071 - DNA, 453 bp, Glycine max var. Williams 82
atgcaagcaacctttctatgctcccatatgtttctatcataccctcttccagtcaaattgttgcagcgtagttcaccacacaagttgttcagtgatggcaccaccactcgtaggagtttaatctatgcatcaaaaagagacccttttgggcaccattatgatggaaatttggtggatgagaacatgatccttcttagaatgcgaattcgtgagattgagatggtggaaatgaagggtaaagctacttcggattggagcgtatgggagaagaagtattttgctgagaattatggttcggatgtatgtgaagcagttggattgttgcaaagagtgttaatgaacaccagaccttcttttgcattgggtatgctagctcttgtcatgctaagcatgtccatgtcaacgttgcaagttgggtttcatttaatagaatttgccaagggaatcatatga

SEQ ID NO: 2072 - DNA, 1203 bp, Glycine max var. Williams 82
atgagaacaatggttgccactttctcatatccagcctctacctattttgtaaggtgttgttccgtgagagaaaaccatgaccaggttaagctgcaagtgaacagcagcatcagaactaatgggagttttaggtccccagttaaagttgagtcactcaaacaaacagtttcaactaccaccactcttggtcaagctgttacaattgatgaaaatggtcttcgccaaaacattccaacaaagaagcaattggttgatcctcatcgtcaagggctcatcattgaaggtggagttggttatagacagactgttgtcattaggtcctatgaagttggagctgataaaacagccacacttgagagcatcctcaatcttcttcaggaaactgcattaaaccatgtttggatgtctggactgctgagtgatgggtttggagcaacacatggaatggtgaggaacgatctcatttgggttgtctcaagaatgcaagttctggttgattactatcccatctggggagaggtagttgaaattgacacatgggttggagcatcaggcaagaatggaatgcggcgggattggctgataagaagccaagtcacaggccgcatttttgcacgtgcaacaagcacgtgggtgatgatgaaccgtaaaacaagacgtctctccaaaatgcctgaagaggtaagagcagaagtttcaccttggtttatagagaagcaagcaataaaggaagatgatgttcaagaaaaaatagtcaaattagacaaagaggcaaaatacatgaattctgacttgaagcccaagagaagtgatttggacatgaaccaacatgttaataatgtgaagtatgtaagatggatgctagagaccatcccagaccaaattctggaggggcaccaattatctggtatcacactagagtacagaagggaatgtggaagctcggatatagtacaatcactatgtgaacctgaagaggatgaaatacttcatggtgtggtggaaccagattactgcacaaatcttctcaatgggttatcatcagatattataaatggtagtggtgtccttacttgccttgagaagaggccattaaggtatacacacctgctacaaaccaaaggagagaaacaaaacgacgaaattgtcagaggaaggactacatggaagaggaagatttctacaatgccattttccacttag

SEQ ID NO: 2073 - DNA, 1281 bp, Glycine max var. Williams 82
atggagtccaacggtcatgcaagagtaaagagaaatgatattattaaagaaaatggtcattcccatttgttaaatgttgatgatgaacttgatccatggaccgcatgggcatacaagcctcgcaccatcacattgttacttattggtgcttgctttcttatatgggcaagtggagcacttgatccagaaagagatgcatctggggatcttgttacttctgttaaaaggggtgtatgggcaatgattgctgtttttcttgcttattgcctactgcaagctccttctacggttcttattaggccacatcctgcaatttggcgcttggttcatggaatggctgttgtttaccttgttgccctcacatttttgctttttcagaagcgtgatgatgctcgacagtttatgaagtttcttcatcctgatcttggcgttgaacttccagaaagatcttatggcgctgactgtcgtatatatctgcctgaaaaccctgcaagcaggtttaagaatgtttatgagacactttttgatgaatttgttctagctcatgttattggatggtgggggaaggcaatattgattcgtaatcaaccccttctttgggtgttatccattggttttgagttggtggagtacacttttcgtcacatgttgccaaatttcaacgagtgctggtgggacagtattattcttgacatcttgatctgcaattggtttggaatatgggcaggaatgcatactgttagatattttgacgggaaaacatacaaatgggttggtctaagccagcagcctaacataataggaaaagtgaaacgaacattaggccaattcacaccagcacagtgggacaaagacgagtggcatccactgcttggtccttggcgtttcattcaagtgcttagtctttgcattgtatttttgacagtagagctcaacacattctttttgaagttttgtctctggatacctcctcgaaattcagttgttatatataggttgattttgtggtggctacttgcgattccaacaattcgcgagtacaactcataccttcaagacagaaagccagtgaaaaaggttggggcatattgttggctctctcttgccatttgcattgtggaacttctgatttgcattaagtttggacacggcttgtatccaaaaccaatgcctatatggctggtaatattctggtcgggtgttggagtgaccattgttacatttttgcttttgtggtcttggcaactccatcgcagtttagggaacaaaaagaggcgataa

SEQ ID NO: 2074 - DNA, 1371 bp, Glycine max var. Williams 82
atgcaaagcttcaacacaaccgaatcagaatcgacctcacctctatattcccattctcccttctatcaccggggaaatgaccccagccgaaatccaacgcgtttctcggatcttcagcattcttttcggcaacacgatgccgttgatttaagctcaagttctgtgtttggtgcaaagtcgagcaatgtggctgttgttgcaagcaacttgcagtgtgggacattcaacacgaaccttgggtgtgcagaatttggttcgatagagcagcgaggcatgtttcagagaggaaccaatagcgccaccaccgtgtccatggggaaccggcacgttgagaactgggcagaagatagccaacacactgaagatacttgcacagatatagacaccgatgataaaaaccaatgtttctcaactgtgtcttggtgcaatggagttggggacggggcacttgtagttgtagactcacaggatcaaagtaagactaaggttaaagctgaagaccagaagaccgtacgtaggctagctcagaatcgtgaggctgctaggaagagtcggttgaggaaaaaggcatatgtgcaacagttggagaccagtcgagttagacttgcgcaattagagcaagaacttcaacgggcacgtcagcagggtgcatttattgcaactggaaaccagggggatcgcagtcattctgctgttggaaatggtgccctagcatttgacatggactatgcccgttggtttgatgagcatcaacggctgatcaatgatataagatcagctataaattctcaaatggatgagaatgaactgcaccttcttgtagatggagtgatggcacattatgatgaattatttaggttgaagagcataggggcaaaggctgatgtatttcacatactttctgggatgtggaagacacctgcagaaagatgcttcatatggctcggtggttttcgatcttcggaacttctcaagatagttagaaaccagcttgagccgttaaccgaacagcagttgatgggcatttacaatctgcagcagtcttcccagcaggctgaggatgcattatcacaaggcatggatgcattgcagcagtctctttcagagacactttcttcctcctctttagggccctctggttctggaaatgttgctgagtacatgggccaaatggcaattgcactgggcaagctggccacactagagaatttccttcatcaggctgacctattgaggcaacaaactctgcaacagatgcgtcgaattttgaccactttccaagctgctcgtgcgctacttgtgataaatgattacgtttcacggcttagagctcttaattcattatggttagcgtgtcctagagagtactag

SEQ ID NO: 2075 - DNA, 1161 bp, Glycine max var. Williams 82
atggccaagccagtgtccattgaggtatggaacccaagtggcaaatacagagttgtcagcaccaaaccaatgcctggaactcgttggatcaatcttctcattcaaaatgatgttcgccttgaaatatgtaccgagaagaaaacgattttgtcagttgaagacatcattgctttgattggtgataagtgcgatggagttattggacagttgactgaagactggggagaagagttgttctctgctttgagcaaagcgggaggcaaagctttcagtaacatggctgttggttataacaacgtggatgttgatgctgcaaacaagtatggtgttgctgttggaaatactcctggagtgctcactgagacaacagcagagttggcagcttcactaactttggcagctgctagaaggatagttgaggcagatgagttcatgagagcaggattatatgatggatggctacctcatctatttgttggaaacttgctcaaggggcaaacagttggtgtaattggagctggtcgaattggatctgcttatgcaagaatgatggttgaagggttcaagatgaacctaatttattatgatctctaccagtccacacgactagaaaagtttgtcacagcctatgccgcattcttgaaagcaaatggtgaaaccccagtgacttggaaaagggcagcaaccatggatgaggtcctccaggaggcagatataattagtcttcatcctgtcttggataaaaccacttatcatctagtcaacaaggaaagactagctaagatgaagaaggaagcaattcttataaattgcagtagagggcctgttattgatgaagctgcacttgtggagcatttaaaacataacccaatgtttcgagtaggccttgatgtgtttgaggaagagccctacatgaaacctgggcttgcagagttgaagaatgccattgtggtaccccacattgcatctgcctccaagtggactcgtgagggaatggctacactagcagctctaaacgtgctggggaaggttaaagggtacccagtttggtttgatgccaataaggtggaaccattcctcaatgagaatgctcgaccaccagctgcatgcccaagcattgttaatgcaaaagccctgggtttgccaacttcaaagctataa

SEQ ID NO: 2076 - DNA, 958 bp, Glycine max var. Williams 82
ggatgtttgcaattgaaaaaggtattgatcgggtgtgatggagtgaactccatagtagcaaagtggctaggcttcaagaatgcctcttttacagggagatatgcaattaggggttgtgcagaggttcaaagcaatcacgggttagaacccaggttcatgcagttctttggcaaaggttttagagctggtgttattccttgtgatggaaacgttgtttactggtttttcacttggacacccaacaaccaagacaaagagctagaagagaaccctgccaaactgaaagaacatgtgctaaacaagcttgagaatatgccaagtgatgttagatactacatagaaaaaaccgaaatcgatgccttccaattagctccattgagatatagacacccttgggagctgatgtttgggaatattagtaaaggcaatatttgtgttggtggagatgctttccaccccatgactccagaccttggccagggagggtgctgtgccttagaagatgggattgttttagccaggtgcctagctgcggccttctccaaacatatcaaagagaaggatgaagaggaccaattcaaaaggattgagggaagcttgaagaaatatgcaaaggagagaagatggagaagcattgatgtcattgctacagcttatatggtgggttctattcagcaggctgagtccaaattggttacctttttgagggacaacattttggctgcattcttagctagtcaattgttcaagaagtcgggttatgattgtggaaaactaaataatagtaactcttagtgacacagttatcttgtaagatgctcggtccgtcagtgttgtgttgcctttcatttggccattttaatgaatttctagtccttgttatactttttatgtcaattttttttcctcgttgttatttgaagttgattggtaaaggtgcacttataagactatagtc

SEQ ID NO: 2077 - DNA, 300 bp, Glycine max var. Williams 82
atgaacaaagctgttagtctttatggccttttggggctttttgcaggtgctattttcagctcatgcatttgtgggactcccaagaattctaaggcagagaatgattgcagtctaatgggcaaaattgaaacatcactcgtcagcacaataccaaaaaccatttacaatggcttcgtcattcttgcaatcgagttaatgcactacctaatctcaaggggttacaagtcagctgcaccttatacaatgatcttgccattttgggtggcatttacactttcagtatcctatatgtcagagtga

SEQ ID NO: 2078 - DNA, 1428 bp, Glycine max var. Williams 82
atgctcacagttctggttctcctctcactccttcttaccatctccacttcccacaatatatcataccctcatttccaacaactcaatgtcaaacaaataatcctcacagaaaccaaactctacccaaacccaacccaaccctccaaacacccccacaataaaaaactcaacagtgccaccgaagcatcttcatcagcaaaatataaactgaagctagttcacagagataaagtccccacctttaacacctaccacgaccaccgaacccgattcaatgcacgaatgcagcgagacaccaaaagggccgcctccctcctccggcgcctcgctgccggaaaacccacctacgccgcggaggcattcgggtcggacgtggtttccggaatggagcaaggaagcggagaatacttcgtgagaatcggagttggaagcccacctcgaaaccagtacgtggtcatggactcaggcagcgacattatatgggtccaatgcgaaccctgcacccaatgctaccaccaatccgaccccgttttcaaccccgccgattcctcctccttctccggcgtctcctgcgcctccaccgtctgcagccacgtcgacaacgccgcctgccacgagggacgctgccgctacgaagtttcctacggcgacggctcctacaccaaaggcacactcgcactcgagacaatcacgttcggaagaaccctaatccgaaacgtggccatcgggtgcggccaccacaaccagggaatgttcgttggcgccgccgggcttttgggcctcggaggtgggcccatgtcctttgtgggccaactcggaggtcagaccggcggtgcctttagttattgtttggtcagcaggggaatcgagtcgtccggattactcgaattcggacgagaagcaatgcccgtaggcgctgcatgggttcccctgatccacaacccgagagcccagagtttttattacattgggctttcgggcctgggagttgggggcctgcgggtgtccatatccgaagatgtttttaaactatccgaattgggcgatggtggggttgttatggacaccgggaccgccgtgacgcggcttccgacggtggcgtatgaggctttccgggatggttttattgcccagaccacgaacctgccccgggcttcgggagtatccatttttgacacgtgttatgacttgttcgggtttgtgtcggttcgggttccaaccgtgtcgttttacttctcgggtgggcctattttgaccctgccagctaggaactttttgatcccagtcgatgacgtgggaactttttgcttcgcctttgctccttcttcttctggtctttccatcatcggaaatattcagcaagaagggattcagatttcggttgatggagctaatgggtttgtgggatttggacccaatgtttgttga

SEQ ID NO: 2079 - DNA, 681 bp, Glycine max var. Williams 82
atggccacaccagcatccatcaccaatgtcactgtggagttccttcaattccccgcggtggtgacacctcctgcctctaccaaatcctatttccttggtggcgcaggggtgagagggttgaatattgaagaagaatttgtaaagttcacgggaataggtgtttatttggaagacaaggccgtgtcatcactcggtgccaaatggaagggcaaaagtgcagctgaattgctggactcacttgacttctacagagatatcatcaaaggtccgtttgagaagttaattcgagggtcaaagttaagaacattggatggtcgtgaatacgtaaggaaggtgtcagagaactgtgtggcccatatggaatccgttgggacttacagtgaagcagaagaaaaagctattgaggaatttagaaatgctttcaaggatcaaaatttcccaccaggctccactgttttctacaaacaatcacccactggaacattggggcttagtttctcgaaagatgagacaataccagaacatgagcatgcagtgatagacaacaaaccactctcggaggccgttctggagactatgatcggagagattcctgtttcccctgctttaaaagagagtttggctacaaggtttcaccagtttttcaaagagttagaggccaatcccaacaatgaaaactga

SEQ ID NO: 2080 - DNA, 2229 bp, Glycine max var. Williams 82
atggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatccaccaacgttgttcgagccgctgcggttgagacactcgaccaaaccaccgaggtttctctggtggagaaatccgtcaacaccattcggtttttggccattgatgcagttgagaaggccaactctggtcaccctggtctccccatggggtgtgctccaatgggtcacattctctacgatgagataatgaggtacaatcctaagaaccccgcttggttcaaccgtgaccgtttcgttctctctgctggacatggctgcatgctccaatatgctctccttcaccttgctggctatgacactgttcaggaacaagaccttaaggaattccgacaatggggaagcagaactcctggacatcctgagaactttgagacccttggagttgaagtgaccacaggtcctcttggtcagggcattgccaatgctgttggattagcactagctgagaagcacttggctgcacgatttaacaagcctgacaatgagattgttgaccattacacatatgttatattgggtgatggttgtcaaatggagggaatttcaaatgaagcatgctcacttgccggtcactggggtctaggaaagctcattgctttatatgatgacaatcacatttccattgatggtgacactgagattgcattcactgagaatgttgatcagcgttttgaagcacttggatggcatgtaatttgggtgaagaatggaaatactggatatgatgaaattcgtgcagccattaaagaagcaaaggctgtcaaagacaaacccactttgatcaaggtaaccactaccattggatttggttctccaaacaaggctaattcctacagtgttcatgggagtgcattaggtgctaaagaagtggatgctacaaggaagaatcttggatggccatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagcacttccgacatacacaccagaaagccctgctgatgctacaagaaatctgtctcagcaaaatctaaatgcccttgttaaggttcttcctggtctacttggtggtagtgcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatgattcgattggacttggagaggatggaccaactcatcagccaatagagcatttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaggagagtgttctacctgcttcagtaacagctagagttagcattgaggcaggatcaacatttggttggcacaagattgttggaagcaaaggaaaggccataggcattgatcgatttggagcaagtgctccagctggaaaaatatacaaggagtttggtatcaccaaggaagctgttattgctgctgccaaagaactttcgtag

SEQ ID NO: 2081 - DNA, 978 bp, Glycine max var. Williams 82
atggccttaaattctccaaactccagcaactttagcactgccctctctcttgggttggcttccaacaccaacgaagccttaacggtgaaaggaatgggccaactagggttgaaccaaaggatcactaaggtgagaaaatcctcattgaccgcaaaagaaagatcgtgtctggttcatggtggcagtgaaaacaacactgagagtatcataagagcaagtcagattgtaagagcccaactggtgcatgcagtatcatcaacaccatccccagtttccagtaataatgttgtggttgttgttgcggacaaaaagaaagccatcgagattctgcaggccaaacttctctgcgcctcagcatttgctcctaaaactagtcccacatcgctcaggccaattagccttagccaccgtttaacttcaacgcccccactcaaaacgcgtcgtggttttcttaatgacgatgattttgcttattctctttgtccctctccgctgtctgtttgttttccccatgaaaccagtaccttgcagaatcatgttcgtggcggcgacaccaagtacgatggtcggatgcatagctatccgtacaagaaaaatgggccctacacgtgtcccaagtgcgggcacgtgtttgagacgtcgcagcggtttgcggcgcacgtgagttcgagtcactacaagtacgagaccaagagtgagagaaagaagagactcatggccaaaatccgaaagagaaatctccgtatagaatgggtaagtggtggactcactgttgttcctgacgatgctcctcctactagtgcttttgcttattcggcacgaaacaacaacaacgttgctcctccacctcctgttagggtggtgaaggttgaaggtcagagtggtatggagcttcagcttgctcctcctcctggatgggaaaaattaactgctggaggtggagctgttaaaatcaaattggagcctgtagctagctag

SEQ ID NO: 2082 - DNA, 1230 bp, Glycine max var. Williams 82
atggattgggggcttgctatatcttctcatcctaaaccttattcagtcacaactggtggaaatctctggcggagtaaacacaccaccaagaatatttactttgcaagttcttggatatcaaaagcttcacgacacaaaagggaaactcaaatagaacataatgttttgaggttccaacaaccaagtttggatcatcattacaaatgcatcagaggagggtctacatatcaagaatgcaatagaaaatttgttgtgaaggcaatctctaaacaacctcttggttttgaagctcatgcttccaatcctaagaacattttggactctgtcaaaaatgtattgtctgctttctactggttttcctatccatacacaatgattggcataacattatgcgcattttcttcatctcttctcgcggtggaaaaattatcagatatatctttatcatttttaattggcgtgttacagggtgtgctgcctcaattgtttattgaaatttatctttgtggtgtgaatcaactgtatgaccttgaaatagacaagataaacaaaccacatcttccaatggcatctggacaattttcctttaaaaccggtgtcattatttctgcagcatttttagctctgagttttggatttacttggattaccggctcttggccattgatttgtaatcttgtagtaatcgcttcatcgtggacggcttattcaatcgatgtgcccctactgagatggaagagatacccatttgtcgcagcaatgtgcatgatttctacttgggctcttgcattgccaatttcatatttccatcacatgcagaccgttgtgttgaagaggccaattggctttccaagatcattgggttttcttgttgcattcatgaccttctactccttgggtttggcattgtccaaggatatacctgacgttgaaggagataaagagcacggcattgattcttttgcagtacgtctaggtcagaaacgggcattttggatttgcgtttccttttttgaaatggctttcggagttggtatcctggccggagcatcatgctcacacttttggactaaaattttcacgggtatgggaaatgctgttcttgcttcaattctctggtaccaagccaagtccgtagatttgagcgacaaagcttccactggatctttctatatgttcatctggaagctattgtatgcagggttctttctcatggcattaattagatga

SEQ ID NO: 2083 - DNA, 1476 bp, Glycine max var. Williams 82
atgacgatgaccaccatacaatcgacgccaggaagctcagggtatttggatttgtttcctgagcgcaaaatgtcatttttcaagaatccttatattctgggactcagtgctgtggctggcattggaggcatgctttttggctacgacacaggtgtgatatcaggagcccttctatatattaaagatgattttgaaggggtcagagaaagtgagttggttcaggaaacaatagtgagcatggcaattgggggtgcaatagttggagcagcaggaggaggatggataaacgatgcttatggaagaaagaaggcgactctgattgcagatgtgatatttattattggagcaatagggatggcagcagcaccagaccctcatcttctcattcttggacgccttcttgttggtttgggtgtgggtgttgcctctgtcacctctcctgtctacattgcagaagcatctccatctgaaatcaggggttctttggtcagcaccaatgttctcatgatcactgctggccagttcctttcctacatcgttaacctttctttcacgcgtgtgagcggcacatggcgatggatgctcggtgtctctgctttccctgcaattcttcagtttcttctcatgctcttcctccccgagtccccaagatggctctttatcaagaataggaaaaatgaagctgttcatgtcctctctaagatctactacgaccctgctcgctttcatgacgaagttgattttctcaccactcagtccgcgcaagagcgccaaagtatcaaattcggtgatgtttttagatctaaagaaatcaaactagcattcctcgtcggagctgggctgcaggctttccagcagttcacaggaataaacacagtgatgtactacagccctaccattgtccaaatggctggtttcaactctaatgagttggctcttcttctgtctctcatagttgccgccatgaatgctactggaacaattcttggcatttacctaattgaccatgccggccgcagaatgttagcactttgtagcttaggaggagtgtttgcatctttgatcgtcttgtctgtctcatttttaaacgaatcatcatcttcgagtggatggcttgcagtgctgggtttagtcatatacattgcatttttctcgccggggatggggcctgtgccatggacggtgaactcggagatatatccggaggaatatagaggaatttgtgggggcatgtcagctactgtgtgttgggtttcaaatttggttgtgtctcagagctttctttcgattgttgaagctatagggataggttccactttcttgattcttgcagctatatcagtgcttgcctttgtgtttgtccttatatatgttccagagaccaaaggattgaccttcgatgaagtagaactcatatggaaggagagagcttggggcaacaactctgactcgagaaaccttcttgctcaagaatga

SEQ ID NO: 2084 - DNA, 627 bp, Glycine max var. Williams 82
atgggagtttgtgacccatttctggacaaagacacatctttgaatttcattggattcaattcatttgggtatcaatcaagattgaattgttgttgtcgtcgtcttggggatgggatcgtgcctgtagatgacgggggcacgggtgtgacgttgctgaagcagggacaggaccttgttattgtgaatgtagatgactccagagctgtattagctgcccaagatcgtagcaatggttctcttattgctgtccagttgagcactgaccacaagccacatcttccaagggaagcagagaggataaggatttgtaaaggaagggtcttcgccattaagaacgaaccagggattgctcgagtatggctccccaacattgattcccctggccttgccatgtcacgtgcttttggagatttttgtctcaaggactttggagtcatctctgctcctgatttctcatatcaccgcctcactcaaagggatcaatttgttgtcttagccacagatggggtatgtgatgttttatcaaacgaagatgctgtgaccattgtggcatctgctccacgctacttagactccaacctcaacaaaaccaccaatagcctcctcctcctcacttcactaatttga

SEQ ID NO: 2085 - DNA, 1843 bp, Glycine max var. Williams 82
acagttttccacctgtaaaaataaattcctgaatgtttgctttactttggtgtaatcttcaaatgaaaaaaagggagatactagagatatattttctctgataccaccatgcgccgcgtggtcttctcttcagcataagctttcaatcatcgtcatcgaagtttcctcgacatatgttgacaataattcatcgtcttgttgcctataaattatcagccactgcgccaatcttgctataccacattctttcttacactctcaagtggaccttcatttttcatagttacgatcttcttctaacccgcaatataaatatagcagtcgggcacatctgatggaacttgaatgctggtgaaagcacaatacaatatctaggagtttctcggataacttatatcttaaagatcctcaacctcaaccagaagatagaatggagtcgatttcggacccaccctttcacgaggcatacaagatcctgtttgacaagaccagaaacggaaacaattttgaagagcataaggagctcttggcggtggccgaggaatgcgaccttccggtgatcgatctgagccgtttagaagagagcgatgaggttgtgagggaagagtgcaagtcacagatagctagggcttcgcaggagtggggtttcttccaggttgtaaaccatggtatttccactgagattttcagcagcttgaggtgcgagcaagagaaggtcttcaagcagccatttgaaaagaagaccaaagaggacaagttcttgaacttctccgccggtagctaccgttggggaacaccctctgccacatgcattaaacagttatcttggtcagaagcctttcatattcctttaaccgatatattaggatccactggatcaaactctcttagttggacaattgaacagtttgctacaacagtttcgagtcttgcacaaacattagccgacatcctggccgagaaaatgggtcacaagtcaaccttctttaaggagaattgtttgcctaacacatgctaccttcgattgaaccgatatcctccatgccctattggttttgggattcacggtctcatgccacatactgacagtgactttctcaccatattatatcaagatcaggtcggaggtttgcaattggtcaaagacagcaaatggatcgcagttaaaccaaaccctgatgctcttataatcaacattggtgacttattccaggcatggagcaacggggtgtacaagagtgttgaacaccgtgttatgaccaacccgaaactagaaaggttctctatggcgtatttcttttgcccttcaaatgatacagtgatagagagttgcagagaaccctctttttacaggaaatttagctttcgggagtatagacaacaagttcgggatgatgttcagaagttgggttccaaaataggcctaccaaggtttctcacacatgcatgaaggaaatggcatataacataattacttcatagctagctagctagctatctatctagagagcataatatataattatgatcatgattatatttatgggtacaacagtgttcaaacatcaactacatagctaggttacgtcatatatatgttttgtgaagaagacagaagagagagatcgatctagaagtagaagtagaaagaaaacaagtgtgcttgtcagtgtacgtttgggttggtaataaaattaatttggcagagacggtcggtatgcatggcagctggtttgggcctgcatgtttgatgctgtctcattttgtctgctgttaagctacaacctgtaatatacgtaccacaatttctattctatttattactacatgttactagaaagga

SEQ ID NO: 2086 - DNA, 1569 bp, Glycine max var. Williams 82
atggccgtcggaggtttcaccaacgccgccggtggcgccgatttcgaggccaaaatcactcccatcgtcatcatttcatgtatcatggctgccaccggaggtctcatgtttggctacgacgtcggcgtttcaggtggtgtgacgtctatgcccccgttcttgaagaagttttttccgacggtatacagaaagacagtggaagagaaaggactggatagtaattactgcaaatacgacaaccaaggattacagcttttcacgtcgtctctgtatctggctggtttgacttcaacgttcttcgcttcgtacacgactcgtaggttgggaagaaggctgaccatgttgattgctgggttcttcttcatcggtggagttgtcctaaatgctgctgctcaagacctcgccatgctcatcgttggaagaatcttgcttggttgtggtgttggctttgctaatcaggccgtgccagtgttcctctctgagatcgcaccttcaagaatacgaggagcattgaatatattgttccagcttaatgtcaccattggcattctatttgctaaccttgtcaactacggcaccaacaaaatcaaaggtgggtggggttggaggctatctcttgggttggctggtatcccagcagttcttctgacattgggagccttgttcgtggtggacacccccaacagtctgatcgaacgtgggcgcttggaagaaggaaaaactgttcttaaaaagattcgcggcactgacaacatcgaacttgaattccaggaattggttgaggccagtcgtgtggctaaagaggtgaagcatccattcaggaatcttctcaagcgcaggaaccgaccccaactcgtcatttccattgcccttcagatattccagcaattcacaggcatcaacgcaatcatgttctatgccccggttctcttcaacaccttaggattcaagaacgatgcatccctctattctgctgtcataactggtgctgtgaatgttctctccaccgttgtatccatctactcggtggacaaactgggacgtcgcatgctcctgctggaggctggtgtgcagatgttcttgtctcaagtggtgattgcaatcattctgggaataaaggtgacggaccattctgatgacctttccaaaggcattgcaattctggtggttgtgatggtgtgcactttcgtgtcttcctttgcatggtcttggggtccccttgggtggcttatcccgagtgagactttcccattggagactcgttccgctggtcagagtgtcaccgtttgtgtcaacttgctcttcaccttcgtcattgcacaggcattcctttctatgctctgccacttcaagtttggcatcttcttgttcttctctggctgggtcctcgtcatgtctgtcttcgtgcttttcctgttgccagaaacaaagaatgtccccattgaagagatgaccgagagagtgtggaagcagcattggttctggaagaggtttatcgatgatgccgcagatgagaaagtagccaatgtctctaatggtaatggatttgatccaacctccaggttgtaa

SEQ ID NO: 2087 - DNA, 444 bp, Glycine max var. Williams 82
atggcaagccttcagttaacaagaacacccttgagtcttttcagacaagaaaggcagcagcaccccagaaagaagaactccactgcttttgagctgaaggctcctcggccacgtctcacactcagtgtgaggtcctataaagtggtgattgagcacgatggagagtccactgaggtggaagttgaacctgacgagaccattctgtcaaaggcattggactctggcttgtctgtgcctcatgattgcaagcttggagtctgcatgacatgccctgctcgtctcattagtggatctgttgatcagagtgatggaatgctcagtgatgatgtggtggagcgtggctatgcactcttgtgtgcagcctaccctcaatccgattgtcatattaagattatccccgaggaggagcttttgtcattgcagttagccacagccaatgactga

SEQ ID NO: 2088 - DNA, 1620 bp, Glycine max var. Williams 82
atgacaacggtagctgcttctcttgatgccaaagaggtgtctacctccaaaactgaccaaaaccaagtgtgtgactgtgatccccaaactagccatgtcttcaaatcaaaattaccagatatcccaatctccaaccacctccctctccacgcttactgctttcagaaactatcccaattctccgaccgcccatgcctcatcgtcggacccgccgccaaaacctacacctactccgagacacacctcatttcacgcaagattgccgccggattgtccaacctcggaatccgcaagggcgacgtggtcatgatccttctccagaactccgccgagttcgtcttctccttcctcgctgcctccatgatcggcgccgtcgccaccacagccaatccgttctacaccgccgcggagatcttcaagcagtttaccgtctccaagacgaagctgatcataacgcaggcaatgtacgtggacaagcttcgcaaccacgacgacggcgcgaagctcggcgaggacttcaaggttgtgaccgtcgacgacccgccggaaaattgcctccacttctcggtgctctcggaggcgaacgagagcgacgcgccggaggttgatatccaacccgacgacgcggtggcgatgccgttctcttccggcacgacgggtttacctaaaggagtggttctcacgcacaagagtttaacaaccagtgtggcgcaacaagttgacggagagaaccctaacctctacctcaccaccgaggacgtgctcctatgcgtgcttccgttgtttcacatattctccctcaacagtgtgcttttgtgcgcgcttagggccgggagtgcggttttgttgatgcagaagttcgagattgggacgctgttggagctcatacagcggcaccgcgtgtcggtggcgatggtggtgccgccgctggtgctggcgttggcgaagaatccgatggtggcggattttgacctgagttcaatacggttagtgctgtcgggagctgctcccttggggaaggagctcgtggaagctctccggaacagggtgcctcaagccgttttgggacagtcgtatattttggatcaagtgatccggagcatatgcgtttttttttttcatttttatttcattcccctttgtttgcaacttgaggtggttaaacctttcccagtacgatatctgaacgatgagaaagcgacagcattgaccatagattcagagggttggcttcacaccggtgatgttggctatgtagatgaagatgatgaaattttcattgttgacagggtgaaagaactcatcaaatataaaggcttccaggtgccccctgcagaacttgaagggcttcttgtaagccatccctccattgcagacgcagctgtagtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgtacatgctattcccaagtctccatcaggaaagatattaaggaaagacctcagagcaaagctagaaaccgccgccactcagacgccttaa

SEQ ID NO: 2089 - DNA, 1107 bp, Glycine max var. Williams 82
atgatgtctctccacatccacgtgtgctctcagctctttttctatttgcatgttataataacactcttcaaaccattacatttacatgtccaactcacacaccctctcttctctctttcaattccttcccagctcttcattgaagaagctatggactttctaaacttcttgcttaacttgttggtccctccaggcagtatgatcaccttggctttctcatggcctgcactttgcttcctcaatttttgtgagtggctttgtaatagtatatatggtgaggatatggataataaagtggtcataatcaccggcgcatcttcaggcattggagagcaaattgcatatgagtatgctttgaggagagcaaatttaacgttggtggcccgcagagagcacaggctaagagggatcgctgagaatgcaaagagattgggtgcaagacatgtgatgattatggcagcagatgttgtgaaggaagatgattgtaggagatttgttaacgaaaccataaatgtctttggccgtgtagatcatcttgtaaatacagtgagtttgggacatacattctgctttgaagaagctacagacacatcagttttccctgttctcctggatattaatttttgggggaatgtttatccaacatttgtggctcttccttaccttcatcaaagcaatggtcgtattattatcaatgcatcagttgaaagttggttgcctatgccaaggatgagtttatatgctgctgcaaaggcagcattagtgaacttttatgagacactgagatttgagttgaaagatgaggttggaataacaatagccacacatggttggattggaagcgaaatgacgaggggcaagttcatgctggaggagggtgctgagatgcaatggaaggaagaaagagaagtgcaggtgacgggtggaccagtagaggagttcgcaaggttgatagtatcaggggcatgtagaggagatgcatatgtgaagtttcctagctggtatgatgtattcctactatacagggtgtttgctccaagagttcttaactgggcattcaggcttcttatttcgccacaagggacaagaggagcttctcttatgtag

SEQ ID NO: 2090 - DNA, 1167 bp, Glycine max var. Williams 82
atggcatcgcgcgtcagcattggcaatctcacttcctccgcgccgtatattaattcccctcattttcgctcacaacttaagctttccagcaactcctctttgcacaagccactcatgcgcgacaagactgtgctggtaaccggcggagccggttacatcggcacccacaccgttcttcagctcttgctcggaggttgcagaaccgtcgtcgtcgacaatctcgacaattcctccgaggtttctatccaccgagtcagggagcttgccggcgaatttgggaacaacctctcctttcacaaggtggacctacgggacagggatgcactagagcaaatttttgtttccacacaatttgatgctgtcatacactttgctggactgaaagcagtaggagaaagtgtgcaaaaacctttactatactataacaacaacttgactgggacaatcactctattggaagtcatggctgcccatggatgcaagaagctcgtgttctcttcttcagcaactgtatatggttggccaaaggaagttccatgcacagaagagttccctctgtcagcaatgaacccatatggacgaactaagcttatcattgaagaaatttgtcgtgatgtccaccgtgcagagccagattggaaaataatattgttaagatacttcaacccagtcggtgcacaccctagcggttgtattggggaggatccccgcggaattccaaacaatctcatgccatttgttcagcaagtagcagttggccgacggcctgcactgacagtttttggaaatgattataatacaactgatggcactggggttcgggattacattcatgttgttgatttagcagatgggcacattgctgcgttgcttaaactagatgatcctaatataggttgtgaggtttataacctgggaacaggaaagggaacatcagttttggagatggttcgagcttttgagatggcatctggaaagaaaattccacttgtgatggctggccgtagacctggtgatgctgaaattgtttatgcatcaacaaagaaagcggaaagagagcttaaatggaaggcaaaatatggcattgatgagatgtgccgcgatcaatggaattgggctagcaaaaacccttatggctatggagatcaggaggattccaccgtttaa

SEQ ID NO: 2091 - DNA, 315 bp, Glycine max var. Williams 82
atgggcaactgcatggagacatacactataggggagaaacagcagcagcaaaaagaagaagaagaaagaggatcattatcaaatgaagagaagaatggtctaagcatgaaagttgtgctgacaaaggaggaactgaaatggctgatacttgaactgaacaagaaaggagaagctggaggagtgaggttggaagaaatgctggaagagatagaaagaggcagagaagagaaggttgatcagaatgagaggggatggaagccttctttggagagcatcttggaggctcctgaattgcttgagatggacaccacatga

SEQ ID NO: 2092 - DNA, 396 bp, Glycine max var. Williams 82
atgatgcacaccatgtttgcgtgcctcaataaaaaagtagaagaaaatctcaaagtcacaaaggcagtgtacagagatgagttaataaccaaaaagaaaccttcaacagtgccaagcaaggcattagtgaagaaaagtgtccgttttgcggactcagaaccttccatttttggagaagataccaatgagaagaagttggtgaaaggaaggtgtagtagtgatggtgatgaatcaggagggattagagtgaagctaaagatgacaaaggaagaagcggcacgtttgctatcaaaatgcaaagaaggaggagttctcgagttcaaggatgttgctcgtgagcttgtggccctcccactgaaccgagttagtgttgtgtctgctttacacgaacgataa

SEQ ID NO: 2093 - DNA, 570 bp, Glycine max var. Williams 82
atgtttaaattatttactcttcgggggctgccatggagcttgagaagtggtggtcaggaaaaggttgagctaacagttgttgaagtagagtcacttcgatcagaacttgctgatatagaagagagggaagctcaattgaaagctcagttggaaaatattgatgaaattttgcggtcagctcgtctatctggctatttgtacattcgaaaaagatgggcagcacttccaggagaacctcctcctatagatgatactgacgtagatgattggcttcctcgatttgttgttcttcagggtgcatgtctattcttatatttgttgtgtacagatctaagtcctcatgactcaacgcttctatctgatattgttgaagtagacaaactaccaagttttaagcgtgaagaagatgatgagacacgatacgccttttatattttaactcgtcatggtttacgatatgaatgttcaagcagttcccagatacaggtggattcatggttatcagctttacactccgactgcaaattggaaactgatacatcaactcccaatggctcaatagaattgtaa

SEQ ID NO: 2094 - DNA, 1011 bp, Glycine max var. Williams 82
atgcattcgacgaagagtagcaccagcgataatatcaatatcaatatcaaatcaaaagataaagaaatccatcgatgctaccataactaccgaaagaagagaaagcgtccttgccaagacgctgtggctcccaccacggaagacgacaactgctgcaccaaggccgccgccgcatcacacggtttcatatccgttatagggcggcggcgcgtgatggaggatgcagtgaaggtggttaccggtttggtggcggcggaacaacactgtggcggttacgatttcttcgcggtttacgacggccacggagggaccttggtggccaacgcttgccgcgacaggctgcacttgttgctggcggaggaagtagtgagggggaccgcagcagacaaagggctggattggtgccaggtgatgtgttcctgtttcatgaagatggacaagggagttggtgaggagaacgatgatggcggcggaaacaccatgggttcgacggcggcggtggtggtggtcggaaaggaggagattgtggtggccaattgtggagactcgagggcggtgttgtgccgtggcggggtagctgtgccactttcacgtgaccataagcctgatcgtcctgatgaaaaagagaggatagaagcggcaggtggcatggtcattaattggaacggaaatcgtgttttgggagtacttgctacttccagatccataggggatcactgcatgaaaccttttgtgatttcacaaccagagaccaaggtgtacgcacgaaaagagtcagatgagtttgtggtagtggcgagtgacgggctgtgggatgtagtgtctaacaagtttgtttgtgaggttgtacgaggttgcctccatgggaaaatgaggaggaattttaaagaggactccattataagctatgcaacagaagctgcagcgttgttggctaagttggctatggctcgtggaagcaaagacaacatcagtgtcatagtcatccaactcaacactactacaacttga

SEQ ID NO: 2095 - DNA, 1289 bp, Glycine max var. Williams 82
aaagaagccggtgccagccgcgtgataccgacataccgtgaacatgcccatacgtgatcacagagattctggtaaacacgtgcagtgtttcaaaagttactaacggacacagatccaagcagttgcgacttgcgagatgcattcgacgaagagtagcaccagcgataatatcaatatcaatatcaaatcaaaagataaagaaatccatcgatgctaccataactaccgaaagaagagaaagcgtccttgccaagacgctgtggctcccaccacggaagacgacaactgctgcaccaaggccgccgccgcatcacacggtttcatatccgttatagggcggcggcgcgtgatggaggatgcagtgaaggtggttaccggtttggtggcggcggaacaacactgtggcggttacgatttcttcgcggtttacgacggccacggagggaccttggtggccaacgcttgccgcgacaggctgcacttgttgctggcggaggaagtagtgagggggaccgcagcagacaaagggctggattggtgccaggtgatgtgttcctgtttcatgaagatggacaagggagttggtgaggagaacgatgatggcggcggaaacaccatgggttcgacggcggcggtggtggtggtcggaaaggaggagattgtggtggccaattgtggagactcgagggcggtgttgtgccgtggcggggtagctgtgccactttcacgtgaccataagcctgatcgtcctgatgaaaaagagaggatagaagcggcaggtggcatggtcattaattggaacggaaatcgtgttttgggagtacttgctacttccagatccataggggatcactgcatgaaaccttttgtgatttcacaaccagagaccaaggtgtacgcacgaaaagagtcagatgagtttgtggtagtggcgagtgacgggctgtgggatgtagtgtctaacaagtttgtttgtgaggttgtacgaggttgcctccatgggaaaatgaggaggaattttaaagaggactccattataagctatgcaacagaagctgcagcgttgttggctaagttggctatggctcgtggaagcaaagacaacatcagtgtcatagtcatccaactcaacactactacaacttgatcgttgccatattcaagctcttattttaacttttcgcgtctaattttccaaagttgtcctgtattattcatttcaatgtagtgggaatgctctttactaattttcaacagccagaaatatgtttctataagctcatctttag

SEQ ID NO: 2096 - DNA, 1524 bp, Glycine max var. Williams 82
aaagaagccggtgccagccgcgtgataccgacataccgtgaacatgcccatacgtgatcacagagattctggtaaacacgtgcagtgtttcaaaagttactaacggacacagatccaagcagttgcgacttgcgagatgcattcgacgaagagtagcaccagcgataatatcaatatcaatatcaaatcaaaagataaagaaatccatcgatgctaccataactaccgaaagaagagaaagcgtccttgccaagacgctgtggctcccaccacggaagacgacaactgctgcaccaaggccgccgccgcatcacacggtttcatatccgttatagggcggcggcgcgtgatggaggatgcagtgaaggtggttaccggtttggtggcggcggaacaacactgtggcggttacgatttcttcgcggtttacgacggccacggagggaccttggtggccaacgcttgccgcgacaggctgcacttgttgctggcggaggaagtagtgagggggaccgcagcagacaaagggctggattggtgccaggtgatgtgttcctgtttcatgaagatggacaagggagttggtgaggagaacgatgatggcggcggaaacaccatgggttcgacggcggcggtggtggtggtcggaaaggaggagattgtggtggccaattgtggagactcgagggcggtgttgtgccgtggcggggtagctgtgccactttcacgtgaccataagcctgatcgtcctgatgaaaaagagaggatagaagcggcaggtggcatggtcattaattggaacggaaatcgtgttttgggagtacttgctacttccagatccatagtgaatctcctctggaataatcttgcattatgatactacttcctggcaaatgacagtattttatttttttcatatactaacactgtttttagtaaatggtttgattcgtttatgtaaaattctgagaatctagttagttttacagatacgtgattaaagagtatattatatatttcctctaaaaaagcgagagtgtgttggtttaaaaggaaggaattttcgcaatatatatgcaggggatcactgcatgaaaccttttgtgatttcacaaccagagaccaaggtgtacgcacgaaaagagtcagatgagtttgtggtagtggcgagtgacgggctgtgggatgtagtgtctaacaagtttgtttgtgaggttgtacgaggttgcctccatgggaaaatgaggaggaattttaaagaggactccattataagctatgcaacagaagctgcagcgttgttggctaagttggctatggctcgtggaagcaaagacaacatcagtgtcatagtcatccaactcaacactactacaacttgatcgttgccatattcaagctcttattttaacttttcgcgtctaattttccaaagttgtcctgtattattcatttcaatgtagtgggaatgctctttactaattttcaacagccagaaatatgtttctataagctcatctttag

SEQ ID NO: 2097 - DNA, 207 bp, Glycine max var. Williams 82
atggctagtttcagattttcattcggtttcggagtggtggccgccgttgttctctctctcatcttcactctttacatgcctgtcgctgttcatgcccaatccctagctccagcacctgctcctaccagcgacgatcaagggattgcgtatgttttgatgatgttggctttggcactcacttatctcatccactcctccaccttctga

SEQ ID NO: 2098 - DNA, 504 bp, Glycine max var. Williams 82
atggctagccaatcaaacactaaatcagttcacgatttcacagttaaagatgccaggggaaatgatgttaatctcgccgattacaaaggaaaggtccttctccttgtcaatgttgcctcacaatgcggcttgactaattcaaactacacagagcttaatcaattgtatgagaaatacaaagggaaaggacttgaaattctggcattcccgtgcaatcagtttggggctcaggagccaggaactaatgaagagattgtggagtttgcttgtactcgcttcaaagctgagtttcccattttcgacaaggtggatgtgaatggtgacaatgctgctccactgtacaagtttctgaaatcaagcaaaggtggactctttggggatagtatcaaatggaacttctccaaattccttgttgataaggatggaaatgtcgttgaccgttatgcacccacaacttctcctcttagcattgagaaagacataaagaagctgctagatgcatga

SEQ ID NO: 2099 - DNA, 675 bp, Glycine max var. Williams 82
atggccgtcacgaaaagcctctccatcttcctcttcatcgccataagctgcgtggccgtagctcaggcagcgaacttcaacatcacaaacaattgcacctacacggtgtgggccgccgccgtgcccggcggcggctcaaggcttaaccctggcgaatcgtggaacatcagcgtgacgaacggcacgacaggaggacgcatctggggtcgaacaaactgcaccttcgacaacgcaggacgcgggaagtgcctcaccggcgactgcgacggtgttcttgagtgcaacaaaacaggtacacctccgaacacgttggtggaattcgcgttgaaccagtacaacaacctcgacttctacgacatctccctcgtcgacggtttcaacattcccttgcaggtgagcccgacctacaactgcagctccgtgaaatgcgccgccgacatcatcggagagtgtcccactcagcttcaggttcccggcggctgcaacaacccgtgcacggttttcaatacgactcagtactgttgtagcaccggtgctgcgggttgcggtcccactgattattccaagttcttcaaggagaggtgtccagatgcctttagttaccctatggatgacgcaagcagcatgttcacttgcatgggaggatctgattataggcttgtgttttgcccttaa

SEQ ID NO: 2100 - DNA, 1605 bp, Glycine max var. Williams 82
atgtgccagttatcgtcatctccctccactttgtgtgatagcaatgagggccatccaaacatgcccacaaccaaaattcatgaggagccagctcacatgctcccccttttgatccccaaacccccaacaacattattcgaacaaggccaaaataaccatcaaactaaaacccatttttccctcgctctcaacgaagtcaaatgcatagccaacatagcattacccatggtgctaaccgggttattactctattctcgctccgtaatctccatgctcttcctcggtcgtgtgggtgagcttgccttagctggtggctctctcgccattggattcgccaacatcacgggctattctattctctcgggcctcgccatgggcatggagcccatttgcggccaggcttttggggccaaaaggttcaaacttttgggtctcgctatgcagaggacaatcgtcttgcttcttctaacttcagttttgatttcattcttgtggctcaacatgaagaaattattgatcctatgtggccaacaagaagacatcgccaccgaagctcaatctttcatactattttctattcccgatcttgtagcacaatcattgctacaccctttgagaatctacttacgaagtcaatctataaccctacctctcacatacaccgcatctctgtctattctccttcacgtacccatcaactactttctcgtctctgtgcttaagcttggaatcaaaggcattgccttaggcgctgtttggacgaattttaacctcgttgtttcgttgattctctacatatgggtctccggcgtatacaaaaaaacatggccaggtgtttcgttgaagggcatcttgagcggttggaaatcgcttttgaatttggcaattccaagttgcatttccgtatgcctcgagtggtggtggtacgaaatcatgattttactttgcgggttattgattaatccccaagcaacggttgcatcaatgggggttctgatacaaaccactgctctgatatacattttcccatcttccctgagctttgcggtttccacacgtgtcggaaatgaactgggtgcggagaatcccaaaaaggcaaaagtcgcagcactggtggggttatgtatcagttacggtttgggtttctcggcattatttttcgccgtttcggtgaggcaagcgtgggcttcgatgttcacacgtgacgcggagatcattgctttgacgtcgatggtgttgcccatcattgggctctgcgaattgggaaactgtccgcaaacaacggtttgtggcgttttgaggggaaccgcgaggcccaagttgggagcgaatataaatttgggttgcttctatctagtgggaatgcccgttgcggtgaggttgagtttctttgccggctttgatttcaaaggcttgtggcttggtttattggccgcccaagcctcttgtatgttcaccatgttaattgtgttggctcgcaccaattgggagggccaagttcaaagagccaaagaactcacatcatcgtctgaggaacaagatcagaattgcttcttcagttcctgcgctaccaaggaatattgctctgattcattattagtttga

SEQ ID NO: 2101 - DNA, 2226 bp, Glycine max var. Williams 82
atggagcttgcttttcttctcggccttattttcatgcttagcgccaacccgacttcaatggctgaagagcatgacatcaacaacaacttgcaaacttacattgttcacgtcaaaaagcccgaaaccatatcttttcttcaatcagaagagttacataactggtattactcgttcctacctcaaaccacccacaagaaccgaatggttttctcttaccgcaacgttgcctctggatttgccgtgaagttaaccccagaagaagccaaagttcttcaagagaaagatgagattgtatcagctcgtcctgaaaggaccctctcattgcacacaacacacactccatctttcttggggctgcgacaaggtgttggattgtggaatagctccaaccttggcgaaggtgtcataattggagtcatagacacaggtatataccctttccatccatctttcaacgatgaagggatcccacctccaccagcaaaatggaacggacactgcgaattcacagggcaaaggacatgcaacaacaaactcatcggtgcaaggaacctgctaaaaaacgctattgaagagcctccttttgaaaacttcttccacggaactcacactgctgcagaagccgctggaagatttgtggagaacgctagcgttttcggcatggctcagggtactgcatctggcatcgcacctaattctcacgtggcaatgtacaaagtgtgcaatgacgaagttggttgcactgaaagtgccatcttagccgcaatggacatagccattgatgatggtgttgatgttctttctctttcccttggtttaggctctcttccgttcttcgaagaccctattgcgattggtgcatttgtggctattcagagtggagttttcgttagttgctcagccgcaaactctggtcctgactacagcactctatccaacgaagcaccgtggattctcaccgttggtgcaagcacaattgacagaaagatagcagcatcggcagtgcttggaaacggtgcagaatatgaaggggaatctttgttccaaccccaagattttagccctagtttgttgccactagtgtattctggtgcaaacggaaacaacaactccgagttctgtctcccaggttccttaaacaacgttgatgtcaagggaaaggttgttgtgtgcgacataggtggaggctttccaagtgttggaaaaggacaagaagttctgaaagctggtggtgcagccatgatcctcgccaacccagaacctcttggcttcagtactttcgctgttgcttatgttttgccaacagtggaagtgagttactttgctggcttggccataaagtcttacataaactcatcttactcaccaaccgcaacaatatccttcaaaggaaccgtgattggtgatgaacttgctcccacggttgtttcattttcttcaaggggtccaagccaagcaagtccagggattctaaaacctgacatcattggacccggagtgaacattctagctgcatgggctgtgtccgtagacaacaaaatcccagcgtataacgttgtttcaggaacatcaatgtcgtgtcctcaccttagtggcgttgctgcattgctcaagagtgcacaccctgattggtcccctgcggctataaagtcagcaattatgaccactgcttacacggtcaacctcggaggcacacccatagttgaccaaaggaatttacctgctgacatatttgccactggtgcaggccatgttaaccctaataaagcaaatgatccagggcttgtttatgatattcagccagaggattacgttccctatttgtgtggtttgggctatgaggacagagagattgaaattctagtgcaaaggagagtgagatgctctggtgggaaagccataccagaagcacaactcaattacccttcattttctattctgatggggtctagttcacagtactacaccagaacgttgaccaatgttggacctgcacagtcaacttacacggtgcaacttgatgtgcctttggccttggggataagtgtgaaccctagtcagataacgttcacggaggtgaaccagaaggttacattctctgtggagtttatcccagaaataaaagaaaatagaggcaaccatacttttgctcaaggttctctcacctgggttagggtatctgacaaacacgctgttaggatccccatctctgttattttcaagtga

SEQ ID NO: 2102 - DNA, 333 bp, Glycine max var. Williams 82
atgctattgtgcctggcagacctagaatttgattatataaatccttatgactcctcagctcgaataaatatggtggttttgccagaatatattacgcaagctgtcctgtgctgcttctaccttcttaccaagcattggattctggcactcttctttcttccttatctttttcacaatgtccgattgtatagacaaggaaggcatttggttgatgttactgagatattcaacctgctcacttgggaaaagaagcaaaggcttgtcaaactcttctatcttgtttttacccttttcctctctgtattttggatgatttacacatcattggattag

SEQ ID NO: 2103 - DNA, 2196 bp, Glycine max var. Williams 82
atggcgagcaccacaccctctgctgactcagcttcagcagatgaagttaccgcaaaagccgttaacaagcgctacgaagggctggtcacggttcgaaccaaagctataaagggcaaaggggcttggtattggccgcacctggaacccatgttgctgcacaacaccgaaacggggctccccaaagcggtcaaactcaggtgctccctatgcgacgccgttttctccgcttccaatccttcacgcactgcttctgagcatctaaagcgcggaacctgccccaatttcaattccgccgccaaaccaatctcctccgtgtctccctcctccgccgtcgccgccatggccttgtcgcctccatcctctccgaccaaccacaaccaccgcaagagaatttcttcttcctacgacgcgccgtcgcagcaacaacagccgaatttggtgttatccggtggaaaggacgatttgggagctttggctatgttggaagacagtgtgaagaaattaaagagtccgaaaacttcagccggtccaactctaaccaaaagtcaagtcgatagcgcctttgattatctcgctgattgggtctacgagtcttgtggctctgtctctttttccgctcttgagcaccccaagttcagagcgtttctcaaccaggtcgggttgccaacagtttctatcagagagttcactggaagtagattggatgccaagtttgaagaagctaaagcatattcagaagcgcgaatcagagatgctttgttctttcaagtagcgtcggagggatggaaatggaaggggaagaagtattgtgaggagaagttggttaacatgagcgtgaatctccccaatgggaccagtttgcacagaaggaccttgtttgtcaccggctctgctccttccaattatgcacaagaggttatgtgggagacactaaccggcatttgtgggaatgtcgtgcaacaatgtgttggtattgttgcggacaagtttaagaacaaggccttgagaaacttggagaatcgaaacccttggatggttaacctttcttgtcagtaccaaggcttcaatagtttgatcaaggacttcaacaaggaactccccttttttaacaccgttacacacaattgtctcaggctcgccagtttcatcaatttcaagtctcaggtgaggagtagttttgacatgtaccaacagcaggagtacgggcacacctggttgctccgaatgccattgccctctcgccagttcgagtattttgacactgtgtatgcaatgatggaggatgtgttgagttcggttcgtgccttgcagttgctgctgttgaatgagaacttcaaaatggcgtcaattgaaaacccgaatgcgagggaagttggggacatgattcgagatgtggggttttggaatgatttggaggctgtgcattcgttggttaaattggtgaaggagatggttaaagagattgagacagagaggcctcttgtaggacaatgccttcccctttggggagagttaagggcaagagtgaaggattggtgctccaaattccatgttgcagaagcggcagtagagaaagtcattgaaaaacggttcaagaaaaactaccaccctgcttgggctgctgcttacattcttgaccctctttatttggttagggacacgagtggcaagtaccttccaccgtttaattacttgacgccggaacaggagaaagacgtggacaagctcataacaaggcttgtgtcaagggatgaggctcatattgtgttaatggagctaatgaaatggagaacgcaagggcttgatcctgtgtatgctcgtgctgtgcagatgaaggaaagagatcctgttactgggaaaatgaggcttgtgaatccacaaagtagtagacttgtgtgggaaacttatctcaccgagtttaagtccctgggaagagttgcagttaggctgattttccttcatgcaacctcgcgtggtttcaaatgtaattggtcttcgtggagatgggtgtgtagccaaggaaactccagagcagcactcgatagggcgcacaagttgatatttattgcagctcattccaaattcgaaagaaaggatttttccactgatgaagagaagaatgcggagttgtttagcttggcaaatggtgaggatgatgtgctgaacgaggtttttgtggagacatcctcagcgtga

SEQ ID NO: 2104 - DNA, 795 bp, Glycine max var. Williams 82
atggggaggcaaccttgctgtgacaaacttggggtgaagaaaggtccatggacagccgaggaagacaaaaaactcataaacttcattttcaccaatggccagtgctgttggcgtgctgttcccaagcttgctgggcttcggcgttgtggtaagagttgtcgtcttcgttggactaattatctaaggcctgacttgaagagagggctcctcacacaggctgaagagcagcttgttatcgatctccatgcccgtcttggcaacaggtggtccaagattgctgccaggttaccaggaaggacagacaacgagattaaaaatcactggaacacccacattaagaaaaagctccttaagatgggtattgatcctcttactcacgaacctcttaacaaacaagtctcatccaaagatagttcatcctctgaagagaatttgccacaagctgacaacactcatcaggttaaggaaagtgatagggttctcaactcagaagaaaattctagctcatcagcagctgaaaattcttctggtgaagaatcccttttagtggaaagcgatgtgtctctaatgaacaccatgtggctggatgaaactcctctaatggacacattatgggacaatacacctaaactagagaatgcaaatagtaacatgggcttgccaatatgggaggataattgtgcttggttgttggactgccaggactttggtattcatgattttggtttcaattgtttcagcgagatcgaatcaaatgtactgcaatctataggcatggacagaaaagggctttag

SEQ ID NO: 2105 - DNA, 858 bp, Glycine max var. Williams 82
atggcgagtgggtggatgaagtcattgcaatgcaagtccagagcataccaagacgtataccaccctaactctaaatacctcattcccagttccagctgcagaaagaccatcaaagacgtcgtcgtcgacacaaccaagcccaggcccaagcccaatcccaagcccgaaaagcctctccagaaacaccccagctccagatacccttcatccgccgccaagcccgacttcgaaaccactatcaaccgatcgaggagcgtgaccgccacgcgccacgccgaccctcgcttcccttctctcaccgaactcaccgagggccacccttcgcggaacgtcgtggagattatcttccacaccagctgggggcccaagcccttctcgggcctggtcgagatgatttttaaagtccacaacggcccacgaaccgtctctcgtttcgaggagtatcgcgaggccgtcaaggtccgggccggaacgggcccggcccatgactacgaggagaatgcgcgatgcgttgcggatgggaatgaggtcatgaggtttcactgcttgggtcccacctccggcggcgctccctacggcggagcttgtgccttgtctttccccggcggcaaaggggcggcgatctgcacattctccggcagcggcggtgcacacgaaagctccggcggtggcaggggcagaagggccatgctggtgtgtcgtgtcattgcgggtcggatctcgaagcaaatcgggttcgtggaatcgttgttggatggacgagttgggttcgactcggtcagtggggacaacggcgagttattagtgtttgactcgcgtgctgtattgccctgttttcttatcatttataaattgtaa

SEQ ID NO: 2106 - DNA, 1761 bp, Glycine max var. Williams 82
atgagcaacctccctacaactcaagggaaagccatccctgatgcctccgactacaagggccgccccgccgagcgctctaaaaccggtggttggaccgcttccgccatgatattaggaggagaagtgatggagaggttgacaacactaggcatcgcggtgaatttggtaacatatttgactgggaccatgcatttgggtaatgctgcctctgccaacgttgtaaccaacttcttgggaacctccttcatgctctgtctgctcggtggcttcctcgccgatactttcctcggaagataccgcaccatcgccatcttcgctgccgttcaagcaactggtgtgacaatcttgacaatatcaaccataattccgagccttcaccctccaaagtgcaacggagacaccgtgccaccttgcgtgagagcaaatgagaaacaattaacggtgctttatttggcgctttatgtaacggcgctcggcaccggaggtttgaaatcgagtgtgtccgggttcggttcggatcagttcgatgattcggacgacgacgagaagaagcagatgataaagttcttcaactggttctacttcttcgtgagcatagggtctctggccgcaaccacggttcttgtgtacgtacaagacaacataggacgaggttggggttatggtatctgcgcgggtgcgatcgtggtggcacttctcgtgttcttgtcgggtacgaggaagtaccgtttcaagaaacttgtgggaagtccattaactcagtttgcggaagtgttcgtggctgctctgagaaagaggaacatggaattgccctctgattcatcattgctctttaatgactacgaccccaagaagcagactcttcctcatagcaagcagttccgtttcttggacaaagctgcaatcatggattcatcagaatgcggaggtggaatgaagaggaaatggtatctttgcaccctaacagacgtggaagaagtgaaaatgattctaagaatgctacccatatgggccaccaccatcatgttttggacaatccacgctcaaatgaccacattctcggtgtcacaagcgacaaccatggaccgtcacataggaaaaacatttcaaatgcccgcggcatcaatgaccgttttcttaattggaacaattctcctaactgtccccttctacgaccgtttcattgttcccgtggcaaagaaagtgctcaagaatccacatggtttcacccctttgcaacgcattggagtcggtttagtactctcagtggtttccatggtggtaggagcactgatagaaataaagagactaagatatgcccaatcacatggtttggtagataagccagaagcaaagatccctatgaccgtgttttggttgataccacagaacttgtttgtgggggcaggggaggcatttatgtacatggggcagttggactttttccttagagagtgtcccaaagggatgaaaacaatgagcacgggattgttcttgagcacactctctttggggtttttctttagcaccttgttagtgtctatagtgaacaaaatgacagcacatggtaggccatggctcgcagataatcttaaccaagggaggctctatgacttttactggctcttggctatattgagtgctataaatgtggtcttatacttggtttgtgctaagtggtacgtctacaaggagaagaggcttgctgaagagtgcattgaattggaagaagcagatgctgctgctttccatggccattga

SEQ ID NO: 2107 - DNA, 309 bp, Glycine max var. Williams 82
atgaagattttttttgggttttgcataaacagtgttggccctgtggtggcttggaccatttgtcctatagcgttggagctcttacttagtctgtgggtgttccaagaagaagccctttactcagcgaggttgttcttcttccgattgcgtcagattgtgttcaacaggaatattaatggtacaaggttggagcgagctttccgtttgatgttgcaaacacttacttccaccaccactgcttcaacaacacagcaagaagaacaactcaaccaggacaccttcaatactcctttaactctcacactatag

SEQ ID NO: 2108 - DNA, 594 bp, Glycine max var. Williams 82
atggaagaggaagataaccaagtccataacttgacagaagagaagaaaaaaagtgaaaacgaagaagtgagtgttgagagtaacgataagaagaagaagaagagaagcagtgatgggaagcacccaacgtatcgcggtgtgcgcatgcgtaagtgggggaaatgggtatcagaaataagagagcccaaaaaaaagtccagaatctggctcggctctttttccacgccagaaatggcggctcgagcccatgatgtcgcggctctcactatcaaaggcacttctgcgttccttaatttccccgaattagcctcacaccttccgcgcccactcaccacttcccctaaggacatccaagccgccgccgccaaagctgctgcactcaactttgaggcccaagtcgaagcccaggcccaggcccagctgagcataccaagttcctcctctgaggttgagttccctgatcttttactggactcaagtcacagtgcaggtgagtttgattactcggcgccgtggctagtagccgaagctgaacatctagacttggcttttcggctcgatgaccctcctttccctgcttgggggtcttactaa

SEQ ID NO: 2109 - DNA, 888 bp, Glycine max var. Williams 82
atgaatctccctatcatagatctgtcctcacctgatcctctttccactgccatttccatccgtcaggcgtgcattgagtatggtttcttttaccttgtgaaccatggcgtggagaatgacttggtcaaagcctttgatgagagtaagaggttcttctcacttccaccaggagagaaaatgaagttggcccgcaaggaatttagaggttatactcctcaggatcctactttaggcctccatggtgattcaaaagagagctattatattggtcctatggcggattcagcaagtgttaagctgaatcaatggccttcggaagaattacttgaaaattggagaccatcaatagaagccatctactggaaactctttgaagctggaaaaaagttgtattctctaattgcactttccttgaatatggatgaagatttctttgataagataggtgccgtggacaaaccatcagcttttcttcgccttttgcgctatccaggtgaaatgggacctcaccaagagatatgctctgctcattcagatactggcgcgctcaccctcctaatgactgatggagtcccaggactacagatctgtcgggacaagttaaaggaaccacgggtctgggaggatgtgccttacatggagggggcctttattgtgaacatcggagacttgatggagaggtggactaattgtttataccggtcaacaatgcaccgggttaaacgaactggaaaagaacgctattcgatggcattcttcttagaccctcatccagactgtgtggtggaatgcctcaaaagttgttgtagcgaatcatgtcctccaagattcactccaatccgaagtggagactacatggatgaaattttaagcaacacaccagtctga

SEQ ID NO: 2110 - DNA, 207 bp, Glycine max var. Williams 82
atgttttcattagtttgcatcttcagggcctttattgtgaacatcggtgacttgatggagaggtggactaattgtttatatcggtcaacaatgcatcgggttaaacaaactggcaaagaacgctattcggtaattataagctacttttctcagtcgcttcattttgtcatatttgttccattaactttttcgaatcatagtttatga

SEQ ID NO: 2111 - DNA, 1433 bp, Glycine max var. Williams 82
atttaccagtatcaattatcaatcattaacaaattttgagttctgatcaaacctcctcagcgtactcgatagttgatactccggactaagaatttacagcacaacaataatgaataataaaatgcttttacgtttcaagaaagcttgtttgttgtggtgattttgcttggactaagttttggtctgtgatttgttgctttggtgagagagtggatatggacgaacggtacgagactttgaaggagcttggttcagggaacttcggagtggcaaggttggccaaagacaaggagacaggagaacttgttgccatcaaatacatagaaaggggaaaaaagattgatgcgaatgttcaaagggagatagttaaccaccgatctttaaggcatccaaatattatcaggttcaaagaggtatttctgacccctactcatttagctattgtccttgagtatgctgctggtggcgaactcttcgagaggatatgcaatgctggtcgattgagtgaagatgaggcaagatttttctttcagcaactaatatctggagttagctattgtcattccatgcaaatatgtcatagagatctgaaattggaaaacactctactggacggaaatccagctcctagacttaaaatttgtgactttggtttctccaagtctgctttgctgcactctcaacctaaatcaactgttggaactcctgcatacattgctccagaagttttgtcgcgaaaggaatatgatggaaaggttgccgatgtttggtcgtgtggtgtgacactttatgtcatgttagttggagcatacccatttgaagatccagaagatcctaaaaatttcagaaagagtattgggagaattatgagtgttcaatatgccatacccgactacgtacgtgtctctaaggagtgtaggcatcttatatctcgtatttttgttgccaatcctgccaagaggatcaacatctcggagataaaacagcacctttggtttaggaagaacttgccaagagagataattgaggctgaaagaaggggttacgaggaaacacaaaaggaccaaccaagccaaagtgtggaagaaatcatgcagatcattcaagaagcaaggacaaaaatccacactggtgagcaagctggcacaggaacttcggatgttgtgcgtggtgatgaggctaatgaggaagttgatattaatgaccactttgccaaatacctaacccttgattaatttgtggttggctaaattccctctctctctatatatatattgtttaccgaagctagtgtgcattcttcgtgtgtatgatatagagttgaatgagacacaacacttcatcgaatttgaaagttgggctattttgtttatcaattataataagaattaatttttgttgtttagataagtttactgaaaaacagtgttaag

SEQ ID NO: 2112 - DNA, 1665 bp, Glycine max var. Williams 82
atggctttaacacttcgctcttcaatttccctcgccagccagaaagaaaccaaactccaaaaacccgatgacgaggttcccaccaaagtgtttaactttgcaaaagccaacccatctttccgtcttagagcaaagagttccatgcaacaaacacatgtcacaggagacaacaacaagaacaaaaacaacaacttcaactccgaagtaacgatgataaacgagaaaagggagaaggttcacgcgccatcggttgcacatagccacaatgattcaatgagagttcccgtgtttgtgatgcttccgttggacactgtaacaatgggagggactttgaataagccgagagcaatgaatgctagtttgatggcactgaagagtgcgggagtggaaggagtgatggtggatgcttggtggggtttggtggaaaaagagggacccttgaagtataattgggaagcctatgctgaacttgtgcagatggttcaaaggcatggcttgaagcttcaggttgtcatgtctttccatcagtgtggaggaaatgttggagactgttgcagcattcctctacctccatgggtgttggaagaaatcagaaagaaccctgagatggtttacacagacagatcagggaggaggaatcctgagtacatctcattgggctgtgattcaatgcctgttctgcgaggaaggactccccttcaagtctactctgattacatgaggagcttccgtcacagattcagagactatttgggcagtgttatcattgaaattcaagtggggatgggtccttgtggggagctgagatatccgtcttatccagaaagcaatggaacatggaggtttccgggaattggagaattccagtgctatgacaagtatatgagagcttccttggaagcatcaactgaggccattgggaagaaagagtgggggaaaagtggaccacatgactcaggccaatacaaccaatttcctgaagacactggatttttcaaaagggaaggtacatggaacacagaatatggacaattcttccttgactggtactccaccaaacttgttgaacatggtgagaaaatccttgtatcagccaaaggcatattcaactcatgtggggtgaaactatctgccaaagtagctggaattcattggcactacaagactaggtcacacgcggctgaactaactgcaggctactacaacacgcggtttcgcgatggatacctaccaatagcacaaatggtggcaaaacatggagttgtgttaaacttcacctgcatggaaatgagggacagagagcaacatgagcattgttcccctgaggggttggttcatcaagtgaagatggcagccagaacagcaggagcagaacttgctggggagaatgcacttgagagatatgatgcaggtgcattttctcaagttctgtcaacaagtaactctggttctggattggctgcattcacttatctgagaatgaataggaggttgtttgagggagacaattggaggcactttgtggagtttgtgaaatgcatgtctgaaggtggaaagagacaaaggcttcctcaatctgattcttgtgggactcatctttatgttggacacatcacaggaattcagaagcagcaagagcaagctcaagaggttgctcttgtgtga

SEQ ID NO: 2113 - DNA, 1470 bp, Glycine max var. Williams 82
atgacaatactactagctgttcgtgattttccggatggatgtggagcatttccgaaatttgttgaggatattaagaataagaatgatcaacatttagcaagaaggtatcttcctccacgaaaagcttcagctgtcagagacttccttcctttatttggagcatgcaatgacatggatgtgtgtcaagaagaggggaagaaagtgggtctacaaaacctcgctgtagatgacaacaatcaattgaaaaaagtatcagcagctgatgatgtaaaagaagaagttaagagtaacattcaagatgactatagtcgcaagagaaatattgtggacttctatcaaaatcaaactgattctgaaaggaatgttactgagggactgaaggagctgcgtgcatttgaagaaccatcttctcagatgaaaatggcgccggaaaaaaaattgcaggtctcatcatcagacatgaaagtggtacttggtttcatggttaaatcagaatgtccttggaggtctggtcaagtttcctcccactttaagttgggagatgctaaaaatgaagacaagagaaagaaagtggtttcttttgcattgcctgacaggtctagaagagctatcaagactaaatgtaattttgggcagaagcctttcaaaaagaaggcaaattctgcttctgaaggtatgggtgaattagaaatttggggaaaggagggctggcttgaccctgttgaaaatagtgaagaatcacatgagttcgatgtaaatgttactccctcttctcattctaatttcactggtggtgatgagagtgactcggatgtgacccgagaaaaagtgagggaagcattacggttgtttcaagttgtttgtagaagtcttttagaggaaggagaatcaaagtcaaatgaactagggaaaagaaagagggttgatttaattgctgcaaggattcttaaggacaatgggattcatgttaactcaggcaagaagatactgggccctgtacctggggttgaagttggtgatgagtttcaatatcgggtggagcttaatataattggccttcatcttcagattcagggtggcatagattatgtgaagcacaatggtaagatccttgcgactagtattgttgcttcaggtggctatgctgattatttggtcaattcggatgtcttggtatattcagggcagggtgggaatgtgatgagcaatgacaaaaaacctgaagatcagaagctcaagcggggcaatcttgctttgaagaacagtagtgaggaaaagaatcctgttagggtgattcgcggctctgaatcaatggatgataaatacaagacatatgtatatgatgggctgtatgtggtcgagtcatattggcaggacagaggatcacatgggaagctggtttataggtttcgccttaaaagaattcctggtcaaaagcttgctttgaaggaagtgaagaaatctaaatag

SEQ ID NO: 2114 - DNA, 498 bp, Glycine max var. Williams 82
atggcactcaggatgtgggcttcttccactgccaatgcactcaaactctcttctgtctccagacctcatctcttgcctcctttttctttctccagatgcttatcttccgtcttggatggacttaagtacgctgattcacatgaatgggtcaagcacgaaggctcagtcgccaccattggtatcactgaccatgcccaggaccatcttggagaggttgtgtatgtggagctgccagaaccaggtggcacagtttccaagaagtctggcttcggagccgttgaaagtgttaaagcaacaagtgatataaactctccaatctcgggggagatcgttgaggttaacaaaaagctcacagaaacgcctggcctggtcaactcaagcccatacgaagatggatggatgatcaaagtaaagccaagcgatccatctgaattagattccttgatgggtccaaaggagtacacaaaattttgtgaggaagaagatgcaagtcattaa

SEQ ID NO: 2115 - DNA, 1036 bp, Glycine max var. Williams 82
attaattagcttttagaaaagaaagaaaaacgggagtgctgattttgattcattagcggattgtttaattgaaatagcaacaagtttagccttgattttttttgtaaggttaggcgaaggataataaaaaacataaggcagaacaaaaagaggatgaggcattcgctgcccaccattcatcgaagataaactttgaaaaaccatatatgaagagctccatcttattgtttcagtgatatattaataataaccaaaacagcagagagaagagaagggctacacaaacacaatctctaatggcactcaggatgtgggcttcttccactgccaatgcactcaaactctcttctgtctccagacctcatctcttgcctcctttttctttctccagatgcttatcttccgtcttggatggacttaagtacgctgattcacatgaatgggtcaagcacgaaggctcagtcgccaccattggtatcactgaccatgcccaggaccatcttggagaggttgtgtatgtggagctgccagaaccaggtggcacagtttccaagaagtctggcttcggagccgttgaaagtgttaaagcaacaagtgatataaactctccaatctcgggggagatcgttgaggttaacaaaaagctcacagaaacgcctggcctggtcaactcaagcccatacgaagatggatggatgatcaaagtaaagccaagcgatccatctgaattagattccttgatgggtccaaaggagtacacaaaattttgtgaggaagaagatgcaagtcattaaagtttgaattgaattggctcctgcagttatgtgtgggactgactgttcttcatatgtttatgatcttattaccttctgaacagttttttaatatgcaacagaactgtttctttccatttttccttcccctgctattgtctcttgtcaccgacacttcagtgtgtctacattctaatttctttaataaaaatatttttattaaagataactattttgtcaatataattactgtgattaatatt

SEQ ID NO: 2116 - DNA, 3039 bp, Glycine max var. Williams 82
atgcccaaaatgcgtgtcctctttgtttttctgtttttccattttcatttccctgaaaccctttctgccccaatctcagagtaccgcgcccttctctctctccgttcagtcattaccgacgccacaccacccgttctctcttcttggaacgcctccatcccttactgttcctggctcggcgtcacctgcgacaaccgccgccacgtcaccgccctcaacctcaccggcctcgacctctccggcacgctctctgccgacgtcgcccacctccctttcctctccaacctctccctcgccgcaaacaaattctccggccccattcctccctctctctccgccctctccggcctccgctacctcaacctctccaacaatgtcttcaacgaaaccttcccctcggagctttggcgcctccagagcctcgaggtcctcgacctctacaacaacaacatgaccggcgtgctccctcttgccgtcgcgcagatgcagaatcttcgtcatttgcatctcggcggcaacttcttctccggccagatcccgccggagtacggacgctggcagcgcctccagtacctcgccgtctccggcaacgaactcgacgggactatcccgccggagatcggaaacttgaccagcctccgggagctctacatcggctactacaacacctacaccggcggcattccgccggagatcggaaacttgtcggagctggtgaggcttgacgtagcgtactgtgcgttgtccggggagattccggcggcgcttgggaagcttcagaagctggacacgctgttccttcaggtgaatgcattgtcaggatcactgacgccggagctggggaacctgaagagcctgaaatccatggatttgtctaacaacatgctctccggtgagattccggcgagtttcggcgagctgaagaatattacgcttctgaatctgttcaggaacaagcttcatggagctataccggagtttataggagagcttccagcgttggaagttgtgcaactgtgggaaaataacttaacaggtagcattcctgagggtttgggcaaaaatgggagactcaaccttgttgatctttcttctaacaagttaaccgggactttgcctccttatctctgttctgggaatactcttcagactctgataactcttgggaattttcttttcggtccaattcctgagtcgctcgggacttgtgaatctcttacacggattagaatgggagaaaactttttgaatggttccattcctaaagggctttttggacttcccaaactcacccaggttgaacttcaggataattatctctctggagagtttcctgaggttggttctgttgcggttaatcttggtcagattactctctctaacaaccagctttctggggctctgtctccctccattggtaacttctccagcgtgcagaagctccttcttgatggcaacatgttcaccggtcggatacctacacagattgggaggttgcaacagctttctaagattgattttagtggcaacaagttctcgggtcctattgcgcctgagatcagtcagtgtaagctgttaactttcctggaccttagccgcaatgagctatctggagacatccctaatgagataactggcatgaggatattgaattacttgaatctttctaagaatcatttagtgggtagcattccctcttcgatatcatctatgcaaagcttgacttctgttgatttttcatacaacaacctgtctggtttggtgcctggtaccggtcaattcagctacttcaactacacgtctttcttgggaaaccctgacctgtgtggcccctatttgggtgcttgcaagggtggggttgccaatggtgcacaccaacctcatgttaaaggactctcctcttctttgaagctgctacttgttgttgggttgctattatgttccattgcttttgctgtggctgcaatattcaaggcccggtcattaaagaaggccagtgaggctcgtgcatggaagttgactgcgttccagcgtttggacttcactgttgatgatgttttgcattgcttgaaagaggataatattattgggaaaggaggtgctggaattgtctacaaaggggctatgcctaatggggatcatgttgctgtgaaaaggcttccagctatgagtagaggctcttcccatgatcacggattcaatgctgagattcagacattggggcgaatccgacacaggcacattgttaggttgttgggtttctgttcaaatcatgagacaaaccttttggtctatgagtacatgcccaatggaagtttaggtgaggttcttcatggaaaaaaggggggtcatttgcattgggacaccaggtataaaattgcggtggaggctgccaaggggctttgctatctgcaccatgattgttcgccactcattgtccatcgtgatgtgaagtcaaacaacatccttcttgattcaaatcatgaagcccatgttgctgattttgggcttgctaagttcctgcaagattctgggacatctgaatgcatgtctgctattgctggttcatatggatacatagctccagagtatgcctacacattgaaagttgatgagaaaagcgatgtgtacagttttggtgtggttcttttagaacttataacaggcaggaaaccagttggtgaatttggtgatggcgtggacatcgtgcaatgggtgaggaaaatgacggactctaacaaggaaggagttcttaaagttcttgatcctaggcttccctcagttccccttcacgaagtgatgcatgttttctatgtggccatgctgtgtgttgaagaacaggctgtagagagaccaacaatgcgtgaagttgttcaaatactgaccgagcttccaaagccacctggctctaaagagggagacttaacaataacagaatcctctttgtcatcatcaaacgctttagaatctccatcctcagcctccaaggaagatcaaaatcctcctcaatccccaccacccgaccttcttagtatttaa

SEQ ID NO: 2117 - DNA, 894 bp, Glycine max var. Williams 82
atgtccatggccatcattaacacttttggaaacgttggtgtctactatattgtattattattatcatggtttctcgtatctggtgtgtgtgtttggggacgacccgccacttttctgcaagactttgaaatcacgtggtcagagactcatatcaggcaaattgatcaaggcagagccatccaactcattctagaccaaaactctggttgtggctttgcctccaagagtaagtacatgtttggccgtgttagcatgaagatcaagctcattccgggagactctgctggcactgtcactgcattttatatgaattctgacaccgacactgtacgtgatgagctggattttgagttcttggggaaccgtagtggccagccttacacagttcagacaaacatctatgctcacggaaaaggagatagagaacaaagggtcaacctctggtttgacccttctgcggattttcacacttatactattatgtggaatcatcatcatatcgtgttctacgttgatgattttcccattagagtgtacaagaacagtgagggaaagggaatcccatacccaacaatgcaagcaatgggagtgtattcaacattgtgggaggctgataattgggcaacaagaggggggttggagaaaattgattggagtaaggcacctttttatgcatattacaaggactttgacattgaagggtgcccagtgccaggacctgccaactgtgcctctaaccaaagtaattggtgggaaggggctgcataccaagctcttaatgccattgaagcccgaaggtacaggtgggttcgtctcaaccatatcatctatgattactgccaagataagtcaaggttctcagtgaccccaccagagtgccttgccggcatttaa

SEQ ID NO: 2118 - DNA, 891 bp, Glycine max var. Williams 82
atgagctctgtacaagcactgtgtcaagcgtgtagttgtgcaatgttccagaacatcgaatgtaagctggggttcgcaaagttctgtggaatcaatgctgttggattaagccgtggtcgtaaaagcttgttgaagccgattatggctaaggaagatcacggcgcgtctttgatcgatgacggtaatcctaaatgccagggacatcaagtcaacaagcctaatggcatcaatcaatctactgcattatctggtaaaagtcttaccgagatgtcaaatattgggaattcgatgaatattttgtggcacgaatgtccaatccagaaacttgatagacagcagctacttcagcaaaagggctgcgtcatatggttaacaggtctcagtggttcaggaaaaagcactctggcatgtgctttgagtagaagcttgcactccaaaggaaagttgacttatatccttgatggtgacaatattcgacatggtctaaaccgtgatcttagttttagagcagaagatcgatcagagaacatacgaaggattggtgaggtatcaaaactcttggcagatgcaggtgttatttgtattgccagtttaatatcaccctaccgaaaggatagggatgcttgccgagctctattgccagagggggattttattgaggttttcatagacgtgccactggatgtgtgtgaagcaagagacccaaagggactttacaagcttgctcgagctggaaagattaaaggtttcacagggatagatgatccatatgaaccaccgtacagttgtgagatagtattacagcaaaaaggaagtgaatgcatgtctccaagtgatacggcagaaatagtaatatcctacttggagaaaaatggatacctcctggcctga

SEQ ID NO: 2119 - DNA, 987 bp, Glycine max var. Williams 82
atggctcagcttaacctcatacttatctggttatttttattgagtctgtgcctttattcatgtcctacttcggcccagttaagtagacaccactatgcaaaaacatgccccaatgttgaaaacattgtcagagaagcagtcaaaaagaagtttcatcaaacatttgttacggttcctgctaccattcgtctcttcttccatgattgcttcgtgcagggttgtgatgcctcggttttggttgcatccacaaaaaacaacaaagcagagaaggatcacccagataatgtttcactagctggagatggatttgacacagtgattaaagcaaaagaagcagttgatgcagttccattgtgcaggaacaaagtttcatgtgctgatattttagccttggcaacccgtgatgttattgaactggccggtgggcctttctacgaggttgaattgggaagatttgatgggctaagatctaaagattcagatgtaaacgggaggctgcctcatccagagttcaacttgaaccagctcaattcactgtttgcggccaacggtctcacccaaacggaaatgatagctctatcaggtgctcacactgttggattctcccattgcaacaaattcacgaacagagtatacaatttcaagagcaaaagtcgagtggaccctacactgaacgagaaatacgcaacacagctaaagtcaatgtgcccaaggaatgtggatccaaggattgcaatcgatatggacccaagcactccacggtcattcgacaatgtttatttcaagaatcttcagcaagggaagggcctcttctcttcagaccaagttctcttcacggactcaagatccaaggccactgtaaatgcatttgctagtagcagcaaaatcttccatgccaacttcgccgctgctatgaccaaattgggccgagttggaatcaagaatgcacagaatggaaacattcgcaccgattgttcagtcatttaa

SEQ ID NO: 2120 - DNA, 648 bp, Glycine max var. Williams 82
atggagaagcttattaggccttgcgacaaagaatacatgaggatgaccatgctaaaacaccaagacactttcaaagagcaggtgtacgaacttcatcgtttgtatcggattcagaagatattgatgaaaaatatggaagccagaagtggtattgaagtaaaccaacgaggatggaacttaaaaaatgtgattagtttaactcaaaatggtagtcataatggtgcacagaaaaatcctatattgaactttgatcttgaaagtcctgctaaggaggacaatgcagaatctgacagcgatggagttctagagattacaaatgagactgagattgagctgacactaggcccttcaagttacaaacgtaaaatagtggagacaccactgacttcagattcggcacatagcttgtcttcttcttctactggatcttgccttataaacaagacaagattgaagacccatcatagcagttattcaactgtagaagaattaagtggaggcttaattggccttgtccaggtgccacattcaaccgcagggtgccaaagtggaattagaaacagttatgattttgaagaacaatcaagagacgagagattgaaccagccaccttggttttttcaagtattgaatctgaacacgacctaa

SEQ ID NO: 2121 - DNA, 1491 bp, Glycine max var. Williams 82
atggaaggcaaccttatcaacatcctttacctcttaatttttctcatcagtttaaaactactattcttcagaaaaaggttaaaaaacccagcaccaagtccaccatctcttccaataatcggaaacctccatcagctgaagaaacagccacttcaccgagccttgtacgacctctcacagaaatatggccctaataatatcctctctctgcggttcgggtcccaacccgtcctcgtcgtttcgtccgcatccgcagcggaagaatgtttcaccaaaaacgacatcatcttcgcgaaccgttttcgctcttcattgacaaagtacatcggcttcaaccacaccattattacagcatcatcgtacggcgaccactggcgcaacttacgtcgtataagctcgctcgagattctctccaaccaccgtctcaactcctttttaggggtccgaaaggacgagaccatgaagttgcttcgaaagctggctaagggttctgataaagacttcaggagagtggagctgaggccaatgttttcggagttaacgttcaacattatcataaaaatggtgtgtggcaaacgctactacggcgaggaatacgatgggaccaacgccgaggaggctaagaggtttagagagatcatgaatgagatatcgcagtttgggttggggtccaaccttgcagattttgtgccgcttttcagattgtttagtagtcgcaaaaagttacgaaaggttggagagaagctagacgcgttcttccaaggactcattgatgagcatcggaataagaaggaaagttcaaataccatgatcggccatctgctttcctcacaagagtcacagccagagtattatactgaccaaactatcaagggccttataatggcgttatatgtggctggcacagagacttccgctgtagcattagagtgggcaatgtccaatttactgaacagtccagaagtgttggagaaagcaagggttgaattggacactcaagttggacaagaccgtttgatagaggaagcagatgttactaaattacagtaccttcagaacattatctccgagactctgcgattgcatccaccactgtcaatgttgttgccgcatttatcatctgaagactgcaccgtgggaagttatgacgtgccacgtaacacaatgttaatggtgaatgcatgggccattcatagggacccaaaaatatgggctgatccaacgagctttaagcccgagaggtttgagaatggaccagtagatgctcacaagctaatctcttttggattggggaggagagcgtgtcctggtgcaggcatggcccaaagaactctgggcttgactttaggttcgttgattcaatgttttgagtggaaaaggattggtgaggaaaaagtagatatgaccgaaggggggggaactatagtgcccaaggccattccattggatgcccaatgtaaagcacgtccgatcattagcaagattttctaa

SEQ ID NO: 2122 - DNA, 1762 bp, Glycine max var. Williams 82
gcatcatactttaacatggaaggcaaccttatcaacatcctttacctcttaatttttctcatcagtttaaaactactattcttcagaaaaaggttaaaaaacccagcaccaagtccaccatctcttccaataatcggaaacctccatcagctgaagaaacagccacttcaccgagccttgtacgacctctcacagaaatatggccctaataatatcctctctctgcggttcgggtcccaacccgtcctcgtcgtttcgtccgcatccgcagcggaagaatgtttcaccaaaaacgacatcatcttcgcgaaccgttttcgctcttcattgacaaagtacatcggcttcaaccacaccattattacagcatcatcgtacggcgaccactggcgcaacttacgtcgtataagctcgctcgagattctctccaaccaccgtctcaactcctttttaggggtccgaaaggacgagaccatgaagttgcttcgaaagctggctaagggttctgataaagacttcaggagagtggagctgaggccaatgttttcggagttaacgttcaacattatcataaaaatggtgtgtggcaaacgctactacggcgaggaatacgatgggaccaacgccgaggaggctaagaggtttagagagatcatgaatgagatatcgcagtttgggttggggtccaaccttgcagattttgtgccgcttttcagattgtttagtagtcgcaaaaagttacgaaaggttggagagaagctagacgcgttcttccaaggactcattgatgagcatcggaataagaaggaaagttcaaataccatgatcggccatctgctttcctcacaagagtcacagccagagtattatactgaccaaactatcaagggccttataatggcgttatatgtggctggcacagagacttccgctgtagcattagagtgggcaatgtccaatttactgaacagtccagaagtgttggagaaagcaagggttgaattggacactcaagttggacaagaccgtttgatagaggaagcagatgttactaaattacagtaccttcagaacattatctccgagactctgcgattgcatccaccactgtcaatgttgttgccgcatttatcatctgaagactgcaccgtgggaagttatgacgtgccacgtaacacaatgttaatggtgaatgcatgggccattcatagggacccaaaaatatgggctgatccaacgagctttaagcccgagaggtttgagaatggaccagtagatgctcacaagctaatctcttttggattggggaggagagcgtgtcctggtgcaggcatggcccaaagaactctgggcttgactttaggttcgttgattcaatgttttgagtggaaaaggattggtgaggaaaaagtagatatgaccgaaggggggggaactatagtgcccaaggccattccattggatgcccaatgtaaagcacgtccgatcattagcaagattttctaaatttcttgcaagtttgaactttggtcgacgttcaaattatcacattaaattagtagccttacagcgatttttatttgttataattcttaaatttacaatgtgattctttagtgagtatatgctttaataaaagatattcgtgtagatttctctatagacaacaaattatctaaacaaaattaattagtagagaatatacattatcattttatttgtaaaatgcttgtagcttgaaaatataatgtgattatttgaa

SEQ ID NO: 2123 - DNA, 474 bp, Glycine max var. Williams 82
atgatggtggaacagttggcggtggcgaagccgagccggccgagcgacgaggtgcaagtgaggatcgctaatgagatcagagccgaattcgatgccttggaaccaaagcgacccatcaaacccaacagaagcgaacccgacgccgttttgcaacacccccccgacgcctccgtcaataatatacctgagcttcacaagtttcgatcccttcaatctcgctctcatgctataatttcatcggcggggattgtggatgcacatgatgagtttgtggagacgcagtactataaagaattggcagcgattgacaaacagcatcacacgacagggagtgggttcataaaggcggtgagagaaggaggggaaggtggatatgagattcatgttaatgctgctgaaacccaacccagaggctataaaagcaaccctgccaccaacgactgggttcctaactctgaggaatatcagttttga

SEQ ID NO: 2124 - DNA, 927 bp, Glycine max var. Williams 82
atgaagaacactaacagcaacacaaaactaatccttctccacccatatatccagaaacaaggaagctcaaaccgcttatggcttctagccttcatatccttcttcaccttagttttccttgccacactcatttacacaagagacacaacctcatctaccactaccactacctcttccacccctttatctagtttcaccaacacccttttatcatccactgtaataaacaccctcctccactatgcctcaaaatccaacgacacctttcacatgccccactcagacctcaaaaccatctccgacatgctccgaaagtgtccctcgccatgcaacttcctcgtcttcggcctcacccacgagaccctcctttggaaagccctcaaccacaacggaagaaccgtcttcatcgacgaaaaccggtactacgccgcgtatttcgaagaaaaacaccccgaaatcgatgcttacgacgtggcatacacgactaaaaggagtgagttgaaggagctgatagcttcggcgaaagaacaagtaggaaatgaatgcaggccagtgcagaatcttctgttttctgagtgcaagttgggtctcaatgaccttccgaaccatgtttatgaagtggattgggatgtgatattggtggatggaccgaggggggattggccggacgctcccggaagaatgtcgccgatcttcaccgccggcgttcttgcccggagcaaaaagggtgggaacccgaagacgcatgtgtttgtgcatgacttctcggggaaagtggagaaggtttctgggaatgagtttctgtgcaaggaaaatttggtggaggctactcatagtttgggacactatgtgctggaaaaaatggacgagagtagcgttcagtattgtaagaatcactcatcaggattcgcttcttcttcgtcttag

SEQ ID NO: 2125 - DNA, 1488 bp, Glycine max var. Williams 82
atggagaagaagaagggtgagctaaagtcaattttccttcctttcctttccactagtcacataatcccgctagtggacatggccagactcttcgccttgcacgacgtcgacgtcaccatcatcaccaccgcacataacgccaccgttttccaaaagtccatcgatttagatgcgagtcgcggtcgccccatcagaacgcacgttgtcaacttccccgccgcacaagtgggtctccccgttgggatcgaagccttcaacgtcgatacgcctcgggaaatgacccccagaatctacatgggcctatcccttctccaacaagtcttcgaaaaactcttccatgacttgcaaccggatttcatcgtcaccgacatgttccacccttggagtgtcgatgctgctgctaaactcggcattccgaggatcatgttccacggcgcaagttatctcgctcgctccgctgcgcactccgttgaacagtacgcaccccacttggaagcaaaattcgacaccgacaagttcgtgttacctgggttacccgataacttggagatgacgcgcttgcagttgccggattggcttaggtctccgaatcagtacactgaactgatgaggacgattaagcagtcagagaaaaagagttacggttcactttttaatagtttttatgacctcgagagtgcttactacgagcattacaagagcatcatgggaactaagagttggggaattggaccggtttcgttgtgggcgaaccaggatgctcaagataaagctgcacgagggtatgctaaagaagaagaagagaaagaagggtggcttaagtggctcaactccaaagcagagagctctgttttgtatgtgagttttgggagcatgaacaagttcccttactctcagctcgttgaaatagcacgtgcgcttgaagattcggggcatgattttatctgggtggtgaggaaaaacgatgggggtgaaggagataactttttggaggagtttgagaagagaatgaaggaaagtaacaaaggatatttaatatggggttgggccccacagttgttgatactggagaatcctgcgattggagggttggttactcactgtggttggaacacggtggtggaaagcgtgaacgcggggttgccgatggcgacgtggcctctgtttgcggagcattttttcaacgagaagctggtggtggatgtgttgaagattggggtgccggtgggggcgaaagagtggaggaactggaacgagtttgggagtgaggtggtgaaacgggaggagattggaaacgcgattgcttcgttgatgagtgaggaagaagaagatggaggaatgaggaagagagccaaggagctaagcgttgcggcgaagagtgctataaaggttggtggatcttcgcacaacaacatgaaggaattgattcgggagctcaaggagatcaagctttccaaggaggctcaagagaccgcacccaatccttaa

SEQ ID NO: 2126 - DNA, 1227 bp, Glycine max var. Williams 82
atgaagaaaagttctggtacctcccagaaacttggttcatttctaagtccaggggcaccaaactatagagagaaaagcattgggagccaaaaggggtggagctcagagagggtgttgctgcagccatcatcaaacagcataaggaatgctagtgtggctaacttgacacccttcaacagtggaagaacaataccttcaaaatgggatgatgctgagaggtggatttgtagccccgtttcaggctatgccaacaacaaaaccaattcctatacacaacttcagcagcggcgaccaaaatcgaaaagtggtccaattatgcctccaggaacaggctactactccaattactcacccacaattccactgagccaaggtttggtagtgaagaacttcatgatgggtggttctcccttttcaactggggtgttggcaccggatgctatctctcttcaccattattatgcacatgaggctgtttttggtacccgttatgactttgacaatagtatgcaatgcttcagtccattcctcaatgaaaatagtgtagctctcccatcagtgtctagtgcacccatgtggtcagaactgctatgtgacccttcgcctaattctcaagacgagaaacgaaacgaaattaagaatgaggacaccgtgacatctcctctctcaaaatgtgacaaaggcactcaaatgagccctcctgagcctgagaatgatgcacccacttcgacaatggatcaacaaaataacctttctgcaaagttagaggtcagagatgtagagatagacagcgaggctagtattattaggtggtctaagagccatgtacccaagctgagcttgctacctggtaaacactcaagaaaaattagtagaacggaaaccaaagcttcaggtttggataatgcagagtcgacgttggactcatccaagattcagagggaggaagccaaaatcgttgcatgggagagtttgcagaaagccaaggctgaagctgaaatacgaaaactagagatgaaattagaaaagaagaaatcgtcatcaatggataagattcaaagcaaactgagaagggcgcagatggaggctgaaaagatgagaaaccaaataactgtagaagaggagggtcagcaggtttccaagactcgaaaagtattttcattccacaaatatgcccagatatggtttccaaggagctgcttcggcactcatgctctccatgattaa

SEQ ID NO: 2127 - DNA, 618 bp, Glycine max var. Williams 82
atgtctgctcaggtcggtgtcaggacacgagcccaagccgcattagccatggaagctgttagttctgctgaaccatcatccaagagaaagaagatcagcaacagtactaaccaagagccaaaactctccaagactccgagaacgagttcttcctccgctgtcaaaccagcgacggtgacggagatggttcagccggtgtcgccggagatggttcagcaacgctgcctgagccctacctccagtgaaattccggcgtcttgctgctccagcaacggatccattggcctcgatcaggacaggatcaagctcttagatctggaggtggagagcgcgcaagttgaaacgtcgacgtgcaatggtggtcatgaaattgagaggagagagatgaaacgttccagcgagcttcgcgagaattctcaggagccggagccaatggagatcaattctcaccgtgtcttatcaaaggcaaaagccatgcctaccgaattggagctcgaggaattcttcgctgcctcggagaaagacattcagaaacgatttcaagacagatacaattatgatattgttaaggacgtaccgctggaaggacgctacgagtgggttcagttgaagccttga

SEQ ID NO: 2128 - DNA, 1264 bp, Glycine max var. Williams 82
aaccgttgaacccctttcgtcattatcacaattttcgtcttctccgtactacacgcgcgcaccaacttacgctcacgccactcctcccttctttcctttcttcacccctagtttctctctcttacattagcaaaaaccaaaacccgaaaaaacgcacagcacagcatcgagcacagcaacacctgaaaaaggaagggttagtgagtgtgtgtgtggaaattgtcatcgctcgcaagagcaacaacaactagtacttaaagagacagagagtgtgcacatcaatgtctgctcaggtcggtgtcaggacacgagcccaagccgcattagccatggaagctgttagttctgctgaaccatcatccaagagaaagaagatcagcaacagtactaaccaagagccaaaactctccaagactccgagaacgagttcttcctccgctgtcaaaccagcgacggtgacggagatggttcagccggtgtcgccggagatggttcagcaacgctgcctgagccctacctccagtgaaattccggcgtcttgctgctccagcaacggatccattggcctcgatcaggacaggatcaagctcttagatctggaggtggagagcgcgcaagttgaaacgtcgacgtgcaatggtggtcatgaaattgagaggagagagatgaaacgttccagcgagcttcgcgagaattctcaggagccggagccaatggagatcaattctcaccgtgtcttatcaaaggcaaaagccatgcctaccgaattggagctcgaggaattcttcgctgcctcggagaaagacattcagaaacgatttcaagacagatacaattatgatattgttaaggacgtaccgctggaaggacgctacgagtgggttcagttgaagccttgaacgtgtgcgtcccagttcgtatcgccatcgaagaagaaaagctccgatcaaattgaacatgtcattttggcctatttatatattgttaattaagtctagtctaggtctttgatttcaatctaaattatctttttaatttacaccagccaagactcttttatgatctggtgtacagcttttttatatttatttcggtgtggttagttattggttaagggtaaacaggaatgaattcagcttcgtttgttctctgtacggagagcagcttaaagctagcttgtgcagaaaaatactgtaaattccctttggtgaagaagaacaaacgcttccattttacagacttcaacctctctctcgtttttcgc

SEQ ID NO: 2129 - DNA, 1923 bp, Glycine max var. Williams 82
atggtgactgctgagaaaaccgtgaaaaatgggcgtcgatcaaatagagaaaggaaaatggctttgacacaagatgttgataagttgaagaggaagctcagacaagaagagaatgttcacagagcgttagaaagagcattaacaagacctttgggatcccttcctcgtcttcctccttatcttcctccacagacattagagcttgtggctgaagtggcagtattggaggaggaggtggttagactagaagagcaggttgtgaatttcagacaaggtctatatcaggaagctgtctacatttcctctaagaggaatgcagaaaatttgagggactcaatggaccagaactccatcaggagctccaaacatcaaagatcaaaatctttgtcccaaagtgagcttaattcaactaccatggctaggcctcaactttctcttgctagaagtgcttccagtagaaagctgttctctgacattgtcgttgatcacactggtaagctagtgaacgggaaacaattgcacatgaaacaagattcgctatcatcaatcccagaagagggacagcgaaaagagaatccactgttttatagctctctgaaggataagcaatctccagagaagaaaacggccaaagtcattactccagtgaagaagtctccaataaaaaaagaatcagctgataaatgtgtagatcacttgaagttacagatggggggggggggggggggggggagattagaagatgaagaaacagctgagagattagatgataatgtgtcagaagttgacagaacacccaacagaatttcagaggatattgtcaagtgcttgtgtagaatatttgtgagaataggcacattcaaggaaaaactaggagaatcaaaaacacctctcagttctacatctgcatgcagcaagggaaaggatcactgttcagaatccaaaatgagggatattggtacatacaatagtttgtgtgagattaaagcctccaatgttgacctcaatcgaacaagatatgtagtgtttctgatccataggttaaagtttctactcgggaaacttgcctctgtgaacataaaggatcttactcatcaggagaaacttgcattttggataaacacttacaattcctgcatgctgaatgcatatttagagaatggcatacccgagagtcctgaaaggattgtagcattaatgcagaaggcaacaatagaagtggggggcctgcagctcaatgcaattacaatagagcacttcatcttgagacttccttatcacctgatgtttacctgcccaaaagctgcaaaacatgacgagatgaaattgcgaagcatatttggcttggaatggtcagagcccttggttacatttgcactttcctgtggaagctgttcttcacctgcgggaagcagcagaccacagagcaaaggtgcaaacagaacaatcagcagaggtgcaagcaggacatacaagggtgcagatcaaggaaaagcccaaaaggagagtcacaagactaaattaccttcgagactatgcttgagggcaggaagggaattgagtagcaatccttatcgtgtgatgctgttgctagagcaggggacaagcttaacggatttgattctgatatacacagcttcacaagttgacaatgagttggaagcagcaaagagggattatttacaggcagcagttggcattacaaaaacaagcaagttaataattccaaagttactagattggtatttacttgactttgcaaaggacttggaatctttgttggattggatttgcctccagctacccattgaactgagaaaggaagcaattgaatgccttgaaagaagggggagacagcccctttcgcagctggtacaaatgatgccctatgacttcagttttaggttgcttttacaccaataa

SEQ ID NO: 2130 - DNA, 639 bp, Glycine max var. Williams 82
atgtcttcagaaacaaaagcagaaacacaaactttgaccaccccctcttactcctcagatgttgacaatggtatagtgaaggatgtagtcctatggagaagaaagaaaataaatataagcgttcttgttgcggcaacagcggcatgggtgttgatggaagtgtttgaattcaacttcctcactctcatatcatgggtggccatactcggtcttgcttcaatattcctctatgccaatatgcttagacttttgggcaaggaaccaccgaacttgttggggttggaagtgagtgaaaaaacaacaacgagaatagcacacacagttcgagcatggattgaagaaggaataaggtggttgttccttgtgggcgcagagaaagagtggcccgtgtttgtgggggctgtggctggattgttatcactatcttatttaggaagttgcatggacctcctaacactagtttatatgggtacgttagtgggaatggcagttccattaacttatgtgaagaacgaggacaagattaagaggtttgtggagtggttgagggagaaacacaagagatattatcagattattgacgagaagaccattcagaagattaaaagcagaatcgtaaaggagaagaaaacagagtaa

SEQ ID NO: 2131 - DNA, 1191 bp, Glycine max var. Williams 82
tccaaacacttgaacatcatctacatttcatcacaatcttcctcaatcatgtcttcagaaacaaaagcagaaacacaaactttgaccaccccctcttactcctcagatgttgacaatggtatagtgaaggatgtagtcctatggagaagaaagaaaataaatataagcgttcttgttgcggcaacagcggcatgggtgttgatggaagtgtttgaattcaacttcctcactctcatatcatgggtggccatactcggtcttgcttcaatattcctctatgccaatatgcttagacttttgggcaaggaaccaccgaacttgttggggttggaagtgagtgaaaaaacaacaacgagaatagcacacacagttcgagcatggattgaagaaggaataaggtggttgttccttgtgggcgcagagaaagagtggcccgtgtttgtgggggctgtggctggattgttatcactatcttatttaggaagttgcatggacctcctaacactagtttatatgggtacgttagtgggaatggcagttccattaacttatgtgaagaacgaggacaagattaagaggtttgtggagtggttgagggagaaacacaagagatattatcagattattgacgagaagaccattcagaagattaaaagcagaatcgtaaaggagaagaaaacagagtaattagctttttaagagaaatgtgcacggttatgctgtattatttaatgaatattaagagtctattatttgtttcgttatatttcggtaatgttatgaatagattagtataacgtaagaattgtaacttcgccctgaaaagttaaactcttaagttaatattattattacgagtgttcatcagcaaatgtggactattacgagtgttaatcatcagcaaatgtggatccgaggctcaattgtagtgggtctgactccagatcagaagattgcgtgttagattcgcggtcgggttcaattcccaaatttttgtcttttttttcggtagagataatctaatctctaattagttagataataaattgatatatccagattcttagactcacagttttagcattccaaattccaaatgggtgtgttatggtgttgcgaatctcaaaatatcattaaaagactaagcatttgtatgagttatataccggaatataaaaatgattaagtttt

SEQ ID NO: 2132 - DNA, 1125 bp, Glycine max var. Williams 82
atggcattgaaatatcataattttttttcccttttgcttttgcttgtgaatctgagctttcatggaaatattgctgctcagaatgctaagttagcagcttctttcatctttggggactcattggttgatgcaggaaacaacaactatctttcaactttttccaaggcagacgttccccccaatggaattgatttcaaggcctctggaggaaatcccacaggacgtttcaccaatggaagaaccattagtgatattgttggagaggaattaggacaaccaagttatgctgtcccatatttggcaccaaacacaactgggaaaaccatactcaatggagtgaattatgcttcaggaggaggagggattctcaatgcaacaggaagcttatttgtgaataggctcggaatggatattcaaataaattacttcaacataacaagaaaacagattgacaagttgctaggcaaatcggaggcgagagattacataatgaagaaatccttgttctccatcattgttgggtccaatgatttcttaaacaattatcttcttccttttgtttcctctggagtgagagtttctcaaaatccggatgctttcgtcgatgacatgatcaatcatttcaggatccaactatacagactttaccaactggaagctcggaagtttgtgatcagcaacgttggcccattaggctgcataccttaccagaggattataaatgagctgaacgatgaagattgtgtggatttggctaacgagcttgcaacccaatacaattcccgattgaaagatttggttgctgagctaaatgaaaacctccctggagccacctttgtcctcgcaaatgtgtatgatttagtgtcggagctgatcgtaaattatcataaatatggattcacaacagcaagcagaggttgctgtggaattggaagtggaggtcaggttgcagggataatcccatgtgtgccaacatctagcttgtgctcagataggcacaagcacgtgttctgggatcaataccacccaagtgaggcagccaacataatacttgccaagcagcttattaatggagacaagagatacatatctccaatgaatcttagacaactcattgatctttga

SEQ ID NO: 2133 - DNA, 1617 bp, Glycine max var. Williams 82
atggatgcttttcagttcaaaactattatttcaggcattcttgccctgctagcatgcgccttgttttatcaatttaagaaaacactttgtggcaatacaaagaagatctgtagggcacctcaagcagcaggtgcatggcctatcattggccatttgcacctcttcaatgctcatcaactcacacacaaaacacttggcaaaatggctgagaaacatggtccaattttcacaataaagcttggttcatacaaagttctagtattgagtagctgggagatggccaaggagtgtttcactgcccatgacaaagcattctccaccagaccctgtgttgcagcctcaaagctaatgggctacaactatgccatgtttggtttcactccttatggctcgtactggcgccaggtgcgaaaattaaccaccatagagcttctttctaacaaccgtcttgagccactcaaggacacaagaacggttgagttagatgctgcaataagggagctttataaggtttggacaagagaaggttgtccaaagggaggggttttggtggatatgaagcagtggtttggtgatttgactcataatattgctctgagaatggtgggagggaagtcatatagtggggttggtgatgatgatcatgcagaaggtgaggcaagaaggtataggagagttatgagagactgggtgtgtttgtttggggtgtttgtgttgtctgattcatttccatttctggggtggttggatatcaatggatatgaaaaggatatgaagagaaccgccagtgaattggatgctctggttgaagggtggcttgaggaacacaaaaggaaaaggaaaaggaaaagaggtttgagtgtgaatggaaaggaagaacaggatgatttcatggatgtcatgctgaatgttctgcagggtacagagatttctggttatgattcagataccatcatcaaggctacttgcctgaatttgattttagcaggaactgaccccaccatggtcacgctaacatgggcactatctctgctacttaaccatcaaatggaacttaaaagagcccgacatgaactggacactcttattgggaaggacaggaaggtggaagaatctgacataaagaagttagtgtacctccaagctgttgtgaaggaaactctgcgcctgtatccaccaagtcccattatcacccttcgtgccgccatggaagactgcaccttttcatgtggctatcacattcctgctggcacacaattaatggtgaatgcttggaagatccacagggatggtcgtgtttggagtgaacctaatgatttcaagcctgagaggttcttgacaatccacaaagatgttgatgtaaagggtcagaactatgagctcgtcccttttagttctggaaggcgagcatgccctggggcctcgctcgctctgcgtgtggtgcacttgaccttggctagactcttacattctttcgatgttgcttctccttcaaatcaagttgttgacatgacagagagctttggactcacaaatttaaaagcaaccccgcttgaagttctcctaactccacgtctagacaccaaattttatgaggactatattatattaagctag

SEQ ID NO: 2134 - DNA, 309 bp, Glycine max var. Williams 82
atggctttcatgatttccagagctgaatcagaggcagagaagtctagccttaaacacatggaagacaaggactcgaccaacacacttgatggcgtctcaagccagctccagttgaagtcctcattgtcatccaaagcctcggcgcaaaccctgaacaaacaacaagttctcaatcgcattcgacaccgtaagtccttaaacagaatcaaaggcgcttttgagggtcttttgggcaactccaaaggtaatacaacttcagcacaagaccagatttggctccaacaagatgacgctttctcttctccttaa

SEQ ID NO: 2135 - DNA, 1146 bp, Glycine max var. Williams 82
atgccaatgctaccatcgtactgcgtgaaggagagtaaaccctgtgtgggttgggttgagaaatacttgggtgattgtctctgcaatttgaaagatgaaatttcctttggctttggcttcataagtctcatatgttggggagtagcagaaattcctcagataataaccaactttcgcgctaagtccagccatggtgtctccttagcctttctcctcacttgggtcgcgggcgacatattcaacctcgttggttgccatctggagccagccacgttgccaacccagtactacacagctctgctttacacaatcactacgatcgtgttagtacttcaaagtttctattatgattacatctataaatggggcaagcgtcatgggaagatcaacaccgatgaggcttataaagaagaagagaaaaaacctttgagaccgaaaccaggccgcgaccactctgggattccaatacaaaatgacggacccaaagaaacgcctcgacgggattactactataggtcagcgagatctttggctgctaatgatactccaccatttggtacatacttgagagctgctaaaagtgtcccttcagccattgtaatgaacgacgattcatcttctgatgatgatgaggctcatccactttcttctaagaagcctgtaacacagcctagacccatcccccgttctgtccctgccacttatggaacttttctagtagcatctatgaactttccccggcagggtaatgccttgatggagggatacaatagattcaatggaagaaaactactcttgcaagagcacaacagcatgcacactgctttgggtcaatggttaggatggctcatggctgttatctacatgggtggccggcttcctcaaatatggttgaatattaaaagagggggcgtggagggcttaaatcctcttatgttcgtctttgcattaatcgccaatgccacttacgtgggaagtattcttgtacgaactaccgaatgggaaagcatcagagctaatatgccatggctgttggatgccatagtttgcgtggcattggacctattcataattttgcagtatgccaactacagataccttgggaagaaaactggaagtgatgatgctgattatggagactactga

SEQ ID NO: 2136 - DNA, 1549 bp, Glycine max var. Williams 82
cctctctccaagtgcaaggaaaacgtaagaaatgccaatgctaccatcgtactgcgtgaaggagagtaaaccctgtgtgggttgggttgagaaatacttgggtgattgtctctgcaatttgaaagatgaaatttcctttggctttggcttcataagtctcatatgttggggagtagcagaaattcctcagataataaccaactttcgcgctaagtccagccatggtgtctccttagcctttctcctcacttgggtcgcgggcgacatattcaacctcgttggttgccatctggagccagccacgttgccaacccagtactacacagctctgctttacacaatcactacgatcgtgttagtacttcaaagtttctattatgattacatctataaatggggcaagcgtcatgggaagatcaacaccgatgaggcttataaagaagaagagaaaaaacctttgagaccgaaaccaggccgcgaccactctgggattccaatacaaaatgacggacccaaagaaacgcctcgacgggattactactataggtcagcgagatctttggctgctaatgatactccaccatttggtacatacttgagagctgctaaaagtgtcccttcagccattgtaatgaacgacgattcatcttctgatgatgatgaggctcatccactttcttctaagaagcctgtaacacagcctagacccatcccccgttctgtccctgccacttatggaacttttctagtagcatctatgaactttccccggcagggtaatgccttgatggagggatacaatagattcaatggaagaaaactactcttgcaagagcacaacagcatgcacactgctttgggtcaatggttaggatggctcatggctgttatctacatgggtggccggcttcctcaaatatggttgaatattaaaagagggggcgtggagggcttaaatcctcttatgttcgtctttgcattaatcgccaatgccacttacgtgggaagtattcttgtacgaactaccgaatgggaaagcatcagagctaatatgccatggctgttggatgccatagtttgcgtggcattggacctattcataattttgcagtatgccaactacagataccttgggaagaaaactggaagtgatgatgctgattatggagactactgagaagccagcaaaaattttgtgtcttgatttgtgggactgtaagacacatgtagagctgcccaatattgaaccacttcaattccaccatgacattcagctattagttaggaaacgcttctattagcgtgttaaaatgtgctatacgattaccagctacgagctatcaacttaatgaattatgaatcgttcacagttcttacaccagctatcaaagttatcaagtatatgaattataatcacccgttcacgattcttataccgtattccattttttgtgtcactaattaataatcgctatcaacagctagcaaagacggggttggttgaattatgaaccgttcactcacgattcattcttcatattgtatgatt

SEQ ID NO: 2137 - DNA, 1644 bp, Glycine max var. Williams 82
tattcctctgtttgcttgttatttcaatttttgttaagaggtaataaaaaaagttttccggtatactcttttgaaaggaaggcacagggaaaccttggtgagtaaaaatacagagatgccctcgattgttattatctttcattgacgttacaagcctcctgtgtttcattcaccgccgcattttgttcttgttgttgctctttcaacaggaaactcctccttcaacaggggaataagatcatgcctggcattctctcaaggctgaatgcaaccatttactgtcgcattcgggaagcaataacaaggcaacaaggagtgccgacatccttgtacagaagttcagctttgcctctttgttcgctcacttcaagtcacacacttcacacaaaatcaatgattactgcctcacattccaatgctatgctgggagatgtttatgcttatggcttaatctcaggtcgtggtagtgtgcgagacttcacaaagcctgctgtaggttgcttgaggggtagtgtgaatctaaggagactacaaccattgtatggtcctttgagttttgggtgttctacttttgatgctaataggaggatccgggattcgagtttgctgcatggatcatggctcaagaatttctcagcctcttcttctgcttgctactcagccggggctgcacatgctgtctcatttgatggaagccctcctgatgaacagcttgcaaattcctctttttcgcctgacccaactattgttggtggtaagcccttgaagatgttgtcaggatcttgttacctaccacatccagataaggaggagacaggaggagaggatgctcattttatttgcacggatgaacaagcaattggtgttgctgatggtgtaggtggctgggcggatgttggcgttaatgcaggactgtttgcacaggaacttatatccaatttagtgagagcaattcaaaaggagcctaaaggttcttttaatctgacaagagtgttaagggaagctcacgcaaatacaaaggtcaagggttcatcaacagcttgtattgttgctcttactgacaagggactacatgctattaatttgggtgacagtggattcattgtggttagagatggatgcaccattttcgagtccccttctcaacagcatgacttcaatttcccatatcagttggagagtgggaatggcgctgatctacccagctctggtgaggtttttaccatacccgttgcttcaggagatgtggtcatttctggaacagatggtttatttgacaatttgtacaacagtgagatcactggagttgttgaacatgcaattagggctggactagagccccaagtaactgctcagaagatagcagcactggctcgtcagcgagcactgtccaagagtagtcggacaccattttctactgctgctgaaaaagctggattctgttattatggtggcaaacttgatgacataactgttgttgtctcatacatatcaggttcagtgagtgagtgagtctcatttttgttctacatgtttgaactggtggaagagaatgaaatgtaacgatattatggtccattttttttggattggtataacgaagatgagatataatggaaactagtagtgaaatttattctatct

SEQ ID NO: 2138 - DNA, 1491 bp, Glycine max var. Williams 82
atgcctagcatggagataggtggcgaaaaagatcagttcaataaatatgcttgtgcatgtgctgtagtcgcttccatgatatccatcatatttggatatgataccggtgttatgagtggagccatgatattcataaaggaggagctcggaatcagcgacacccaacaagaagttcttgcaggaatcttaaacctttgtgccttggtaggatctttagctgcaggaagaacctctgattacattggtcgacgctacacaatcgccctagcctctgtccttttcatgggtggttcaattctcatgggatatggtccaaactacgcaattctaatgttgggaaggtgtgttgctggtattggcgtgggttttgctcttttgatagcaccagtttattctgctgaaatctcctcagctaaatcacgaggctttctagcttccctacccgagctttgtattggtattggaattttacttggttacgtagcgaactacttcttagggaaattgactttgaagcttgggtggagattgatgcttggtattgcagcagttccttcacttgctttggcttttggcattctggcaatgccagaatctccaaggtggttggtgatgcaaggccatttaggaaaagccaagaaagttttgttgaaagtttcaaatactgaacaagaagctgatcttcggttcaaggatataaagattgctgctgggattgacgagaattgccctgaggaaatggttaagctcccacagaagaaccatggtgaaggggtttggaaagagttaatagtgagaccctctaattctgttcggtggatgttgattgcagctgttgggattcacttttttgagcatgcaactggaattgaagctgttatgctatatagtccaagaatctttaagaaagctggagtcaccacaaaggacaagctcttgctcacaaccattggagtaggcctcacaaaaatctttttcttgataatagcctcatttttgcttgacagatttgggagaagacgcctcttgcttacaagcaccggaggaatggtttgtagccttgcagtgttaggattcagcttgaccatggtgcatacttcacaggaaaagctctcatgggccttgacccttagcatagtggctacttactcatttgttgcttcttttaatattggacttggacctgtcacatgggtgtatagctcagagattttcccttctaagttgagagcacaaggagcaagtattggagttgctgtcaacagagtcatgaatgctgctgtttccatgagtttcatttcaatctataaaacaataactataggtgggacttttttcatgtttgctgctatatctatattagcttggttgttcttctattttttcctgcctgaaaccaagggggtggccttggaagggatggagatggttttcagcaaaaattatagtaggaatgtagctgcagaaactgatcagaggcagaacgcgtaa

SEQ ID NO: 2139 - DNA, 1494 bp, Glycine max var. Williams 82
atggagatcgagcggggtaacaataatgagcacaaaggttcaagatatgccgttgcatgtgcggtagtcacttccatgatatccattatatttggttatgatactggtgttatgagtggggccctgatattcataaaggaggagctaggaatcagcgacacccaacaagaagttctagctggcatcttaaacatttgtgcattgtttggttctttagttgcaggaagaaccgctgattacattggtcgacgctacacaatcaccctagcctctattcttttcatggttggttcagttctcatgggatatggtccaaactacgcaattttaatgactggaaggtgtgttgcgggtattggtgtcggttttgctcttttgatagcaccagtttatgccgcagaaatctcctctactaaatcccgaggctttgtaacctccctacccgagctttgtattggcattggaattttacttggttacatagtaaactacttgtttgggaaactaattttgaggcttggatggagattgatgcttggtattgcagcagttccttcacttgctttggctttgggcattctggcaatgccagagtctccaaggtggttggtgatgcaaggccatttgggaaaagccaagaaagttctattacaagtttcagacacagaagaagaagctgagcttcggttgaaggatataaagagtgctgccggcattgacgagaattgcactgaggaaatagttaaacttcctcaaaaggacaatggtgaagcggtttggaaagagttgattttcaggccctcttattctgttcggtggatgctgattgctgctgtggggattcacttttttgagcatgcaactggaattgaagctgttatgttatacagtcatagaatctttaagaaagcaggtgttaccagcaaggacaagctcttgctcacaaccattggagtaggccttacaaaagtcatttgcttgataatagccactttttttattgacaaagttgggagaagacccctcttgcttgtaagcgttggaggaatggtttgtagccttggggtgttaggattcagcttgaccatggtggatacatcccacgaggaactcttgtgggcattaattcttagcattgtggccacttatatctatgttgcgtttttcaatcttgggcttggacctatcacgtgggtctatagctctgagattttccctttgaagttgagggcacaaggagcaagtataggagttgcagtcaacagactcaccaatgctgctatttccatgagttttatatcaatctataatgcaattaccataggcggggcttttttcatgtttgctggtatatctgttattgcttgggcgttcttctactttttcatgccagaaaccaaaggcgtggccttggaagagatggagatgcttttcagcaaaaacaagggaaataatgtaactactacagaaatcgacctgaggcagattctctag

SEQ ID NO: 2140 - DNA, 2975 bp, Glycine max var. Williams 82
tcctagactcgaaaactcaacaaatgcaactaataataagtagtcgcggaaacaaaaaatcacgttgacgggtctttctttctctctcgatactactattccctgttgctaagacttttttatttgtttgttttcataattgattatgcttttctcagccacgcttgctttgctttcgctgaagattatcctcacctttcttttgtttttttaatcaatctttctcgtcaagtctcagaaaagagaaaatacatgctactttttcacctccacagagattgattcagattccatataaagttttcgttttgttcatgagcttgcttatctatggcggaaacacgctgcttaatgttaaattcgtggtgattttattgctgcttattagcactctgtatctgatcggttgaagggagaagaagaaaaggactttcttctgtagaattctttctcttctaatttgtagctctgctgggacactctcctgatggtaactgatattggtgaaggggaagagttacaaaatccccgctcctttaaggtgcatagtaaaatctgcacagaactcacagaattagtggatagaatctcaagaatagttccagacatagaggcggcacggccaggatactcttcaggaatagagtctctatgtttgctgaacaatgcaattgataaagtcaaactacttctgcaacattgctccgaatgtagcaaattctacctggctatgacaggagatacagtactctcaagatgcctaaaggcaacaagatcattagagaaaagcttaatccaaattcaagatatggttcctgttatgttggctgtagaggtttctagaataattcatgatctagaatgtacaagacttgttctggaccctaatgaagaaaaggctgggagggttgtgagagagttgcttactttaacctcagattcagctgatgattctgaagttaaagctcttcagtttgcagcatctacactgaatataacatccccaaaggccatcttaatagagcaacgatctattaagaagttgttagataaacttggacccaatgacctcccaaagaagaagatactgagatatcttctgtatctactgaaaaagcatggaaagctcatggtgggggaacatgtggaggaggtctattctcgttctgaggaacaagctgcaacagagaactcgaatcacgattccctacgaagccatcatgttgattcagacacaatcttgaagtatggtcagtataaaactcacaccaatgagttaagtggagttgcaccacttgaggaatataagtgcccaatatcctcaaggttgatgtatgatcctgttatcattgattcaggagtaacatatgaaagaatgtggataaaaaagtggtttgatgagggtaatgacatatgtcccaaaaccagaaagaaactagtccatatgggattaactccaaacatggccatgaaagacttaatatcaaagtggtgcagaaataatggagtctccattccagaccctagtaggcatgcagaagatatttgtgcatgggaagcttcaaacacttccattagcagcttaggaagttatttcaatgatttcaccgcaccagtggatcttagtagcatgtcaattgggccattggatactagtttcagtttagatgcctcacatggtaagaccactcgtggctcaaatttgatgcagaccaagagccgtgacaattctcacaaacatcaggctcatacagagatacatgatactgatttgatgctcttgcctcaactctgtgatcttcaatgggattctcaatgcaaggtcattcaagatttgaaagataatttgaaaagcaatagccaagcttttgtttctgtatcagcagagaatttcatcgaaccactcgtcaggtttctgagcaatgcatatgatctgcgtgatattaaagcactgagagctggaactcagcttctgttggagtttgtgaacaactgcagaaatggtacgactaatttgaatgaagatactttcattatgttggcaagttttctcaattcagatgtgattggagaaactcttgccataatggaagaactgtcaggatatgggtttagtaaagctaaaattgcagcatccagtgctctcagttctattctaaacatgcttgattctgaaaacaaaggtttccaacagcaagctattagaataatgtacaacttgtccttcagtggtgaagtttgtccccgcatgctatctctcaggcaataacgaggaacaagaacatgcgctggctgttctagtctctctatgttctcaacatgtggattattgtaagttggtaatgcgtgaggatgagcatatcataagtcttcttatctatatctcacagaatggaaatgacagaggaaaaggaagtgcattggaattgcttcatcttttgaaagatattgacattgctgagaatgaaggttgtcctgagccaaatatcaacaactcttctcgagattctaacagttaccaccctgaagaaaatcaaccatcaaagaaatccacgtttctgaagaaactatcaccgttctcaaagtccagttcacatgcatcaaaaaccaaaagatgacaatgaatttctctgcattttgtagcacttatttgtggcatttttagctttgaagattcaatcgcaaagcatctgctacttaattttgcagagtaacaacaggtagtatgatgatgtgtatatagttgtgcttatgagttttgagattctgatttagggcctgttaaagtcgacagttttctgacttctcttttccttcctgtcaacatactagctaggtagaccaattacacatttcttgtttattcatattgtgtatatatatttaacactttgcagtatttggctactactgtaaaatagatattagtgtaataaaggtgcttgccaatatttttttaacttaatttatttatc

SEQ ID NO: 2141 - DNA, 1332 bp, Glycine max var. Williams 82
atggcggctatgcttctgctccttccgccaaacacaaagcagaccaaggctttgctggagagatgttcaaatgtaaaagaactgatgcagatttatggtcaattgttgaaaaaaggcaccatcaggaaccagttaacagtaagcacgctcttggcctcatacgcaagaatagagttgggtaacttagcctatactcctatggttttcgacagcataagctcacctaatactgtcatatggaacaccatgattagagcatatactcaaatagtaatgacccagaagcagcgctgcttttgtaccatcaaatgcttaacaactcagtacctgacaattcttacactttcccttttcttctcaaagcatgttctgctctctcagcctttgaaaaaatccacgctcacattatcaaaaggggttttggtttggaggtctatgccacaaactctctccttcgcgtttatgcaatttcaggcaacatccaatctgcacatggtcctattcaatcagcttcccacgcgagatattgtttcttggaacagaatgattgatgggacaggcatgcacaaagaagccctgtctcttctacagcaaatgctagttgcaggcatcaaacctgatagtataaccctgagttgttctctttcagcatgtgccggccttgacatgtatgttaaatgtggtgaaatggaaaaggccctactagtgttcagtaagttggagaagaaatgtgccagtgcttggacggcattaattggtggctttgcaatcaatggaaagggtagagaagctttagattggtttaccaaatgcagaaagcaggaattaagccaaactcgtcatgcaggactaactgaagaagggaagtccctgtttgagagcatgagctctgtttataatattaaaccttctatggaacattatggatgcatggtggaccttatgggcggcgcagggttgttgaaagaagcaagggagttcgtagagtccatgcccgtcaagccaaatgcagcaatatggggagcactgctcaatgcttgccaactgcacaaatattttgagcttggtaaagagactggcaaaattcagattgaattggaccctgatcatagtggtcggtatattcatttggcaagcatttatgctgctgctagagaatggaaccaagtgaccagagtgagaagccagatcaaacataggggactgctaaattatccaggatgcagtagcatcaccctgaatggggttgtccacgagttctttgctggggctggatcccacccacatatccaagagatatataacatgcctaatcttcttacaaacagatga

SEQ ID NO: 2142 - DNA, 2166 bp, Glycine max var. Williams 82
atggatcagtcaccaccttattataaccgatttcctcagactccaagctcatccaagaagggaagaagtggttatgaaccatcagacacagagacagagtggcaagagattccacggcacgaacgagaaagaagaaacttcactttagaagaaacaaaagcatttacactaatgaacaaaagccccatggcactacacaggagacacccttcaaggtttgaacatgaagtctcatcagcttcaacagcttcacgaagaagacaccatagtaaatcaccctataagctgcgcgtagcagaagaagatgttactgttgctgcatcatcatcacccataacaggtttgaatacaaagagaaatatcagtcccttgccgagacctgaccttggaagaaccgtgtctcctttcagggagcaaagaattgagaagccacactacaagagatcagtgacagctccaagattgaggattcaagagagcaacaacggagggagaaccattaatgaaatggttcataaacaaagagaagcttctcctttcgaagcgccttcggttggcataatcaacgagatgatagcacaggtgaagctatctaaagatcccactagtgattattcatcagtgctcgaaagcactgattccattcatccgggtgaccttttcttttctcgcgaatgcaacgccttgcaagcgaagaattcttcgttgccaagacgcatccagcagtgtgagtatttcagtccaagaccaccggtgaacaccaccagaatcccatctgaaagcaaaggaaataatggtgacattaacatgaaaatgaatatcttgtctcgatcaaacacgggtttaagttctgcggctacgagtagaaagggcagtgacactgggaagccaagtagtgtaacaagcgaagctagtggaaagacaactgcaagcatgaagaaattcacagccaatagaaaaaagaatcagaaagatacatggttttcttgcatgaaaacaggtaactgtagaaccacaaaaaaatcgcccgaacgtcgacctattgatgaatcttctttcatagagaaggcagttgtagtggaaagcctcccacaattctgggcagataaacaccaacctgcttcacttaatggcttcatttgcaataaacatgaagctcaacttctcaaggaattggtgtctcagggctcttgtcctcatattttgcttctaggaccctctggctccgggaaaagagaactagcaatggctattcttcgagaaatatatggggatgcatgttgtaacctgtctcatgatttaagacattttcctattcaggaccaaaggcttaagaaagtatctgttccaataacatccagttctcatcacatggagctagatgtaaattcagaaccaaatgctaaatatgctttaatgggattaatcaaagaaattagcaatatatatgcgattgcccctgaagtcagcaatattaatttcaagtcagattttaaagttatagttctttatgacgtccacaaagcagtagataacatccagcacattatcaaatggatcatagaccgctattctgatatatgcaaattagtcctctgctgtgaagatgatgcagaccttattgaacctgtgaaaaaccgattcaaagttatccaagttgatgctcctcagaatcacgaaattattgaggttcttattcagatagcaaagaatgaggaaattgatctatccgtgaattttgctgcaaaaattgctacaaaatctaagcagaacctcagaaaagcaatcatggctcttgaagcatgcaatgcacacaactatcctttttcagaagaacaaccaattccggttggatgggaggagattgtaatagaagttgctgcagagatcctagctgatccatcattttcacgcttactctcaatacgagggaaatttcaaatgcttctgttggattttgtccacccgaaattgattctccagaaactcgtggaacatctcctaaaaagaattgaggccagcttaagaagggagctttactactggcatgcttattatgacagaagactcccaccaggaataacagctttactaaagttagaagaattcgtggccaagttcatgagcatgtgcagaaaaaactctggcagtcggaaatatgtgtag

SEQ ID NO: 2143 - DNA, 477 bp, Glycine max var. Williams 82
atgatttcttccgtgtcctttccagcgtctcttcccgccgttaacttctccggcaacgccatggcttcgccgtcgtgccgcgtcaaatcccggccaatagtcgccttcgccaccgccactgccaccgctgaagctcgctcttcctggacggagcaaccgagaccttcctatctgaactcctcttgctcttcgctttacgatatcctcggcatccccgctggcgcctctaaccaagaaatcaaggccgcgtaccggcgactagccagagtctgccaccccgacgtggcggccatcgaccggaaaaattcgtccgctgacgaattcatgaagatccacgccgcgtactctactctttctgatcccgacaagcgcgctaactacgatcggagcctattccggcgacaacggccgttgtcgacggcggcggtgttctccggttacacgcgtcggaactgggaaacggatcagtgctggtag

SEQ ID NO: 2144 - DNA, 951 bp, Glycine max var. Williams 82
atggctgtcatggttgcattcttgaatttgatcatcatgttttcagtagtctctacaagcaagtcactgagcttaaactactattcaaaaacatgccctgatgtggaatgcattgttgccaaggcagtgaaggatgccactgctagggacaaaactgttccagctgcacttctgcgaatgcacttccatgactgtttcgttcgggggtgtgatgcctctgtgctgctaaattcaaaaggaagcaacaaagcagaaaaagatgggccaccaaatgtttctttgcatgcattctatgtcattgatgcagcgaagaaagcactagaagcttcatgcccaggtgtggtctcttgtgctgacatccttgctctagcagcaagggatgcagtttttctgtcaggaggacctacatgggatgttcctaaaggaagaaaggatggcagaacatctaaagccagcgaaaccagacaattaccagcgccaaccttcaacttatcacaactgcggcaaagcttttctcaaagaggactgtcaggggaagacctggtagctctgtcaggggggcacactttgggtttctctcactgctcatctttcaagaacagaatccacaacttcaatgctacacatgatgttgacccttcattaaatccatcatttgcaacaaaactgatatcaatttgtccactaaaaaatcaggcaaaaaatgcaggcacctctatggacccttcaacaacaacttttgataatacatattacaggttgatcctccaacagaaaggcttgttttcttctgatcaagttttgcttgacaacccagacactaaaaatctggttgcgaagtttgccacctcaaaaaaggctttttatgacgcttttgcaaagtccatgatcaaaatgagtagcatcaatggtggacaggaggttagaaaggactgcagagtgatcaattaa

SEQ ID NO: 2145 - DNA, 375 bp, Glycine max var. Williams 82
atggcttccgcttcctcttcctttctcacatataaaaagcattcattactgcaaaatggttggttggttttgagggtcgacggtggcactgccccacttgcttccctcgacatttcaacatggcctaacgttggcaagtataaagtcgatgttgcttccttcgagtcactagcactgctcgagttacaggttagagaagacaccgatctcttcatcattgacgaagttgttccaaagtttggcagagacataccagaagtagcaaggttgcggaatcatgcaggggcaacttgttttacattgagcgttagtaacagagatgctgttagagaaaagatacgctcacaattggaagatctgctgacaaaacactag

SEQ ID NO: 2146 - DNA, 471 bp, Glycine max var. Williams 82
atgggtgctctggatcacatctctgagctctttgactgctcccataccagctccaagctcaagaagaagcgcaaacaattccagacggtggaggtgaaagtgaagatggactgcgaagggtgtgagagaaaggtgaagaaatcggtggagggaatgaaaggggtgacagaggtggaggtggatagaaaggccagcaaggtaactgtttccggctatgtggaaccctcaaaggtggtttctcgcatcgctcaccggactggtaagagagcggagctatggccatacttgccgtacgacgtcgttgcgcacccttacgcgccaggtgtctacgacaggaaagcgccatctggctacgtgcgaaacgctgatgtagaccctcggctcaccaacctcgcacgtgccagctccactgaggtcaagtacaccaccgctttcagcgacgacaaccccgccgcatgtgtcgttatgtga

SEQ ID NO: 2147 - DNA, 852 bp, Glycine max var. Williams 82
atgtggaaagcagcactaacagaattaacagccactgcctctctaatgttcaccttgacaacttccatcattgcatgcttggactcacatgagatcgatcctaagcttcttgttccctttgcagtcttcacaatagcctttttgttcctaattgtgacggttcctctcacgggaggccacatgagtcctgttttcacattcattgctgctttaaagggtgttgtgactctcacccgtgccctcatttacgtgctagcacaatgcattggttcaataattggtttctttatactaaaatgtgtcatggacccaaaattagcttacacatattccttgggaggttgtgccatcagtggccaaggagtgatcaattcttcttctggtggtattaagccactagatgctttgttagtggaattcacttgcacatttgtggtactctttgtgggggtaacattggcatttgataagaaaaggtcaagggatttgggcttgccaatggtgtgcttggtggtggcaggagctatggcattggcggtatttgtgtccataactgtaactgggcgggccggttatgcgggtgtgggcttgaaccctgcaagatgcttaggcccagcgttgcttcatggagggttactctgggaagggcattgggttttctggcttgggcccttcttggcatgtgtagtctattatgctgtgtctattaacctaccaagggagggtttggtttgggtggatggagaatatgatgtgttgaaattggctctcggttcttgtgggaatgtctataatacttccgtttcaaaggatcatcaactagaagaaccaagtgcagggttccaagtctaa

SEQ ID NO: 2148 - DNA, 285 bp, Glycine max var. Williams 82
atgggttactattattgtaaacccaggccttgtgatactcgtactcccaatgttgttctgatcttggccgtggccttgcttcttctatgtgcaccaaagctcttctcaggtgaagcagaggaagaagaagaaacgaataacacctcaccttttgtggtgccaataatcgtagtactcatcctgcttttgttgtcctttttgggaggttcaagcagaagaagggtttgtgtcaagccaccatattgtcagtttttttcatggagaatagcacgtaagaacttatga

SEQ ID NO: 2149 - DNA, 720 bp, Glycine max var. Williams 82
atgagaggaagaaggtggtactgggaaccatttggggtgatggaaaaagtgctttggaggaagtttgggaagaggtggaagtggcttcttgtagattggaactggatgaagtggtggaaacttagggagtggaggaagaggtggaagtggcttcttgtagattggaactggatgaagtggtggcaacttagggagtggaggaagaggtggaagtggcttcttgtagattggaactggaggaagtggtggcaacttagggattggtggaagtggtttcttgaagattggtggacatggcttctttggcggtgttggaggaggctcctttggtggtgttggtggctcctttggtggttttggtggaagaggaggaggattctttggtggttttggtggaagtggaggcacaacctttggtgggcttggtggtttcttcggtggttttggtggatgaggaggctcaacctttggtggttttggtggatgtggaggcttaacctttggtgggcatggtggtttcttcggtggttttggtggatgaggaggctcaacctttggtggttttggtggatgtggaggcttaacctttggtgggcttggtggtttctgtgcgatatgtaccctgtgttcatcaattcaattttggtggaaagcaaggagagctctatcaattttagaaacaaatgtgacattctgctaattgctacgaaagtattgtag

SEQ ID NO: 2150 - DNA, 1148 bp, Glycine max var. Williams 82
tgctattaaatgagcataaatgaactcttattctttgaagagatattagaaaacttaactatccaatcacaatgcatttgtatacacatgaaattaattaaaaataaatacaatgatctgggttgtctaacttgccccgatgatgatcttcattcgagaacaacaatattgatcacactcatacttcacatcactttaaacttcttaatcatatcgctctattttagtttaaattttatttatattctcaccccaggctcatcacatgccctatccttccaaggctttattagcaacaaatagacttcctcaatatacttgatcatacggaaagcacaaaaaagaagacagaaaaaatgcatgcatattttgcagacccaacaagagtaatcatctacctctgcaatattaatatataaagcctaaggatgagaggaagaaggtggtactgggaaccatttggggtgatggaaaaagtgctttggaggaagtttgggaagaggtggaagtggcttcttgtagattggaactggatgaagtggtggaaacttagggagtggaggaagaggtggaagtggcttcttgtagattggaactggatgaagtggtggcaacttagggagtggaggaagaggtggaagtggcttcttgtagattggaactggaggaagtggtggcaacttagggattggtggaagtggtttcttgaagattggtggacatggcttctttggcggtgttggaggaggctcctttggtggtgttggtggctcctttggtggttttggtggaagaggaggaggattctttggtggttttggtggaagtggaggcacaacctttggtgggcttggtggtttcttcggtggttttggtggatgaggaggctcaacctttggtggttttggtggatgtggaggcttaacctttggtgggcatggtggtttcttcggtggttttggtggatgaggaggctcaacctttggtggttttggtggatgtggaggcttaacctttggtgggcttggtggtttctgtgcgatatgtaccctgtgttcatcaattcaattttggtggaaagcaaggagagctctatcaattttagaaacaaatgtgacattctgctaattgctacgaaagtattgtag

SEQ ID NO: 2151 - DNA, 474 bp, Glycine max var. Williams 82
atgcagattttaacgcggcgccaaggagcatttttgtgcttctggttgtctgtgctttttgtggtagtagacttttgctatggtgaccatagtacagtcgaggtagtagggttgggagaatgcgcagattgcaaggagaaaaacattcaaactagccaggctttctcaggtttacgtgtgacagtagactgcaaggcagcaagtggaaactttgaaaggagaggggtcggtgagcttgatgaatatggaaacttcaaagtttcccttcctcatgacactgtaaaagacgataaactgatagaagaatgctatgctcagctacttagtgcatcagctgcaccttgtcctacccatgatggcccattgagccacaaaatagtgataaagtcaaaaactaataatgagaaacacacccttggtcctgctgggaaactcaagttttcatcacaaacatgtgcttcagcctcttctgga

SEQ ID NO: 2152 - DNA, 622 bp, Glycine max var. Williams 82
atactcacacacacttccatagaagtttaattaacagcttctgagttctaagctaagtctgcttttattcttttctctcccgttatatatatagtatttgcttatatatatatatactactcattaggaactgtgattgcagttcctaatgcagattttaacgcggcgccaaggagcatttttgtgcttctggttgtctgtgctttttgtggtagtagacttttgctatggtgaccatagtacagtcgaggtagtagggttgggagaatgcgcagattgcaaggagaaaaacattcaaactagccaggctttctcaggtttacgtgtgacagtagactgcaaggcagcaagtggaaactttgaaaggagaggggtcggtgagcttgatgaatatggaaacttcaaagtttcccttcctcatgacactgtaaaagacgataaactgatagaagaatgctatgctcagctacttagtgcatcagctgcaccttgtcctacccatgatggcccattgagccacaaaatagtgataaagtcaaaaactaataatgagaaacacacccttggtcctgctgggaaactcaagttttcatcacaaacatgtgcttcagcctcttctgga

SEQ ID NO: 2153 - DNA, 1401 bp, Glycine max var. Williams 82
atggctctgtgttcagtttttttcaattttcttcttctgcttcttctttctttcaccaaagaagctttaggtgtttcagagcaagaagctgacagagtgcatggactacccggacagcctccggtgaagttcaaacaatattctggttatatcactgtcaatgaaacccatggaagagcactcttctattggttctttgaggccactcataaaccagaagaaaaacctcttctcttatggctcaatggaggccctggttgttcctcaattggttatggagaagcagaggagctaggacccttctttcctcaggacagcagccaaccaaagctaaagttaaatccttattcatggaataacgctgccaatcttttgtttttggaatcccctgttggggtggggttctcctacaccaacaccagcagtgatataagtgagcttggtgacaccattaccgctaaagattcacacacctttatcatcaagtggtttagaagatttccacaattcagatcacacgaattctacatttccggtgaaagctatgcagggcactatgttccgcaactttcagagctcattttcgataataatcgcaatcctgtcgagaaagactacattaacttcaaaggattcctgattggaaatgcattactggacgacgaaacagatcaaaagggtatgatagattatgcatgggatcatgctgtgatatctgatggagtataccataacattacaaccatatgcgatttcagccttccaattctaaatcaaacaaatgagtgcaatgtggaactcaataagtacttcgctgtgtataagattattgatatgtatagcttgtacactcccagatgtttcagcaacaccagcagcaccagaaaggaagcccttcaaagtttttcaaaaattgatgggtggcacagaaaatcagctggatatgatccttgtgcatccgattatactgaagcgtacctaaataggccagaagtccaaaaggcattacatgccaatgtcaccaaaattccatatccatggactcattgcagcgataatatcacattttggaatgactcaccacagtccatgcttcctgtcatcaagaagcttattgctggtggtattcgcatttgggtttacagtggagataccgatggaagaattcccgtgacttcaacaagatacactcttagaaagttggggcttgggatcgtcgaagattggactccctggtataccagcaagcaggtgggaggatggaccattgcttacgatggacttacttttgttaccataagaggtgctggtcatcaagttcctactttcacacccaagcaagctctgcagttggttcgacacttcctagcaaataagaaattaccatctcaaccaatttaa

SEQ ID NO: 2154 - DNA, 1703 bp, Glycine max var. Williams 82
cccacgtggctttggggaataacaaaatgtctgttttcataagtctcttcactatttaaacccaaagcaccccacggctggtgctgaggaagtgagtccagagacagggatcagttatggctctgtgttcagtttttttcaattttcttcttctgcttcttctttctttcaccaaagaagctttaggtgtttcagagcaagaagctgacagagtgcatggactacccggacagcctccggtgaagttcaaacaatattctggttatatcactgtcaatgaaacccatggaagagcactcttctattggttctttgaggccactcataaaccagaagaaaaacctcttctcttatggctcaatggaggccctggttgttcctcaattggttatggagaagcagaggagctaggacccttctttcctcaggacagcagccaaccaaagctaaagttaaatccttattcatggaataacgctgccaatcttttgtttttggaatcccctgttggggtggggttctcctacaccaacaccagcagtgatataagtgagcttggtgacaccattaccgctaaagattcacacacctttatcatcaagtggtttagaagatttccacaattcagatcacacgaattctacatttccggtgaaagctatgcagggcactatgttccgcaactttcagagctcattttcgataataatcgcaatcctgtcgagaaagactacattaacttcaaaggattcctgattggaaatgcattactggacgacgaaacagatcaaaagggtatgatagattatgcatgggatcatgctgtgatatctgatggagtataccataacattacaaccatatgcgatttcagccttccaattctaaatcaaacaaatgagtgcaatgtggaactcaataagtacttcgctgtgtataagattattgatatgtatagcttgtacactcccagatgtttcagcaacaccagcagcaccagaaaggaagcccttcaaagtttttcaaaaattgatgggtggcacagaaaatcagctggatatgatccttgtgcatccgattatactgaagcgtacctaaataggccagaagtccaaaaggcattacatgccaatgtcaccaaaattccatatccatggactcattgcagcgataatatcacattttggaatgactcaccacagtccatgcttcctgtcatcaagaagcttattgctggtggtattcgcatttgggtttacagtggagataccgatggaagaattcccgtgacttcaacaagatacactcttagaaagttggggcttgggatcgtcgaagattggactccctggtataccagcaagcaggtgggaggatggaccattgcttacgatggacttacttttgttaccataagaggtgctggtcatcaagttcctactttcacacccaagcaagctctgcagttggttcgacacttcctagcaaataagaaattaccatctcaaccaatttaatcacttttcttttaatttatcattttgaagtttgtttctgattaagaatggatatttcttgtttctgggtttcaaaaagcccacttgtgttctatttttaattttcaattatttcataagactcttctgaagtatgaattgcatcatatccatatataaaatttaatgtctacctattagcagtat

SEQ ID NO: 2155 - DNA, 2856 bp, Glycine max var. Williams 82
atgatgatcgatcagtctctcacccaagttgttggaggcatcaaagaactcgcccaacttcttgaaaccgatttgaagcatggcatcggcgacaacaacaaggatgacattgatcaccgaaaacgtgtcttcggtgtcaacatgctcacgaagcctccttccaaatgctttctttcttttgtccttgaatcttttaacgacaccaccatcatcattctcttggtttgttctttactttctcttttctttgggatcaagcaacatggttggaaggagggatggtacgatggaggtagcatcatattagcggttattcttgtcattgctgtctcttctgtcagcaactttaaccaatctaaacagttccagaagctttctgcgaaaagtaacaacatgggaggagtggaagtagtacgaggtggtcggcgacaaagcatatcaacctttgacgtggtcgtgggtgacatcgtgtgcttgaaggtcggtgatcaggttccagcagatggggtttttttggagggacattcgttgaaggtggatgaatctagaatgacgggggagagtgaccacgtgcatgtgcatgcgaatggtgaaattgaaaaaaacccttttttattattatctgcaggcacaaaggtcaccgatggatttgcacgcatgcttgttacttctgtgggaatgaatactgcatggggtaccatgatgggtttcataaccaataaagaggttaataatgaggagacacctttgcaagtgcgtctcaataagttgacttctgctattggaaaggttgggttgttggtggctgcacttgtcttggtggtgtctatggcacgttacttcgcgggttgcacgagagatgactttgggaaccgtgaatttgttcggggaaggaccgagtctgatgatgttgtgaatgcggttgtggcgattgttgccgcggcggtgacaattgtggtggtggcgatccctgaagggttgccgcttgctgttactctgagtctggctttttccatgaagaagatgatgagggacaatgccatggttaggagaatctctgcctgtgagacgatgggatcagcaacaacaatctgcactgataaaacaggtacacttacgttgaatgagatgaaggtgacagaggtgtgggtggggaaaaggaaaataaaagcggatcaggaagaagatttggcaccgagtttagtccaattgctgaaagaaggaataggattgaataccactggaagcgtttattttcatccccaccaaacttcttcatcattgcctgaaatttcaggtagccctactgaaaaagcgttgctttcctgggctgtggaggatttggggatgggcgacatcgatgaagtgaagcagcattgtgagataattcatgtggagacattcaactctgagaaaaagagaagtgggattctgatgagggagaagagaggaagaagcaacagcagcaacaacagggtccatacacactggaagggtgctgctgagatgatattgcgcatgtgctcaacttactacgaccatacagggcaaatcataatcattgatgatgaagagagggctcaaatagagaacattgtcgagtgcatggcaacgaaaagtttgagatgcattgcctttgcccaaaagagcttattatgcgaaaaacttgaacttgaagagacagaactcacactgttggggatacttgggttgaaagacccttgtaggccaggagttggagcagcagttgaatcgtgcaagaatgctggagtgaagattaagatgattacaggagataatgcgcacacagcaagggccatagcctctgaatgtgggattcttgatgatgaattggatgatgatcaagcagcagtggttgaaggctttcaattcagaaatttctcacatgaggaaagaatggataagattgatagaatcaaagtcatggccagatcatctccatctgacaagcttctgatggttcaatgtttgaagcagaagggtcatgtggtggcagtcacaggtgatggcacaaatgacgcacctgctctgaaggaagctgatattggactttccatgggaatacaaggcactgacgtggcaaaggagagctcagacattgttatccttgatgacaatttctcttctgtggtcactgtattggagcgggggagatgtgtgtacgcaaacattcaaaagttcattcagtttcagctcacagtcaatgttgctgcacttgccatcaactttgtagctgcagtttcttctggtaaagtgtctctttcagctgtccagcttctgtgggtaaacctggtaatggatactcttggagctttggccttggccactgagcaaccaactaatgatctcatgaatatgccacctgtgggaagagttgacccacttataactagagttatgtggaggaacctcatttcacaagcagtgtatcaagtgcttgtcttgctcactttacaattcgagggaagatcatcaatctttggtggtgtcaatgagaaggtgaagaacactatgattttcaatgcttttgtcctctgccaagtcttcaatgagttcaacgcaaggaagctggagacgaagaacatatttgaagggcttggtaaaaataagttgttcatggtaattgtgggcctaactgtagttcttcagctagtgatggttgagtttctcaacaagtttgccaatactgagagattgacttgggagcaatggtgtgtgtgtgttgccattggagttttgtcttggccaattggtctgctggtgaagtgtctcccagttcgcaacaagtgtctcccaattgttactgacttaaggtcaatagcaagaagaaaatga

SEQ ID NO: 2156 - DNA, 3259 bp, Glycine max var. Williams 82
ggcgaatgcatggctttgacagccatcttcttcacattataatgaacaccccaattagccctatttcaactcaacgttattcttagcgaaatgatgatcgatcagtctctcacccaagttgttggaggcatcaaagaactcgcccaacttcttgaaaccgatttgaagcatggcatcggcgacaacaacaaggatgacattgatcaccgaaaacgtgtcttcggtgtcaacatgctcacgaagcctccttccaaatgctttctttcttttgtccttgaatcttttaacgacaccaccatcatcattctcttggtttgttctttactttctcttttctttgggatcaagcaacatggttggaaggagggatggtacgatggaggtagcatcatattagcggttattcttgtcattgctgtctcttctgtcagcaactttaaccaatctaaacagttccagaagctttctgcgaaaagtaacaacatgggaggagtggaagtagtacgaggtggtcggcgacaaagcatatcaacctttgacgtggtcgtgggtgacatcgtgtgcttgaaggtcggtgatcaggttccagcagatggggtttttttggagggacattcgttgaaggtggatgaatctagaatgacgggggagagtgaccacgtgcatgtgcatgcgaatggtgaaattgaaaaaaacccttttttattattatctgcaggcacaaaggtcaccgatggatttgcacgcatgcttgttacttctgtgggaatgaatactgcatggggtaccatgatgggtttcataaccaataaagaggttaataatgaggagacacctttgcaagtgcgtctcaataagttgacttctgctattggaaaggttgggttgttggtggctgcacttgtcttggtggtgtctatggcacgttacttcgcgggttgcacgagagatgactttgggaaccgtgaatttgttcggggaaggaccgagtctgatgatgttgtgaatgcggttgtggcgattgttgccgcggcggtgacaattgtggtggtggcgatccctgaagggttgccgcttgctgttactctgagtctggctttttccatgaagaagatgatgagggacaatgccatggttaggagaatctctgcctgtgagacgatgggatcagcaacaacaatctgcactgataaaacaggtacacttacgttgaatgagatgaaggtgacagaggtgtgggtggggaaaaggaaaataaaagcggatcaggaagaagatttggcaccgagtttagtccaattgctgaaagaaggaataggattgaataccactggaagcgtttattttcatccccaccaaacttcttcatcattgcctgaaatttcaggtagccctactgaaaaagcgttgctttcctgggctgtggaggatttggggatgggcgacatcgatgaagtgaagcagcattgtgagataattcatgtggagacattcaactctgagaaaaagagaagtgggattctgatgagggagaagagaggaagaagcaacagcagcaacaacagggtccatacacactggaagggtgctgctgagatgatattgcgcatgtgctcaacttactacgaccatacagggcaaatcataatcattgatgatgaagagagggctcaaatagagaacattgtcgagtgcatggcaacgaaaagtttgagatgcattgcctttgcccaaaagagcttattatgcgaaaaacttgaacttgaagagacagaactcacactgttggggatacttgggttgaaagacccttgtaggccaggagttggagcagcagttgaatcgtgcaagaatgctggagtgaagattaagatgattacaggagataatgcgcacacagcaagggccatagcctctgaatgtgggattcttgatgatgaattggatgatgatcaagcagcagtggttgaaggctttcaattcagaaatttctcacatgaggaaagaatggataagattgatagaatcaaagtcatggccagatcatctccatctgacaagcttctgatggttcaatgtttgaagcagaagggtcatgtggtggcagtcacaggtgatggcacaaatgacgcacctgctctgaaggaagctgatattggactttccatgggaatacaaggcactgacgtggcaaaggagagctcagacattgttatccttgatgacaatttctcttctgtggtcactgtattggagcgggggagatgtgtgtacgcaaacattcaaaagttcattcagtttcagctcacagtcaatgttgctgcacttgccatcaactttgtagctgcagtttcttctggtaaagtgtctctttcagctgtccagcttctgtgggtaaacctggtaatggatactcttggagctttggccttggccactgagcaaccaactaatgatctcatgaatatgccacctgtgggaagagttgacccacttataactagagttatgtggaggaacctcatttcacaagcagtgtatcaagtgcttgtcttgctcactttacaattcgagggaagatcatcaatctttggtggtgtcaatgagaaggtgaagaacactatgattttcaatgcttttgtcctctgccaagtcttcaatgagttcaacgcaaggaagctggagacgaagaacatatttgaagggcttggtaaaaataagttgttcatggtaattgtgggcctaactgtagttcttcagctagtgatggttgagtttctcaacaagtttgccaatactgagagattgacttgggagcaatggtgtgtgtgtgttgccattggagttttgtcttggccaattggtctgctggtgaagtgtctcccagttcgcaacaagtgtctcccaattgttactgacttaaggtcaatagcaagaagaaaatgagcctgaatgcttccacctgaagaatcatcttgtaaaatgagctcttatccatatctccaacaagtgcaaaaaaatttaaaataatagcaaaagccattcgatgataaaaaaaaaaccattgggatttttcatggaaggctaaccatatttatctatactcggttgcacaatcatttagcttatccatttgtcttgttctattttggacaacttctattaattggattggaatttggaatcttgtttgtggaattaaattccacttgtttactttgctactagttggacaattatgaacgtaatttttcttcac

SEQ ID NO: 2157 - DNA, 939 bp, Glycine max var. Williams 82
atgaacaagaaagagattgaaaagtggattggaggagatgagagtgcctcggagatgctgagtagagtgagcagcatgcgacctttcttgtttcctccgccgctccacagggttcctctccgcgtcggaaacgtcgtcgagcttgtggggccctctccttccgccaaaacgcacattctcatccacgccgccatcacttccgttctccccaaatgctacggaggcctcgaccacttggtcctctttctcgacctcgattgtcgcttcgacattgcgcgcttctcccaattgctcattcatcgcattacccaacacggaacggattcttatgataaaacgctgtatgctctctgtatggcccgttttttgtacgtccgttgttacgacagctttgaatttcttcacactctcaggacattgcattgtcgcttagagaaggagaaagaagttcacggagttggtgtccacctcctcatgattgacagcatcggagcttttcattggatggatcgtgcatcgatgttcttgtctcaaagagaaaacagcaaaaaaaaacttttccttcagaccatgtcagaagctgtagttcagaatattagaaaacttcttcaggtgcaccctatgcttattatagccacaaagtcagtggtttttgggaatagatattctacagcttcaaatgatgtcaaagtgaatatggaggaaggatgttcaaaaaatgtggcaagaaaccatcaaaatttccagtatcgtgaatacatgccttctgtctggcagtcctttgttacacacagaatacttgtacgatcttcagatgagcatcctgttacaaccaattatcaaaactcttcattctatttgttggaatggttattgccaagattgagttttccggataagattgtagtgaaagatgctggtgtctttgttgattcatga

SEQ ID NO: 2158 - DNA, 306 bp, Glycine max var. Williams 82
atggcttccctttatgatgtgcttggtatttcagtgggtgcaagctgcatcgaaataaaggctgcttacagaaagctggcaagaacataccatcctgatgttgtggccatgaatcagaaggaaagctcagcgaaccaatttatgatgatccattcagcttactcaactttatctgacccagagaagcgagctcaatatgacagagaaatctatagatacagaagatcagcaaatatggaagcaagaaatcagacattttcctatgctggaagtgcaaggaaatgggaaacagaccaatgttggtag

SEQ ID NO: 2159 - DNA, 1617 bp, Glycine max var. Williams 82
atgggtaccactaccacctttccgccttcagccgtttcaaccaccagcaaatggctgggcttcgtggcggccgtgtggattcaatgcatctccggcaacaactacactttctcaaactactccgacgccctcaaatccctcatgcacctcactcagctccaactcaacaacctctccgtcgctaaagacgttggcaaagcctttgggcttctcgcgggcctggcctccgaccgcttccccacttgggccattctcctcataggctccgtcgaaggcctaattggctacggaacccaatggctcgttgttagccaaagaattcaacccctcccctactggcagatgtgtgtgtttctgtgcatgggagggaacagcacgacgtggatgaacactgccgttttggtaacatccattcggaacttccgttcaaacagaggacccgtttcgggcattctgaaaggctttgtagggttgagcactgcgatattcactactctctgttccgctctcttcgccgacgatcctggctccttcctcatcatgctctctgtcattcccttcgcagtttgcctcaccggtgtgtttttcctccgggagattcttcccgtcgcctccgccgacgccgacgccgaggaggtaaagtatttcggcgtcttcaacgtcgtggcggtggcaatggcgctttttctgttggcgtatgggttcatccccagccccagcatgttggtgtcaagagtgttcgtggcggttttggttgttatgctggtttcgccgttggggatcccggtgtactcgtacttgaagggtagcttcggagaggggaatgacgtggaggggcagagggtgaaggagccgttgcttcagattccggagaaggagaacgaagctgtggcggcggagatagtgaagagggtgccggtggtgggtgaggagcacacgataatggaggcgctgagaagcgtggatttttggatcttgttcgtgtcgtttctgtgtggggttggaacgggtttggcagtgatgaacaatatgggtcaaatcgggttggctctcggatacccagatgtctcgctctttgtgtcgcttacaagtattttcgggttttttggacggatcatctcgggtactgtttcggagttcaccatcaagaaagctggaacacctagacctctttggaatgcagcatctcagcttctaatggctgtaggttacatactcctggccatggctatgccaggttccctatacattgggtctattttagttggcatgtgctatggagtgaggcttgccattacagtcccaacagcctcagagttatttggactcaaatattatggtctcatatacaacattctcatccttaaccttcccttgggttctttccttttctctggtctgcttgctggcatactctatgatatggaggcaactacaacagagggaggaggcaacacgtgtgttggaggtcattgttacaggctagtctttgttgtcatgactggagcatgcattgttggcttcttcttagacattctgttgtcaatcagaaccaagaatatttacaccaagatttccatgagcaagaaatccctagcaacatccaataggcagtga

SEQ ID NO: 2160 - DNA, 1542 bp, Glycine max var. Williams 82
atgttgccaagaagtagaacccttcctagcagaatccaccaaggaattatagaagagaggcataatgtcaggcactacttacaagttgaagtgcgacccaataatacccaaacggagaccgaagcgatgaatatccagtctaactattccaagtgcttcgatgatgatggtcgcttgaagagaacaggaacattttggatggcaactgctcatatcatcactgctgtgataggctcaggagtcctttcactagcatgggcggttgctcagcttggttgggttgctggacctattgtcatgtttctctttgccgtcgtcaatctctacacttccaacctattaacacagtgttacaggaccggtgactccgttactggacacagaaattacacctacatggaggcagtcaactccatcttgggaggaaaaaaggtcaagttatgtggcctcatccaatatatcaatctgtttggagttgcaattggatacaccattgctgcctctgtcagtatgatggccataaaaaggtcgaattgttatcacagcagtcatggaaaagatccctgccacatgtcaagcaatgggtatatgataacattcggaatagcagaagtgatattttcccaaatcccagactttgatcaggtgtggtggctatccatagttgcagctatcatgtccttcacttattcttcagttggattgagtcttggcgtggccaaagtagcagaaaataaaagtttcaaaggaagcctgatgggaattagcattggcacagtaacacaagccggaacagtcactagcacacagaaaatatggaggagtttacaagctctcggggcaatggcctttgcatactccttttccattatcctcatcgaaattcaggacaccataaaatctcctcctgcagagcacaagaccatgagaaaggccacaactttgagcatcgcagttactacagtgttctatttactctgtggatgcatgggttatgcagccttcggagataatgcacctggaaacctcttgactggttttgggttctataacccttactggcttctggacattgccaaccttgcaattgttatccacctagttggggcataccaggttttttcccagcccttatttgcatttgtggaaaaatggagtgcacgtaaatggccaaagagcaattttgtcaccgcagaatatgatatacccattccctgctttggtgtgtaccaactcaacttcttccgcttagtatggaggaccatttttgtgctgttgacgaccctcatagccatgctcatgccttttttcaacgatgtggttggaatacttggcgcttttgggttctggcccttgacagtttatttccctattgacatgtatatttcgcaaaagaagattggacgatggaccagtcgctggcttggacttcagttacttagtgccagttgcctcatcatttcattgttagctgcagttggttccatggcaggggtggttttggacctcaagacttacaagccatttaaaactagttattaa

SEQ ID NO: 2161 - DNA, 1200 bp, Glycine max var. Williams 82
atggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaagaccgcgaaaacagtggcttcaccagggaggggtattttggccatggatgagtccaatgctacctgtgggaagcgtttggcttcaattgggctagagaacactgaagctaaccgccaggcgtaccgtaccctccttgtgacagttccaggacttggtcagtacatctctggtgccattctctttgaggaaactctctaccaatccacaactgatggcaggaagattgttgacgtgctcctcgagcaaaacattgttcccggtattaaagtcgacaagggtttggtaccccttgctggttccaacgatgagtcatggtgccaaggtcttgatggtcttgcctctcgctcggctgcatactaccagcaaggtgcccgtttcgccaaatggcgtactgttgtgagcatccccaacggtccctctgctctggcagttaaggaagcagcctggggtctggctcgctatgccgcaattgctcaggacaatggattggtcccaattgtggagccagagatcttgcttgatggggagcatggtattgacagaacttttgaagtagcaaaaaaggtctgggcagaggttttcttctaccttgctgagaacaatgtcctttttgagggtattcttcttaagcctagcatggttacacctggagctgagtccaaggacaaggccagtcctcagacagttgctgattacaccctcaagctccttcacaggagaattccccctgctgtccctggaattatgtttttgtctggtggacagtctgaggttgaagctaccctcaacttgaatgccatgaaccaatctccaaacccgtggcacgtgtcgttctcgtatgccagagccctccaaaacactgccttgaagacatggggaggccgcccagagaatgtgaaggcggcacaagatgcacttcttttccgtgccaagtccaactcgctcgcccagcttgggaagtacaccggtgagggtgaatctgaggaagccaagaaggagttgttcgtcaaaggctactcctactaa

SEQ ID NO: 2162 - DNA, 657 bp, Glycine max var. Williams 82
atggactcgttcagtttcaacaacctacaagcagagaaagccaacgtgatcctaaagcatcgcaagcttcaaagggtcgcaagcttgtttagaatcattgaagtgtgtatcattttggtcttgatttcaagattctccatgcagctaccagtagcagtaaaaaactccagcgtgtacttaagggacttgtcactcttcatgaacagccctcgttttgttttcctcgttggaaacgtcataatcatcgcactcttcgctcagttctccactcagggtaataacgctccagagcctgatctttaccaagagttcgttcaaaacaccacaaaaaatcacagacacacagaaacagttgtggcagaatatagcaaaaagaaacagaggatgaaaacaggggaagtgaatattggtctgaagaaggattatagaagatgtgaaacagagattttaagcgaaaaaccacatcgtgtgttacgcaggtgtgagactgagaatggaaggaagagcatcgaacctgctactattcaagaagtggcgcaaatttcgtgccctgaagatgggatgagtaacgaagagtttcgtcaaactgtggaggctttcattgctaggcaacagaggatgcgaagagaagaagaggaagattattatttaatgtga

SEQ ID NO: 2163 - DNA, 1884 bp, Glycine max var. Williams 82
atgcatgaaataaagtggcgcgattctggttccaagcaattcaagttcatggacccaacagtttcaatttcaagtcacaagcgctccaacagtgacccaatgaagaggagagtcatgggagatggattagggagcatcagtgaagcttcttgtcagcctgaagtggatccgggggaactaaagcaaaacattgaatccaagaagaggcaataccataatatggatcttcaaagttctttgactcaagagattcttcagcttcaaaaacgactacagcaacaattcgtgatacggcgcgcattagagaaagcatgttatgtgcctttttcacaggatgctacaatagaaaattcaatacccaaggctgcaaaggaactgattaaggaaattggaatattagaattagaagttgtgcatttggaacaatacctactttctttgtatcggaaaagatttgatcaacaaatttcaactctatcaaccaaggaaagaagattggaattagcttcagacactaatcaaggaacatccgcagtgcctggaaatgatgctatctctgacaaagaaatttcagttgtgcactgtagtaatgtcatttcacccagaaattcatctgggtttaagcttaaggaatgcaataaccagttgggagcagaaactggtttagactctagtattcatcgatgtcactccacactatctcaacgaacaacatgctcaattgaagcttctcctgggaacattgagaccaaagctgttgttgactcttaccattctctaccattatccatgttggagcaagctcagtatgctaaatcaagttcaaccagcctggcagagcatcttgggagtagctatgttgctaatgttccagaaacaccaaattggctttctgaggagatgattaggtgcatatcggctatatattgtgaacttacagagccaccttctcttggtcataaaaatgctccatcacctatttcattctcatcttctggtaacgagttatctacacagagccagtgtactaagaagggatcacattggaaggagcattcatccttcaatttaaactccactaaccctttccacgtcagagggtccaaagaatttagtggaccttattgctctatgataaggatacagcaattatgcacagatagtcagaaattaaaagaaattgagtacatgctacgaaggtttaggtcacttgtttctcggctggaagatgttaatcctagaaatatgaagcatgaagaaaaacttgccttttggattaatgtgcacaattccttagcaatgcatgccttattagtttatggagtttcagccaaccatgttaaaagaatgtcttcggtactgaaggccgcatataacattgggggacatactctaagcgtagacctgatacagaacttcattctgggatgcagattgcctcgcccaggacaatggctgaggttgtggtttccttcaatgacaaaaccaaaggttagagatgcaagaaaaggatatgctatacatcgtccagaacctttattactctttgctctatgctcaggaagccattctgatcctgcggtacgtttgtacacatccaagagagtctttgaggagttactatgtgccaaagaggaatacattcagtccaccatcaccataagcaaggaacagaaactagttctcccaaagatggttgattcctttgcaaaaaattcaggtctaggagcatctgatttggtggagatggttaagccttatctacccgattctcaaatgaagagcattcaagagtttcaatcaaagacaagctggaaaagcattgaattaacccatcataacttcactttccattacttgatttcaaaggaattagcttggtaa

SEQ ID NO: 2164 - DNA, 330 bp, Glycine max var. Williams 82
atggtagtggagttgtatcttatcctccaaactctaacgcggatttccaattacagtgcaatcagttttgaagaaaacaacacatccctcaactttttacttgtgtggggggttactttaatctctagtgaagtgctgtccccattttcatcttctttcatgatgttggtcatagtaggtcttcttttccgtttgtggaaacacatgcatcatgcacttagtcaattgcttggtctaatctatactccctccaaactcttttataagaaacaaaagagatttccccatgtattaagaaagttaagtttccattgtatcattttcaattaa

SEQ ID NO: 2165 - DNA, 729 bp, Glycine max var. Williams 82
atgcaaaaactatattttgatgatggatggaatgctttccatgaagaaaactgcttaggacatgcagactttcttgtcttcaagcatgaccgtagtaatgagttcaaggtagtaatccttgaatcatcaacacagtgtcaaaagcctgtggtaaagatggaggaggagaatgaacaagagcaagcagcagcacaacatgttgaggactgtgacatagaggaggaggaagacagttcttccaaggatgagaactatgatggcagtgattctgatgatgatgaagagagtgaagaagaattcagtgctggattcaagcgtcaaagtcatcatagaagagcttgcaaaagggagtctgcatcaaattccaaccccaatgctgaagatcttcttccagaatatgtatttgatccagaaatgtgtattcagccggagaatcatttttttaaagcaaaactctacaaaactagacccaacgaattggatatttcaataaatttattgggagactgtcatcataacttggcacaacagacattcatcaaaaccaagtatcagcaagtgtcaggaagagtgtgtaggtggaaagattatagaatatatatcaagggttgggatagcttttgcagaaggaatgagatcgaaagagatgatacttgcttctgtgaagttatatcaggggaagagcaaggagtaagaacactaagggtgcatgttgctaggaggagatga

SEQ ID NO: 2166 - DNA, 810 bp, Glycine max var. Williams 82
atgttccaaactaaaatggcaactaactctctccattactccatccaacaccaccaccattccctcaccaaacgccatcacccttcagacaccccaccccacacatcacttttcctcaaacaccctacaccccctatacaccccaacatcactatctcccacactccttcaaactcacacatcacttactccctctctcaaaccacctcttcctccaccacctccccaaccaccccttcctttgacctcctccgccaccacctctccaacaaaaacttcgaattggccgatgaggagacgcgccgtctccttatcgtcctagctggcgaagccgcgcagaagcgtggctacgtctttttctcggaggtgaagttcatctctgagggtggcctgcgggccatagactccctctggagggagtacagtggcgggaaattcgggtacagcgtgcagaagaagctactggagaaggccaatggggacttcaccaagttcttcatcaaggttgggtggatgaagaagcttgacactgagatggagcaatacaactacaggtccttccccactgagttcatctgggagctcaatgatgacaccccagaggggcatttgcctctcacaaacgctctcagagggacacagttgctcaacaacgttctcaaacacccagcttttgatgtagttgatgacaaagaagaaaaagaaaaagatggtgagaacaaggaaaatggaggagcaatctctgccacaggattaaaggataatggttcttcttcaaagaggatcttcaaaacggactatagcttctga

SEQ ID NO: 2167 - DNA, 1554 bp, Glycine max var. Williams 82
atggcatatatacctctcattgttctagttacctcattgattactatcacacaaggcgttattacccctaatcctgaaacagcttctctgaatcggaatagtttcccaacaggcttcatctttggtacagcatcctcggcatatcagtacgaaggtggagcaaatgagggtggtagaggaccaagcatttgggataccttcacccataaatatccagaaaagataaaagacagagacagtggtgatgtagccgttgattcatatcatcgctacaaggaagatgttgggattatgaaggatatgaatttggatgcttacagattttctatttcttggtctagaatactccctgaaggaaagttaagtggaggtataaatcaagaaggaatcgattattacaacaaccttatcaatgagctactagcaaatggtttgaaaccatttgtgactctttttcattgggatcttccccaatctttagaagatgagtatggtggctttttaagccctcgcattgtgaaagattttcaagactatgcagacctttgcttcaaggaatttggagatagagtaaaacattggataactttgaatgaaccatggagttatagccaacatggttatgcaacaggggaaatggcaccaggtcgatgttctgcttgggcgaatcctaattgcaatggtggtgattccgcaagtgaaccttatttggtctcacatcaccaacttcttgctcatgcggcaagtgttcatgtgtacaagaccaagtatcagacatttcaaaatggtttgataggcataaccttgaatgttaattggtacgtgccgttctcggataacaaacttgatcacaaggctactgaacgagctattgacttccagtatggatggtttatggatccactaacaacgggagattatccaaaaagcatgcgattcttagtgagaacacgtttaccaaagtttacaaaggaacaatccaaattacttattgattcttttgattttattggcataaactactattccacttcttatgcctccgatgcacctcaactaaaaagcaatgccaaaatcagctacctaacagattcccttgctaatttttcatttgtgcgtgatggaaaacccattggtttaaatgttgcttcaaattggttgtacgtttatccaagaggatttcgagaccttttgttatacactaaagagaaatacaacaaccctttaatttatattacagaaaatggtataaatgagtatgatgattcatcattatcacttgaggaatctcttcttgatatttatagagttgactatcattatcgtcatctattttatcttcgagaatcaattaagaatggtgtgaatgtaaaaggatattttgcatggtctttgctcgacaattttgaatggcacttaggttacactgtacgatttggaatgaattttgtagattacaaaaatggcttggaaagatacccaaaactttcagcattatggttcaaggattttctcaaaattgaaatcaaacttcatgaagattccatgcaataa

SEQ ID NO: 2168 - DNA, 1572 bp, Glycine max var. Williams 82
atggcatttaaaggctatttccttatcggcctcattgctattgttgttgtcacttccaaagttacatgcgaattagaagcagaaacagtttcacctattattgacatttcactcaatcggaacagtttccctgaaggcttcatctttggggcaggatcttcctcgtaccagttcgaaggtgcagcaatggaaggtggtagagaaccaagtgtatgggataccttcacccataattatccagctaagatcaaggatagaagcaacggagacgtggcaattgactcatatcaccactacaaggaagatgttggcatgatgaaggatatgaatttggattcatatagattttccatttcttggtcaaggattctcccaaaaggaaagctaagtggaggtataaatcaagaaggaatcaactattacaacaaccttatcaatgagctactagctaatggtatacaaccactcgtcactctttttcattgggatcttcctcaagcattagaagacgagtacggcggcttcttaagtccacttatagtgaaagattttcgggactatgcggaaatttgcttcaaggaatttggtgatagggtgaagtattgggttactttgaacgagccatggagttacagtcagcatggttatgcaaatggaggaatggcaccaggtcgttgttctgcttggttaaattcaaattgcactggaggtgattctgcaacagagccttatttggttacacatcaccaacttcttgctcatgcagcagttgttcgtgtgtacaagaccaagtatcaggtgtctcaaaagggttcaataggcataactttggtagctaattggtttataccgctcagagataccaaatctgatcaaaaggctgctgaaagagcaattgacttcatgtatggatggtttatggatccattaacaaccggagactatccaaaaagcatgcgatctcttgtgagaacaagattgccaaagtttactacagagcaatccaaactacttattggttcatttgattttattggcctaaattattactctacaacatatgcctctgatgcacctcagctaagcaatgctagacctaattacataacagattctcttgtcagtccagcatttgaacgcgatggaaaacctatcggtataaagattgcttctgaatggatatatgtttatcctagaggaattcgtgaccttttattatataccaaggaaaagtacaataatcctttgatttacatcactgaaaatggtataaatgagtatgatgaaccaacacaatcacttgaggaatctcttatggatatttatagaattgattatcattatcgtcatcttttttatcttctatctgctattaggaatggctcaaatgtaaagggatattatgtatggtctttgttcgacaattttgaatggtcttccggttttacatcaagatttggaatgatttatgtagattacaaaaatgatttgaagagatacaagaaattctctgcattatggtttgagaattttctgaagaaagaaaccaaactatatggttctagcaaatag

SEQ ID NO: 2169 - DNA, 2721 bp, Glycine max var. Williams 82
atgataaagcctcaagtgtatcaatcacagaacaccaatcaaaccctcttgtttctgcagaggctatccgttcacagcagtactgcatctcttccactatggttggggagtaaagtgcagaggcaaaaaaagcttaaccacctcgttctggtttcacgcaacgttgaaactaattccactacaacagatactcatacagataagagtacagtgattaaggttaaggccatagttaaggtgaaagtaaccgtgggtggtttcttctcaagtctgaggttagaccgaggaatcgatgatataacagatttgcttggtaaatctctcctcttagagcttgttagctctgagcttgatcctgtgacggggctagagaaggaaacactgaaagcatatgcacacaaagcaggaaatggcgaggagtcggttaagtacgaagctaaatttgaagttccaaatgattttggggagattggtgctgttcttgttgagaatgagcatcacaaggagatgttccttgaaacaatccacctcgatggcttccctgagggtcctattaattttcattgtgcctcttgggttcactccaagttcgataatcctaccaaaagggttttcttctccgacaagtgttacttaccgcgagagacaccgagtggtttaagaagactacgtgaagaagaattgagtcatctgagagggaatggagaaggagaacggaagagctttgaaagaatatacgattatgatatatacaatgacattggagatcctgataaaagccttgaacttcaaagacctcctttaggaggtaaagagcgaccttatcctagacgttgtcgaactggtcgtccacatagtgaagcagatccattgtcagagaaaagaagtagaaatttttacgttccaagggacgagtgcttctcagaggtgaagcagctcacgttctcaaccaagacattacactcggtgttgctaatattgctcccaactttggggaaaattatcaaagaaaaggagcttgcattttcctacttccacgacatagattcactcttcagccatggacttgacttgcctcccgaagaaaccgagaagggtttcctaggaaaaatcatgcccaggctcgtcaaatccatctctggcgacaggacacacgtgcttcgcttcgagaccccagagactatgagcagggacaggtttttctggtttagggatgaggagtttgctagacagactgttgctggtctcaacccgtatagtatacgattggtcacagaatggccattgaggagtaaacttgacccagaaatatatggtccaccagaatcagcaatcacctcagaaattatcaacaaagagattggaggcataatgtctgtagaaaaggcgattgaaaaaaagaagctgttcatgttagactaccatgacatacttttaccctacgtcaacaaagtacgcaaactcaaggggaaaacactgtatggttcacgaactttgttctttctaaactcagaggggacactgaggcctctagccattgagttgactcgaccgccgtcatcttcaaataatacgggccaatggaagcaagttttcacaccttcttggcactcaaccagtgtttggctctggaggtttgccaaggctcatgttcttgcacatgactctggctatcaccaacttgttagtcattggttaagaactcactgtgtgacagagccgtatgttattgcaaccaacaggcaacttagtgagttgcaccccatatacaaattgctacaccctcatttccgttatacaatggagattaacgctatcgcacgagaagcacttatcaacgctgatggcaccattgagagctcatttgcaccaggaaagtactccatagagattagctctgctgcttatgctctcgaatggcggtttgacaagcaggcactaccagcagatctagttagcaggggaatggctgtgaaagatccattttctccacatggcttaaagctcaccattcaagactatccttttgccaatgatggactccttctgtgggatgctataaagctatgggtcactgactatgtcaaccactactaccctgaaccaagtcttgtggagtcagacgaagagttgcaggcatggtggacagagattagaacacttggtcatgctgacaaaaaagacgagccatggtggccacgtcttaaaaccccaaaagacctcattggaatcctcaacacaatcatatgggtaacttctggtcaccatgcagctgtgaactttgggcaatatgtttatgggggatatttcccaaataggcctacaattgtcaggaccaaaatgccctcagaggaccctacagaggaagagtggaaaaagttcattgcaaaccctgaaagagcactcctcaagtgctttccttcacaacttcaagcaactagagtcatggctgtcttggacatactctcaactcattcacctgatgaggaatacataggagagaagatggaaccatcatggggtgaagatcctgtcataaaggatgcctttgaaagatttagagaaagactgaagaaattagaaacactgattgatgagaggaatgaaaacacaaagttgaagaacagaaatggagctggcattgttccgtacgagcttttgaaacctttctcaaagcctggtgtgactggaatgggggttccctgtagtatatctatttaa

SEQ ID NO: 2170 - DNA, 1023 bp, Glycine max var. Williams 82
atgaggaagcccgaggtttctggaaaaaacaacaacattaataacaagcttagaaaggggttgtggtcacctgaagaagatgacaagctcatgaactacatgctaaacagtggacaaggttgttggagcgatgtagccagaaatgcgggccttcaaaggtgtggcaaaagttgtcgccttcgatggatcaattacttgaggcctgatcttaaacgaggtgcattctcaccacaagaagaggaaatcatcatccatttgcattcccttctcggaaacagatggtctcaaatagcagcgcgcttaccagggagaactgacaatgaaattaagaacttttggaattcaacaataaagaaaagactcaagaacttgtcctccaacacctcaccaaatggaagcgagtcatcatatgagcccaacaacaaagaccttaacatggcagggtttactacttctaatacccaacaaaatcaacaacatgctgattttatgcctatgttcaattcatcatctcaatcaccatccatgcatgccactacagttctcaattccataattgacaggttgcctatgctagagcatggactaaacatgacaagttctggtggattcttcaacagcaaagggccatgcttctcatcatcacaaagtggagttgacaacaacaaagggttttatttggaaaatggaggagtatttgggagtgtaaatattggtgcagaaggggatatgtatgttcctcctctagagagtgttagcactacttctgaccattataacctgaaattggagagtacgtgcaacacagatactaacaatagtaattactttgatgacataaacagtatcatccttaataactgcaacattaataatagcaacaatattaagagagctgaaaatagggctggtggggtggagaatttgtttcaagaagagttaaccattggagagtgggacttagaggagttgatgaaagatgtttcatcctttccgtttcttgatttttcaaaaatccaataa

SEQ ID NO: 2171 - DNA, 378 bp, Glycine max var. Williams 82
atgagtttgattctggggttggctcttgcattccttcttggaacaggactacattttggagctaagctatttaccaaagatgttaatgtccttcacctcattagaattgagatcccgtttgtagcagctactcaatccctcaactctttggcatttgtatttgatggtatcaactttggggcatctgattttgcatattcagccatttctttggatgcggtggcaattgtcagcattatttgtctacttattttatcatctgctagcggtttcataggaacttggattgctatgaccatctatatggatcttagagcaattgttggctttttgaggattggaactagatcaggaccgtgggagctgcttaattactaa

SEQ ID NO: 2172 - DNA, 609 bp, Glycine max var. Williams 82
atgttgtctacatttggttttgtttcttcatcggatatgtctgatgtgtcacgccggaaaatgactagaacgaccagaattcacataatggccttagacggcatcgtgaacgtgaattcactcttcaccttagccctcttcctcggcatcaccaccaccagcaccaccaacaccctcatcggcgaagacgacgcagcctgtgcagccggaacctccatgtcggagggcctcattgcgttccacgtttactccttcagctcctttctattttccagcctcatcgccttggctctcaaaaacgtcatcaacttcagcaaggacgtccacgagggtgacgccgttctggacaacaacaacaacaactggattcacagtgttgcaaaaattaacactgtcgttttgaggtttggaactctcgtttcggcttttgggtcggtgttcggatgcgggtttttggtgatggctcttgtggatttggtgcagatcaagttgggaaccttcacttgtggtagtcctcacaccttcgctgccgtcgctcccttgcttgttcttgtccccactgcacttcttatctatgttgttctcgtcatctatgcctttactcgttaa

SEQ ID NO: 2173 - DNA, 1308 bp, Glycine max var. Williams 82
atggctcaactcgaacgccctcaaagacaggttgagactccaaaaaccccccctaccatccacaccatggaacaactcctccgagaaggagaatccaagtctaagcagtcaccaacctactcctcctcctcctccatgaactcttctccatcctcccctttcttccaaaggttgaggcaccatgactcagaagaagaccatggccagaatcagaagaaatcagttctcaccaaggtgaaggagaaggccaagaaacttcgccacagcctcagcaagaggaaacacgaggacggcaaccccactagtccctcatcagctactggcgtagaaggcgatggagcagaagaagatgctgaatacctcggagctcctatgtacggttcggagaagtcacctgcaggatacgaagcatatgtaaggcagcagaattcaagtccaagaggaaatctagtattcccagagaagcatatgttatcaagcagtgacaaacacgtggttgaaccggatcatcaagaaaagacactaagccgctccatgtctaagaagacaacaacaacctcttctccaaatgctactacttctaacattaatactaatactctttctggtctaaacaagacaatcgtagcaaagaaaccaacaccagttcatgttgaaaaaccggatgcatcccatataacctccaaaatccaaggccttactgtgtcgaaacccacagaacatcatgatcacacttcaccatcatcaacaacagttcagacaattcgcaacacttctttgtcctatgctgctccattcactccccctgcaaagttaccctcccaagctccttcaattactccgcgaactacaccggctccggtgacaccagaaccttcatctgctcctgcatttagtgggaagagcacaagccccaccgcgcaaatacaggacaagggtgtgtcgatgaaagagtacttgctgaacaaattggagccaggggaagacgagaaggcgctgtctcagatgatatctgaagcaatgagtccaaggagaactcccggtgatgtaggcgtgatggagaaggtgagagaagctgtaacttctttgctccgaactgaggaaccaacaaaatatgcagacacgactactactactcctactcgcatgtcgtgtcaaagcccgaaggcttcttgcgcttcatctcaaatgccagcatctatcagcgcttctcgctcttcatctcaaatcccgctatctttcaacgctcaacaagactatgaagtggctgaggaagaaaaccatggccggattcttcaggcaaattga

SEQ ID NO: 2174 - DNA, 1761 bp, Glycine max var. Williams 82
atgatcaaacctattccttcatcaccttcactttttgtggcattcctctttgccaccagcttcctttggtcttttcccgaatttgttctcgctacttcaaagcatggaagtgctacaaggcactacaagtttgatataaggttgagaaacgttacgaggctgtgccacacgaagagcatggttaccgtgaacggaaagttccctgggcctagagttgttgcaagagaaggtgacagaatagtggtaaaggtggttaatcatgttcccaacaatgtcagcatacactggcatggagtgagacagcttcaaagtggatgggcagatggtccatcttacataactcaatgcccgattcaaactggccagaattatgtgtacaacttcaccattgttggacaaagaggaaccttattctggcatgctcacttttcatggttaagagccactctctatggacccctaatcctcctacctaggcgcaacgaatcttacccatttgagaaaccctacaaggaagttcccatcatctttggtgagtggtggaacgctgatccagaggctgttattgcacaagcccttcagacaggggctggcccaaatgtctctgatgcctacacttttaacggacttcctggacccttttacaattgctccaataacgagacagacacggacactttcaggttaaaggtgaaaccagggaagacatatcttcttcgtttgatcaatgctgcactcaatgatgaactctttttcagcattgcaaaccacaccttggtaactgttgaagctgatgctacttacgttaaacctttcgagtcagacatcatagtcctggggccaggacaaacctcaaacgttctgttaaagacaaaagctgagtacccaaatgccaatttcttgatgctagcaagaccatatttcactggcatgggaactttcgacaattccacagttgctggctttctagagtataagaataaaccacttgctgctcccaaaaatattaatattcccactttgaaaccatttcttccagccatcaatgacacttccttcgttgccaactttagtaacaaattcttcagtttgaaccctgcaaaggtgcctcaaatagttgacaagagcttcttcttcacaattggacttggaacaagtccttgtcccaaaaaccaaacatgccaaggaccgaacaacagttcaaagtttgcagcctcaatgaacaacatatctttcactcttccttccatagcacttcttgagcaacatttctttgggcaagctaataatggcatttacaccactgatttccctgccatgccactcatgccattcaactacacggggactccaccgaacaacactttggtcggtaatggaacaaagactgtggtgataccctttaacacaagcgtgcaagtggtgcttcaggacactagcattttgggagctgagagccaccccttgcaccttcatggctttaatttctatgttgtgggtcaaggctttgggaactttaatcctaacactgaccctcaaatattcaatctttttgaccccgttgaaaggaacactgttggtgtgccctctggtggttgggttgcaatccgattccttgctgacaatccaggtgtttggctgatgcattgccactttgatgtccaccttagttgggggttgaggatggcttggattgttgaggatgggaagctacctaatcagaagttgcctcctccaccagctgatctccccaagtgttga

SEQ ID NO: 2175 - DNA, 780 bp, Glycine max var. Williams 82
atggctgttgccaacaatgtgctttgcattgctttcattatcactttaacgtgggcagttgaagctcgaattccggggatttactctggtggtgcatggcaaagtgctcacgccaccttctacggaggatccgacgcttccggcaccatggggggagcgtgtgggtatgggaacctgtacagccaggggtacggtgtgaacacggcggcattgagcacggcactcttcaacagcgggcttagctgcggtgcgtgttttgagataaagtgcgcaaacgacaggcagtggtgccactccggcagtccttccatcttcatcaccgccaccaacttttgccctcccaacttcgctcttcctaacgacaatggcggctggtgcaaccctcctcgccctcacttcgacctcgccatgcccatgttccttaaaatcgccgaatatcgcgccggaatcgtccctgtcgcctatcgccgggtgccatgcagaaagcacggagggataaggttcacggtaaacggattccgttacttcaacctggtgctggttagcaatgtggcgggtgcgggtgatatcgtgcgcacgtacgtgaagggcacccgaaccgggtggatgccaatgagccgaaactggggtcagaactggcagtcaaacgcggttttggtgggccaggccctgtccttccgcgtcaccggcagcgaccgccgcacctcaacctcgtggaacatcgctccacccaattggcaattcggtcaaactttcaccggaaagaatttccgggtctga

SEQ ID NO: 2176 - DNA, 1077 bp, Glycine max var. Williams 82
atgtccgaacctcattcaccgccccgtacctccgcgtatctcgacgcgctctctcaggcgatccacaagaaacttcagcgggcattggctaattcctcgcagaggcgcaatttgttgcaggagctgtttgcggacatagctttagaagtcgatgagcgagccaaagatgtaattgtcaacaaggaagaagatggcatttctcccgcagaggatattaatgatggtccgttatgcttctatgatgtgcttgctgattattttgtgcgagtgtctgagagtggaaaacctatccttgacttgattgttcaactttggagccaatcatttgcttcacatatttttgccctactgtttcacaaatggttatttgaagttcatcttgataatccagaagtgcttctccggtattcatctgctctggttcaaggtgccacaaatgttttctggattgacattcaaacaaatacaaggcgattccagtctctattccgttaccttttggaagatgttggattagaccacactcgattgaataaaattcctttccaggctcagcgggatatgtatcttttgctctcaaggttcattctattttacaacaaagctgacaaaatagatagcttcctgaagcaatgtcccgctttcccaactgctttcttaattggcggtccagcagatatatttgttaccgaactcactgatcagcttcaaaagctaaaggttgaaccagtgctgcttcattacctttcagaaattaagatccttcagggtatggaattgagaatgactactagtacgagactgaaaacttgtttgtatagctttacttcacctggtggtccaatgtatcccactagagccgttcgtcatgcagcttgggaagcattagatttactttttccggtgggacgttatcctcggcatcttattagtttgttcttcaggttgctttatccgtggtattggccttcctcttgttggaactttgtgatttcttgcattcaggcagttttttactccgtgctggggtttatattttctacgtgggataagattgccaagccaaaatcacaatag

SEQ ID NO: 2177 - DNA, 255 bp, Glycine max var. Williams 82
atgacaaattgcaagtctttggatatgacttgtttgatcatttgggcaactgaagatcctttggcagtgacacccttttggaacgagatgacagagatggtccttgctcctctatatacattttattttccgaagaaaaaacgaggttgttgttgtgattttgaaaatgttaatttcatctacatatgcagctccgtacgtgaaacaatactaagttgtggacttatatatatggtttcttactatagattttaa

SEQ ID NO: 2178 - DNA, 759 bp, Glycine max var. Williams 82
atgccgatttctagaattgccattggaaatccttcagagtttggccaagcggatgcgcttaaggctgctcttgctgagttcatctcaatgctaatatttgtctttgcaggagaaggctctggcatggcatataacaaactcacagacaatggttcggcaacaccagctggggtggtggcagcatccctgtctcatgcatttgctctttttgttgcggtctctgttggtgctaacatctcaggtgggcatgttaaccctgctgtcacatttggtgcctttattggtggccacatatccctcctcagaggcattctgtactggattgctcagttgcttggttctgtagttgcttgcttgctccttaaatttgccactggtggattggaaacatctgcgttctcattgtctcctggggtgggagccgcaaatgcacttgtttttgagattgtgatgacttttggtttggtttacacagtgtatgctactgcagtggacccaaagaagggtaaccttgggataatagctccaattgcaattggtttcattgttggtgctaacatcttggcaggtggtgcctttgatggtgcatccatgaacccagcagtttcttttggacctgctgttgttagcgggacatgggctaatcactgggtctactgggttggcccattaattggttccgctattgctgccattatatatgagacttttttcatcacccctaactcttatgaacatcttcctgtaacagattattag

SEQ ID NO: 2179 - DNA, 2847 bp, Glycine max var. Williams 82
atgttagaggacattgaatcatctactactcggctttgtaaaatgggattcggtcgaaattcgacctcaagaagcggagattacttggaaggaatgcttaacgactatgttggaggaaggaacaaactgaaggctcagaagagcgccgccacaacaacgaagtttgtggcagtgctcacgtgccttcagtttttctttgcagtctatgcaacattcctattgtattacatgggcccttccattgatttaagaaccaagccagagttcacatgggcaacaaaaattgcccaacaatggaagcaactcatcatcacgccccatgttgttggccactaccaagaagctgcttcctctctcatcaaggaggatcttcttcccacaactccttcccaagtgtgtgagaatgagaagatagacttcatgcaaaagaagtccaatgatgtccaaatgatcaagataaagagagagctctatgatgaggtgctgagcttccaaagcaaaacctttggctccgagactctccaagagctaatttcaatgaaatccaaatgggacttgaaaggtccaaacaggccaaagatcacggttttgctaaaccacttcaagagaaagacactttgtgctcagctcgattctttgctccaacaaaccctcccttttcatcatgtttgggtgctttcatttgggagccccaatgaggcctcattgaagagaattgttgacacctataacgactcaagaatcagcttcataagctcaagctacgatttcaagtactatggaaggtttcaaatggctcttcagactgaatctgatcttgtgtacgttgttgatgatgacatgattccgggaaggaagatgttgcagattttggcacatgttgctgggacagacaagtacaagaattctgtcttggggagtattggaaggatattgccctttagacagaaagatttcacctttccaagttacagaaaatttcggtctaaggaggcagggttgtatttgcctgatcctgcttatgatatcactgttgataaaattgtgcaggtggattttctatcaagttcatggttcctctctgctgatcttgtcaagacactcttcactgagacaccttttaccttctcaactggtgaagatcttcaccttagctatcagcttcagaaatacaaaaatgctggttcatttgttcttccagtggatcctaaggacaaggaaacatggggtgatagtgagcacaggcttgcatatgtgtctgaaaccacagtgattttcaaggatgtagttcaagtcagagatgatcaatggtggaaagcactttccacaggctatgtgactcaatgggctgcaatgtaccctcaaaaaattgatgcactcttttatgctcactcagttgatgaagtaaaaatgcttgcaccacttcttgaaaagttcaggtccacagttggcaagaaggcctacattgttgtctctggaggcaattactgcccttgtgaagatgctgcaagagctctcaaatggcctgcattggtctgcaaagaacgccggtttaagatttttgacttggccattgaagcactttctggggtgtcagattctgaggcaccagtgatacatgcagtgtacaccagcttgaagggtttgatcaaaattcacaatcccagtgtagtgatcagtctggctgacattgaccctcatgtgagaaaagctctcaagatggcctcagaaaccaactcaaatgacaccacattggttcttttaccaaggtcttcagtttctcaagttctttggatggctgatctgcgttcaacagcattgccaaactggaatcggatgagggtttctgtgaacatcatcacccaaaatagagccaattcactagcaaggcttctcaaatctctcagcaatgcctactatctcggagatgaaattcccattaccttcaacatggatagcaaggtagatgaggcaactataagactagtaggttcatttgagtggcctcatggacccaaaaccctgagaaggagaatcgtccaaggaggtctaatccgcgctgtgagtgagagttggtatccatcttctgatgatgactttggactcctactagaagatgacattgaagtttcaccttactactacctatggatcaaatatgcactcatggcttaccactatgaccctcaagtctctctacctgagctctcatccatttcactctacactccaaaacttgttgaagttgtcaaagagaggccaaaatggaatgccacagaattcttcaaacacatccaccccaacacaccttaccttcaccaactaccttgcagctggggagcagtgttcttcccaaagcattggagagagttctatgtgtacatgaacatgaggttcactgaggatgccaagtccaacccagttcaaattccaaagtctagaacaaatggatggcaagcttcatggaagaagttcctcatagacatgatgtaccttagagggtatgttagtctctacccaaatttcccacaacaagcaagcttttcaaccaaccatatggaaccaggggcacatattagtgctaaagacaatttggttaagcataacaaacaggactttgaggtgccactaatgaaagaagactttagaaactttttgccagcaatgaaaatgccttcagcatcaaggcttccatctcttaacctcttcaatcaaccagtttctctaaagggtctcaaagctgctggagctaagttgggacaggatgtgcttagatgtgacaatgccactgaggttgttgctgttgacaaagatactggtctaccttacacttgctccaaattctga

SEQ ID NO: 2180 - DNA, 1747 bp, Glycine max var. Williams 82
acaaccttagtttcacgctcgcatattatatggttagtgttagtacttcgtagcaccccttttctgtgtcccaacttgtaagttactccatctaacgcaccgctttgaccctttcttcccgtcgccggttgccggcataacatgttttgacggcgcatgaattccatcgaatcatgcggcgcttccgtaccagagatccggtcgttctccgcactttcagatgattctgtctctgaagccggaaatcagataacgagaaattccttattttctggaggatgaagagaaagtgaataatagctttgttgaattggatacaagggaaggagtgaatgatggttttcctagagttggaccaaatgattcgcttcttcctggtctttttgatgatgttgcgctgaattgtcttgcttgggttaatagatcggattatgcttcactagcatgtataaataaaaggtacaacttgctgattaggagcgggtatctatttgagttgaggaagaagttggggattgtggagctagagcatttggtttattttggtttgtgatccaagagggtgggaggtgtttgaccccaagaggaatagatggataacattacctaagataccttggtgatgagtgctttaatcatgcagacaaggagtccttggctgtggggagtgaattgttggtttttggtcgggaaatgatggattttgccatttggaagtacagcttgatttctcgtggttgggttaagtgtaaggagatgaaccatcctcgctgcttgttcggatctggcagtcttggttcaattgctattgttgctggtggaagtgataaatatggaaatgttcttgaatcagcagagttgtatgactcaaattcaggtacatggaaactattgccaaacatgcatacaccacgaagattgtgctctggcttttttatggatggaaaattctatgtgattggtggcatgtcaagtcctacggtttcattgacttgtggggaggagtatgaccttaagacgagaaactggcggaaaatagagcgtatgtatccatatgttaatggggctgctcaggcacctccacttgtggcagttgtggataaccagttgtatgcggttgagcatctaaccaacatggtgaggaaatatgacaaggaaaggaacacctggagtgaattgggaaggcttccagtacgtgccgattcttctaatggatggggcctggctttcaaggcttgtggagagaaacttctggttgtgagtggacaaaggagtccagaaggtgaagctgttgtactgaattcatggtgtcctaggacaggagtcaggaatggaaccatagattggcaagtacttggtgtgaaggagcatgttggggtgtttgtgtacaattgtgctgttatgggatggtttggtgaagtgcttttagattgactcagtagaagatttgctggtatctacaatctgacatagctttgaggggtgcttccgtgttgattcatctcatttaccaagttaattgtccctgggatagccttcccttgatgagaattggggtttctacctttggcatctgtatttggatgtgtttctcattttcatgttccataatttttatttgcttttgagattacttagtaggcttacacagatatgttctgttatctttttccttatccaactatgtaaaccaataaatcataaagttttattttttttaatacttcaatccttattctttgcttta

SEQ ID NO: 2181 - DNA, 1659 bp, Glycine max var. Williams 82
atgatgattaaacttctccaccaccctttaaccaccaacaagtcttcctacagaaaaatgagatatccgtcattcagcctccttagagaacacaacattctgttcataaggggcttcatgatcttgttcctcagctgcataaccattcagcttaatttctgtatttccagcaccccttcttctctcaaagcacttcccttggagggacacttcagttttgaagaagctgaccttaaacatgcagccagtgactttggcaacaggtaccaatctcaccccatggcagtgctgcatccaaaatcagtttctgacattgcaaacaccataaagcatatctggaacttggggccaagttctcagctcagtgttgcagctagaggccatggccactcactccaggggcaagcacaggcccatggaggagttgttatcaacatggaatcactcagtgtcccagaaatgcaggtgcatacaggagaatcatctccttatgttgatgtctcaggaggggaattgtggataaacatcttgcatgagacactaaggtatggatttacaccaagatcatggacagattacttacatctcacagttggtggcactttgtccaatgctggtgtaagtggccaagcatttaggcatggtccccagataagtaatgttcagaagctggagattgttacaggaactggagaagtggtaaactgttctgaggagcagaatggtgaactctttcacagtgtacttggagggctaggtcagtttggcattataacaagagcaagaatattcctggaaccagcacctgccatggtaaaatggatcagggtgttgtatgcagatttcacagcattcattagagaccaagagaaattaatatttgcagaaaaggcctttgattatgttgaaggatttgtgataataaacagaactggtctgctaaataactggagctcatccttcaacccacaagacccagttcaagctagtgagttcaagtcagatggaagaactctcttctgcctagaattggccaaatactacaatcttgaagaaacccttctagtgaatcaggaagttgagaaacatttgtcccgcttgaactatatcccatcaacactttttctaacggaagtcacatatgtagactttctagacagggtgcatacctcagaggtcaagttgcgttcaaaaggcttgtgggatgttccacacccatggctcaatctttttatacccaaaaccaaaatacaccatttcgcagaggttgtcttcgggaacatcgttaaagaaacaagcaacggccctgtccttatctacccagtaaataaatcaaaatgggacaacagaacttctgttgttattccagaggaagatattttctacttagtggcatttcttgcctctgcagtcccctcttccaatggtcctgatggccttgagcacattttgagtcggaacaaaaaaattttagagtattgtgaaagagccaatcttggggtaaagcaatatttgccccactactctacacaggaagaatggacggcgcactttggttcccaatgggagattttcaagaaaagaaaatcactttatgaccctttggctatacttgcccctggccaaggaatatttcaaaaatcaataaccttctcatga

SEQ ID NO: 2182 - DNA, 3206 bp, Glycine max var. Williams 82
atcattatgttttcccctcattgaaacatagatgctgctacctagaggctatttcccacaagtgaacatttcccacatagatcaagaagggagaggttttctttccaattccaggaccacatgcaacccattggtgaccaaaataaattcaacaagagattacgaatgcatgctgtatagcttttccaatccaataaagtgacaagtttttatcactctaagaagctgtaaaatctctcattggaccaaaaactcaagttgctatgaaaaaggataaaaggcacacaagagtacaagtactagagtaattcaatgccacccaaatacaataacaaaagaaagcactaataaaaaaacttgttcaatagctgtgtactaaagattctaataaaaaacataggcagcaacagcagtggtggttgtgcagcattgcatcagaatgtaagtagcagtctttcattgtttccatttgttcttgcaatagcttgacctacaaaggagggccccaagaagaccctacatggccaatcaatagcacaaatggaacgaaacttcacgtgtcacatggaccaacatagaccccaccaatgtcatatctctctcttgaatgtattcatacaaccctgcaagtccttctcattcaatttaatggcaggaatactcgatgtttacactccgacagtaatggattcaccaccaccacgacatagtgaggtagacaggagcattggcatatcataactgccccaagaggcagagaaaaatatatgaatatgcagtgacaaaaggacttgttttttttcttttttctattttttctaaattcggaaaaaatagagcatgcttaaattggttaatgatcaaaaaaatagaaacatgtctgtccttgatggaaagatgggggggttgtggtaggaactgtttggaaaagtggcaagatttgtgagatctctctttggtgtcactttttcctcttcaacttggcataagtatgatggcttcggtttctcttttaaacaaactcgccccaaaagtgagaagaaccaaaaggaatccttccaagaaataaccattcttcatacggattctcataactgaaaggttgactcaaccacctacaaacaaacttctataaattctgcccctaccatctccttcttcacttcatcccttacccttttgtttgtactcacaaaccaaaccaaaccaaacaaacaagcaaagcctacaatatgatgattaaacttctccaccaccctttaaccaccaacaagtcttcctacagaaaaatgagatatccgtcattcagcctccttagagaacacaacattctgttcataaggggcttcatgatcttgttcctcagctgcataaccattcagcttaatttctgtatttccagcaccccttcttctctcaaagcacttcccttggagggacacttcagttttgaagaagctgaccttaaacatgcagccagtgactttggcaacaggtaccaatctcaccccatggcagtgctgcatccaaaatcagtttctgacattgcaaacaccataaagcatatctggaacttggggccaagttctcagctcagtgttgcagctagaggccatggccactcactccaggggcaagcacaggcccatggaggagttgttatcaacatggaatcactcagtgtcccagaaatgcaggtgcatacaggagaatcatctccttatgttgatgtctcaggaggggaattgtggataaacatcttgcatgagacactaaggtatggatttacaccaagatcatggacagattacttacatctcacagttggtggcactttgtccaatgctggtgtaagtggccaagcatttaggcatggtccccagataagtaatgttcagaagctggagattgttacaggaactggagaagtggtaaactgttctgaggagcagaatggtgaactctttcacagtgtacttggagggctaggtcagtttggcattataacaagagcaagaatattcctggaaccagcacctgccatggtaaaatggatcagggtgttgtatgcagatttcacagcattcattagagaccaagagaaattaatatttgcagaaaaggcctttgattatgttgaaggatttgtgataataaacagaactggtctgctaaataactggagctcatccttcaacccacaagacccagttcaagctagtgagttcaagtcagatggaagaactctcttctgcctagaattggccaaatactacaatcttgaagaaacccttctagtgaatcaggaagttgagaaacatttgtcccgcttgaactatatcccatcaacactttttctaacggaagtcacatatgtagactttctagacagggtgcatacctcagaggtcaagttgcgttcaaaaggcttgtgggatgttccacacccatggctcaatctttttatacccaaaaccaaaatacaccatttcgcagaggttgtcttcgggaacatcgttaaagaaacaagcaacggccctgtccttatctacccagtaaataaatcaaaatgggacaacagaacttctgttgttattccagaggaagatattttctacttagtggcatttcttgcctctgcagtcccctcttccaatggtcctgatggccttgagcacattttgagtcggaacaaaaaaattttagagtattgtgaaagagccaatcttggggtaaagcaatatttgccccactactctacacaggaagaatggacggcgcactttggttcccaatgggagattttcaagaaaagaaaatcactttatgaccctttggctatacttgcccctggccaaggaatatttcaaaaatcaataaccttctcatgacggtagccacgttttagtaatgagaagaaaaaaaaggcccttatggcatacatatgtgaatatattcctgcatatgcatactgtgtgtgttgcaccaagacagcacaagagttactgggtcaatacaagagaacaaaggtttcaaacgtgaattattattatagggtttcaaaaaatataccaatattatcagtgctagaaacgaatgtatatatcaattttgcaaacagctccttattttgttttgtaatgtagccaatttcaagaacaaaagttatgtgcccctgctacataaatattaagacaactaaagca

SEQ ID NO: 2183 - DNA, 621 bp, Glycine max var. Williams 82
atggaacccttagtcctatactcaccaaaattaccagtcctcattgagcatctaaccatggctgctcctcttcaattcttctttctcttcaccctcactctcttctcatcatcattctccgagcaatcccacatcgaactaccctcaaacaacaacaaccctaaccctaaccctttacaaaaactgtccaatctccacttctactaccacgacataagagacaacgaaaaccccaccattgtgcaaatcgtggacaccccaaagaacgttccgaacgggttcgggtctactttcgtgatggacgatgcgatgaccgaaggaccagagctgagctcgaagcacgttgggagagcccaggggctgtttggcttggcctctcttcaggaccttgggatgttcatgctcaccaatttcgctttcaccgaaggagcttatgctggaagcacgttgagcatgcttgggaggaatcccatatcggagcagaatagggagttgcccattgttggtggcactggcgtgtttagatttgccactggctatgccattgctaatagcgttaattccgtttctacccctcaacattttgttgtcgagtacaatgttacagtgtggcatggctag

SEQ ID NO: 2184 - DNA, 576 bp, Glycine max var. Williams 82
atggttgtccctcttaggcactttcttgttttctctctcaccctcatatccatcatcttccacacccatggagcgttctctgagcaatcaataatcaagttacccacagaccaaccaagggtagagaaactgacccacttgcattttttctaccacgacatcttagagggcaagaacatcacggtggtgaaaatcatcgagccatcagcgagcgaggttcgtgaagcaactgggtttggaaccactttcatgatggacaatgttttgaccgagggtccagagctgagctcgaagcacgttgggagggctcaggggctgtttggcttggcctctttggaggaccgtggaatggtgatgctcattaacttggctttcagtgagggtgagtatgctggcagcactctcagcatgcttgggaggaaccctgttcaggacactgttagggaaatgcccattgttggaggcacgggcgtgttcaggtttgccaagggctatgccattgccaagagtctttgggaaatttctgacaatgagcattttgtggtggagtatcatgtcactgtttctcatccttag

SEQ ID NO: 2185 - DNA, 1101 bp, Glycine max var. Williams 82
atgggttctaactatgaagagattcttcctcttccaaaatgttcacctcatgatgaagacaatgcatgcctatctgctatgcaacttagctttagcccaatggtttatactgctgtgttgaatgctgctattgagctcaacttgtttgagatcatagcaaaggcaaacccaccaggcatgtcagcctctgaggttgcttctaaacttccaactcagcacaaaaatttacctaaaaggcttgatcgcatgctgtgtctacttgccagtcattctcttcttacctgttctacaagcacaaaggaagatggtggggttgaaagactctatgaactttcacctgttggcaagtactttgtcaatgatgaaaccactggctctttggccttgttttcaacgtttatgaatcatggaacgctcgttgacgcattccttaatttcaaggagatacttcttgactgtgataatggcctatacattaaagttcatggaatgcccatttatcaaggcatacaatctgatccagcgtgggatcatacttttaataaagcaatggccaatatatgcacaagagagatgacaaagatacttgaaatatatactggattcgaaggaatatcattgttaattgatgtgggaggtggagttgggcagtgcttgaatatgataatctacaagtatccttcaataaagggtgttaattttgatcttccacaagtaatacaacaagctccaacttatccagggattgagcattttgaaggagatatgttcgaaagtgttccaaagggtgatgccatactattgaagggcatattgcacaattggtccgatgaaaattgtttgaaaattctaaataattgctacaaagctttgccagaaaacggtaagttggttgttgtagacttcataatgcccgaagcagttcagtctactgaagcagataagatggttactagctttgacaatcttatgtttcttgacggaggaagcgaaagaaccgagaaagaatttttgaatttatgcaaatgttctgatttttctagtttccaagttgtttgtcgtgcctttactgctttgggagtgatggaattttataaataa

SEQ ID NO: 2186 - DNA, 336 bp, Glycine max var. Williams 82
atgaataagcaagtaccaaagaattgttctagacatgggagtgataaatatgtaaagtttaatgttcatattaatgatgatgaagataatttgagtgaaccagatcagacagagtttgtgggaacttttgttaatttgttccatggacaaggccataatatcaaagtaactagttttaaggtagggatatcaaaagtgctcgattctttagaagctgaagaagacgatgttgtgctagttactttggtgcctaaggttgaaaaaggagatgtcatcataggaggcatcaaaaaaaagacaaaaacaactacgaatccgagagaattagaggattga

SEQ ID NO: 2187 - DNA, 3258 bp, Glycine max var. Williams 82
atggaaatggagcacagagtgattccgttttccacgagagggtggaggaggacttatgatgttttcctcagttttagaggagaggatacccgttttggtttcactggtcatctctacaacactttacgtcatagagggatcaacactttcatggatgatgaggcgcttgagagaggagaacaaatatcagaagccattttcaaagcaattgaagagtctgggaaagccatcgttgtgttctcgaaaaactatgcatcctcaacatggtgccttgaagaacttgtcaaaatcctcagttgtatgaaaactaaggaacttaaagtttatccactattttacaacgtggatccatctgaggtacggtaccagagagcaagttatggtcagcaattggctaagcatgaaatcaaaatgaagtatagcaaacagaaggtgcaaaactggaggctggctctgcatgaagctgccaatcttgtagggtggcattttaaagatggacatggatatgaatatgaatttatcacacggattgttgacgtggtgggcatatcaaaacccaatcttttgcctgttgatgaatatctagttggaattgagtcacgtatacctaaaataatattccgtttgcaaatgactgatcccactgtcatcatggtggggatatgtggagttagtggaattggtaaaaccactcttgctcaagctttgtataatcacatcagcccacaatttgaaggttcatgctttctcaatgatgttagaggaagttcagccaaatatgggttagcatatctgcaagagggaattctttctgatatagctggtgagaatatcaaagtggataatgagcacaaaggaattccaatcctgattaggaagttgcacggcaaaagggttcttttgatacttgataatgtggacaagctggagcaattggagtatttagcaggagaatgcaattggtttggtttgggcagtagaattatcataactagcaggtgtaaagatgttctagctgctcatggagttgaaaatatatatgatgtacctacgttaggatattatgaagctgtgcaacttttaagttccaaggtaaccacgggacctgtacctgattattataatgccatttgggaacgtgcagttcactgttcccatggccttccattggttttgaaggatattggttctgatttgtcagaaaaaatgaatgttattggttctgatttatcatggccttcaattgatgaattggggattgcactagaaagatatgaacgagtttgtgatggagaaattcagagtatacttaaagtgagttatgatagtttgaatgaatgtgagaagaaaattttccttgacattgcatgtttcttcattggagagccagtatcatatgttgaggaaatactatcagctattggtttcaatccacaacatagtatcaacagacttatcgatagatctctcctatctatcgattccagtggaaggttgatgatgcatgaccatataaaagacatggccatgaaaatagtgcaacaggaagcacccctgcatccagaaaaacgaagtagattatggtgccctcaagatgttcttcaagttttaaatgaaaatgagggatctgataaaattgaagttatgatgttggttgacttaccacgaggaaatgatgtactgaagttgagtgacaaagccttcaaaaatatgaaaagcctgagaatgttaattattaaggatgccatatattctggaatcccccaacatctctcaaatagcttgagagttctgatatggagtggatatccttcaggatgcttaccacctgattttgtcaaagtgccttctgattgtctcattttgaacaatttcaagaatatggagtgtttgactaaaatggatttcactgattgtgaatttttgtcagaagtacctgacatttctggaatcccagacttaaggatattgtatctagataattgtataaatttgattaagattcacgattctgttggatttcttggtaatcttgaagagctaactacgataggatgcactagtctaaaaataattccatcagcattcaagttggcatctcttagagagctctctttctctgagtgcttgagacttgtgaggtttccagaaatattgtgtgagatagaaaatttgaagtatctcaacttgtggcaaactgccatagaggaattaccattctctattggaaatcttagagggcttgaatctttaaatctaatggaatgtgctaggcttgataagctacccagtagcatttttgcactaccaagacttcaggaaattcaagctgactcgtgtagagggtttgacatttctattgaatgtgaagatcatggacaaccgagattatctgcttctccaaacattgttcatctgtatctgagctcttgcaacttaacaactgaacatcttgttatatgtctcagtggttttgccaatgtggtatatttggacatatcttacaatagttttacggtccttccagcatgcattaaagaatgtatcaatttgaagactcttctgctaagcaattgcaaccaacttcaagatattttagtcattccctctaaattagaagacatagatgcattaaactgcacatctttgacatctcaatcatcaagtgtactattgagccaggcatttcatggaactgggcagaaaactgtaattcttccaggtttaaggattccagaatggtttgatcattgcagcagtgaaagatccataaccttttggggccgtgagagattcccaaggatttgtgtgtgtgtttcttttggaatgctcgaaaattcactgcaccaccattttcaagttacattctgtatagtcatcaatggccacaaaaggatattgtccaaccgttgttacgattggtcagttcagacagatcatgtgtggctttttgatctaactgcccttgttagttatgaagatctcagaggaacattggtgaagagtgactggaatcatgtggagattgaaatggaatggaattgctgtatacaaggtgaccatgggccaacaagaatggctattgtgaaatggtatggaattcacgtatacaggcaggaaagtaaaatggaggatatttctttcacaaatcccaaaaatctacaagaaaatattacaagtaaaagggttggtactgaggttttggattcatcagagaaaagccaaaagaagttgaaagcaatttctcagtgggattga

SEQ ID NO: 2188 - DNA, 564 bp, Glycine max var. Williams 82
atgggtatggctgcagaagctcagttccatgttctggctgttgatgatagccttattgacagaatgctgattgagaggctcctcaaaacctcttcctttcatgttactgctgtggattctggtagtaaggctttgaagtttcttggtttggttgaagagaagagaaatgaggagcctcctccctgtattgctctagaatcccatcaggatgtagaagtaaacctgatcataactgattactgtatgccagaaatgactggctatgatctgctgagaaagatcaaggaatctaaatctcttaaagacataccagtggtgattatgtcctcagagaatgtcccagcaaggattaacagatgcctagaagagggagctgatgaattctttctgaaaccagttcaacagtcagatgtaaacaagctgaggccacatttgatgaaatcaaaagttaaggatggggaagaccaacaaatcagtaacaaaaggaaagaaacagaagaaagccattccccagataaaactaggacaaaaatggagcctcaaaaagtggttaatttcagttaa

SEQ ID NO: 2189 - DNA, 966 bp, Glycine max var. Williams 82
atgtcgaaggtggtttgtgtcaccggagccagcggcgccatcggatcatgggtggtcctactcctcctccagcgtggttacaccgtccatgccaccgtccaagatatcaaggatgaaaatgagacgaaacatttggaggaaatggaaggagcaaagagtcatctccatttttttgaaatggatcttcttgacatcgactccattgccgctgccataaagggttgttccggcgtaatccaccttgcatgtcctaacatcattggtcaagtcgaagatcccgagaaacagatattggaaccggcgataaaaggaacggttaatgtgttgaaggcggcgaaggaagcaggggtggagcgcgtggtggcgacttcatcgatttcgtcgattatgccaagtcctaattggccagctgataagattaagggagaagagtgttggacggaccttgaatactgcaagcaaaaggggttgtattatcccattgcaaagactctagcagagaaagcgggttgggactttgcgaaggagacaggttttgatgttgtcatgataaaccctggtacagcattgggccctctgcttcctccaagaatcaattcaagcatggctgtgcttgttagtgttctcaaagggggcaaagagacctacgaggacttctttatgggaacggctcacttcaaagacatagcattggcacatattttggcacttgagaacaagaaagcagcaggaaggcacttgtgtgtggaatctattcgtcactttagtgatcttgtggacaaggttgctgagttataccctgaatacgatgtggctaagttgccaaaggatacccaaccagggttgttgagagcaagtggaaaggatgcatcaaagaagctgattgatttaggtctagaattcactcctgttgagcaaatcatcaaggatgcagtggagagtttgaagagcaggggctatgtctaa

SEQ ID NO: 2190 - DNA, 438 bp, Glycine max var. Williams 82
atggagaaccctaaagaaaataacaaggtagagaatcctcatacggtgaatgcagttttgcatcctacttttgtcttttctgctagaaaactagcagaccaattgggagatacaaaagctgatatggatcctgatccggaacaacaaatattggatcctaaattaagaagaatattgtcaaactcatttgttgcccaaagatcaagggagaagaagaaaaatcatttagcccatatggagattcaaaagaaaacttttgagaatgaaatagcccaaaaacaaccaatacaagatttgtaccaaaataagaggcaagctcagatagtagaagaagaaacattgtaccaggaaattgatattcttaagaattattcaatgttcgaagatgctgaaattgagaagaacaaaggtgaagtgaatagggagagagaactctaa

SEQ ID NO: 2191 - DNA, 1236 bp, Glycine max var. Williams 82
atgggttcttcttggataagagggaagtgcgttggtaagggcgcgtttggcactgtcagtgtcgcgcttcgcaaacgtgacgatcaaactcaaattttcgcggtgaagtccgtggatttaaaaacgggtctcccgggtcagctggaggcgttggagaacgagattcggatcctccagcgcatgtcttctccgcacgtggtaacttttctcggcgacgacgccacgtgcgagcagcggaaccttcatatggagtacatgccaggtggcacgctcgctgacctggatgctgacgtggacgagattttagtgagacactacacgtggtgccttgtgagcgctctgaagcacttgcacgcaaacggcgtcgttcactgcgacgtgaagggaaagaacgttctcgtcggagacggagggaaaggtttcaattgcaagctcgctgacttcggatcggcggcggagttctccaacgaagggtttccggcagtggtgccgcgcgggagtccgctgtggatggcgccggaggtggttcgccgggagttgcaaggtccggcgtcggatgtttggtcgttgggatgcacggtgatcgagatgatcaccggaaaaccgccgttggaggggaacatcgtggacacgctgaaccggatcgggttctccggcgaggtgccggagtttccgaggcggttgtcggagctcggaagggattttctcgagaagtgtttgagaagggaagcgtggcggcggtggagctgcgatcagctgctgcagcatccgtttttgttgccgtgtggtgagattgcggaatcgtcgccgcggtgtgttctcgaccgagttgactcggagttcgccgagttcgaccacgacgaagaagaagaagaagaaacaataactgaaaatgaaaactgggcgaggggtagaattggaaaattggcgatcagggaaatggtaaattgggaaacagaaggttgggtggtggtgagggaattggcttccgacgcggaaccggcggtggcagttgacagttctgaagaagttaaagacttgacatgcccgcgaaatattcggaaagagagggtagaaaggggaattcatttagggacaaattcggaatttaaaaatatagaaaacgaaagggtaaaaatgaaaatgtgggatttggcctgtgacacgtgcaatttggtgtccttttcgctttgtgttaatggaatgagagaaccccaacaagataaacaaacttga

SEQ ID NO: 2192 - DNA, 1740 bp, Glycine max var. Williams 82
atgtgtggcatacttgctgtgcttggttgctctgattcatctcaagccaaaagggttcgcgtccttgagctttctcgcagattgaagcaccgtggtcctgactggagtgggctccaccaatatggtgataactatttggctcatcaaaggttagccatagttgatccagcgtctggtgatcaacccctcttcaatgaagacaaaactgtagtggttacggtgaatggagagatctacaatcatgaagaactcaggaaacagttgcctaatcacaccttccgtacaggaagtgactgtgatgttattgctcacctgtatgaggagcacggagaaaactttgtggacatgcttgatggtatattttcgtttgttctgctagatactcgtgacaacagttttatagtggcacgagatgcaattggggtcacttccttgtacattggttggggtctagatggctctgtctggatttcatcagaattgaaggggttgaatgatgattgcgaacattttgagtcttttccacctggtcacttgtactctagcaaagagagagcgtttcgcagatggtacaatcctccatggttctctgaggctattccctcagcaccttatgatcctcttgctttgaggcatgcctttgagaaggctgtggtaaaaaggttgatgactgatgttccctttggtgttttgctctctggaggtttggactcttcattggttgcagccgtcacggctcgctacctggcaggcacaaatgctgccaagcaatggggaaccaaattacactctttctgtgtaggccttgagggtgcacctgacctaaaggcagcaaaggaagtagcagactacataggtactgtacatcatgaatttcactacactgttcaggatggcatagatgccattgaggatgtgatctatcacattgaaacatatgatgtgacaacaattagagcaagcattcccatgtttcttatgtctcgtaagatcaagtcattgggagtcaaatgggttatatctggagaaggatctgatgagatctttggagggtatctatatttccacaaggcaccaaacaaagaagaatttcatcaagaaacatgccgcaagattaaagcactccacaaatatgattgcttgcgagccaataaatcgacctttgcctggggtctagaagccagagtgccatttttggacaaagattttatcagagttgcaatgaacattgatcctgagtataaaatgattaaaaaggaagaagggcgaattgagaaatgggtactgaggagggcctttgatgatgaagaacatccttatctgccaaagcacattttatacaggcagaaagaacaattcagtgatggagttggctatggttggattgatggccttaaagctcatgctgagaaacatgtgactgatagaatgatgctcaatgctgctaacattttccccttcaacacaccaaccaccaaagaagcatactactatagaatgatatttgagaggttcttccctcagaactcagccaggctgagtgttcctggaggaccaagtgttgcatgtagcacagccaaagctgttgagtgggatgctgcttggtctaacaaccttgatccatctggtagagcagcacttggagtgcatgcatcagcttatggaaatcaggtcaaagctgtagaaccagagaagatcataccaaagatggaagtttctccactaggagttgccatatag

SEQ ID NO: 2193 - DNA, 2254 bp, Glycine max var. Williams 82
acttaactctttcaacttggaacccttctacgtgttctccattccctctctcactcctccatctacgtttcttaaatcattttcttctttctctctttctttatcttctcatttttctcattacactcttttttttttctctcaacttttctcttattaaccatagttcacatattatatcatcacatatcatagtgatatattatatcatatcacaatgtgtggcatacttgctgtgcttggttgctctgattcatctcaagccaaaagggttcgcgtccttgagctttctcgcagattgaagcaccgtggtcctgactggagtgggctccaccaatatggtgataactatttggctcatcaaaggttagccatagttgatccagcgtctggtgatcaacccctcttcaatgaagacaaaactgtagtggttacggtgaatggagagatctacaatcatgaagaactcaggaaacagttgcctaatcacaccttccgtacaggaagtgactgtgatgttattgctcacctgtatgaggagcacggagaaaactttgtggacatgcttgatggtatattttcgtttgttctgctagatactcgtgacaacagttttatagtggcacgagatgcaattggggtcacttccttgtacattggttggggtctagatggctctgtctggatttcatcagaattgaaggggttgaatgatgattgcgaacattttgagtcttttccacctggtcacttgtactctagcaaagagagagcgtttcgcagatggtacaatcctccatggttctctgaggctattccctcagcaccttatgatcctcttgctttgaggcatgcctttgagaaggctgtggtaaaaaggttgatgactgatgttccctttggtgttttgctctctggaggtttggactcttcattggttgcagccgtcacggctcgctacctggcaggcacaaatgctgccaagcaatggggaaccaaattacactctttctgtgtaggccttgagggtgcacctgacctaaaggcagcaaaggaagtagcagactacataggtactgtacatcatgaatttcactacactgttcaggatggcatagatgccattgaggatgtgatctatcacattgaaacatatgatgtgacaacaattagagcaagcattcccatgtttcttatgtctcgtaagatcaagtcattgggagtcaaatgggttatatctggagaaggatctgatgagatctttggagggtatctatatttccacaaggcaccaaacaaagaagaatttcatcaagaaacatgccgcaagattaaagcactccacaaatatgattgcttgcgagccaataaatcgacctttgcctggggtctagaagccagagtgccatttttggacaaagattttatcagagttgcaatgaacattgatcctgagtataaaatgattaaaaaggaagaagggcgaattgagaaatgggtactgaggagggcctttgatgatgaagaacatccttatctgccaaagcacattttatacaggcagaaagaacaattcagtgatggagttggctatggttggattgatggccttaaagctcatgctgagaaacatgtgactgatagaatgatgctcaatgctgctaacattttccccttcaacacaccaaccaccaaagaagcatactactatagaatgatatttgagaggttcttccctcagaactcagccaggctgagtgttcctggaggaccaagtgttgcatgtagcacagccaaagctgttgagtgggatgctgcttggtctaacaaccttgatccatctggtagagcagcacttggagtgcatgcatcagcttatggaaatcaggtcaaagctgtagaaccagagaagatcataccaaagatggaagtttctccactaggagttgccatatagagctagtatgagccatagcaaaaactagtagttgccctagaaccaaaatatattattatactagtcatcaatgactcattaatcatcataaatgaaaatttggcctgctgtgtagtttattcaggcaaggctatatataaatagataaggctctctatctagctgtcttaagtgttgttccatccacatcttgtcttcgttttctatttatgtcatctgagcactatcatgatgtactggatttccaagaaaatgttcagttaaatttgaatgcaaagttcactatttcagactttc

SEQ ID NO: 2194 - DNA, 1740 bp, Glycine max var. Williams 82
atgtgtggcatacttgctgtgcttggttgctctgattcatctcaagccaaaagggttcgcgtccttgagctttctcgcagattgaagcaccgtggtcctgactggagtgggctccaccaatatggtgataactatttggctcatcaaaggttagccatagttgatccagcttctggtgatcaacccctcttcaatgaagacaaaactgtcgtggttacggtgaatggagagatctacaatcatgaagaactcaggaaacagttgcctaatcacaccttccgtacaggaagtgactgtgatgttattgctcacctgtatgaggagcacggagaaaactttgtggacatgcttgatggtatattttcgtttgttctgctagatactcgtgacaacagttttatagtggcacgagatgcaattggggtcacttccttgtacattggttggggtctagatggctccgtctggatttcatcagaattgaaggggttgaatgatgattgcgaacattttgagtcttttccacctggtcacttgtactctagcaaagagagagcgttccgcagatggtacaatcctccatggttctctgaggctattccctcagcaccttatgatcctcttgctttgaggcatgcctttgagaaggctgtggtaaaaaggttgatgactgatgttccctttggtgttttgctctctggaggtttggactcttcattggttgcagccgtcacggctcgctacctggcaggcacaaatgctgccaagcaatggggaaccaaattacactctttctgtgtaggccttgagggtgcacctgacctaaaggcagcaaaggaagtagcagactacataggaactgtacatcatgaatttcactacactgttcaggatggcatagatgccattgaggatgtgatctatcacattgaaacatatgatgtgacaacaattagagcaagcattcccatgtttcttatgtctcgtaagatcaagtcattgggagtcaaatgggttatatctggagaaggatctgatgagatctttggagggtatctatatttccacaaggcaccaaacaaagaagagtttcatcaagaaacatgccgcaagattaaagcactccacaaatatgattgcttgcgagccaataaatcgacctttgcctggggtctagaagccagagtgccatttttggacaaagattttatcagagttgcaatgaacattgatcctgattataaaatgattaaaaaggaagaagggcgaattgagaaatgggtactgaggagggcctttgatgatgaagaacatccttatctgccaaagcacattttatacaggcagaaagaacaattcagtgatggagttggctatggttggattgatggccttaaagctcatgctgagaaacatgtgactgacagaatgatgctcaatgctgctaacattttccccttcaacacaccaaccaccaaagaagcatactactatagaatgatatttgagaggttcttccctcagaactcagccaggctgagtgttcctggaggaccaagtgttgcatgtagcacagccaaagctgtagagtgggatgctgcttggtctaacaaccttgatccatctggtagggcagcacttggagtgcatgcatcagcttatggaaatcaggtcaaagctgtagaaccagagaagatcataccaaagatggaagtttccccactaggagttgccatatag

SEQ ID NO: 2195 - DNA, 2246 bp, Glycine max var. Williams 82
acttaactctttcaacttggaacccttctacgtgttctccattccctctctcactcctccatctacgtttcttaaatcatttccttctttctctctttctttatcttctcattttcctcattacactcttttttttctctcaacttttctcttattaaccatagttcacatattatatcatcacatatcatagtgatatattatatcatatcacaatgtgtggcatacttgctgtgcttggttgctctgattcatctcaagccaaaagggttcgcgtccttgagctttctcgcagattgaagcaccgtggtcctgactggagtgggctccaccaatatggtgataactatttggctcatcaaaggttagccatagttgatccagcttctggtgatcaacccctcttcaatgaagacaaaactgtcgtggttacggtgaatggagagatctacaatcatgaagaactcaggaaacagttgcctaatcacaccttccgtacaggaagtgactgtgatgttattgctcacctgtatgaggagcacggagaaaactttgtggacatgcttgatggtatattttcgtttgttctgctagatactcgtgacaacagttttatagtggcacgagatgcaattggggtcacttccttgtacattggttggggtctagatggctccgtctggatttcatcagaattgaaggggttgaatgatgattgcgaacattttgagtcttttccacctggtcacttgtactctagcaaagagagagcgttccgcagatggtacaatcctccatggttctctgaggctattccctcagcaccttatgatcctcttgctttgaggcatgcctttgagaaggctgtggtaaaaaggttgatgactgatgttccctttggtgttttgctctctggaggtttggactcttcattggttgcagccgtcacggctcgctacctggcaggcacaaatgctgccaagcaatggggaaccaaattacactctttctgtgtaggccttgagggtgcacctgacctaaaggcagcaaaggaagtagcagactacataggaactgtacatcatgaatttcactacactgttcaggatggcatagatgccattgaggatgtgatctatcacattgaaacatatgatgtgacaacaattagagcaagcattcccatgtttcttatgtctcgtaagatcaagtcattgggagtcaaatgggttatatctggagaaggatctgatgagatctttggagggtatctatatttccacaaggcaccaaacaaagaagagtttcatcaagaaacatgccgcaagattaaagcactccacaaatatgattgcttgcgagccaataaatcgacctttgcctggggtctagaagccagagtgccatttttggacaaagattttatcagagttgcaatgaacattgatcctgattataaaatgattaaaaaggaagaagggcgaattgagaaatgggtactgaggagggcctttgatgatgaagaacatccttatctgccaaagcacattttatacaggcagaaagaacaattcagtgatggagttggctatggttggattgatggccttaaagctcatgctgagaaacatgtgactgacagaatgatgctcaatgctgctaacattttccccttcaacacaccaaccaccaaagaagcatactactatagaatgatatttgagaggttcttccctcagaactcagccaggctgagtgttcctggaggaccaagtgttgcatgtagcacagccaaagctgtagagtgggatgctgcttggtctaacaaccttgatccatctggtagggcagcacttggagtgcatgcatcagcttatggaaatcaggtcaaagctgtagaaccagagaagatcataccaaagatggaagtttccccactaggagttgccatatagagctagtatgagccatagcaaaaactagtagttgccctagaaccaaaatatattattatactagtcatcaatcactcattaatcatcataaatgaaaatttggcctgctgtgtagtttattcaggcaaggctatatataaatagataaggctctctatctagtcgtctttgtgccatccacatcttgtcttcgttttctatttatgtcatctgagcactatcataatgtactggatttctaagaaaatgttcagttaaatttgaatgcaaagttcactatttcagactttc

SEQ ID NO: 2196 - DNA, 573 bp, Glycine max var. Williams 82
atggaactgctgctccagccaccaccacgtccacccagcgatgacagtggcgaacagcaccagctagtgcctcctcaagtacatcctctcacggtctcattcctccatgccaagaaccccgacgagacttctccccaaaccaccgccacggacaccaagctccgcggcaagggagcgccacaggaggagtttagtgtcgaccacgtgctgaccaagcgccaccgtcgtgagaagctgaatcataaacaagctgaaccccggaacactgagctagctgtcaaattgttacataaagcttctgtttgtgggaatctttgtgcccagtaccagcttgggctttgtctgcatcgcggtggtgggagggcaaaatggtatatgaaagttgcagagggtgggtatgtctatgctatgttcaatatctccttgtgcttctcctttggggaaggattgacacgtaaccatcaactagcaagaaaatggatgaagcgggctgcggatcgtggccatagtaaagctcaatttgaggacatgctctcttttatgttaaagagaagcgaggagaaattcaaataa

SEQ ID NO: 2197 - DNA, 1359 bp, Glycine max var. Williams 82
atgaagaaaacaccagcccccagtttgcataaatctaaccaaagaaaaaagaatgttggattccaagatagaggtgcagccaatggtacacagagtcaccatgttgagagccattctgctctgacatatttcaagtcttccttcaagaaattttttacattgtttctctctgggaagcgaaaaacagactcagaagctgctgaaagtgatgacagaaagaatacacacaaagttagaggggtatcatcttccacagatgtatcatctgatagttccaagagttcatcaaaaagggtgttttctcattgctctgcatcatctggcactgcaagtagtaagcttggaatgggaaacttcacctttgaggagatttacaaggcaacagcaaagttctctctagagaataagattggggaaggcgcgtttggaacagtgtataagggaaagcttaatgatggaacccttgtggctgtaaagcgtgccaagaaggatttactaaacaagaacttagctgagttcaagaatgaaataaacaccttgtcgaaaattgagcacattaaccttgtaaggtggtatggatatttggagcatggacatgaaaagattattgttgttgaatatattagtaatggaactcttcgggaacatttagatggtattcggggagatggactagaaattggtgagcgtctagacatagcaattgacatagctcatgcaattacttaccttcatatgtacacagatcatccaattattcatagagacgtcaaagcatcaaatatcttaatcaccgataaactaagggccaaagttgcagacttcggttttgctcggttgggaccagaagaccctggtgcaacccatatttcaactcaaattaaaggaacagctggttacatggatcctgattacatgcgaacgcgacatctctccgaaaagagtgatgtttattccttcggcgtgctgcttgttgaaatgatgacaggaagatatccagttgaaccacagagacctcccaatgagagagttacaattaaatgggcaatgcagttgttgagacaaaaagaagttgtgattgccatggatccaagattgaggagaaatccaacctccaacaaggcagtgcaaaaggttctcaagctagctttccaatgccttgcaccggtgagacgatcacgaccatctatgaagagttgtgcagaggttctatgggagattcgtaaagattttaaagaaaaagcattttctcatcctcctcaccattctgcagatttccctcaaagagatgctaggaagaatagacataagacatatggtattgaagacagtaaaggctataaatttgtatttgcataa

SEQ ID NO: 2198 - DNA, 489 bp, Glycine max var. Williams 82
atgcagacatggaaagggggagaggatgccaaccatacctattttaacagcaaggctatgctatgttatgagtttaatgcagaggcaaatcatgatttgtgtcccaagtgtatatatgcgtatgtcccatcggtgatactgataaagcgtcctccatatgaagaacccctggattggccaactcggaaaagagtagctttgggatctgcaatgggtctttcatatttgcatgatcattgtgacccaaagattattcatcgtgatgtgaaggctgccaacatattgctggatgaagagtttgaggctgttgttggggactttggattggccaaacttatggattacaaggacacggtgaaaattcaaaaaaacctggggctgctcataatgttcgactatattcaattgcttccacaaggtatggggacttttttgatggaaaaactgccagcttgtgtgtgcgtcgtgctgtttattatgatcctgtga

SEQ ID NO: 2199 - DNA, 3603 bp, Glycine max var. Williams 82
aacgatggtcgtttaataaccaccttcattactagcaataaggagtactatgacgggtcccgtgttgaccatagtagttgtattggtaatccaaagacagtcttttcattctgattgtctttgaataagctttttctcttcccttcaaaatccagctcctaagctcctcgcatattatctctctctctctaaaatcacaaattacaaaattccttccattttctctctaaaaccgtcatgacctccattgcgcctcttgtcctccctatctccaacccccaaaccaccgcgggaacctccagtgcaggcggcggtgccatcgaggttccaacgaacaacctggccttcggcgatcatcaccctccgcggttctctcttggatcctcttcggggccccaacaatgccgtcgccaagtgacgcgcctcctctgcgaagaagcgtgtggttattacggataaggctcgcgtcggtgttcaggaacgacgtggaggggttatatgagaagcttctcgctggtgagagcagcatcacccccatcgaccgcttcgacgcctccaagttccgcacgtgctttggcagccaaatccgcggcttctccgccgagggctacatggacgacaagaacgatcgccgcttcaacgactgcctccactactgcattgtcgccggcaaaaaggccctcgaaaatgccgacctcgccccaaacaagcactccaaggattgaagttttgctgctctggtacagcgtttgttgacatggaaagggggagaggatgccaaccatacctattttaacagcaaggctatgctatgttatgagtttaatgcagaggcaaatcatgatttgtgtcccaagtgtatatatgcagcgtcctccatatgaagaacccctggattggccaactcggaaaagagtagctttgggatctgcaatgggtctttcatatttgcatgatcattgtgacccaaagattattcatcgtgatgtgaaggctgccaacatattgctggatgaagagtttgaggctgttgttggggactttggattggccaaacttatggattacaaggacacggtgaaaattcaaaaaaacctggggctgctcataatgttcgactatattcaattgcttccacaaggtatggggacttttttgatggaaaaactgccagcttgtgtgtgcgtcgtgctgtttattatgatcctgtgacaggaaaggaagatccttccaagaatggcatttgtagcaattttttgtgtaactcaaagccatgaaacaaaattcagatcacagtagtggttgtgtttgaagattgagggctatatatcttttgggtcgaattataattcgatcctcataacttagcattgatgcatgttgtgcttgaggttcaaggactatttatccttccgatcggatcacaatttgatctcacaatttagcctcaccttatgcttgagacttgaaggttatgtatccttcggattgaattatgcgaccatgcatttccttggttggactttatttgatctgtttgttttagtatataagtgtttgatccatttagtctcggaataataaatgtgtcgtaagactaacattggagacaatcatgtatccaaatccttcatatatgagagaatattttgatatgtcataatgactcaatccataaatattagaaataatatgcataatagactaagataaaaaaaggtcctctcattaacctagaaagatagattaaagaatacattttatttaagtgttttgaaataggtcactttcagaaaccttttctaattatgaagtacaaatacacacccacacacatacacccacccacacaccacacacgcacgcgcacacacacacacacacacacatatatatatatatatatatatatatatatatatatatataaaaatcaaagggtaaaaatacataattaagaattatgataaggaatcacaatcaatagcaataacgaaaccgaccaaatcaattaaataattgttgctattaattatttaatcattgttatacgattcaaaattattaaaaatcaatcaattaaaaaaaaggctcacaaaaaaaaaaaatcaaattttactaatttcaggaataagtttttgccaaataaataattaaataatacatctaatgtatccatctacagtgttttttgacaaataaaaacacatcaaatcatatggattatgaaagcaatggcaatactaggtggggttaatcttcaggcaactgcattccatgattaagtttctaaataaatgtaaagtaaacttagaaaagaaaatttccaaaagattataaaactaatttatttgcccacatgcactgcaaaatgcaaaaatactccctccggtatggttgcaagcaataaaaatcttttattttttttcttaaatataaattaatttcacttacgtcttatttttttaaaaaaaaaaactctctaaaatagttttcatttaataaggctaagaattattttagggtaaatagtcattttcgtccgtaaatgtatagaacagtaacagattcatctccaaacaacggaaattcaaattttagtctctgaaagtgaaaaaagtgcgacaaattcattcatccgttaacttccatctattaccattaatgaaagagcctatgtggctcggagggatgaaaatgcgacaaaaatgattgccaacatgtctgttgaatcaatttaaccaaaatgtaagtaagttttcattagaccaaaatgttaataagtttccattggaataatttgttaaaaaaaaatttcatttaagaataaaatatattttaatcttcatctttccactccccctttttatcgttgcaaatataactttaataatgaacataataatgaacataatatttattaataagcataatttgtccattgctcttaaatttctaatgtaataataccttatataaaatatgagactcaaacaaaaatacacaaccattaagttaattcttacaaaaaatgagatccaacttaattttatcactacctaatgttgtcgcaatagaaattttagagcaacagatacgttatgcttattaaccaatattatgtttattgttatgttttgtctaacttatgcttgtttttctatttttttaaagtacttattgtaatgttatacttgaaacgataaaaagtggggagggacggggaggaaaaatgaagattaaattatatgttacccttaaatgaaatgaaatttggagtctgacaaattagttcaatgaaaactcacattttggtctaatggaaacttagtgacattttgtttcaatatattcatcaactatgtaggctctttcattaacggtgacagatgaaaattaacgaatgaatgaatttgtcgcactttttcactttcggggactaaaatttgaattttaatattttaaaaacgaattttgtagcgctttatacattaagagacaaaaatgattatttatccattattttatgtttgatatcaaatttcaatgaatgatagtttagaaaaaattatttttaattgaaaataacaaaatttaatgaag

SEQ ID NO: 2200 - DNA, 4237 bp, Glycine max var. Williams 82
aacgatggtcgtttaataaccaccttcattactagcaataaggagtactatgacgggtcccgtgttgaccatagtagttgtattggtaatccaaagacagtcttttcattctgattgtctttgaataagctttttctcttcccttcaaaatccagctcctaagctcctcgcatattatctctctctctctaaaatcacaaattacaaaattccttccattttctctctaaaaccgtcatgacctccattgcgcctcttgtcctccctatctccaacccccaaaccaccgcgggaacctccagtgcaggcggcggtgccatcgaggttccaacgaacaacctggccttcggcgatcatcaccctccgcggttctctcttggatcctcttcggggccccaacaatgccgtcgccaagtgacgcgcctcctctgcgaagaagcgtgtggttattacggataaggctcgcgtcggtgttcaggaacgacgtggaggggttatatgagaagcttctcgctggtgagagcagcatcacccccatcgaccgcttcgacgcctccaagttccgcacgtgctttggcagccaaatccgcggcttctccgccgagggctacatggacgacaagaacgatcgccgcttcaacgactgcctccactactgcattgtcgccggcaaaaaggccctcgaaaatgccgacctcgccccaaacaagcactccaaggattgaagttttgctgctctggtacagcgtttgttgagaattttattttatgcagacatggaaagggggagaggatgccaaccatacctattttaacagcaaggctatgctatgttatgagtttaatgcagaggcaaatcatgatttgtgtcccaagtgtatatatgcgtatgtcccatcggtgatactgataaagcgtcctccatatgaagaacccctggattggccaactcggaaaagagtagctttgggatctgcaatgggtctttcatatttgcatgatcattgtgacccaaagattattcatcgtgatgtgaaggctgccaacatattgctggatgaagagtttgaggctgttgttggggactttggattggccaaacttatggattacaaggacacggtatggggacttttttgatggaaaaactgccagcttgtgtgtgcgtcgtgctgtttattatgatcctgtgacaggaaaggaagatccttccaagaatggcatttgtagcaattttttgtgtaactcaaagccatgaaacaaaattcagatcacaggtaagagctagctctttttactccaccgaagattgacataatttctgatatcttttataacttctcaaaatttgtattccaacaaagtgatgccttggtgaaccttgctcagttgggagaatgtcttgctcagttgtttcttgttattcctgttgccataggtgtgttctatgtacttcactagagggtgggtttgcaaagtaatacttgaatgtgccttgctctaggaacttctttactatttgaaatctgcattgttgactgctatttatttgctggttaatcaattggaatttatactatgcatggtgtgctctgcatgtgaaagtagcaacttacttaaataatagatgaggcaattgagggtacaaaaaatattttttttaaaaataatacattttaagacagttgtctttataaccgtcttagaatgtaacacattttacatcggtcgtgtgaataggaccgacgtagaatatattacattctaaaatggtcatagagacaaccgtcttagaaagttcacacattctaagacggtcgttaaaaaccatcgtcgtaaacgtgttcttttctatgatatctgttacgacaacagttaataatcgatgttgtattaatcaaataaccgatgtacaataacgtttatgcagtagtggttgtgtttgaagattgagggctatatatcttttgggtcgaattataattcgatcctcataacttagcattgatgcatgttgtgcttgaggttcaaggactatttatccttccgatcggatcacaatttgatctcacaatttagcctcaccttatgcttgagacttgaaggttatgtatccttcggattgaattatgcgaccatgcatttccttggttggactttatttgatctgtttgttttagtatataagtgtttgatccatttagtctcggaataataaatgtgtcgtaagactaacattggagacaatcatgtatccaaatccttcatatatgagagaatattttgatatgtcataatgactcaatccataaatattagaaataatatgcataatagactaagataaaaaaaggtcctctcattaacctagaaagatagattaaagaatacattttatttaagtgttttgaaataggtcactttcagaaaccttttctaattatgaagtacaaatacacacccacacacatacacccacccacacaccacacacgcacgcgcacacacacacacacacacacatatatatatatatatatatatatatatatatatatatataaaaatcaaagggtaaaaatacataattaagaattatgataaggaatcacaatcaatagcaataacgaaaccgaccaaatcaattaaataattgttgctattaattatttaatcattgttatacgattcaaaattattaaaaatcaatcaattaaaaaaaaggctcacaaaaaaaaaaaatcaaattttactaatttcaggaataagtttttgccaaataaataattaaataatacatctaatgtatccatctacagtgttttttgacaaataaaaacacatcaaatcatatggattatgaaagcaatggcaatactaggtggggttaatcttcaggcaactgcattccatgattaagtttctaaataaatgtaaagtaaacttagaaaagaaaatttccaaaagattataaaactaatttatttgcccacatgcactgcaaaatgcaaaaatactccctccggtatggttgcaagcaataaaaatcttttattttttttcttaaatataaattaatttcacttacgtcttatttttttaaaaaaaaaaactctctaaaatagttttcatttaataaggctaagaattattttagggtaaatagtcattttcgtccgtaaatgtatagaacagtaacagattcatctccaaacaacggaaattcaaattttagtctctgaaagtgaaaaaagtgcgacaaattcattcatccgttaacttccatctattaccattaatgaaagagcctatgtggctcggagggatgaaaatgcgacaaaaatgattgccaacatgtctgttgaatcaatttaaccaaaatgtaagtaagttttcattagaccaaaatgttaataagtttccattggaataatttgttaaaaaaaaatttcatttaagaataaaatatattttaatcttcatctttccactccccctttttatcgttgcaaatataactttaataatgaacataataatgaacataatatttattaataagcataatttgtccattgctcttaaatttctaatgtaataataccttatataaaatatgagactcaaacaaaaatacacaaccattaagttaattcttacaaaaaatgagatccaacttaattttatcactacctaatgttgtcgcaatagaaattttagagcaacagatacgttatgcttattaaccaatattatgtttattgttatgttttgtctaacttatgcttgtttttctatttttttaaagtacttattgtaatgttatacttgaaacgataaaaagtggggagggacggggaggaaaaatgaagattaaattatatgttacccttaaatgaaatgaaatttggagtctgacaaattagttcaatgaaaactcacattttggtctaatggaaacttagtgacattttgtttcaatatattcatcaactatgtaggctctttcattaacggtgacagatgaaaattaacgaatgaatgaatttgtcgcactttttcactttcggggactaaaatttgaattttaatattttaaaaacgaattttgtagcgctttatacattaagagacaaaaatgattatttatccattattttatgtttgatatcaaatttcaatgaatgatagtttagaaaaaattatttttaattgaaaataacaaaatttaatgaag

SEQ ID NO: 2201 - DNA, 810 bp, Glycine max var. Williams 82
atggcaagtatttctactgtctcggttcttgatagaaggcttgaagggaaagtggctcttatcagtggtggtgctagcggtataggtgaggccactgcaagactcttctctaagcatggagcacacgttgtgatagctgatattcaagacgatttgggtctctctctttgcaaacacttggaatccgcttcctatgtccattgcgatgtcacaaacgaaaacgacgttcaaaacgccgttaacacagcgatttccaagtatggcaatctagatatcatgtttaataatgctggcataattgatgagataaaaacaagcatacttgacaacagcaagtttgattttgagagagtgataagtgtgaacttggttggtccttttctgggaacaaagcacgctgctagggttatgattcctgctaaaaggggaagcataattaacactgctagtgttgctggaacctttagtggaggggcttcacatgcctacacaagttcaaagcacgcactaattggactgatgaaaaacactgcggtggagcttggacagtttggtattagggtaaattgcttgtccccttatgtggttgccacaccattgactaagaaatgtttcaatcttgatgaagaccgaaatggtgagatttattccaacctaaaaggtgttcatcttgtgccaaacgatgtggccgaagctgctctatatttggcaggtgatgagtcaaagtatgttagtggtcacaatcttgtgttagatggagggttcaccaatctaaatgtaggattttctgtgtttgggcagtctgagtaa

SEQ ID NO: 2202 - DNA, 1093 bp, Glycine max var. Williams 82
ttatggtacatccttcacgatcacataattaagcaattacgtttaacactctaaaacatctctcgttggctatattatatatcctgaaaagctcactcatggcaagtatttctactgtctcggttcttgatagaaggcttgaagggaaagtggctcttatcagtggtggtgctagcggtataggtgaggccactgcaagactcttctctaagcatggagcacacgttgtgatagctgatattcaagacgatttgggtctctctctttgcaaacacttggaatccgcttcctatgtccattgcgatgtcacaaacgaaaacgacgttcaaaacgccgttaacacagcgatttccaagtatggcaatctagatatcatgtttaataatgctggcataattgatgagataaaaacaagcatacttgacaacagcaagtttgattttgagagagtgataagtgtgaacttggttggtccttttctgggaacaaagcacgctgctagggttatgattcctgctaaaaggggaagcataattaacactgctagtgttgctggaacctttagtggaggggcttcacatgcctacacaagttcaaagcacgcactaattggactgatgaaaaacactgcggtggagcttggacagtttggtattagggtaaattgcttgtccccttatgtggttgccacaccattgactaagaaatgtttcaatcttgatgaagaccgaaatggtgagatttattccaacctaaaaggtgttcatcttgtgccaaacgatgtggccgaagctgctctatatttggcaggtgatgagtcaaagtatgttagtggtcacaatcttgtgttagatggagggttcaccaatctaaatgtaggattttctgtgtttgggcagtctgagtaaaaaatgtcttttaataattatagtgttggtgttttgatgactgtgtttagagggcactgcagttccgaaactttatctgccagcgtatgtgaagaaaagcaatatagggtattataagcctcattccacgtacactagccgtttttgtatttgtatgtaaaaattggatgaaattggtttcatat

SEQ ID NO: 2203 - DNA, 2439 bp, Glycine max var. Williams 82
atgaaggttcaagaaacgaggtcgcatgttcatgcacctggggaagaagagaaggtgatgacaaggaagcagaaggctgagtccaaggcacatgaagtggagcattctccaaagaaggccaaggtggaaaaagaagatggccaaatcaacggaaaatctgaaactggagttgcagaagaatatgatgagttctgcaaagtaacaaacgagcaccttcctttggaacaaatgagagagattatggaggctaatagccttgattcttctggctctgatcttgaaattgcaagaagatgccaagacttgctgttttatggtgcattggacaaatgctcggtttgcaatgggagtttggagttcgatggaagacgttatgtttgcagagggttctacagtgagtgggctagttgcactttcagcaccagaaaccctccaaggaaacaagaacccattaagttacctgattctgttcaggactctctggcttcagatttgctaaagaaatatcaggacccgagtcacaggcctcacagggatctaggcttagctgaaaaaccctttactggaatgatgatatctctgatgggtcgtcttactcggacacatcattattggaaaacaactattgaaaagcatggaggaaaggtggcaaactctataattggggcaacttgtttggtagcttcacctgctgagcgagaacgtggtggcacatccaaacttgcagaagccatggagaggggtataccagtggttagggaggcttggttgattgacagcatcgaaaagcaagaacctcagcctttggaatcttatgatcttgtctctgatctttctgtggatggcaagggtatcccctgggacaaacaagatcctggggaagaggctattgaatcactctcagcagaactcaagctttatgggaagagaggggtctataaagattccaagttgcaggaacaaggtggaaagatatttgaaagagatgggatattatacaactgtgccttctctgtttgtgaccaagggctaggactgaatgactattgcgtcatgcaactgattgttgtcccagagaatcctttgcatctgtactttaaaaaagggagagttggcgatgatccaaatgcagaggagcaattagaagagtgggacaatgtggatggtgctctgaaagagtttgcgaggctctttgatgaaataacaggaaatgagtttgaaccttgggaaagagagaagaagttccagaagaagccattgaagttttaccccattgacatggatgatggagttgaagttagacatggcgcactaggtcttcggcagctggggatagcagcgacacactgcaaacttgagcctttggttgcaaattttatgaaggtcttgtgcagccaggagatatacaagtatgcattgatggagatgggttatgactctccggaccttccaattggaatggttacaaatcttcatctgaaaagatgtgaggacgttctcttagaattcatagacaagatgaaatcactgaaagaaactgggcccaaggctgaggctgtgtggactgattttagccaaagatggttcactctgatgcactccacaaggcctttcaattttagagattatcaagagattgcagagcatgctgctgctgcgttagagggggtgagagacataacccaggcttctcacctcataggagatatgacaggctcaaccattgatgaccctttatcagagacatacaagaaattgggctgctcaatttctgccttggacaaaagttcagatgattatgagatgattgtgaaataccttgaaaaaacttatgagccggtcaaagttggtgacattgaatatggggtgtcagtggaaaacatttttgcggttcaaacaggtggttgcccttcctatgaagacatagtaaaattgccaaataaggttcttctatggtgtggatcacgaagctcaaacctcttgaggcacttacacaagggattctcgccagcaatatgctcattacctgttccgggttatatgtttggcaaagctattatctgttctgatgctgcagcagaggctgcaagatatggttttacagctgtggacaggccagaagggttcttagttttggccattgcttctctaggaaatgagattaccgagttgaaaagcccacctgaggatacatcatctttggaggaaaagaaggttggagtgaagggactggggaagaagaaaacagatgaatcagagcattttgtttggaaagacgatataaaagttccttgtggtaaactagttgcctcagaccatcaagatagccccctggaatacaacgagtatgctgtctacgataaaaagcaggcacgcataagctacttggtgggagtgaagtatgaagagaagggtgcagtgattgacacagctgaatga

SEQ ID NO: 2204 - DNA, 2932 bp, Glycine max var. Williams 82
ttcagggatcaatcaaaagcttatttagtgcacatcatgtgcaagtccttcagactctgaactacatgcttggcttttgttcatcgtagtaatatagaggtctttcattattcagtttgatttagcaccaagatgaaggttcaagaaacgaggtcgcatgttcatgcacctggggaagaagagaaggtgatgacaaggaagcagaaggctgagtccaaggcacatgaagtggagcattctccaaagaaggccaaggtggaaaaagaagatggccaaatcaacggaaaatctgaaactggagttgcagaagaatatgatgagttctgcaaagtaacaaacgagcaccttcctttggaacaaatgagagagattatggaggctaatagccttgattcttctggctctgatcttgaaattgcaagaagatgccaagacttgctgttttatggtgcattggacaaatgctcggtttgcaatgggagtttggagttcgatggaagacgttatgtttgcagagggttctacagtgagtgggctagttgcactttcagcaccagaaaccctccaaggaaacaagaacccattaagttacctgattctgttcaggactctctggcttcagatttgctaaagaaatatcaggacccgagtcacaggcctcacagggatctaggcttagctgaaaaaccctttactggaatgatgatatctctgatgggtcgtcttactcggacacatcattattggaaaacaactattgaaaagcatggaggaaaggtggcaaactctataattggggcaacttgtttggtagcttcacctgctgagcgagaacgtggtggcacatccaaacttgcagaagccatggagaggggtataccagtggttagggaggcttggttgattgacagcatcgaaaagcaagaacctcagcctttggaatcttatgatcttgtctctgatctttctgtggatggcaagggtatcccctgggacaaacaagatcctggggaagaggctattgaatcactctcagcagaactcaagctttatgggaagagaggggtctataaagattccaagttgcaggaacaaggtggaaagatatttgaaagagatgggatattatacaactgtgccttctctgtttgtgaccaagggctaggactgaatgactattgcgtcatgcaactgattgttgtcccagagaatcctttgcatctgtactttaaaaaagggagagttggcgatgatccaaatgcagaggagcaattagaagagtgggacaatgtggatggtgctctgaaagagtttgcgaggctctttgatgaaataacaggaaatgagtttgaaccttgggaaagagagaagaagttccagaagaagccattgaagttttaccccattgacatggatgatggagttgaagttagacatggcgcactaggtcttcggcagctggggatagcagcgacacactgcaaacttgagcctttggttgcaaattttatgaaggtcttgtgcagccaggagatatacaagtatgcattgatggagatgggttatgactctccggaccttccaattggaatggttacaaatcttcatctgaaaagatgtgaggacgttctcttagaattcatagacaagatgaaatcactgaaagaaactgggcccaaggctgaggctgtgtggactgattttagccaaagatggttcactctgatgcactccacaaggcctttcaattttagagattatcaagagattgcagagcatgctgctgctgcgttagagggggtgagagacataacccaggcttctcacctcataggagatatgacaggctcaaccattgatgaccctttatcagagacatacaagaaattgggctgctcaatttctgccttggacaaaagttcagatgattatgagatgattgtgaaataccttgaaaaaacttatgagccggtcaaagttggtgacattgaatatggggtgtcagtggaaaacatttttgcggttcaaacaggtggttgcccttcctatgaagacatagtaaaattgccaaataaggttcttctatggtgtggatcacgaagctcaaacctcttgaggcacttacacaagggattctcgccagcaatatgctcattacctgttccgggttatatgtttggcaaagctattatctgttctgatgctgcagcagaggctgcaagatatggttttacagctgtggacaggccagaagggttcttagttttggccattgcttctctaggaaatgagattaccgagttgaaaagcccacctgaggatacatcatctttggaggaaaagaaggttggagtgaagggactggggaagaagaaaacagatgaatcagagcattttgtttggaaagacgatataaaagttccttgtggtaaactagttgcctcagaccatcaagatagccccctggaatacaacgagtatgctgtctacgataaaaagcaggcacgcataagctacttggtgggagtgaagtatgaagagaagggtgcagtgattgacacagctgaatgatgaaccaaaaaggatgaaaggaaagcttttttgtaatgcaggagttgaaagatatgaccatcttgtctgaagatgtactagtggtttctctagttggtggaagatctgtcattttgatgtatatttacgtgtgacaaaataggctgtatatggtgtcacattttgatgtatgtatagttaaattgcccaagttagggtaagtaaatattttgtcctactcatgactgcatgagaatggaactacatctaacactatgttgtttaagtcttagttgactagtactactcagcgactagtactactcagtctgtatgaatgatatgatgagtagaagaaatggtataatgatgtcctttatat

SEQ ID NO: 2205 - DNA, 2277 bp, Glycine max var. Williams 82
atggggtttgccaaaattttaagctctttcaccgttctgttcattgggtataccttggtgaatggatccaccccaaagcattatatagtttacatgggagatcattcacaccccaattcagaatctgtaatcagagcaaaccatgagatactagcttcagttactggaagccttagtgaagcaaaggcagcagcactccaccattacagtaaaagcttccaaggcttctcagctatgattacaccagtgcaagctagtcaacttgcagaatataaatcagtagtgtccgtatttgagagcaaaatgaataaacttcacacaacacattcttgggattttcttggattagaaactatcaacaagaacaatcctaaagcactggacaccacatccgatgtcattgttggtgtcattgactctggcatctggccggaatcggaaagcttcactgattatggattaggtcctgtgcccaaaaaattcaagggagagtgtgttactggtgaaaaatttacactagccaattgcaacaagaaaattattggtgctcggttctattcaaaagggattgaggcagaagttggtcctctagagactgctaacaagatttttttccggtcagctcgggatggtgatggacacggaacacacacggcttccacaatagcagggtccattgttgctaatgccagcttattaggcattgccaaaggaaccgctagaggtggtgccccaagcgcgagacttgcaatttacaaggcatgttggtttgatttctgcagtgatgctgatgttctttctgccatggatgatgccatccatgatggggttgacatactatctctttcccttggccctgaccctccgcagccaatttacttcgagaatgcaatcagtgtaggagcattccatgcattccaaaagggtgttcttgtttctgcttctgctgggaactcagtttttccacgtactgcatgcaatgttgctccttggatcctcactgttgctgctagcacaatagacagggaattcagttcaaatatctaccttggtaactcgaaggttttaaagggttcttctttaaatccaataagaatggagcattcgaatggtttaatatatggaagtgccgctgcagctgcaggagtttcagcaacaaatgcaagcttctgcaagaacaatactctagatcctaccttaatcaagggtaaaattgtaatctgcacaattgagactttcagtgatgacagacgagccaaggccatagcaataaggcaaggagggggtgtcggaatgatacttattgatcataatgccaaagatattggttttcaatttgtcatcccaagcactctcattggtcaggatgccgtacaagagcttcaagcatatataaagacagataagaatcccactgctataatcaacccaacaataactgtagtcggtaccaaacctgctccagaaatggcagctttttcttccattggaccaaatataataacaccagacattattaagcctgacataacagcacctggagtgaatattttggcagcatggtctccagtggcaactgaagccacagttgaacatcgatctgtcgactataacatcatttccggaacatcaatgtcttgcccacatgtaactgcagttgcggcaattataaaatctcaccacccacactggggtcctgcagccataatgtcttcaataatgacaacagcgacagttattgataacacacgtcgagtcataggaagagatccgaatggaacacaaaccacaccatttgactatggatctggacatgttaatccggttgcatcactcaatcctggattagtatatgattttaattcccaagatgttctcaattttctgtgcagcaatggggcaagcccggcacaacttaagaacctcactggggttattagtcaatgtcagaaacctcttacagcttcctccaacttcaattacccttcaattggtgtgtccagcttgaatggaagtttatcagtgtatcgtacagttacttattatggtcaggggccaacggtatatcgtgcaagcgttgaaaatccatctggtgtgaatgttaaagttacacctgcagaattgaagtttgtgaaaactggggaaaaaataactttcaggattgatttcttccctttcaagaacagcgatggaagctttgtgtttggtgctttgatatggaacaatggcatacaaagggttaggagtcctattggtctcaatgtactatctacttaa

SEQ ID NO: 2206 - DNA, 2426 bp, Glycine max var. Williams 82
atggggtttgccaaaattttaagctctttcaccgttctgttcattgggtataccttggtgaatggatccaccccaaagcattatatagtttacatgggagatcattcacaccccaattcagaatctgtaatcagagcaaaccatgagatactagcttcagttactggaagccttagtgaagcaaaggcagcagcactccaccattacagtaaaagcttccaaggcttctcagctatgattacaccagtgcaagctagtcaacttgcagaatataaatcagtagtgtccgtatttgagagcaaaatgaataaacttcacacaacacattcttgggattttcttggattagaaactatcaacaagaacaatcctaaagcactggacaccacatccgatgtcattgttggtgtcattgactctggcatctggccggaatcggaaagcttcactgattatggattaggtcctgtgcccaaaaaattcaagggagagtgtgttactggtgaaaaatttacactagccaattgcaacaagaaaattattggtgctcggttctattcaaaagggattgaggcagaagttggtcctctagagactgctaacaagatttttttccggtcagctcgggatggtgatggacacggaacacacacggcttccacaatagcagggtccattgttgctaatgccagcttattaggcattgccaaaggaaccgctagaggtggtgccccaagcgcgagacttgcaatttacaaggcatgttggtttgatttctgcagtgatgctgatgttctttctgccatggatgatgccatccatgatggggttgacatactatctctttcccttggccctgaccctccgcagccaatttacttcgagaatgcaatcagtgtaggagcattccatgcattccaaaagggtgttcttgtttctgcttctgctgggaactcagtttttccacgtactgcatgcaatgttgctccttggatcctcactgttgctgctagcacaatagacagggaattcagttcaaatatctaccttggtaactcgaaggttttaaagggttcttctttaaatccaataagaatggagcattcgaatggtttaatatatggaagtgccgctgcagctgcaggagtttcagcaacaaatgcaagcttctgcaagaacaatactctagatcctaccttaatcaagggtaaaattgtaatctgcacaattgagactttcagtgatgacagacgagccaaggccatagcaataaggcaaggagggggtgtcggaatgatacttattgatcataatgccaaagatattggttttcaatttgtcatcccaagcactctcattggtcaggatgccgtacaagagcttcaagcatatataaagacagataagaatcccactgctataatcaacccaacaataactgtagtcggtaccaaacctgctccagaaatggcagctttttcttccattggaccaaatataataacaccagacattattaagcctgacataacagcacctggagtgaatattttggcagcatggtctccagtggcaactgaagccacagttgaacatcgatctgtcgactataacatcatttccggaacatcaatgtcttgcccacatgtaactgcagttgcggcaattataaaatctcaccacccacactggggtcctgcagccataatgtcttcaataatgacaacagcgacagttattgataacacacgtcgagtcataggaagagatccgaatggaacacaaaccacaccatttgactatggatctggacatgttaatccggttgcatcactcaatcctggattagtatatgattttaattcccaagatgttctcaattttctgtgcagcaatggggcaagcccggcacaacttaagaacctcactggggttattagtcaatgtcagaaacctcttacagcttcctccaacttcaattacccttcaattggtgtgtccagcttgaatggaagtttatcagtgtatcgtacagttacttattatggtcaggggccaacggtatatcgtgcaagcgttgaaaatccatctggtgtgaatgttaaagttacacctgcagaattgaagtttgtgaaaactggggaaaaaataactttcaggattgatttcttccctttcaagaacagcgatggaagctttgtgtttggtgctttgatatggaacaatggcatacaaagggttaggagtcctattggtctcaatgtactatctacttaacattgattggttataccttaagaaaatgcatttatttatatatatcactttgatttcggcaataaaaaaaaaaagttcaatagatatcattgaggatttccaatatagcgaattctccacaagcaagactggatctttatgtaccaata

SEQ ID NO: 2207 - DNA, 1482 bp, Glycine max var. Williams 82
atggaatttggaagcataatccacttccttgaggacaagaatgttttggtcattggtgccgctggtttccttgccaaaatttttgtggagaagatactgagagtgcaaccaaatgtgaagaaactttatcttcttctgagagccacagatgctgaatctgcctctcaacgattgcataatgagattatccagaaggacttgtttagattgttgaaggaaaatcttggtgcaaagttcaatacctttgtttcagaaaagttgacacttgtgcctggggacatttctcaagaggacttcaacttgaaagaccccattctacgggaagaaatttgcagtcaaacccattgtattatcaattttgctgccaccactaactttgatgaaagatacgatgttgcattgggtataaatacattaggagttaagcatgttttgaacttcgccaaaagttgtattaagctgaaggtgcttgtccatgtatcaacagcatatgtatgtggtgagagaggaggactcattatagaggattcatgccaattgggcgtgtcactaaatggagtgcccggactagacattgacatggaaaagaaagcggtggaggataagttgtaccaacttcaacaagagggggctacagaggatgatattaaaatggcaatgaaggacttcggtatgaaaagagcaactatatatggatggccaaacacgtatgtctttacaaaggcaatgggagaaatgcttatagaaactctaaaggaaaacgtgtccgttgttattgtacgtcctacaatggttaccagtacttacagagaaccttttcctgggtgggtcgaaggagtaaggaccattgatagtttaattgttgcttatggcaaaggaaaattaacatgctttcttgcagacatcaaggcaacttttgacgtgataccggcagacatggtggtgaatgcaataataagtaccatggtggcgcatgcaaataagccatgtgataatatcatatatcatgtgggctcctctttagaaaatccagttagataccacaatctccaagactatggctttagatatttcaaggccaaaccatatgtaaacaaggaaggaaattatgtcatggttcgcaaagttacagtgttagacagcatggctagctttcagagatacatgttcattcgttacttccttccattaaagggactagagctagccaatgctgccttttgccaatattttcagaggacgtatcttgacattagaaggaagatctatacagtgatgcggttggttgacctttacaggccttatttgttcttcaatggcgtttttgataatatgaacacaaaaaagttgcggatagcggcaagagaaagtggggtagagatggaggagtatttgttttactttgatcctaaaatgattgattgggaggactacttcatgaatatccatattcctggtattgtcaagtatgtcttcaagtga

SEQ ID NO: 2208 - DNA, 2196 bp, Glycine max var. Williams 82
atggcgagtaccttctgcttactccactctcccctctatcaattcccatcttcatcttcttcttcttctgggcccataaaattgcgagcttccacaacatcttgcttggggcagcaagacaaagagccactctgcaacagaagaaccgttcttttgaccagcatcgctcttcttccgtttcgccgtttgaagcgggccccagctctcgaatccccacctccacctccaccccctacagaagaaaccgacgtgaagacacaagaggataaccaggaagccgagaaagcacctgaagtggaccaaccgtcaaattcctttctgcttctcctgaatggaattggaatattttcttctggtgtgttgggtgctctctatacacttgctcagaaagaaaagtccactgctgttgcaacaatagaaacaatgagcagcaaactgaaggaaaaggaagaactgattgtttccttgaagaagaactatgagttgaagttactaaacaagcgggaggaacaagccaagctacttgaaaaggcaaaggaagagcaactggcactgataaaccaactgaattctgcaaacagtactattaaccgcttggggcaggagcttaaaaatgagagaagtttgattgaggacctgaaacttcaaattgaccgacttaaagctgagctttcaaagactgatacagataagaaggatcttgaaaacaatttgaaagaaaagatagattccattggtgttttacaagaaagaatcaatctgctgagtgtggacctcaaggacaaagaagatgctgttcagaatctcaattcatcccaagcagaaaaggagttggaattgaagagtttgaagtctacctatgagcaaaccaaggatgacttaataaatgttcaattgcagattcaagggttgaaagatgaactactgaaaacccaagaggaactagaagctaaagattccttggtgatagaactaaattcaagagtgagttccttaactattgagaacaataattttaggagtaaatgtgatgtcatggagaaggaatacaatgatctaaagttcagtgctgtaaagaaggctgctttggactctaaggttttaagagaaaaagaagaggagcttcatcagctaaaggatcagtttgaacttgccctaggtgaagcaagcaaaagccagatcgtcattgctgatttatcccaagaaagagatgatttgaaggaggctctagataatgaatctagcaaggtgaatcatttgaagcaagaactccaagttaccctggagaatcttgcaaaatcaagaaatgagtctgctgaattggaaaaccttctaactttgtcaaacaaactgtgcaaagagctcgagctcgaggtctctaagctctcatctgagctcactgaggttaatgaatcgctacagagaaaccttgatgatgcgaaacatgaggcagaaatgctagcaagtgagcttacaactgccaaggaacacttgaaggaagcacaagcagagctgcaaggtgtgtcaaaagaattgacagctgctcttgaaaagaatgatagcctacaaaaagaattagttgaagtctacaaaaaggctgaaagcacagcagaggatttgaaggaacaaaaacagttagttgcttctctgaacaaagatttacaagcattagagcagcaagtctcaaaagacaaggagtcccgaaaatctcttgagagggacctggaggaggcgaccatatcactagatgaaatgaaccgaaatgcggtgatcctttctggggaactacagagagctaattctcttgtttctagccttgaaaaagagaaagatgtgcttattaagtccctaaccaaccaaagaaatgcatgcaaagaggcccaagacaacattgaagatgctcataaccttatcatgaaacttggcaaagaaagagagaatttagagaaaaaaggtaagaaatttgaagaggaattggcttctgccaagggtgagatattgcgcttgaagagtcgaatcaattcttcaaaagttgctgttaacaatggcccagtgcagaaagatggaggtgaaaaaaaggtcaacccttcaaaagttgcggtaaacaatgagcaagcacagaaagatgaaggtgaaaacaaggttactgtaagtgcacggaagactgtcagaagaagaaaggctaatccacaataa

SEQ ID NO: 2209 - DNA, 576 bp, Glycine max var. Williams 82
atgctcaaaggactatgtgtttgttatcttgtactaatagtcactttctttagcgtatctgtatccggttattgggcatttggtaatgaatctgaaggcctcatcttaagcaacttcgtggacaatgggaagcctctggtgcccaagtggtttatttacatgaccaacattttgattataacacaattatctgcggttggtgtggtttatttgcaaccaacaaatgaagtgctggagcaaacatttggagaccccaaaagccctgagttctctaaacccaatgtaatccctagagtgatttctcggtcattagctactactatttcaaccactatagcagccatgcttccattttttggagacataaactctcttataggagcatttggctttatcccacttgacttcatcttgcctatggttttctacaatttgacatttaagccatctaagagaagccctattttctggttgaatgtgacaatcgttgtggctttctccgcattgggagctatagcagcagttaggcagatagttcttgatgctaaaaattaccaattatttgctaatatatga

SEQ ID NO: 2210 - DNA, 1062 bp, Glycine max var. Williams 82
atgtcaagtatggggtattcaaggtctttcttggcttcttttcttcttgctgtgttgctcaatgtgactaatgggcagcctctagtccctgcaattttcacatttggggactcaattgtagatgttggcaataataaccaccaattgactattgttaaagcaaacttccctccttatggaagggactttgagaatcactttccaacaggaaggttctgcaatggaaagcttgcaacagacttcattgctgatatccttggatttacctcttatcaaccagcctacctcaacttaaagaccaaaggaaagaacctattgaatggtgccaactttgcctcagcttcttctggttactttgaattgacatccaaactatatagttcaattccattgagcaagcagcttgaatactacaaggagtgccagaccaaattggtggaagcagcagggcaatcaagtgcttcatcaattatatctgatgctatatatcttattagtgctgggaccagtgattttgttcagaactactacataaatcctctgcttaacaagctttatacaactgatcaattctcagacactctcttgcgatgctattccaatttcatccagagtttatatgcattgggagcaaggaggattggtgtgacatcattacctccaattggttgccttcctgcagtcatcactctcttcggtgctcatatcaacgaatgtgtgaccagtttaaacagtgatgcaattaacttcaatgaaaagctcaacaccacatctcagaacttaaaaaatatgcttccaggcctcaatttggtcgtctttgatatctaccaacccctctacgacttggccaccaagccttctgaaaacggattttttgaagcaaggaaggcttgttgtggaacggggttgatagaggtatctattttgtgcaataagaagtccataggaacatgtgctaatgcatctgaatatgtattctgggatggttttcatccctcagaggctgcaaacaaggttttggcggatgaattgattacttctggcatctctcttatatcctaa

SEQ ID NO: 2211 - DNA, 909 bp, Glycine max var. Williams 82
atgccatcatcactatcctctttcctccgtatggctcctattctctcccttcttgtactctcatgtgtgatttgttctagtagtgctcagggaccaccttcacctggctactatcctagttctaaaattagtcctgttagtttttatcaagggtttagaaacctctggggatctcagcatcagagactagaccagggctcattgacaatctggcttgactctaactcaggaagtggattcaagtcacttcactcttatcgatctggttactttggtgctgccattaagcttcaacctggttacactgcaggagtcattacatcattatatctttcaaacaaccaggaccaccccggaaaccatgatgaaattgacattgagttccttggcaccactccagataaaccatatgtcttgcagacaaatgtatacataagaggaagtggagatgggaatattattggaagggagatgaagtttcatctttggtttgacccaacacaggattttcacaattatggcattctatggaaaccgaatgagataatattttttgtggatgatgtccccataaggaggtatcctaggaaaagtgatgccacatacccctcaaggccaatgtatgtgtatgggtcaatatgggatgcatcttcttgggcaacagaggatggaaaatacaaagctaattataattaccaacccttcgttggtaggtataaaaacttcaaacttcaaggttgcactagtgaaagctctgcctcatgcaagccaccttctttctcgccatctggctttggtagtctaagccctcagcagtttagggcaatgcaatgggtccaaaacaactacatggtctacaattattgccatgaccctaggagagaccacacatttatcccagagtgttag

SEQ ID NO: 2212 - DNA, 1434 bp, Glycine max var. Williams 82
atgtcagtttcttcttcttatgcaacttctcgcttcacccataagcgtgactacccaacacaatcacaagcagaaaaactcataagaagccttaacctattaccaaaggactcagttaacattgtaaaaggtgaccatgttggttttgtcccaggaaagatcgtggagaagaagttctcgctattttgtgattctgggccttctattgaagaccttggtcaccatgctggctactattcacttcctcattccaaagctgctagaatgttctactttttctttgaatcacggaacaataaggatgatcctgtagtgatatggttgactggaggaccagggtgtggaagtgaattagctttgttttatgagaatggtccttttcatattgccaataacttgtctcttacatggaatgattacggctgggaccaggcatcaaatattttatttgttgaccaacctacgggtacaggtttcagttactcttctgaggaaagtgacattcgtcatgatgaaacaggaattagcaatgacttatatgacttcttgcaggagtttttcaaggcgcatcctgagtttgttaagaatgatttttatattactggagaatcatacgctgggcactatgttccggcacttgcatcccgggttaaccaaggaaataaacaaaatcaaggaatccatataaacctcaagggttttgctattggtaatggattaacaaatcctgcaattcaataccaagcttacccagattttgcattagacaatggaataattacaaatgctgagtacgataacatcagcaagttaatcccagggtgtgaacaagctgctaaaacttgcgaaaatcaaggtggacaaagttgcgcgactgcgttatatatttgtcaaaacatatttagtcttatcctggattatgctggcaacattaattactatgacatcagaaagaagtgtgtgggagaattgtgctatgacttcggtaacgtggaggagtttttaaaccagaagaaagtgaagagtgctttaggtgtgagggatgacttgcagtatgttttatgcagtacaacagttcatgctgctatgcttcaagattggatgagaaacatggaagtggggattccttctcttcttgaggatggaatcaagttgcttgtgtatgcaggggaagaagatctcatatgcaattggcttgggaattcaaggtgggctcatgccatggagtggtcaggccaaaaggcctttggaacatcttctacagtgaaatttgtggttgatggtgtagaagcagggtctcttaatagctatggacctctctcttttctcaaggtgcatggggctgggcacatggtccctatggatcaaccaaaagttgcacttcaaatgttgaaaagctggatgggagggaaattgaatgcctccttctattag

SEQ ID NO: 2213 - DNA, 195 bp, Glycine max var. Williams 82
atggctgttatttttacttttatagggcacttgccttggatgatgcctgatcgtgtaatggaattttgcaacaacaatgatcttcggctgattgttcgtgcacatgaatgtgtgatggatggctttgagcgttttgcccagggacattcgatcacacttttctctgctacaaactgctgtcgtatttgttactag

SEQ ID NO: 2214 - DNA, 484 bp, Glycine max var. Williams 82
ctattcccttccgatttgcttacgttattgttaatcccaacttttgatatttcatctaatttgaagaattactttttataatggctgttatttttacttttatagggcacttgccttggatgatgcctgatcgtgtaatggaattttgcaacaacaatgatcttcggctgattgttcgtgcacatgaatgtgtgatggatggctttgagcgttttgcccagggacattcgatcacacttttctctgctacaaactgctgtcgtatttgttactagcttctacatgccactttcctccacagataattctcccttctaaattttggcactttattatttgaataggtacggcaaataatgctggggcaatattagttttgggtagagatctcgttgtggttcctaatttgattcatccattaccgcctccaatttcttcacaataaactcattcggcaaatgatgctgtcgcctgaatttctggt

SEQ ID NO: 2215 - DNA, 1677 bp, Glycine max var. Williams 82
atgggtgtcaataaacaaaccagttttccaatgcagaaagcagggtacggtggcgatggaatatacaggtctctaaggccttgtttggttctcccaaatgaccccaacctctccctcgtctcattcctcttccaaagcgtttcctctttcccatccaaaatcgccctcgtcgattcccactcttcccaaacacttaccttggcgcacctcaaatcacaggtcgccaaacttgcccacggtttcctcaaactaggcataaacaaaaacgacgtcgtcctactgctcgctcccaacagcatccactaccctatatgcttcctcgctgccaccgccatcggcgccgtcgtctccaccgccaatcccatttacacagtcaacgaaatctcgaagcaagtcgacgactccaaccccaaactcctcatcaccgtcccagaattatgggacaaagtcaagaacctcaacctccccgccgtaattatcgatacggaaacagctcaaggactcgtgagtttcgaagctggcaacgaggtgtcgagaataacgagtcttgacgcggtgatggagatggctggaccggcgacggagctgccggagagcggcgtgaagcagggggacacggcggcgcttctgtactcctcgggaacgacggggttgagcaagggcgtggttctgacgcaccggaacttcatagcggcgtcggtgatgatcggaatggacgacgacctcgccggggagcaagacgacgtgtacctgtgcgttctgccgatgtttcacgtgttcgggctggcggtggtgacgtacgcggcgctgcggcgagggagcgcggtggtggtgatggagaggttcgagctggaggcgctgctgaaggctattgagaagcagagggtgacgaagctgtgggtggtgcctccgatcctgcttggtctggcgaaacagagcgtggttggaaactacgatctttcctcgttgaggcgtataggttcgggtgctgctcctctcgggaaagacttgatggaagagtgtggcaggcgttttcctcatgttgccatttgtcagggttatggtatgacagaaacttgtggcattgtttctgtggagaatccaagagtaggggttcgtcatactggctcaacgggaacgctagtttcaggagtcgaagctcaaatagtgagtgtggatacacagaagcctctccctcctagacagttgggagagatatgggtgcggggacctaacatgatgcaaggctatcacaacaatccagaggccacgagattgactatagataaaaaagggtgggtacatacaggagatcttggatattttgatgaagatggacaactttatgtggttgaccgtatcaaagaactgatcaagtacaaaggtttccaggttgcaccagcagaacttgaagggcttctcgtttctcaccctgaaatactagaggctgttgttgtgccatatcctgatgatgaggctggtgaggttccaattgcctatgttgttcgctcacccaatagttcactgactgaagaagaaattcagaagtttattgctaagcaggttgcacctttcaaaaaattgcgaagggtaacattcatcaacaatgttcctaagacagcttcaggaaaaattctcagaagagagcttactgcaaaagcacgatccaaaatataa

SEQ ID NO: 2216 - DNA, 1788 bp, Glycine max var. Williams 82
atggtgtccgacgccagcaagaagaaggccgcacagaagaaggccgccgccgccgccaagagaggtggcaaagctgccgccgctgccgttatggccgccacctcttccaaagccgccgacaaggtcgccaacggaatcgccgatattcagatttcggatcggacctgcaccggcgtcctctgttcgcatcctctctccagagatattcgaatagagtctctatccgtcacattccatggacatgatctcattgttgattctgaattggagctgaattatggaaggcgttatggcttactcggattaaatggttgtggaaaatctacactgcttacagccatcggttgtcgggaacttccaattcccgaccacatggacatatatcatctaaccagggagattgatgcctctgatatgtctgcattggaagctgtcataagctgtgacgaagaaagattgaaattggagaaagaagcagaagctttagctgcacaggatgatggaggtggtgaatcccttgaacgcatttatgaacgattggatgccctagatgcagccactgcagaaaagcgtgctgctgaaatcttacatggtcttggctttgacaagcaaatgcaggcaaagaagacacgtgatttttccggtggctggagaatgaggattgcattagcgcgagctctatttatgaacccaaccattcttctacttgatgaaccaaccaatcaccttgatttggaagcttgtgtgtggctggaggagagtttgaagaagtttgaacgtattctggttgtgatttcacactctcaggactttcttaatggtgtctgcacaaatattatccacatgcaaagcaaaaaactgaagctctacactggtaattatgatcaatatgttcagacacgttctgagctagaagagaaccagatgaaacagtacaagtgggagcaggagcagattgcctcaatgaaggaatacattgcccgatttggccatggttcggctaaactagctcgccaggcacagagtaaggagaaaacactggcaaaaatggaacgtggtggacttgcagagaaggtggtcagagacaaagttttggtatttcgttttactgatgttgggaaacttccccctccagttctccagtttgttgaggtgtcatttggttatactcctgataatctcatctacaagaacattgactttggggttgatttagattctcgggttgcgctggttgggcccaatggtgctgggaagagtacactactgaagctaatgacaggtgacttgatgcctagtgatggcatggtccgacgtcataatcatcttcgaattgcacaatatcaccagcatttggccgaaaagctagacatggaaatgtctgctctccagtttatgattaaagaataccctggaaacgaggaagagaagatgagggcggcgattgggaagtttgggctgtcaggtaaagcgcaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggacggtggcttggtgcttgtcagccatgattttaggctcataaatcaggtggcgcatgagatatgggtatgtgctaatcaatctgtgaccagatgggagggtgacattatggaattcaaggcgcatctaaagtcgaaggcgggtttatctgactga

SEQ ID NO: 2217 - DNA, 312 bp, Glycine max var. Williams 82
atgtctactactacacatgtctcccttctgtccctttacctcatcctatctctaaattcccttcacatgaccatggctgcaaggatcattccccaaagtgctcctagcacagttacaaggcctcaatttctatcagaagctgaaacttatttgaagccacatcttggtcacgaacaaaatgtcttccaagggagacaagtcaagaattgcttgccaaaagggtataggcataactcagctccaagcagattcgtgaactatgacacgctaggctctagtggctgttccggaatgcgttcggagaagccatga

SEQ ID NO: 2218 - DNA, 611 bp, Glycine max var. Williams 82
tggtttcaaccccaccatgatattgcttgaaacttacttcccaattgactctcacatttaatttcattccatatatatgcccctatctagcccttatttaagctccttgagcctcctcctttctgctcagtgtaagataacacaaaaaattaaagttcatagcatcagctgcaaaaattactgttgaagagaatgaagcttgtggtgattgcactagtgttgatgctggcaagctcttctgtggctataaataggatgaaatttgtgccaaaattggacgagagatcggaactgagtaatgaatctgatgataatgatcaccatcaaatccctcgaaaggagtatggaaaacctggatctggccaacgtgaagtggatgaggggtttcgtcacgtctacaccgctggcaatgactatggcacacctggccagggaggaaattaaatattaaatgttattaattagtatatatattaattaaggatgcattataaagctgtatatatgtatgcatatgtcttgcagtgtttgatgtgatgagtaatgaatgctagctgatgagtgggtgttggtaattagatattcatgtaagtaataattagttagagaat

SEQ ID NO: 2219 - DNA, 429 bp, Glycine max var. Williams 82
atggcactaatagaaatatgtctcacaaattcaactctttatgtgagtactcaaggacaagccgtgattgaaaaggtcacaaggccatatcttgggaaatcagcttcaatctcacagagcatactaaaattgaatgctccagaaaccagagtcgtctcatatgaagcagataatggttcagcaattgggattcattgtttaggccacgtgttcctacccaaacgtacttgttcttctctcaccatatatattagagaaagaaccctaaaattccatcgccgcgatgaacatgcattgacgacaacaaagaccttgaccacggggacgtcgaactcgacccgagcaacgtactctgaagaaggtggttcacttttcttcagatctaatcaaagaaagaaatggacgaagcgttggaaatgtcatgtgtga

SEQ ID NO: 2220 - DNA, 666 bp, Glycine max var. Williams 82
atggcagaggctaatgtagtgctgttggatttctggccaagctcttatggaatgagagtgaaaatcgctttggcagagaagggaatctcatatgagtgcaagcaagaagacttggaagctagaagctctctgcttttagagatgaacccggttcacaaaatgataccagttttgattcataatggaaaacccatctgcgaatcactcaacattgttcagtacattgatgagacatggaaccacaaaccttcttctctccttccatctgatccttacaaacgatcccaagccaggttttggggcgattacattgacaaaaatgtatacaatgctgtgaagagggtatggacagggaagggtaaagaacaagaagagttcaagaaacaatttatacaatgcttgaagaccttggaatatgaacttggagacaagccatattttggtggtgaggactttgggtatgtggatgtggctcttgttcccttcactagctggttttacacggttgagacttgtgggaaactaagcattgagaaagagtgtcccaaactcatggcttgggccaagaggtgcatggaaaaagagagtgtggccacgccactccctcaccctcaccagatctatgcctttgcaatgcaatataaacagagacatggacttgagtag

SEQ ID NO: 2221 - DNA, 2016 bp, Glycine max var. Williams 82
atgcttctgaacctctcccatgcttcctttcagcaggaaaatatgaaggccggaaaagtttactccaaatttaattgtcgatatcttattcctttcagtaaacaactctccatgaagttctgttctacttcagtggcttcttttctttttgtcatagttatttttttccctctagctattgctgatctaagttcagataagcaagcccttcttaattttgctaatgctgtcccccaccgtcgaaaccttatgtggaatccatccacctcagtctgttcatcttgggtaggcatcacttgcaatgaaaatagaactcgtgttgttaaagtccggctccctggagttggactagttggcaccatcccatccaatacacttggcaagcttgatgctgtgaaaattattagccttcgctccaacctactcagtggaaatcttcctgctgacattggttctcttccttctcttcagtatctctacctccagcataataacctttctggtgatatacctgcctcattgtctccccaactcattgtacttgatttgtcatataactccttcactggtgttattccgaagacatttcaaaatatgtcagtattaactagtttgaatctccagaacaactctctatccggacagatacctaatcttaatgtcactctgctcaagcttttgaatttaagctacaaccatttgaatggctcaattcccaaagctcttgagatttttccaaattcttcctttgaaggaaactctctcttatgtggaccacctttaaagccatgctctgcagttccccctacaccttctcctgcctcgactccgcccccatcaactactggaagacaaagctcaaaaaacaagttgagtaaaatagctatcattgttattgctgttggaggagctgtggtgctattctttattgctcttgtttttgttatttgctgtttaaagaaggaagataacagaggctccaatgtaattaaagggaaaggtcctagtggtggtaggggtgagaaaccaaaagaagagtttggaagtggggttcaagaacccgagaagaacaagttggttttctttgagggaagttcttataattttgatcttgaggatttgctgagagcttcggctgaagttctggggaagggtagttatggtactgcatataaggccatactggaggagtcaatgactgttgtggtgaaaagattgaaagaagttgtggtaggcaagaaggactttgaacagcagatggagattatgggaagagttggacaacacacaaatgttgtgccacttcgcgcttattattattcaaaagatgaaaagcttttggtatatgactatgtcccaggtggcaacctacacacactcttgcatggtggtaggacaggtggaagaactccattagactgggactcccgaataaaaatatcccttggaacagccaaaggtcttgcccacattcattctgttggtggtcccaaattcacacatggaaatatcaagtcctcaaatgtcctcctcaaccaagataatgatggctgcatttctgattttggccttgcgccccttatgaatgttcctgctaccccttctagagctgcaggttatcgtgctcctgaggtgattgaaacccgtaaacactctcataaatcagatgtgtacagttttggtgtcctccttcttgagatgcttaccgggaaggctcctctccaatctccgggacgtgatgatatggttgatctccctaggtgggttcagtctgttgttagggaagagtggacggccgaagtttttgacgtcgagctaatgaggtaccaaaacattgaagaagaaatggtgcaaatgttgcaaattgccatggcttgtgtggcaaagatgccagatatgagacctagcatggatgaagcagtgagaatgatcgaagagatccggcaatctgactcagagaaccgaccatcttctgaagaaaataaatctaaggactcaaatgttcagactccatag

SEQ ID NO: 2222 - DNA, 2754 bp, Glycine max var. Williams 82
tctatcttcatttattatttatctgcaaaaacaataaaaatcaagtcactttcttccatgctttttatttttaatgaagcttctgtcttctgtttctgtaccttgttgcagctgctgctttctagcttaaaatgctcctcaatttcatccaaattcccttgctttatggcctctttgtgttgtacatgctcttcccaatgaaacccacttccagattgtgttagtaacaactagttgagaatctgaagcataagcacccccaccaacttcaatttctgctttcaccaaatgctacttcttgtgctgtttcatctctctgaatttgtgaagtctgagactaacacatgcttctgaacctctcccatgcttcctttcagcaggaaaatatgaaggccggaaaagtttactccaaatttaattgtcgatatcttattcctttcagtaaacaactctccatgaagttctgttctacttcagtggcttcttttctttttgtcatagttatttttttccctctagctattgctgatctaagttcagataagcaagcccttcttaattttgctaatgctgtcccccaccgtcgaaaccttatgtggaatccatccacctcagtctgttcatcttgggtaggcatcacttgcaatgaaaatagaactcgtgttgttaaagtccggctccctggagttggactagttggcaccatcccatccaatacacttggcaagcttgatgctgtgaaaattattagccttcgctccaacctactcagtggaaatcttcctgctgacattggttctcttccttctcttcagtatctctacctccagcataataacctttctggtgatatacctgcctcattgtctccccaactcattgtacttgatttgtcatataactccttcactggtgttattccgaagacatttcaaaatatgtcagtattaactagtttgaatctccagaacaactctctatccggacagatacctaatcttaatgtcactctgctcaagcttttgaatttaagctacaaccatttgaatggctcaattcccaaagctcttgagatttttccaaattcttcctttgaaggaaactctctcttatgtggaccacctttaaagccatgctctgcagttccccctacaccttctcctgcctcgactccgcccccatcaactactggaagacaaagctcaaaaaacaagttgagtaaaatagctatcattgttattgctgttggaggagctgtggtgctattctttattgctcttgtttttgttatttgctgtttaaagaaggaagataacagaggctccaatgtaattaaagggaaaggtcctagtggtggtaggggtgagaaaccaaaagaagagtttggaagtggggttcaagaacccgagaagaacaagttggttttctttgagggaagttcttataattttgatcttgaggatttgctgagagcttcggctgaagttctggggaagggtagttatggtactgcatataaggccatactggaggagtcaatgactgttgtggtgaaaagattgaaagaagttgtggtaggcaagaaggactttgaacagcagatggagattatgggaagagttggacaacacacaaatgttgtgccacttcgcgcttattattattcaaaagatgaaaagcttttggtatatgactatgtcccaggtggcaacctacacacactcttgcatggtggtaggacaggtggaagaactccattagactgggactcccgaataaaaatatcccttggaacagccaaaggtcttgcccacattcattctgttggtggtcccaaattcacacatggaaatatcaagtcctcaaatgtcctcctcaaccaagataatgatggctgcatttctgattttggccttgcgccccttatgaatgttcctgctaccccttctagagctgcaggttatcgtgctcctgaggtgattgaaacccgtaaacactctcataaatcagatgtgtacagttttggtgtcctccttcttgagatgcttaccgggaaggctcctctccaatctccgggacgtgatgatatggttgatctccctaggtgggttcagtctgttgttagggaagagtggacggccgaagtttttgacgtcgagctaatgaggtaccaaaacattgaagaagaaatggtgcaaatgttgcaaattgccatggcttgtgtggcaaagatgccagatatgagacctagcatggatgaagcagtgagaatgatcgaagagatccggcaatctgactcagagaaccgaccatcttctgaagaaaataaatctaaggactcaaatgttcagactccatagattaacagtgccttttgcttaaccaggaagtgacaataaaatggtatataagagtgcatgcttgatcaacctttctgtccaattgttcaatatttctcacagatgttgttcctcgagttattttctcctgtagttatgttgctttccttgaattcttatgtattaacatcccgattcaattaatgatcttgattcaagcacatttggtcccttgtaattgttgttaagctgttttaacaccaatggatatgtgtattagatcaccttatcatgccatccatggctaggtaatgttgataaaaaaaatcaacctcttcagtctcttgttccttaggtgaccatggggcagtacatcaataatgctttaaaaacaatatattcagtttagttcttt

SEQ ID NO: 2223 - DNA, 687 bp, Glycine max var. Williams 82
atgtcatccactgctagcttgggttatgggggtccaacctgcttcaacaatgttgttcatcagacaatgaggaacagtttcatagccacaaaacagcataacagtgtgatgagagtggtgaagggttggagaggaagacatggtaataattgcaacacatccaaaagggtggtaggagttgtgcagtgtagagggctaggggacttcataggtggagacttgataaagtttgatcttggacgttggctttcagatgttgaagagcacaaagcacttgcaatataccctcctcatgaaggaggctatgagggtcgctacttgtcacgcctcaaacgtcagggatactattttcttgatcttacagctcgtggccttggtgatcctgaaaccaccctcactaagattcaccctgtttgccctcctcatgttgggaagcagccaatagcaaggtggtatttcccaccagaagttgattacagattagaagcattgccaccaaatgccaaaggactggtggtgtggataattgaagccaaggttctctctaaggcagaactgcagttcctagctttgctgccaacacttaggcctaatgtgagggtcattgctgaatgtggaaactggagaaagtttatgtggaaaccactaaaagaaattgcgggactaacaaccagtgaggaagcttga

SEQ ID NO: 2224 - DNA, 2199 bp, Glycine max var. Williams 82
atgggtgcatgcttgagtaagaagaaagggtcttctacagcaacaaccaaatcagctgcttcttccactgtgcctgagctgaagaataattctcctttttctgttagtggtgttgtcaatgtttccaaacccaatgtggaagaagtgaaactgaagaaggacaattcaaagaaagggaaagaagagaagaagcatgagacagtgccaccagaacctgaagggcatgtgaaaaaggagatattcatcatcaagcaccggaagaaccatgatgataataataatagagtcagaaacaattccaattccaagtccccacctttcactgaagaatcaacaatatgtgacaaaacagcacctacagcaaacatgggtggtggtggtggtggtgtaggagtgaggacttcaagctgtaccaaagaagaggtggatgcaattctcatccagtgtgggagacttagcagaagctcttcaggtaatgccattgctgctgaacataagagaaggtactcaggctcaaagagaagctacgattttgaccactgtgacaatgacactgtttccaatgatgatgactcaaagaaggtcaatgccaatgagagcaacagtgatctgtgtgaggaggagaggcaccagcaccagcaccggccacgccaccgccagtctccaagtccgaaccgaaggccctcttcttcttctcaggaaaggagaagaaggacaccaagcagggaaagagagcaacagcagcaaaggtcaagcagcagagaaaggagagttagtagatctcctggaagaagatcatcagagaacaccacaccttccaatgcaagaaacaacaatagcagcaacaacactagttctaggcctgggaagatggtttctgttcctgccactgtttcatcactggtgatggataagagtaataacaatggcagtggagaatctggagcaaccactggcatcaagaggatagcagtgaagagaaatgttggcgctgcctcgccgcgctcgcagtctcctgcaagagcaaatgggaatggagcaaatggtaataaagcattcagtgagaatcagcagcagccatcccttagccgcagcaattcaaggaaagcagaacaatctccttacaagagaaatccattgagtgagattgaacctaattcccttgcttttccacattcaacaaccaacaatagcagcagcagggtgcaaaacagacccaaaaaggaatttgaaacagaagctaatcagaaaacaaatggcaacagaactgcatcagacaagggtgtgactataaattgcaagacaaaggttcaacaagaggaagatgtgaaagtgcagtcttcaattactgataatgttgttgtgaaaacaatggtacccccaggggttgacaacctaaaaccaccctatacattaacaagaagcagatcttcgaggcgatcgcaggagttagacatcaactgtgaagctctattgaatcctccaccacagtcctatgcttcactgctgcttgaagacatccagaacttccatcagaagaacacaccaccagtttctctcccggcttgtgtcaccaaagcttgctccatcctagaagccgttgctgatctcaactctaacgccggcttaaatttctgcagtggggaagacaggagaagtccactagcttttcaatgtagcaggaatgactacaatgttccattgactactaatgattatgggaagagggagccagatgccgaggaccctgttgtggaatcgatgttagtattcaatgatgatgatgtgatggaaccgaacttgcacaagtatgtgacagtgaatagaggtggttcacttggtggtgcggacatggatgaccaagagtcttcaggaagcaacagcttcactgtgagtagtggtcaacagcattggggtgtttcttcttcttcatgggaaccaagttcagttgaatcgaaagattgctggacttcgaggtcgaactactccaaagaggaatgtcagagaagtccattaggcttggaaggaacggtggcatctgaagtggcggggcgtgatgcgggtggagccaagaagaaattgaacagccaaaggagagagtgtgatcatcagcatggcagtggaatagggcgtggtaggcttggtgccaataaagttcttcacaacatacctgttgtcacagcagctgcatccacatag

SEQ ID NO: 2225 - DNA, 621 bp, Glycine max var. Williams 82
atgatggagaaaggaagtgtggttgaagctgcagtaactagatctcccatgcagatgaagatgggggatcatgaattagaaggcaacactaccagtgccctacgcactgccgagacgtttctgcgtttgttccctgttggtctatgtgtttcagcacttgttctcatgcttaagagctctcagcagaatgaatatggatctgttgattacagcgatcttggagctttcaggtacttggtgcatgcaaatggcatttgtgccggctactctctattttcagcggtgattgctgctatgccatgcccttccactatacctcgtgcttggactttctttttgcttgatcaggtgctgacatacataattctagcggctggagcagtgtcaacggaggttctatacctggctgagaatggagacgccgcaacaacgtggagctcagcatgtggctcttttggtcgattttgccataaggtcacagcatcagtagctatcacatttgtggcagtgttttgctatgtcttgctttccctcgtttcctcctacaaactcttcaccaagtatgatgcaccagcaagcaggcccactgaagccattgaggttgctgctttccctggctag

SEQ ID NO: 2226 - DNA, 2235 bp, Glycine max var. Williams 82
atggatccagaaacagaacaaggctcagaattctcaatcgaattgcaatcgaaagcgttccaagttctaagctcaaacgacaacaccgcaatggaaaccctcttctcccacctcttctactctcctcattccgaacaactccgatcccaagcactcgaattctttcaatgctgcaaacaccaccaccccgatcttctcttcatcaaactcttcttcctcctccgttccactcctctccccgaaactcgcgccaacgccgcacgcgccttgcacctcctcaacccctcccacctctggcccaaccttaagcccatcgcccaggcccacctcaaggcccacttcctcaacttcctctccgacgaaccttccctccacgtcctccgcctcgcctcctatctcctcgctcaaaccgtctccgttatcttcaaaactcaccaaacctggcctgagctcctcaattttttactctcctccatctcctccgatgaaaacaagcgccgcgaggtcgccgcgcttgtcttcgccaggctcccaaacgactgccgttttctcgtccacaacgctctcagggacaacaaacgccttcttcacgcgtcgtttctgcgctgcctcgcgtcgtccagccccgacgtccaggtcgccgcgttcggcgccgtcgtcagcttgatccctctgttctccgaaactaagctcttccacgagctcctccgcgccctcatggttggcgtcttcacgctcctgcatggctacgaaggaagctacttcaaaatcgcgttcgcggagttgataaatctggtttctcgccagccgcagcttttgaaaccctacatgaacgacatggttctcgacgtgcttcagatcgcggagagcggtggcttgagcgacgaaacgcaccgtttggcgtttgagttggtgatggccatggcggaggagaaggagtacgagaacgtcttcgctaaccttccttacaggattgtgagcaagctgttccttgttccgatgaagatgttgcagcgcctcgcggaggacgatggtgagcgtgaattgaaaaacgagaaggtttttgatgtttacgagtttggaatgaagagcttgaagaagctttgcgttgtgctcggagcgagtaaagccgtgcctgttgcgtttgaagtgtttcggcttcacttagatgatgatgcggcatattggaaggagcgccatgcaggaatcacaatgctcagtgtgatcgcagaagagttctctgatgaaatggtattgatggaaaattttctggttggagtggtgaccaaaattttgaagtcaatgcaagactctcatactcaagttcggttggcaactttcaaatttatggagactcctacaaactttgttcaggtggtgcaaatcctttaccatcacaggcttgtgcatgctttttgcactgcactcgacaatgaacaggtcgttaaagtgaaggaacaagctgcctcagcaatgcaatttttcctaaagaacactttgccagaaagcttaacactaaataagactgcggaaactgtattaggaaaattgttgccattgattcaggacaaagatagttccgagataagaggtattgctttgtcaactttaaatatagttgcacaacggtgtcatgaagtggctaacaagtactgtgcaatttatcttcccatcttactggaagcatgcaaggactataattattatatcagagaggaggcagcacggggaattcgaatttgtgcagagcttggaacacaacagttgaagccttttatcaatagaatattgtcagaactcggtgttttgatgaacaatccaagtccactgaatgaaaaagcgcatgatattgcagtttctgctctaggaagaatttgtgaattccatcgtgaatgcattgatggctctcagatggttcctgcctggttaagtttcttgccacttagaaatgatttgattgaagccaaacttatgcatgaacagctttgtttaatggctgaaagatttgataaggaccttttaggagctgatagtcaaaactttatcaagattattgtagtgcttcttgagattattgataagggtgacaaattagctacagcacaaacaatccagcaggtggaaaatttgctgaggcagcttgggcggtgtattccacgtagtgcgtttgatacaattttttcatctttgaatgcccagcaaagggcattactattgtctttgttatactcctag

SEQ ID NO: 2227 - DNA, 2682 bp, Glycine max var. Williams 82
atgaggaaccacaagtcccacatcgctacatacctctcttgtttcctctccgtaatcctctatgcacactcccaagatgacacctcagcaatgctcgccctcagggacaccctcaacccgcctgaatctctcgggtggtctaacccagacccgtgtaagtggaaacacgtcgtgtgctctgaagaggtaaaacgggtcgcccggatccaaatcgggcaccagggcctccaggggacactccccaaccccaccgtgatccaaaccttgacccaattggaacgcttggagctccaattcaacaacattttgggtcatcttccaagcctaaacggtttaagctccctccaagtcctcattcttagcaataaccaattctcttccattccaaacgacttcttcatcggcttgtcggagcttcaaagcgtcgagatcgacaacaacccgttcaaaccttggaaaatccctgacaacttcgttaactgttcttccctccaaaaaatttccacgaattcaaccaacattgtcggaacgctcccggatttcttctcgagccttcccacgttgacccacttgcacttggccttcaataatctcgagggtgtgttgcctttgagcttttccgggtcgcagattgagaccctctggttgaacggacaaaagggtggtgaaagcaacaaccttggcagtaatgttgatgttttgcagaacatgacatcgttgacgcaggtttggttgcattcctatgcctttactaggcctcttcctgaattttctgggttggaaagcttgcaagatttgaacttgagggataatgctttcacgagtcctgttcccgggtctttgttggggttgaaatcactcaatgttatgaacttgactaataacttgtttcagggggcagtgcctgagtttggttctggggttgaggtggatttggatttgggtgacgattctaatagtttttgtttgtcgcatgtaaggaattgtgatccaagggtggagattctgctttctgttgtgagggtcttagggtatcctagaaggtttgctaggaattggaaggggaataatccttgtgcggattggattgggatgggtcttgagggtactatagctcctgagtttggtttgcttaaatcactgcaaaggcttgtgcttgctgataataatctcattgggccaattccaaaagagttggcttttttgcccgggcttgttgaattgaatgttgcaaacaatcgtctttatgggaagatcacgagttttaagagccatgtggttcttaccacaaatgggaataaggacatagggaaggataagcccagcctagggccaagatcatcacctttaggtccactgaattcaacagctccgaacagaagtgaagaaaatgatgggaaaagatccttacatgtagtggtgattgtgtttgttgtgattggtggtgtggtgttggttttggtgattggtttcttggttttttgtctgtttaggatgaagcagaaacggttgagcaaggtgcagagtccaaatgcaatggttattcatccacggcattctggattggacaatgaaaatgtgaagataacgattgcagcttcaagtcttagtgttgatgttagtggaattggaatgcgaaccatggctggcagtgaggcgggggatattcaaatgggtgaagcaggaaacatgattatttctatacaagttctgaggaatgtcactgacaatttcagtgagaagaatatactgggacaaagaggttttggaacggtttacaaaggtgaactgcatgacgacccaaagattgttgtgaaaaggatggagtcgggggcaattagtgggaaaggtgcaacaaaatttaagtctgaaattgttgttttgaccaaggttcgccaccggcatcttgtttctcttcttggttactgcttggatgggaatgagaagcttcttgtgtatgagtacatgcctcaggggacattaagtaaacacctttttaattggatggaagaaggactgaagccactggaatggaacagaagattgaccattgccttagatttggcaagggttgttgagtaccttcatagcttggcccatcaaagcttcattcatagagatttaaagccttcaaacattctccttggagatgatgtgagagcaaaggtttcagattttggtcttgtgcgtcttgctccagaaggaaaagctaccatagaaacaaggattgctggaacttttggatatttggcaccagaatacgcagttattggtcgtgtgacaactaaagttgatgtgttcagctttggggtaatattgatggagctaataactggaagaagagcacttgatgatacccaaccagaggataacatgcaccttaaagccattgaccacacaattgagctcaatgaggaaacatttgctagtatccacaccgtggctgagttagctggccactgttgtgcaagggagccatatcaaaggccagacgcaggtcatgttgttaatgtgctttcttctcttgtagaactttggaaaccatctgatcaaagttctgaagatgtatatggcattgacctagccatgtctttaccacaagcattgaagaaatggcaggcttatgaaggtagaagccaaatggaatcttcttcttccatactcctacctcctatgatatga

SEQ ID NO: 2228 - DNA, 231 bp, Glycine max var. Williams 82
atggttggaattggagttccaatatgcgtgcaatgtggcaacacgagcaacccctgccggtgcaaggtggtggggccaacgctggggttcctggcgtttgcggcggcggcggtggtcgagtggccggtgggggctctggtgtattgctttcgccactcaaagggtcgcaaaatcatgggtcatcccgctaccgtcatatacccttcagtcaccaatgccatccccatctaa

SEQ ID NO: 2229 - DNA, 1503 bp, Glycine max var. Williams 82
atggaatcccctcatgcgaagaaatcggggggtttgaagctcccagctggcatgtccggaacctcactccgcctcgacaccgcgccagcatcttcttctttccgttcttccatctcgaccctcaattctccttcttctctccgctccatctctaacctcacatcgccttcgaaatcgaactcggcctgcagcgaccggttcatcccgtgcagatcctcctcgaggctgcacacgttcgggctcgtggacaggccgtcgccggtgaaggaagggagtaacgaagcgtattcgaggttgttgaaatcggaactctttggatctgactttgcttctccttctctttcttctctttcttctcctgcaggtgctgctgctcctccttcgcctctcagtcccagcaagaacatgctccgcttcaagaccgatcactccgccgcgccttcttctccttattcaccgtccattttgggacagcagaatggcttcacttctgactcttccacaccgcctcccaaacctcctagaaaagtccccaagacaccccacaaggttttggatgcaccatcacttcaagatgacttttatttgaatctggtggactggtccacacaaaatgttcttgcagtggggctaggcacttgtgtttatttatggagcgcttcaaacagcaaagtgactaagttatgtgacttggggccttatgatggtgtttgttctgtccagtggacccgggagggttcttttatatcaattggtacaaatcttggccaagttcaggtttgggatggaactcagtgtaagaaggtcagaaccatgggtgggcatcagacaaggactggtgtcttggcatggaattctcgcattttggcttcagggagcagagataggaacatacttcagcatgacatgagggttccaggtgactttgttagcaagcttgttggtcacaagtctgaggtatgtggattgaaatggtcctgtgatgacagggaacttgcttctggtggtaatgataatcagctcctggtatggaatcaacactctcagcaaccagttttgagacttaccgagcacactgctgctgtgaaggccattgcttggtcacctcaccaaagcagtctccttgtgtctggaggtggaaccgctgataggtgcattcgtttttggaacactacaaatggccatcaattgaactgtgttgacactgggagccaggtctgcaaccttgcttggagtaaaaatgtgaatgaactagtaagtactcatgggtactcccaaaatcagatcatggtgtggaaatatccatcattgacaaaggttgcaactctaactggccacagcatgcgagtgctgtaccttgcaatgtctcctgatggtcagacaatagtaactggtgcaggggatgagactctacggttttggaatgttttcccatcaatgaaagcaccggcccccgttaaagatacaggcctttggtcactggggcgcacacaaattcgatga

SEQ ID NO: 2230 - DNA, 1338 bp, Glycine max var. Williams 82
atgttctccattctcctcctccttcttcctcctctaacaatcactcttttcaccgttttcctccaaatccaaaccacctcttctctctcctcttccctccaaacccctctcatattgcctcttaaaacacaaacactcccatatggcttagtttcacttccaacaccatcgtccacacgtaaggtctcattctaccacaacgtaaccttaaccgtttcactaaccgtaggcacgcccccacagagcgttaccatggtcctcgacacaggcagcgagctctcctggctccactgcaaaaaacaacaaaacattaactcagttttcaacccacatctatcttcctcctacaccccaataccatgcatgtctcctatctgcaagactcgaactcgagactttttgatacccgtttcgtgcgactcaaataacctctgccacgtcaccgtctcctacgccgacttcacctccttggagggcaacctcgcctcagacacgttcgccatatccgggtcgggtcaaccgggaattatattcgggagcatggattccgggttcagctccaacgcaaacgaagactccaaaacaaccgggttaatgggcatgaaccgagggtcgctctcgtttgtgacccaaatggggtttccgaaattctcgtactgcatctccggcaaagatgcttccggcgtgttactcttcggcgacgccacgttcaagtggcttggaccgttaaagtacactcctttggtgaaaatgaataccccattaccctacttcgaccgggtcgcgtacacggttcggttaatgggcattcgggtcgggtcaaaaccgctacaggttccaaaggaaatcttcgcgccagatcataccggggcgggtcagacaatggttgattcgggtactcgattcacttttcttctcggttcggtttacactgctttgaggaacgagtttgtggcgcagacgagaggggtgttgacccttttggaggatccgaatttcgtgtttgaaggggcgatggatctgtgctttagggttagaagagggggtgttgtgccggcggtgccggcggtgacgatggtgtttgaaggggcggagatgagtgtttccggtgagaggttactgtatcgggtggggggtgatggtgacgtggcgaaagggaatggtgacgtgtactgtttgacgtttgggaattcggacttgttagggattgaggcttacgtgattggacaccatcatcagcaaaacgtgtggatggagtttgacttggtcaactccagggttggatttgctgacaccaagtgtgaacttgccagtcgaagacttggtttggattcataa

SEQ ID NO: 2231 - DNA, 1414 bp, Glycine max var. Williams 82
atcacttaaaaatcaattttctcatgataaatccacacgtactataactctttcatgactctaataagtccaccgattctcatagacaagtagaagggagagaaaatgaaatcaaaatgagaattatttgttccacagaaaagcagtgaaggaactcaggtaactctcatgctgggttgaaatccattcactgttaatcctccatcaacacaaataacttgtccagtgatgtaagaggcagcaggcaaagaaaggaaagtcaccaacgatgacacttcttccggttctgcaatgcccttaagaggggtccgagacaaaatatcttccacaagtttaatcgaacacatggacattcataattctaacaacaaacaattaaggagatgatatgatatggtgatcctttgaccaagcggcattatccacatacacatggtacctatgacactttgtcgtggtgagttgcatctgcgtgtgactgcaagatatggctcttgttctcaacgtctcattgtgttccacttgtaaaccccatctttctctctcaacctccaatcccaacaaagcttcttctacttttcctcttcctcttcctcttctgggactcaacataaagaaaagtctccaaccatctcagaaactcacattttcattgggtgaatccgtgtctggtgccaccctcgttgctctcctctctgcttctttcatctttgttgatcccgcacttgcattcaagggtggagggccatacgggcaagaagtgacaaggggacaagatctcactgggaaggacttcagtggcaagactctgatcaaacaagacttcaaaacgtccatactgagacaagccaattttaaaggtgcaaagttaataggtgctagcttctttgatgctgatttaacaggtgctgacctttcggatgctgatcttagaaatgcagatttttccctggcaaatgtgacaaaggcaaatttaagcaatgctaacttggaaggtgcacttgcaacaggaaatacatcttttaagggatcaaatattacaggcgctgacttcacggatgtaccactaagagaagatcaacgtgaatacctctgcaaagttgctgatggagtgaacccaacaactggaaatgctacgcgtgatacattgttctgcaattagtattccattgctgaatactcactccaagaccttcaaatgtttgcatagaatggtttcatagctaacaaaatactcccttcatgttgctggaatcttgtatttacatagcaccacaatttagattatttcaaatttccattccccatacacacacttgacaataacattgtgatgtaatgctcataaccagcctacctatgttatatattattattattgtaatcatatagcaaaaatcctttcataaatggt

SEQ ID NO: 2232 - DNA, 474 bp, Glycine max var. Williams 82
atggctctttcaccactcggcatgcttctggtcattgccaccatcttactcccattcaatattgttgtggccaaggaatttgttgttggcgatgatcatggatggacaataggctttgattacgcagcttgggctgcagataagaccttccaggttggggacctacttgtgttcaagtatgctgttggaaaacacaacgtgttcaaagtgaatggaacagcatttcagagctgcacgattcctccagcaagtgaggcattgaccactggaagtgatcgtattgtgttggcaattcctggcagaaaatggtacatatgtggtgttgttggtcactgcaatgctggccaaaagcttgttatcacagttcaaccccaaacactgcctccaactcctgcccctgcaccttcaccttttcaacatcgccctcattttggtcgatggattcctaagaagctatttacaatattccattaa

SEQ ID NO: 2233 - DNA, 709 bp, Glycine max var. Williams 82
aacagtcatatataacagggaaattaaatcgtcttttaatggctctttcaccactcggcatgcttctggtcattgccaccatcttactcccattcaatattgttgtggccaaggaatttgttgttggcgatgatcatggatggacaataggctttgattacgcagcttgggctgcagataagaccttccaggttggggacctacttgtgttcaagtatgctgttggaaaacacaacgtgttcaaagtgaatggaacagcatttcagagctgcacgattcctccagcaagtgaggcattgaccactggaagtgatcgtattgtgttggcaattcctggcagaaaatggtacatatgtggtgttgttggtcactgcaatgctggccaaaagcttgttatcacagttcaaccccaaacactgcctccaactcctgcccctgcaccttcaccttttcaacatcgccctcattttggtcgatggattcctaagaagctatttacaatattccattaaactttattgttgctttaacctatgtttgttttgagagtgtgggagtactagtgcattaattggttggtcctcgggataaattattgtttctatttcaaaattcatcaggatttttgttgttgtattttaaaattcaaattgggagtttgtgatgtgcttataatatgataatataagcacaatccacctatatatac

SEQ ID NO: 2234 - DNA, 1797 bp, Glycine max var. Williams 82
atggatgctttatctaagaaaaacgaaaattcttctcaaaagaaaagtgatggggttgttttgtcttgtctcaccacagattattcttccagtgataccagtttctgtggatccagttcttcagtttctactgatgaagctaaggcaaaagggtcttcttcacctgctcctcttggttggcctattctcaaggccacaatctccaagcgctctagttctgatgaaaaagaaaacagacataaatcccacttggaagacaaaaagtttaccagtattggcttgaagttgtcagaacttgacatgatgaaggagaggtttgcaaaattgttgcttggtgaagatatgtcaggttctggaaaaggggtttgcactgctttggccatttctaatgccattactaatctctgcgcaactgtatttgggcaattatggagactagaacctttaccttctgagaagaaagaaatgtggcagagagagatggaatggcttgttagtgttagtgattacattgtcgagttgatgccttcttggcaaacatatcctgatgggagtaagctcgaggtaatgacttgcaggcctagggcagatatttttatcaatcttccagctctccgcaaacttgacaacatgcttctcgaaattttagacagtttcactgctacagagttctggtatgtagaccaaggaattgtagccccagatgcagatggttcggcctcttttcgcagaacaattcagcggcaagaagagaagtggtggcttcccgtgcctcgtgtcccccctgcaggactcagtgaagactcaagaaaacagttgaatcactctcgagaatgtgcaaaccaaatactaaaagcagccatggctatcaacagcattgctttggctgaaatggaagttcctgagtcatatttggaagttcttcctaagaatggaagaacttgcttgggggattttgtttaccgttacataacatcagatcaattctccccagagtgccttcttgattgcttagacatatcctctgaacatgttgcactagagattgcaaaccgtgtggaagcagcaatttatgtttggcggcgaagagctcactctaggtcctcaccaaaccccaaccgttctaccacaaaatcatcatgggaaatagtcaaggacttcatgattgatggagataagagagaactactagcagatagagctgaaaacattctagtttccttgaagcagcgtttcccaggcttaagtcaaactacccttgataccagcaagatccagtgcaacaaggatgttggaaaatctgtgctagagagctactcaagagtattggagagcatggctttcaacattgtggcccgcattgatgatttgctgtatgttgatgacttgacaaaacattcagagaggtttgcattggttcctacaactacagttaacatggtttctcagcagaagaagattacacgtccaccactctcagtgtctgtctcaggcactacaccacacaaagcatcaattggcactcctagcttttcatctgcggctgtgccactaattagtcctgcaagaggggagagaactcctttcctccacaacatcaacaacagcatcaaacctcatcgtcgcggctttggggtgaggagagtgttgtcaaattatcttggtgtagagacaaagactactaagatatgcagcaactcaactgaggtgaattgttcaaacccaagtagcaagaaaaccgaactacaacaacaaccagaacaacaacgtcagaagtttaaaaacaggaccaaatga

SEQ ID NO: 2235 - DNA, 1392 bp, Glycine max var. Williams 82
atggaggaggagaaacagagaggcaaagggcacagactattgctgatgccatcaccattacaaggccacataacaccatttctccacctcggtgacatcctcttctcaaagggcttctccatcaccattctccacaccatcttcaactccccaaacccttcttcctaccctcacttcaccttccacgccatccccgacggcttatcagaaacagaagcttcaacactcgacgccgtgctcctcaccgacctcatcaacatcagatgcaagcaccctttgaaggaatggttggcttcttcggtgctgtctcatcaggaacctgtttcttgcttcatttccgatgctgcacttcacttcactcaacctgtttgtgacgagttgaagctcccgcgccttgtgctcagaactggtggagcctcgtcttttcttgtttttgcctcgtttccacttcttagagaaaagggttacctccccgtacaagaatctagattggatgagcctgtggtggatctcccaccactcaaggtgaaagatcttcctaagtttcagtcgcaggatcctgaggcattctataaactagtttgtcgctttgttgaggaatgcaaggcatcttcaggggttatttggaacacctttgaagagttggaatcatctgctttgacaaaattgcgccaagatttttccataccaatataccctataggcccttttcacaaacacttgcttacaggctctgcttcttctactagcttgttgaccccagacaaaagttgtatgtcttggttagaccaacaagatcgtaacagtgttgtttatgtgagttttgggagtattgcagcaataagtgaggctgagttcttggagattgcttgggggttagccaacagcaagcagccgttcttgtgggtgattcgacctgggctaatccatggttcagaatggtttgaaccattgccaagtgggttcctagagaatttgggaggaagaggctacattgtcaaatgggctcctcaagaacaagtgcttagccatcctgcagtgggagcattttggactcataatggttggaactcaactctagagagcatatgtgaaggggttccaatgatttgtatgccatgttttgcagaccaaaaggtcaatgccaaatatgcaagcagtgtttggagggttggggtgcaattacagaataagctagatagaggagaggtagagaagaccattaaaacactcatggttggggatgaagggaacgagattagagagaatgccttaaatttgaaggaaaaggtaaatgtttccttgaaacaaggtggttcgtcttactgtttccttgatagattggttagtgacatattgtcactgaaatctgctacatctagagttcactga

SEQ ID NO: 2236 - DNA, 1164 bp, Glycine max var. Williams 82
atggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggttgatcaggttgttggtgtccatgggagaagcattgagaacaatttccttcaaagtgaagacggcttcatgtggtggaacacaatgtgttaatacttttggggatgagcagcttgcagtggatttgctagctaatcagcttctttttgaggccttaaattactctcatttctgcaagtatgcttgctctgaagaaaatcctgagctcttggacatgggaggtccagttgaaggtggatttagtgttgcatttgatccccttgatggctccagcattgtggacacaaatttcacagtaggcaccatctttggtgtgtggcctggagataagttgaccggcatcaccggaagagatcaagttgctgcagccatgggggttcttggtcctagaacaacatatgtacttgctctaaaagacttccctggcacccatgaatttcttctgcttgatgaaggaaaatggcagcatgtcaaagagaccacagaaattggtgaaggaaaattgttctccccaggaaatttgagagccacatctgacaaccccgattatgctaagttgatcgattactatgtcaatgaaaagtacacattgagatacacgggaggaatggtgccagatgtcaaccagattattgtaaaagaaaaaggcatcttcaccaatgtgacatcaccatcagccaaagccaagctgagactgttgtttgaggtagctccgttggggttcttgattgaaaaagccggaggttacagcagtgatggtcatcagtctgtgctagacaaagtcatcactaacattgatgagagaactcaagttgcttatggatccaagaatgagatcatccggtttgaagaaaccctgtatggtaaatccaggctcaaggatggtgtagctgttggagcagctgcttaa

SEQ ID NO: 2237 - DNA, 849 bp, Glycine max var. Williams 82
atggccactgccaccgccgccgccgccacgtcatactttttcggcacccgtctcaacaacgttaacacgacaaccttaaacaacggaagattccacgcgctcttgaacttcggcaaaaagaagacggcgccgcagccgccgccgaagaaaaaggaagtgaaagtgaaaccctccggagaccggctggtgtggttcccgaatgcggagccgccggagtggctcgatggaagcatgatcggcgaccgcgggttcgacccgttcgggttcgcgaagcccgcggagtacctgcagttcgacctggactcgctggaccagaacctcgcgaagaacatcgccggcgatgtgatcggaaccagggtggaggtcgccgaggttaagccgacgccgtttcagccctactcggaggttttcgggattcagaggttccgtgagtgcgaactcattcatggaaggtgggcaatgctgggttctctcggtgctttggccgttgaggctctcacgggagtcgcatggcaagacgccggaaaggtagagctagtggaaggatcatcttacctgggacttcctcttccattttcattgaccacactgatctggattgaggtgatagtgatagggtacatagagtttcaaagaaatgcagaacttgacccagagaaaaggttgtacccaggtggcaggttctttgatcctctgggtttggccaacgaccctgaagaaaaagccagacttcaacttgctgagatcaagcattctcgcttagccatggtggtcttcctcatctttgcaattcaagctgctgtgacaggaaaaggcccaatcagttttcttgctaccttcaacaagtga

SEQ ID NO: 2238 - DNA, 1311 bp, Glycine max var. Williams 82
atgtcaccggtcgccggagtcagtgcccccctcctgggggaatccaaagcagcgacgccgccggcttccgtccccggcgcggtgttcaacgtggcgacaagcatagtcggcgccggaatcatgtcgattccggcgatcatgaaggttctcggcgtggtgccagcattcgcgatgattctcgtggtggccgttctcgcggaactgtcggtggacttcctgatgcggttcacgcactccggcgaaacgatgacgtacgccggcgttatgagggaagcgttcggatcggccggagcgttggccgcgcaagtttgcgtcatcatcaccaacgtcgggggcttaattctctaccttatcatcatcggggatgtgctatctggaaagcaaaatggaggtgaagtgcatttgggcattttgcaacagtggtttggaattcactggtggaattcccgggaatttgctttgcttttcaccttggtcttcgttatgcttccattggtattgtacaaacgtgtagagtccttgaagtacagttctgcagtgtcaactcttcttgcagtggcatttgttggcatatgttgtggtttggctatcacagctctggtgcaaggaaaaacacaaactcctagattgtttcctcggttagactaccaaacgtcattctttgatctgttcactgcagttcctgttgttgtcacagccttcacatttcattttaatgtgcatcccattgggtttgagcttgccaaggcatcccaaatgacaacagcagttcgattagcattattgctttgtgctgtgatctaccttgcaataggtctatttgggtacatgctatttggggattcaacccagtcagacattctcatcaattttgaccagaatgctggttctgcaattggttcctttctcaatagtttggtccgtgtaagctatgcactccacatcatgctggtgtttcctctattgaacttctctttgagagccaacatagatgaagttctcttccctaagaagcctatgctagccacagacaacaaaagatttatgatcctcactctggtgctgcttgtattctcctaccttgcagctatagcaatcccagatatttggtacttctttcagttcctgggatcatcatccgcagtgtgccttgccttcattttccccggctctattgttttaagagatgtccacggtatatcaacaagaagagacaaaattattgcactggtaatgattatactagccgtggttacaagtgtgcttgccatttccaccaacatatttaatgcttttagtagcaagtcataa

SEQ ID NO: 2239 - DNA, 1359 bp, Glycine max var. Williams 82
atgtttgagggtttgtgcttgaaaatggagaaaagagggaatgtgttgatggagaagtatgagtttgggaagctattaggtcaaggaaactttgcgaaggtttaccatgcaagggacgtcagaactggtgagagtgttgccgttaaggtgattgacaaggagaaaattctaaaaattggactagtggatcagacgaagcgagagatatcgattatgagactggttaaacatcccaatgttttgcagctttatgaggtcttggccaccaagaccaagatttacttcatcatagaatatgccaaagggggcgaacttttcaacaagatagccaaaggtagactcactgaggacaaggcaaggaagtactttcaacaattggtcagtgctgttgatttttgccacagcaggggtgtttatcacagagatttgaagccggagaacttgcttttggatgagaatggagttctcaaggtagcggattttggattaagtgcacttgttgaatctcaccgtcaaaaagacatgctgcatacaatttgtggaactcctgcatatgtggctcctgaggttataagtagaaggggctatgatggaacaaaagccgatgtatggtcttgtggagtgatcttatttgttcttttggctggtcatttgccattctatgatttgaatcttatgtcactgtataacaaaataggcaaggccgattacaaatgtccaaactggtttccgtttgaagtgcgcagactgttagcgaaaatccttgaccccaacccaaataccaggatatccatggcaaaacttatggaaaattcgtggttcagaaaaggattcaaacccaaatctggtcaagtgaaaagagaggctgttaatgtggctttagttgattctgatcaagttttttgcttgtgtgagaatacaagtgctgctgttgttgaggcagagcaagcattggttaaaccttcacagtttaatgctttcaatataatttctctgtctgctgggcttgacttgtctggcctttttgctggcaatgttgaactggatgataccaaatttacatttatgagctctgcctcatccatcatgtctacaatggaggatattgctcgcgttttgagtatggagataattaagaaggatggagggttgctgaaattggagagatccagggaaggtagaaaaggaccactttccattgatgctgaaatatttgaggttgccccatctttccatttggtcgagttgaagaagtcctgcggtgatgcattagaataccagaagatattgaaggaagacttaagaccagctctaaaagatattgtcggtgtttggcaaggtgagcagcatctgcactag

SEQ ID NO: 2240 - DNA, 1284 bp, Glycine max var. Williams 82
atgttgttgaatagtaaattttgcttatcgtatttgtgctttggatgtttagtgtgttctaaactttgtagtttctatggacagaaagcacctgaagtggaccaaccatcaaattcctttctgcttctcttgaatggaattggagtattttcttccggtgtgttgggtgctctctataaacttgctcagaaagaaaagtccactgttgttgcaacaatagaaacagttttaagagaaaaagaagaggagcttcatcagctaaaggatcagtttgaacttgccctaggtgaagcaagcaaaagccagatcgtcattgctgatttatcccaagaaagagatgatttgaaggaggctctagataatgaatctagcaaggtgaatcatttgaagcatgaactccaagttacccaggagaatcttgcaaaatcaagaaatgagtctgctgaattggaaaaccttctaactttgtcaaataaactgtgcaaagagctcgagctcgaggtctctaagctctcgtctgagctcactgaggttaatgaatcgctacagagaaaccttgatgatcttacaactgccaaggaacacttgagggaagcacaagcagagctgcaaggtgtgtcaaaagaattgacagctgctcttgaaaagaatgatagcctacaaaaagaattagttgaagtctacaaaaaggctgaaagcacagcagaggatttgaaggaacaaaaacagttagagcagcaagtctcaaaagacaaggagtcccgaaaatctcttgagggggacctggaggaggcgaccaaatcattagatgaaatgaaccgaaatgcggtgatcctttctggggaactacagagagctaattctcttgtttctagccttgaaaaagagaaagatgtgcttattaagttcctaaacgaccaaagaaatgcatgcaaagaggcccaagacaacattgaagatgctcataaccttatcatgaaacttggcaaagaaagagagaatttagagaaaaaaggtaagaaatttgaggaggaattggcttctgccaagggtgagatattgtgcttgaagagtcgaatcaattcttcaaaagttgctgttaacaatgaccaagtgcagaaagatggaggtgaaaacaaagtgcagaaagatggaggtgaaaaaaaggtcaattcttcaaaagttgcggttaacagtgagcaagcacagaaagatgaaggtgaaaacaaggttactgtaagcgcacggaagactgtcagaagaagaaaggctaatccacaataa

SEQ ID NO: 2241 - DNA, 1284 bp, Glycine max var. Williams 82; identical to SEQ ID NO: 2240

SEQ ID NO: 2242 - DNA, 2001 bp, Glycine max var. Williams 82
atgcgttggagctctactaactcagaggtggttgcttcaaacaaaaccacgttaggagagattttggacattgagaaaaacatggctaagtgggtgctcaatgctccagagccaccttccatgctgcgtcaggtcgtggacaacgtcaaggacaccctcttgccacatccaaatccaaagacattctcttatctcaggaaccaacccttttccaaacgtgcctttgccttgttgcaagacttgtttcccattcttccttcactccataactacaatgcccaaaagttcaagtgcgatttcatggccggtctaacccttgcaatcttcgctattcctcagtgtatgggaaatgcgacattggcgcggctaagtcctgaatatggcctctatacaggaattgtcccacctcttatttatgccatgctggcgagttcaagggagatagtgatcggacctggatctgtggattcactgctactttcctcaatgatccagacattgaaagttcctattcatgattctattacttacaaccaacttgttttcactgtgactttttttgcgggcatctttcaagttgctttcgggctctttaggtttggttttctggtggaatatctttcagatcccacgatcgtggggttcttggcagcagctgccgtgagcattgggctacaacaattgaaaggattatttgggatcgttaactttaccaacaaaactggtttattttccgtggtcaaatctctttggacatcgttcaaaaaccaatcagcctggcatccctacaatttaattattggattctcatttctctgtttcatcctatttaccagattcctgggcaaaaggaacaagaaactgatgtggttgtcacacgttgctcctctcctttctgttattgtatcctctgttgttgcatacaaaataaactttaacgagcttcaagtgaaggactacaaagttgaagtcttgggaccaattaaagggggcagctcgaatccaagctcactccatcagttaacatttgatagccaagttgtgggtcatttgatcagaatagggctcaccattgctattatttcactcacgggatctattgctgttggccgatcatttgcatctctaaaaggacacagtattgatcccaacagagaagtggtgtccttgggcataatgaacattgttggatccttaacttcttgctatattgcatcaggatctttgtcacgtactgctgtaaactacaatgctggctctgaaacaatggtgtcgaacatagtgatggcactgacggttctcatgtcacttaaatttttgacggggcttttgtatttcactccgaaagcaatccttgcagcaataattctctcggccgtaccgggactgattgaccttaacaaagcacgtgaaatttggaatgttgataaaatggatttccttgcttgcactggagcctttttgggagtcttgtttgcatctgcagaaataggccttgcaattgggatcacgatatcatttgcgaagataattataacctcaattcaacctgctacagcggttattggaaggcttccaggaacggatgcattcggcgatgttgaacaatatccaatggcggttaacattcctggggttttgatagtctctttaaaatcttcttggctttgttttgcaaatgcaaatcttgtggaggaaaggattgagagatgggtgaacaatgcaaaagctaaggaaggaagagaaagcaccttcacatacgtcattattgatgcctcaagtcttacgaatattgacaccgcgggaatagcttctctggtggagctcaacaaaaatctgatttcacggggagtaaagttagctatcgctaaccctaggtggcatgtaattcacaagctaagattagctaacttcgtgagcaaaattggaggaaggattttcctttctgtgggagaagcagtagatgcatgtgttggcactaaaataatggttgttgtataa

SEQ ID NO: 2243 - DNA, 2291 bp, Glycine max var. Williams 82
tcaacaaaagattaagagttgctccaatttgttgattaaacaataggaaaacaattgaagttccctggtccttgcgtgtataataactggcatgcatgtccaaataaagaagctagctagctagctagaaggagtgaagaattgaagcaccttctctgacagcactaggttcttgaaatgcgttggagctctactaactcagaggtggttgcttcaaacaaaaccacgttaggagagattttggacattgagaaaaacatggctaagtgggtgctcaatgctccagagccaccttccatgctgcgtcaggtcgtggacaacgtcaaggacaccctcttgccacatccaaatccaaagacattctcttatctcaggaaccaacccttttccaaacgtgcctttgccttgttgcaagacttgtttcccattcttccttcactccataactacaatgcccaaaagttcaagtgcgatttcatggccggtctaacccttgcaatcttcgctattcctcagtgtatgggaaatgcgacattggcgcggctaagtcctgaatatggcctctgaattgtcccacctcttatttatgccatgctggcgagttcaagggagatagtgatcggacctggatctgtggattcactgctactttcctcaatgatccagacattgaaagttcctattcatgattctattacttacaaccaacttgttttcactgtgactttttttgcgggcatctttcaagttgctttcgggctctttaggtttggttttctggtggaatatctttcagatcccacgatcgtggggttcttggcagcagctgccgtgagcattgggctacaacaattgaaaggattatttgggatcgttaactttaccaacaaaactggtttattttccgtggtcaaatctctttggacatcgttcaaaaaccaatcagcctggcatccctacaatttaattattggattctcatttctctgtttcatcctatttaccagattcctgggcaaaaggaacaagaaactgatgtggttgtcacacgttgctcctctcctttctgttattgtatcctctgttgttgcatacaaaataaactttaacgagcttcaagtgaaggactacaaagttgaagtcttgggaccaattaaagggggcagctcgaatccaagctcactccatcagttaacatttgatagccaagttgtgggtcatttgatcagaatagggctcaccattgctattatttcactcacgggatctattgctgttggccgatcatttgcatctctaaaaggacacagtattgatcccaacagagaagtggtgtccttgggcataatgaacattgttggatccttaacttcttgctatattgcatcaggatctttgtcacgtactgctgtaaactacaatgctggctctgaaacaatggtgtcgaacatagtgatggcactgacggttctcatgtcacttaaatttttgacggggcttttgtatttcactccgaaagcaatccttgcagcaataattctctcggccgtaccgggactgattgaccttaacaaagcacgtgaaatttggaatgttgataaaatggatttccttgcttgcactggagcctttttgggagtcttgtttgcatctgcagaaataggccttgcaattgggatcacgatatcatttgcgaagataattataacctcaattcaacctgctacagcggttattggaaggcttccaggaacggatgcattcggcgatgttgaacaatatccaatggcggttaacattcctggggttttgatagtctctttaaaatcttcttggctttgttttgcaaatgcaaatcttgtggaggaaaggattgagagatgggtgaacaatgcaaaagctaaggaaggaagagaaagcaccttcacatacgtcattattgatgcctcaagtcttacgaatattgacaccgcgggaatagcttctctggtggagctcaacaaaaatctgatttcacggggagtaaagttagctatcgctaaccctaggtggcatgtaattcacaagctaagattagctaacttcgtgagcaaaattggaggaaggattttcctttctgtgggagaagcagtagatgcatgtgttggcactaaaataatggttgttgtataaccaacaacaatttggctttctatggattaaattgttttttgtatctggagcaaactgtcaaacatttgttagttattaattttatcacaaatatttcaaaatgtgcattgtacaccgtt

SEQ ID NO: 2244 - DNA, 1813 bp, Glycine max var. Williams 82
tcaacaaaagattaagagttgctccaatttgttgattaaacaataggaaaacaattgaagttccctggtccttgcgtgtataataactggcatgcatgtccaaataaagaagctagctagctagctagaaggagtgaagaattgaagcaccttctctgacagcactaggttcttgaaatgcgttggagctctactaactcagaggtggttgcttcaaacaaaaccacgttaggagagattttggacattgagaaaaacatggctaagtgggtgctcaatgctccagagccaccttccatgctgcgtcaggtcgtggacaacgtcaaggacaccctcttgccacatccaaatccaaagacattctcttatctcaggaaccaacccttttccaaacgtgcctttgccttgttgcaagacttgtttcccattcttccttcactccataactacaatgcccaaaagttcaagtgcgatttcatggccggtctaacccttgcaatcttcgctattcctcagtgtatgggaaatgcgacattggcgcggctaagtcctgaatatggcctctatacaggaattgtcccacctcttatttatgccatgctggcgagttcaagggagatagtgatcggacctggatctgtggattcactgctactttcctcaatgatccagacattgaaagttcctattcatgattctattacttacaaccaacttgttttcactgtgactttttttgcgggcatctttcaagttgctttcgggctctttaggtttggttttctggtggaatatctttcagatcccacgatcgtggggttcttggcagcagctgccgtgagcattgggctacaacaattgaaaggattatttgggatcgttaactttaccaacaaaactggtttattttccgtggtcaaatctctttggacatcgttcaaaaaccaatcagcctggcatccctacaatttaattattggattctcatttctctgtttcatcctatttaccagattcctgggcaaaaggaacaagaaactgatgtggttgtcacacgttgctcctctcctttctgttattgtatcctctgttgttgcatacaaaataaactttaacgagcttcaagtgaaggactacaaagttgaagtcttgggaccaattaaagggggcagctcgaatccaagctcactccatcagttaacatttgatagccaagttgtgggtcatttgatcagaatagggctcaccattgctattatttcactcacgggatctattgctgttggccgatcatttgcatctctaaaaggacacagtattgatcccaacagagaagtggtgtccttgggcataatgaacattgttggatccttaacttcttgctatattgcatcaggatctttgtcacgtactgctgtaaactacaatgctggctctgaaacaatggtgtcgaacatagtgatggcactgacggttctcatgtcacttaaatttttgacggggcttttgtatttcactccgaaagcaatccttgcagcaataattctctcggccgtaccgggactgattgaccttaacaaagcacgtgaaatttggaatgttgataaaatggatttccttgcttgcactggagcctttttgggagtcttgtttgcatctgcagaaataggccttgcaattggggtatatttttgttttttttttctttaaatttttttgtgacatggttaacttcaattaaatgttgaaagataaatttgcagcccatgtggatacccatataataataataataataataataattgacatg

SEQ ID NO: 2245 - DNA, 567 bp, Glycine max var. Williams 82
atgttgcttggaaaacgtcctcgggcaccgattatgaaaagaactacaagcatgagtggtggtttggccgtggaaaccaaaacaagcaaggaggaagaagtactcatgtctgataacatgaaactcgtggatccacatgttaacgttgttgccatgggaacaccaaatgatcaattcgtgcctaaccacaccaaaaatgtttctcaggccaacggttcatatgtatatggtgaccgtttgatgggcatgggcgtcaacatgagcatgcctctttccccgacaacctcaaataaccatcgtcaccacatgactcacaaccatacaacaaacactaacaacatacatactacttctcactttcttcggacttgtggcctctgcaactgtcatttggcacctggccgagatatctatatgtataggggggacacggcattttgcagtttggagtgtagggagaagcagatgaagcaggaccagaggaaagagaagtggaaggcggggtctaataaggagcaccaccgtgcatcgccaccgggcgccaccgcgaaggcttcttgtaattga

SEQ ID NO: 2246 - DNA, 426 bp, Glycine max var. Williams 82
atgatgaaaagatgtgaattggtgtttgaagcttcaacaagaggagggtgtgaggagcacccatatgataagcaatcaccaggtgtttgctcctcttgcttaagggaaaagctatctcagctatacaacacaaaccctattattgatcctcgttgtttttcttctccttcttctccttcttcgcctcatcaatcttttttttcttcgaagcacggttcttccggtcaccggagaccgcgctttcggaggaacgcttcgcaagcggcggaatctgcctcgtgcatgctgagcttgaacttgaagaagagcaagtcgctggcgtttgcttcgaggaatagggagagggatgtgatgatgagtggaaggaagaaagatgggttttggacaaaggtgctcaaactcaagagaaaggatacacgggcctaa

SEQ ID NO: 2247 - DNA, 2186 bp, Glycine max var. Williams 82
ttataatatcatgtattatcttctctttcctttttatatttctattatatatactccttgtagggtaagatgattcatttttttaataattattaacataataatcttaaagaactagtttaaagtggaagaaagggatgaacacagttgacttgaccttactcgattccttccaacagcactcttcttctccctggtcataattcatttgcaattcttgttgaaacaatgcatctagaggtatatgaacaagtctcactatctttcttggtctgctgtcggtgtttgtgacctcgaaatttcgttcaccagtgttttgggttgaattctgcttacccttcaagtatttttcagtttcccagaaaaaaatattggtgtggctagtcaaagttgagctttttttgtcccttttgttatcatagtttgattccttcaccaaagttatataaacatgttgtatgtgttttggagtttcagctagagacttggacaattttggttgctattgtgtgcatcttggtatttcttctgaaggagtttgttatgggagggaagagctcaaaagggagtggtaggaggtatgattttggtgcttcttcatcttcaagggataatagctatggtggataccctccgcaatcaccatacacttcttatcaaacacctcagcacccttgtgcatcagcatcagcatcagctccattttatgactatgcacagccaaaaaggaagttggataagaagtattccagaatagctgataattaccgttctttggatgaggttactgctgcacttgcgaatgctgggctggaatcttctaatctcattgttggaattgatttcaccaagagcaatgagtggacagggaagaggtcattcaatcgaaaaagtttacatgacattagaagtggtcaaaacccttatgaacaagcaatttctattatcggaaagactttatctgctttcgatgaagataacttgattccctgttttggattcggagatgcgtctacacatgatcaagatgtattcagtttcttttcagaagagaggttctgcaatgggtttgaggaagttctgacacgatacagacaaattattccttccctcaaactcgcaggacccacttcatttgcccctattattgaaatggctatgactattgttgagcaaagtggtggccaatatcatgtcttgctaataattgcagatggacaggtgactagaagcgttgacacacagcatggcaacttaagtccgcaagagcttaatacaataaatgcaatagtaaaagccagtgagtatccactgtcaatagttttggtgggagttggagatggaccatgggaaatgatgagggaatttgatgataacatcccttctcgtgtatttgacaattttcagtttgtgaattttactgaaataatgaggaggaatgtagatccagccagaaaagagacagatttttcactttcagctttgatggagataccttctcaatacaaggcaaccctagagcttggcatattgggttcacggaggggacattcaccagatagggttgctctacccccacctctttatagtagaacctcttccagcatcagcacaaaatctacaaggtcaaacagttttcagcagaggacacctacacatactagctatgatagcggtgttcacacagagacatcatcaagttctttatacgataataaggtttgccccatttgtcttaccaatgcaaaggatatggcctttggttgtgggcatcagacttgttgtgagtgtggagaagacctccaattctgtcccatttgccggagcacaatccatactagaataaggctttactagttagctttgatgcagaagtactttcaatgaaaatttcatcatttccagaataaggggctgcaaaaggatgtgcagatttggtcaggctcttttcaagatggtttcttgtccacaaaaactgcactcgcaatttcgaggcaaaacttgtattcccagttacagttaggaagaagtgttcacagaaagaattggccttccctgttgtatatatatgcagttcatgtgtcttggaaggcatcatgtttttaaataaactgcttgtataaaaattgtttgcatttttctaaagagcatttattgttttggtcaaatctagattgtctttctac

SEQ ID NO: 2248 - DNA, 594 bp, Glycine max var. Williams 82
atggcagcaaccatagcaacaacaatggctatgatcaactcaaagtgcatcaacacaacagggtcatcacacaagttgcacaaccccaagctcccaccctcaaaacccaccctctcccttttctcccttcagaacctcccaaagggcctaacctcccacgtctcaacttccacagcaggcactgccatcgcaggcgcaatattctcctcactcgcaaactgcgacgcagccttagctgcatcgcaaattgctgaattagccgaaggtgataaccgcgggctggcattgttgttgccgttgattccagccatagcgtgggtgctgttcaacattctgcagccagcactgaaccaactgaaccgcatgcgtaacagcaagggggtcatcgttgggctcgggctagggctctgtgcatcgggcatgatgtccggcccagaagcgtcggctagtgagattgctatgattgccgatgctgctgccagtgacaacaggggacagcttctgctgtttgtggttacaccagcgattgtttgggttctgtacaacattttgcaaccggcactcaaccagcttaacagaatgagatccgagtag

SEQ ID NO: 2249 - DNA, 1815 bp, Glycine max var. Williams 82
atggataatggttgtttctcttccccaagacgtgattttcctgctggtctgagagttctagttgtggatgatgatccaacgtggctcaagatccttgagaagatgctcaaaaagtgcaattatgaagtgactacatgttgtttagcaaggcatgctctaagcttgcttcgtgaaaggaaggatggatatgatatagtgatcagcgatgtaaacatgcccgacatggatggttttaaacttcttgagcatgttgggcttgagatggatcttcctgtcattatgatgtctgtggatggggaaacaagcagggtgatgaaaggtgttcaacatggagcctgtgattatctccttaagcctataaggatgaaagaactgagaaacatatggcagcatgtcttaagaaaaaggatacatgaggccaaagaatttgaaagttttgagagttttgagagcattcacttgatgagaaatggatcagagctatcagatgatgggaacctgtttgcggtagaagatgttacctcaacaaagaaaagaaaagatgcagataacaaacacgatgacaaagaatgtttggatccatcatccaccaagaaagctagagtagtctggtctgtggatcttcatcagaagtttgttaaagcggtgaatcagattggatttgataacatcttatatctttcacgcacacaaaaaattgtaacaaatcatatttgtttggcagaagtggggccgaagaaaatactagatctgatgaatgtcccatggctgactagagagaacgttgctagccacttgcagaaatacaggctttatttgagtaggattcagaaagaaaacgatcagagatcttcctcaagtggattgaagcattcagattttcctttaaaagatatgagaagttttggttttcagaactcagtaaacaaccagcaacaaaacgatgttgccattgacagctacaatcattcggatggatcattacaacttcagaatgtggaaactaaaagtcacgaagcggatcccaagggaattgtttcacagtccaccatagcgaaaaaaggaaggattttgactggtaacattgctgacacaaatatgagagagagtttaagggttggccttaatcaaacttttgcccctctggagtcagaagaaaaccatgcagtatttgattgttccatgccaacaccatacacttggactgaagttccacacatgcaactcaaagaagaacacaagtcaattgttcatttagaagatagcttcaatcagttgccattacatggtaagcagcagcaacacatccaagtggatcaatcacaatcagttgcttcaattagttccgctcccttgataacggaggaagaggttgctgcttgtaaagagccaaaacctttgtttgcagattacaagaatgattatgccaattctgtgagttcaatagggaatgcagttggcacctttcctattcaaccaggaagtcttattatgaatggtcaatcttcagaacccatttccaccacaaattctggattgaaaacacagggatataataatctcagtagcatttctgatctggaaatttaccaaagcaaccttcttttgggaggtgaggtagcttctgcaccatcattggatgaggacttgcatttctattggctacaaggtgaatgctataataatatgaacttcagtctgcagaatataggaatgtctgaatattatgatccaggacttatttcagaagctccaacacacttatatgattcagctgattactcagttatagatcaaggtctattcatagcatga

SEQ ID NO: 2250 - DNA, 270 bp, Glycine max var. Williams 82
atggccgccaacagatggttgaaacctgaggtatacccactcttcgcttcagttggtgtggctgttggaatctgcggtatgcaacttgttaggaatataaccaccaatcctgaagtcagggtgaccaaacagaacagaactgcaggaattcttgagaattttgcagagggagagaaatattcacaacatagcctgaggaagtatgttcgcggcaagcagcctcagattatgccatccgtcaacaacttcttctctgatccatcaaactaa

SEQ ID NO: 2251 - DNA, 732 bp, Glycine max var. Williams 82
atgggaaggggaagagtggagttgaagaggattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgttggagaggtaccagaaatgcaactatggagcgcctgaggacaatgtggcaacaaatgaagccttggtattggagttaagcagtcaacaagaatacttgaggctgaaagcgcgttatgaagctcttcagcgttctcaaaggaaccttatgggagaagatcttggtcctctaagcagcaaagagcttgagtcacttgaaaggcagctagattcgtctttgaaacaaatcagatcaataaggacccaattcatgctggatcagctttctgatctacaacgtaaggaacactttctaggtgaatcaaacagagatctcatacaaaggttggaagagtttcaaataaatccacttcaactgaatcctagtgctgaagaaatggggcatggacgctatccaggtcaaccccaaggccatgctctctttcaaccattggactgtgagccaaccttacaaattggatatcatcctgatccagtatcagtggtgtcagaaggcccaagcatgaataattacatggcaggatggttaccatga

SEQ ID NO: 2252 - DNA, 1359 bp, Glycine max var. Williams 82
atgtggggcaagatattgcaatccataaggaaaagtctcataagccttcaacagaagtctatgaattctcgaaagagtgaagaagttgatagtagtgtcactagtgtgtctgtgtcactgcatgatggtgtgcagtgggtaaattgcaattgttgcatagaggaaaacaaacaatgcaattttgaccacattaatgcctcagaaggcgcaaataatgtccacgcccagcgtgatgccaacgccaacagttcttttactcatgctgtaatcaacatggtggggatgctcgtaggtttggggcaactgtcaactccatatgctgtagaaaatggagggtggtcatctgcattcttgcttatgggactaggagtgatgtgtgcttatagttctcacatacttggagtatgccttagaaagaatcccaagttaacaagtttcatggatattgggaagcatgcatttggatcaaaagtgtttttggggacaaatttgaagcttcacttgcctaatttttcttcatcccagctcctaactgcggtggcagtcttcattgcaatgcctagtttgtggatcagagacctttcttccatatctttcctttcaagtgttggcattctcatgtctctactcattttcctgtgtgtagcagccactgcactcttaggacatgtccaatctaatcattccatacctgtcctccacctccataatattccatcagtatctggcctctacgttttcggctatggaggacatattgttttccctgaattatatacagccatgaaagacccctccaaatttacaaaggtttctattgtgagcttcgcagtagttacagcaatttacacgacattggggttcatgggtgcgaagatgtttggtaaggatgtgaagtctcagatcacacttagcatgccacaagagcacattgtaacaaagattgctctgtgggcaaccgtggtggcacctatgaccaaatatgcacttgaattcaccccatttgcaattcagctagagcatgcacttccaacttccatgagtgtcagaaccaaaatgataattagaggctgcgtaggttcattttcacttttgttcatactaacccttgctctgtcggttccatatttcgagcatgtactaagtctcactggctccctggttagtgttgccgtttgtttaattttgccaagtgctttctacgtgaagatatgttggggtcagatatcaaagcctcacttactactaaacctcttcctcatcatattcggctttgttcttgccgtgatgggcaccatttcctcctcacagttactactcaaaagtcttcaatcacataacttgaggcacaaggaatga

SEQ ID NO: 2253 - DNA, 1659 bp, Glycine max var. Williams 82
atgaggtctgctggagcaaataccccaactcagaaggaaccatacattcgtactagagagaatccatacttcgatggccttctaagatctgatggtcagattcccttgaagtctcaattagaatttacgtatattggtgaaaccagacccaaaaactttgtctcagatatctctgaagaggttatggagttgtcaccggagaattcagcagtctcaggattgaactctaaatcttctgaacattcttcgtctgagaagtggttaaaaaccagcaaaattgctccatttatacaactggatattctatccgagctgattgaaccggataatccaaaacatcatcatcttggatatggccaaagcccccggactcctgaacaatcacctgcaatacacaatacagaaaagacatatactgtcattagaagaaaagaaaagctatcaagtattctacttccactatctgcagcttcatactatattggagtatcaccagaaatggaaattgttgaatcatgtgaaagcattgacaagctaaatgcatttttgaaagcaagaaaggatgatgtcaatgctggtgtacctgggaaattcttacatgctgttatgggttcagatggtgctgacgtgggaactgtggcttcaaccatcatgtattccttctacctacatgtaacttcagaaagcaatcaattctgcacagttccaattattaacattaaccgggcaaatcttggctcacatgttgaactcaagtggctgcttgattcgtgtcatattgatcagtcatccttaatttttgcagatgagattgatctctcatactatgatatatttggaagtcttaagatcgtactgttgaagggaagcaggatttccagtaagcaagagaaattaaagcaggctgtggttgaaatttttcactgcagaaagggagagacaatatatccatgggttaaaactgtcacaacaacagaagaggaaagctcttgttgcaccgccatagcagacaaatttgcgacgtattcgcctgaaattttggctagcaaatcattcagcaaacttctgctagctggcattcttttggatactgcgaatctaagggaccctcgttgctcctctaaagataagtacatggcttcattattgatcaatggtgctggtcgttatggatgcaatggtctttaccaattattgaggtacaaaatgcatgacctttcctccctccaagtagcagatatcttgcgaaaggattttaaaaagtggacaggacaagaaagtgcagattcaaggtcagtgcaaattggcatgagttgtatcggaatttcaatcggacagcttctttctcacgcagaaaatctagctcaagaaataacacgcttccagttatctgagaaacttcgagcacttattgtcgtttcggggtattataacgatgaaaagaacttcaagagagaagttttaatatctacggaatctgcaaagctattggagagtttgctcttcttcttcgatttcaatgcttcccggctgccactcaagagcttacactttccaggtctgaaaaatgggatgaaagcgtatgagatcgataagattacatcaaggaaaatagtagagcatctcatagaagagttcgttgggataccaaaagcctaa

SEQ ID NO: 2254 - DNA, 2835 bp, Glycine max var. Williams 82
atgaccaaccatgcatgttattcctgcctccttgcaaggttggtgcttttcttggctctttttcaaggcacttctgcccaaacacaagctcaggctcttctcaggtggaaacagagtctccctgcccaatccattttggactcatgggtcatcaactccactgctacaactctaactccatgctcatggcgaggtatcacttgtgattctcaaggcactgtcactataataaacttggcttacactgggcttgcaggtacccttctaaacttgaacttgtctgttttccctaaccttctccgtcttgatctcaaagaaaacaatctcactggccacataccacaaaacattggggtgctctcaaagctccaattccttgatctttccaccaactttctcaatggcactctgcctctttccattgccaatctgactcaagtttttgagcttgatctttcaagaaatgatataacagggatattagatcctcggttatttcctgatgaatctgataggccccaaagtggcctcattggtatcagaaatctcctcttccaggacaccctgctaggtggtagaattccaaatgaaatagggaacataagaaacttgactctgctagctctagatgcaaacaacttctttgggcctattccttcatctttaggtaactgcacacatttaagcattcttagaatgtctcaaaaccaactctctggcccaatacccccaagtattggtaacttaaccaatctaaccgatgtgcgctttcaaattaacaacttaaatggtacggtgccacgagaattgggaaacttgtcatcattgattgtgttgcatcttgctgagaacaaccttgttggtgaattaccaccacaagtgtgcaaaagtggcagacttgtaaattttagtgcagcatacaatagtttcacaggcccaataccaagaagccttagaaactgcccagcattgtacagagttcgacttgaatacaaccggctgacaggttatgcagatcaggattttggagtttatcctaatctcacttacatggacttcagctataatagggtggaaggtgacctctctgcaaattggggtgcttgcaaaaacttgcaatatctcaacatggctgggaatggagtaagtggcaacattccaggtgagatttttcagttggaccaactgcgggagcttgacctatcctccaaccaaatatcaggagagattcctcctcagatagtaaattcctctaacttgtatgaattaagtttgagtgacaacaaactctctggtatggtaccagcggatattggaaagctttccaatttgcggtccttagacatctccatgaacatgctgttgggaccaatccccgatcagataggggacatctacaacttgcagaatttaaatatgagcaacaataacttcaatggcacaatcccctaccaagttggaaaccttgcatctttacaagattttttggacttaagttacaattcactttcaggacaaattccttctgatcttgggaagctttcaaatttgataagcttgaatatctctcacaacaacctgtcaggttctatccctgactcccttagtgaaatggtgagtttgtcagccatcaacctctcctacaataatttggagggtccagttcctgaaggtggcgtattcaattcttctcatcccctggatttgagcaacaacaaagatttatgcgggaatattcaaggtttgcgtccatgtaatgtttctctcactaaacctaatggtggatcaagtaacaaaaagaaggttctgatcccaattgctgcttccttgggaggtgctctttttatttctatgttgtgtgttgggattgttttcttttgctacaagagaaagtcaagaactcgaagacagaaaagttcaattaaaagaccaaatccattttcaatttggtactttaatgggagagttgtgtatggagacataatcgaagctaccaagaactttgacaaccagtattgcattggggaaggagcgttgggaaaagtttataaagcagagatgaaaggaggtcaaatatttgctgttaaaaagttgaagtgtgatgaagaaaatttagacgttgaaagtataaaaacctttaagaatgaggtagaagccatgtctgaaacacgacaccgaaacattgttaagctttacggattttgctctgaagggatgcacacatttttaatttacgagtacatggatagagggaacttaactgacatgctgagagatgacaaggatgcattagaactagattggcctaagagggttgacattgtcaaaggtgtagccaatgctttgtcctatatgcatcatgattgtgctccgcctttaattcatagagacatatcaagcaagaacgttttactgtcctccaatcttgaagctcatgtctcagattttggaactgcaaggtttctgaagcctgattcgcctatttggacatcatttgccggcacatatggctatgctgctccagaacttgcttatacaatggcagtgaccgagaaatgtgatgtgttcagctatggtgtttttgctttcgaggttcttacgggaaagcaccctggtgaacttgtttcctacatacaaacttctactgaacagaaaataaacttcaaagagattttagaccctcgcctcccgcctcctgtcaagagccctattttgaaggaattggcattgattgccaacctagcactttcgtgtctgcaaactaaccctcaatctcgaccaactatgagaaacatagctcagctccttgcaatggatactgcagatatgagatga

SEQ ID NO: 2255 - DNA, 1023 bp, Glycine max var. Williams 82
atgaatttggcatcaggtgttggtggaaagattgaaaaatctcaaattttgtccgcagttgagaagtatgagaagtatcatgtttgtcatggaggccaagaggaagagagaaaagctaattacactgatatggttaataaatactatgatctttctactagcttttatgagtttggctgggggcaatctttccattttgcccacagatggaaaggggaatctcttcaagaaagcattaaaagacatgagcacttccttgctttacaacttggcctaaagcctggacaaaaggtcctggatgttggatgtggaattggggggccactaagagaaatttctcgattcagctcaacatcagttacaggattgaacaacaatgagtatcagataacaagaggagaggcgctcaatcgcattgctggagtggacaagacttgcaactttgtcaaggctgacttcatgaaaatgccattccaagacaatagttttgacgcagtgtatgcaattgaagccacctgtcatgcaccagatgcttatggatgctacaaagagatctttagagtgttgaagcctggccaatattttgctgcatatgaatggtgcatgactgatgctttcgatcccaacaacgaagagcaccaaaggataaaggcagaaattgagattggtgatggactccctgacattagattgaccacaaagtgtgctgaagctctaaagcaagcaggttttgagctaatctgggagaaagatcttgcgattgagtctcccgttccttggtactttcctctggatacaagtcgtttctcacttactagctttcgtctaactgctgttggacgatttttcacaagaagcttggtcaagggtctagaatatgttggatttgctccaaagggaagtctaagggttcaagaattcctagaaaaggctgcagatggactagttgaaggaggaaagaaagagattttcacaccaatgtatttctttttggctcggaagcctgaatcaagtgactactaa

SEQ ID NO: 2256 - DNA, 1383 bp, Glycine max var. Williams 82
atggccaaaaagaagagctggtttagtctggtgaagaggctctttatatgggacacacattccacacaagataagaaggagaaaagaaggaaatggatatttggaaggctaaagagcaagagattgccttcaattaaagctccactaccctcaaaaggaacaacactaagtgaggcagagcaagaacagagcaagcatgctttaacagtggccattgcctcagcagcagctgctgaagctgctgttactgctgctcatgctgctgctgaggttgttcgcctcactgggcaacgcaacgaaaactcagaagaatctcaacctgttaaaactaggaatggtgctccacaatccacataccagtgccagagggagattaaagaatctgctgcagccatcaaaattcaaactgcatttcggggttacctggcaaggaaggctttgagggcgttgaagggaatagtgaagcttcaagctatcattcgtggcagagccgtaagacgccaagctatgagtagtcttaagtgcttacagtccattgtgagcatccagtcacaggtctgtgcaaggaggctccaaatggttgaagggagatgtgattactctgaaaatgaagagatgcaagattctaaagacaaaataattaggatggactcaaacagtgaaagaaagtgggatgaaagcactgtattgaaggaagaggtagacacctcttgcacaagcaagagagaaagaacaaaagaatactcatttaaccacagaaggtcagcagagtcagaaagaagtaaagtaaatggaagatggaggtactggctagagcagtgggtagatacacaactttcaaagagtaaagagcttgaagatttagactcagtttttagctcacattctagagctggggaggaatatggaggaaggcaacttaagctgagaagtaatattcagagacaaaatccagttgaaggattggattctccaatacttggttcaagaagatcttttcctcataggaggcagtgttcagtgggagaggaccactcatttttaagctctcctgcaactccagcatacatggctgcaacagaatcagcaaaagcaaaagcaagatcaacaagctccccaaaaataaggactggggggaatgtggacatgaactctgatagctattcaccatgcaagaaaaagctatccattgcatcttctattaacagtgaaatgcttagtaatggtagggtgggcaagctcagtgttaaccagcagcaaagatcaccaagctttaagggactttcagtgcctataaaatcaagccgaacaactatcaaggatctcagtattaattcagattgctcactccctaattgggatcgacaggctttcttcaaatga

SEQ ID NO: 2257 - DNA, 1980 bp, Glycine max var. Williams 82
atggaatccagtaattgggttctcaaacatgcatcaattttactggttttcttccttagccttggttgttcaacctctgaaactctcactcgctcactcttggactttgtggttaccaacaccacagtcctacacagcaatttcactctggtatcagaattcagaatgataaacagacgaattttgaaggattgctctgcttcaaatccctttgtcaaagtcaatgtcacctcaaattctagcttgtcagatgacgagttcgtgacggtcacagttactggggtttccaatccttcagtcagtgattgggttgctatgatctcaccttccacttctgatgtgaaaacttgtattctgaatgaggccttctatctgcaaactggtgatacggccaaacttcctctgctttgtcattaccctgtcaaggcacaatacatgaaaaatgatccaaattacctcagttgcaaaaagaaagaatgtaagacattccaaaatgggaaatgtgctgtctcaacgtgcagtggttcactacagtttcatgttgtcaacattagaagtgacatcgagttcgtgttcttctccggtggattcgtggaaccatgccttgtgggaaggtccacgcctgtgagctttgctaatcctaagaggccactctatggacatctctcgagcatagattccactggaacatcaatgagattgacatgggttagtggagacaaggagcctcagcaaatccaatatggaaatggaaaaacagttgcttcagcagtcactacattttcacaagatgatatgtgtagttcagcgctgcctagtcctgctaaggatttcggatggcatgatccaggatacattcattcagcacttatgacaggacttaagccttcaagcaccttctcctacagatatggaagtggctgggttggttggagtgaacaaatcaaattttcaactccacctgctggaggatcagatgagctaagattcattgcatttggtgatatgggcaagactcctcttgatgcttcagaagaacactacattcagccaggagctctttcagttattaaagctatagccaatgatgtaaattccaacaatgtaaattcagtctttcacatcggagacataagctatgcaacaggttttctagcagaatgggattacttccttcaccttatcaacccagtagcttccaggatttcttatatgacagcaattgggaaccatgagagggattatatcgattccggttcagtatatgttactcctgactctggtggggaatgtggagtaccatatgaaacatactttccaatgccaacttcagcaaaggataagccttggtactcaattgaacaaggaagtgttcatttcacagtaatatcaactgagcatgactggtcagagaattctgagcagtatgaatgggtgcaaaaggacatggcatcagttaatcgacagaaaacaccttggctaatcttcatgggacatagaccaatgtacaccaccaaccatggattcttaccttctgaaaacaaatttatggaagccgtagagccattgctattagaaaataaggttgacttggttctttttgggcacgtgcataattatgagagaacttgttccttgtttcaaaatgaatgtaaagccatgcctgcaaaggataaaaatggtgttgacacatacgatggcagaaattacagtgcccctgtgcatgctgtcattggcatggctggcttcaccttagacaagttctcaagcaatgtaaaaagctggagcctgaaaaggatttctgagtttggttatttaagagcacatgctacgaggaatgatttaaacttggaggaatgttgtgccatatatcagaagcagagatttcctatgttggctaaagtagatattcacgttttcaggaaggaatatgtccaaatgcattcctctcatagtgaggtattatttaaatatctgtaa

SEQ ID NO: 2258 - DNA, 207 bp, Glycine max var. Williams 82
atgggagacgtattctacggcaacgatgaccaccgagaaatgaacgatgattgtatgtataaggaggatgtagtgatggagagcatcagaagccaacgggaaatcaaagacctcaagcgcagacaaaacaacaacaactgctgctacttctacttccttcgatgctttcactttctcacgcttctccctgctttcgtcaacttctga

SEQ ID NO: 2259 - DNA, 486 bp, Glycine max var. Williams 82
atgtttggccaacttgagcatgagctagagctgcacgtgccggcgagtgaggcatgggatctgtttggtgcccttgaaataggaaaacttgttgcccaagagctgccggaattgtttcaaaaggtggagctaacagaaggagatggaggggttgggactgtcctcaaactaacttttgctccaggtgtacctgggccagctggttacaaagagaagttcactaagattgataatgagaagcgcataaaagaaacagaggtagttgaaggagggtacttggagttaggattcactctatttagagttcgtttggaagtgatagagaaaggtgaagagtccagcataatcaaatctacaatcgagtatgaagtcaaggaagagaacgcggccaatgcctcacttgttactatccagccagtggcaaccattgctgaacttgccaagaattatctcaacaaaaacaaggctgcaaaagaagcaaattaa

SEQ ID NO: 2260 - DNA, 904 bp, Glycine max var. Williams 82
cagcgagtgacataaatacatacgccaaaatcaaagtatgcactaagcctgcaagattttgtcttggtacgcacttactgccctatatgttttaagcgagtttcatacttcacacgcacaccagaaacattgtgattttcaaggtaggcttttctccagaagatagaagatgtttggccaacttgagcatgagctagagctgcacgtgccggcgagtgaggcatgggatctgtttggtgcccttgaaataggaaaacttgttgcccaagagctgccggaattgtttcaaaaggtggagctaacagaaggagatggaggggttgggactgtcctcaaactaacttttgctccaggtgtacctgggccagctggttacaaagagaagttcactaagattgataatgagaagcgcataaaagaaacagaggtagttgaaggagggtacttggagttaggattcactctatttagagttcgtttggaagtgatagagaaaggtgaagagtccagcataatcaaatctacaatcgagtatgaagtcaaggaagagaacgcggccaatgcctcacttgttactatccagccagtggcaaccattgctgaacttgccaagaattatctcaacaaaaacaaggctgcaaaagaagcaaattaagtagtaatcatttgcctatatagttcatgaataaagataccaacttaattacatgctttgtttcatcaattcatatcacaatgttttctttctcagatgatttgcatttatcttgagaaacatctatgctatgaaatgagaattgggtggtagtaataccatatacattttgttgatcagtacattcatcaatttaattatcagaacatgcaacctagctagctggttggatcatattgaatgaattat

SEQ ID NO: 2261 - DNA, 1748 bp, Glycine max var. Williams 82
ctgaaactccaaggaacatgggcgtccttcttgtcttctccaacaccaacaaattaattaacaagtggaagcgcttctcttcttgttcaaacctatttcatcttagcaatccaaaaatacatatatggtaaattaattaagttcagtaatttgtttctgcagattttctggccattcgtggggtcaaactgggtgaggaaaaatgagtgacaatttgatgggaaaagtcaacgctttgggggagcgtctcaaaattggtggggctgaggtgggtcggaagatgagtgctggcatgagttctgtgagcttcaaggtcaaggaatttttccaagattcaagccatgctggtaaactcgttggggaagctacctctgaggccctacatgagcctgattgggctacaattcttcatatatgtgacttgatcaatgctgatcaacttaacactgctgaattggtacgtgcaattaagaaaagggtcgtggccaagagtcctagaggtcagtatctggctttggttttgcttgaagcgttggtcaagaactgtgacaaggctttcttggaggtggcaactgagagagtccttgatgagatggtcaagctcattgatgaccctcagactattcttaataaccggaataaggctttgataatgattgaggcatggggagagtcaaccattgagcttcgctatctgcctgtctatgcagaaacttacaagagtttgaaatcaaggggtattcgattccctggccgtgacaacgaaagcttggctcctatatttactcctcctcactctgccattactccagaggctgatgtcagttttgcagatcttattcagtatgatattcatgggcaaagcttaacctctgttactcctcctcgttctgccactactccagaggctgatgtcagtcttgcacatcttatgccgcaagatattcatatgcaaagttttaagtctgaacaaataaaggaaacatttgatgtcgcgagaaatagcattgagcttctttctactgtgttgtcttctacaatgcagcagaatgtgttgaaggatgagttgaccaccacattagtacaacagtgccgtcagtcccagactagtgtccatagaatcgttgagactgcttgggataatgaagcagtgcttgttgaggccttgaatgttaacgatgagattcagaaggttttctccaaatatgaagagctgaagaaggagcagaaggagcctaccgttgttccatttgaagctgaaccggttgttaccaaagaggaagcactgattagaaagccaggttcaagaattggagtccatggagggagccacgatgacatgttggatgatcttgatgagatgatttttgggaaaaagggtagggatgatgcatttgaaggagggcaacatccaaagaaacaacaatcatcatcaaaagatgacctcatctccttctaagttgccacagcaacaaaaacaaagcctgtctatatattagactactaggacagtgtctttgacttgattgcttgctgctttcatttctatatgttgattatatgtataaactaattaagttctgataccactttccattattattacaacgtgaaaaaaactcagagaactttagcacgtctaagaattagttgaaagtcctacctggaacatatgtttgaactttgaatataccatagaaatgtaataagccaatcaagctattgcaatgcaaacatattattccttc

SEQ ID NO: 2262 - DNA, 1053 bp, Glycine max var. Williams 82
atggagaccctctgctctgcattggtgttcccatctttcagaatcagaacttcagctttctccaaatgtggcatcagggcttccattgccgttgagcaacaaacttcccagactaaggttgctctcctcagaattggtaccagaggaagtccactagctctggctcaggcatatgagaccagagacaagctcatggcatcacatgcagagctagcagaagaaggggctattcagattgtaataataaaaacaactggtgacaaaatactatcacagccacttgcagacattggtgggaagggcctattcacaaaagaaatagatgaggcactcataaacggtgacattgacatcgctgtccactcaatgaaagatgttcctacgtacttacctgataaaacaattctaccatgcaaccttccacgtgaggatgtaagagatgcatttatatccttgagtgcagcttcactggctgatctaccctcaggaagtattgttggtactgcttcactcagacgaaagtcacagatactgcacagatacccatctctaaatgtggaggaaaatttccgtggcaatgtccaaacaaggctgagaaaactcagtgagggcattgtccaagctaccctattggcattagctggactcaaacgtttaaatatgacggaaaatgtgacttcgatcctatcaattgatgacatgcttccagctgttgcccaaggtgcaattggaatagcctgtagaagtaatgatgataaaatggcggaataccttgcttcactgaatcatgaagaaacaagactagcagtttcctgtgaaagagccttccttgaaaagttggaagggtcttgccgcactcctattgcaggctatgctagcagaaatgaggatggcaattgcttgtttagaggattagttgcatcccctgatggaatccgtgtgcttgaaacttccagaattggcccatatgctttcgaagatatgataaagatgggtaaggatgctggagaggagcttctttctcgagccggacctggctttttcagtcgttaa

SEQ ID NO: 2263 - DNA, 939 bp, Glycine max var. Williams 82
atggatgaccaattttcgaccgttcatagtcatagtcgtgagccaatgcctaggggcttagttcatgagaagtcttcagagcccaaatttcttgcctacattggtgcccacgaatttttcacaatagagacgtggaaagcagctttggtagagttaattgcaactgctgcactaatgttcaccctaacgagttgcaatattgcatgtttggagtcacaagatgtcaatccaaagcttattcttccctttgcagtcttcatcatagtattcttgtttctaattgtgatagttcctctatccgggggtcatatgaaccctatttttacattcattgcggctttaaagggtgttgtgaccctttctcgtgctctcctttacgtgtcagctcaatgcattggctcaataattggtttctttgtactcaagagtgtgatggagccaaaattagcagacacatattctttgggaggttgtgcccttggtgacaaaggacaaagttctggcctaaggccacaagatgctttgttgttggaattctcttgcacattcttagtactctttgtgggtctaacgttggcatttgataagaaaaggtgcaaggaattgggcttgccaatggtttgtttggtggttgcagcatccttggcactggcagtgtttgtgtccataactgtaactggcaggcctggctatgcaggtgctgggctgagccctgcaagatgcctaggtccagcgttgcttcatggaggcccactatggaatgggcattgggttttctggcttgggcctttcttggcctgcataatctattatagtgtctccattaatctaccaaagaaaggtttgaattgggttgatggagaatatgatgtcttaagattggctctgggttcttgtaggactatttctaataatacggatttaaatgatctttcttga

SEQ ID NO: 2264 - DNA, 1674 bp, Glycine max var. Williams 82
atggattggtgtcaaaatcaaaacggaagttttaaaagtacagatgcactatgtattgcggcagaagctgatgaggaggaacttgatttcacaaaggtagacaagccaaggcctatagaaagatgcaaatcatgcgaagtaagatcactaagtgaactgtccaaagtttctgagaactcttcttactcaatagaccatcttgataaggcagcttctcttcagccaaaatcgggtatgaataccccaggatcattggtattggatccacaatcacatccaatagtatctgaaggctgggaagctctgatgcgttccttggtgtattttcgtggtcagcgtgttggtacaattgctgctatggatagttctgatgagaaaatcaattacgaccaggtgtttgtaagagactttgtccctagtgctttggcttttctgatgaagggggaacctgaaattgttagaaattttatcttgaagacccttcgccttcaatcatgggagaaaatgattgataagtttcacctagcagaaggagtaatgccagcaagttttaaagtacttcatgatccagtcagaaaccatgagaccttgatagcagactttggtgaaagtgcaataggccgggttgctcctattgattcgggattttggtggattatattacttcgtgcatacacaaagtctacaggagacaattccttggctgaactgcctgaatgtcagaagggcatgcgcttgattttgaatttatgcctttcagagggatttgacaccttccccactctactatgtgcggatggatgctgcatgatagatcgtagaatgggtgtttatggttatccaattgagattcaagcacttttcttcatggctttaaggtgtgccttgatattgctaaaggaagatgctgaaggcgaggagttcagagaaagaattaccaaacgattgcatgccttaagctatcacctgagaagctatttttggttggatttgaagcaacttaacaatgtatatcgcttcaaaacagaagaatactcacatactgcagtcaacaagtttaatgtcattcctgattctctacctgattggatttttgatttcatgccacttaaaggtggttactttattgggaatgtcagtcctgctaggatggatttccgttggttttgccttggtaattgcatagctattttgtccagcttggctactcctgagcaatccattgcaatcatggatctcattgaatctcggtggcaggaactgattggggagatgccactaaaagtttgttatccagcccttgaaaaccatgagtggcgaatcataactggatgtgacccaaaaaacactagatggagttaccacaatggaggatcttggccagttctattatggcttcttgctgctgcctctatcaagacaggacgaccccaaattgcaaaacgtgcccttgaaattgttgaaactaggttgttcaaggacaactggcccgaatattatgatggaaagcttggtcgttatattgggaagcaagcccgcaaatgccaaacttggtccattgctggttacttggtggctaagatgttgttggacgatccatcacatttaggtatggtggcactagaggaagacaaacaccaaaaacctgtgctcagaagatcaaattcattgtga

SEQ ID NO: 2265 - DNA, 327 bp, Glycine max var. Williams 82
atgaaagaaattaaaatcaaactccaaagagttccatacgtgctagttgaccccacaatttggccttcaatgggttactattattgtaaacccaggccttgtgatactcatactcccaatgttgttctgatcttggccgtggccttgattcttctatgtgccccaaagttcttctcaggtgaagcagaggaagaagaagatgaaacgaataacacctcaccttttcaggtaccaataatcatagtactcatcctgcttttgttgtcctttttgggaggttcaagaagaagggtttgtgtcaagccaccatattgtcagttttgctga

SEQ ID NO: 2266 - DNA, 1704 bp, Glycine max var. Williams 82
atgtcagatcttgaggctcccttgcgccctaagaggaagaaggtttgggtggactatttcgttcagtttcgatggatccttgttatttttgtggtccttcccatctccttcaccatttatttccttacataccttggggatgtaagatctgagtggaagtcctataagacgcgtcagaaggaacatgatgagaatgtgaagaaggttatcaaacgtctcaaacagaggaatccatcaaaagatggtcttgtctgtaccgctcgtaagccctggattgctgttgggatgcggaacgttgactataagagagcccgtcattttgaagttgatttgtctgctttccggaatgtacttgagatcgacaaagaacggatgattgcaagagttgagcccctagtcaacatgggtcagatcagcagggtgactgtacccatgaatctttcccttgctgtagttgcagagcttgatgatctaactgtcggtggtctcattaacggctatggtatagaaggaagctcccacaaatatggtttgttcgctgatactgttgtggcctatgaaattattttggctgatggcactcttgtgagagccaccaaggacaatgagtactctgatctatactatgccattccgtggtctcagggaacactcggccttcttgttgctgctgagatcaggcttatacccgttaaggagtacatgaagctaacctataaacctgttgttggcaccctgcaagatcttgctcaggcatattgtgattcttttgctcccagagatggagaccaggataatgaggagaaggttccagactttgttgaaggaatgatttatacaccaacagaaggtgtgatgatgacaggaagatatgcttcaaaggaagaggccaagaagaaggggaataagatcaacagtgtaggatggtggtttaaaccctggttctatcagcatgcacagacggcactgaagaaaggagagtttgtagaatacattcctaccagagaatattatcacaggcacacgagatgcttgtactgggagggaaagcttatcctcccatttgctgatcaattttggtttaggtatctgtttggctggttgatgccacccaaggtttctctcctcaaggcaactcaaggtgatgctataagaaactattaccatgaaatgcatgtcatccaggacatgcttgttcctttgtacaaggtgggagatgctttagaatgggttcaccgtgagatggaggtataccccatttggctctgcccacacaaattgttcaagctgcctgtcaaaactatgatttaccccgagccaggattcgaactacaccgcaggcaaggagacacccaaactgctcaaatgtacacagatgttggagtttattatgcaccaggtcctgttcttaggggtgaggtatttgatggggcagaagcagtgcgtaaaatggagaactggttgattgaaaatcatggttttcagccacagtatgctgtgtcagagctgtccgagaaaaacttctggaggatgtttgatgctggtttatatgagcatactaggaggaagtatggagctgttgggacctttatgagtgtatactacaaatcaaagaagggcaggaaaactgagaaggaggtacaagaagcagagcaagcgcaccttgaaactgcatatgcagaagttgatcaaccagtagactga

SEQ ID NO: 2267 - DNA, 306 bp, Glycine max var. Williams 82
atggcttccctctatgacgtgcttggaatttcagtgggtgcaagctgcatcgaaataaaggctgcttacagaaagctggcaagaacacaccatcctgatgttgtggccatggatcagaaggaaagctcagcgaaccaattcatgatgatccattcagcttactcaactttgtctgacccagagaagcgagcacaatatgatagagaaatctatagatacagaagatcagcaaatatagcaggaagaaatcagacattttcctatgctggaagtggaaggaaatgggaaacagaccaatgttggtaa

SEQ ID NO: 2268 - DNA, 1986 bp, Glycine max var. Williams 82
atgactgttgaaaagagaattgttttggttgggattagaattgatggctatagcagacagctcctcaactgggcacttgccaaagttgctgagcctggggattgtgttatagcagttcatgttgttaaaagttcggattatgtttccaaaaacaagactctgatagatggctatttagaagtttatgaaggcctatgtggtgtgaagaaggtaggtctcaccggtcaaatcttcacaggaagctccattaaaaacattcttgttagagaagctaaaaagcatgctgccctggctctagtggtagggggtcgagctgccacagctaaatattgtgctaaacgtctacaacccaccaccaatgttctagccattcaagactcaagaattgtcttcagaagttgcaccaataaacaactaccaggtggtcttatactggatccaagaccaagtttaacaatcataaaagaaaatttgcgtgacagagcaatccactcttcaatttgtgactccatcgtggagattgaggaatcaacgcgcaaaaattccttagaatcgaaggaagaagcgtttaatggatcagaaaagagcaagtcaaggtcaatatccatgtttgcaggtgattctgccgaacagaagcttggatggcctctactccgcagagccaattcaggaatgtcacaaacccttcatgcaagggacatgtcagtagtacaatgggttatgaccttaccagatcgttcaccaaataaaggttctagctcttcttccactgaggaaaatccatttgaaaggagcatcagcgatgttgaatatgagagctcttcaaattcctctccttcatctgttgatataccaaatggcctggaagagatgttaaatttaaattctctaaattgcaagcggttcagccttgaggttctgaagtcttgcactagccaattctcttcagaaaaattggttgggaaaggagggagcaatcgtgtgtacaaaggagtcctcactgatggaaaatcaatcgcagttaaagtaatgcagtcatcaaaagaagcatggaaagattttgcccttgaggtggaaataatatcctcattggagcacaaaagcattgcccctttacttgggatttgcatagagaacaatactttaatatctgtttatgactatttccccaatggcagcttagaggaaaatctgcatggaaagaacaaggatgaatccatcttgtcatgggaagtaagatttaatgtggctattaggatcgctgaggcccttgattacctacacagggaagctttgaagcctgtcatacataaagatgtcaagtcgtctaacattcttctctcccaagggtttgaacctcagttgtctgattttggactagcagtatggggaccaacaacttcatcctttttgacccaagatgtagttggaacatttggttaccttgctcctgaatacttcatgtatggaaaggtcagtgacaagatagatgtctatgccttcggtgtagttttacttgaactaatatcaggaagggaacctatcaactcggcagcttgcaaaggacaggagagcttggtcgtgtgggcaaaaccaataatagagagtgggaatgttaagggcttattggacccaaatttagaagggaaatttgatgaggcccaattgcaaagaatggttttggcagcatctttatgcatcacacgggctgctagacttcgtcctaaactgagccagatactgaagatcctaaaaggagaagagaaagttgaatatttcttaaactctcaaggagataatgatcaggaggattcagaaaatcaagaaaacattgatgacgaagtgtatccaaattcaagtgcagagttacacctaagtcttgcattacttggtgttgacgatgacagtacatcacatagtagcacagaccacagctatagtgaagacttgaaagaacaatggagcaggtcatcaagttttaattag

SEQ ID NO: 2269 - DNA, 867 bp, Glycine max var. Williams 82
atggccattcaagcacagtggtatccaaataattctgcttctccgttttgcaacaatggtttttgtgctggtgggcttattgactctcatatcaatttccaaccgaaaaatcatcttcaacaacagcagttgcagctatcagaacagcatttgaaagagttatataatgcgagtcatggaactgttgatccaaatcttcatgtttataattcaaaagccgtgaattctcatatgtttgctgttcagcttgagaagcaaagggaggagattgatcagtacatgaaatccgaggatgagaaattgagatatatgctacgggagcatgggaaacaagtgatggcattgttgaagaaactggaatctcgatcacttcatgttttaagggaaaaagatgaagaaattgcgcaagctattaagaaaagggtggagttggaagagtatttaagaaagctagaggcagaaaatatgaagtggcagaaagtggctcaagagaaggaaaacatggcattgtccctctataaaacattggaggaaatgacagaaagtggcaattttttgaacaatgggatggtggcaaatgatgcagtgtccttttgtggcgaaactgggggaaaagaagagatggacgaagaagaagcaacagcagagaaagagaaaaaacgtatagaatgttgcggtggggtgagtgagtttgaacagaatacgagaagaggagtaatggtttgtaaaagctgtcattctaggagctcgagctttctgtttctaccatgcaggcacctttcttgctgcaaagtttgcaacactttcctcgaggcatgccccgtttgcagcacaccaaagaaggctaccattgagttgagactttga

SEQ ID NO: 2270 - DNA, 1050 bp, Glycine max var. Williams 82
atggaaatgtgtggagccacagcactgacatggtcccataccatctgtccgtcgcttcaccttcctcgatccgtctctaccagggaggctaggagcttctgtgtttggtgtgtctctgatcaagaccccaagggaaataaaatgatcatatctgtaactggagcaacaggttttattggtagaaggttggtgcaaagattgcatgcagacaatcacagtgttcatgtcttgacacgatctaaatctaaagcagaaacaatttttccagcaaaagactttccaggaatcaagatagcagaagagccagaatggaaagatagcgttcagggctcaacaggggttgtgaatttggctggactgcccataagtacccggtggtctcctgagataaagaaggaaatcaagcaaagcaggattcgagtgacctcaaaggttgcagaattgataaacagtgcaccagatgatattcgacctaaagtttttgttagtgcaacagctgttggttattatggcaccagtgagacacaagtctttgatgaacaaagtccatcaggaaaggattacttggctgaggtttgcagggaatgggaatccacagccctaaaggtaaatggagatgttagagtggctctaattcgcattggtgttgttcttggtaaagatggtggagcattagttaaaatgatacctatcttcaacttgtttgctggtggacctctaggctctggaaaacaatggttctcctggattcatttggaagacattgtcaatttaatatatgaagcactatcaaatccatcttacaaaggtgttatcaatggaactgcaccaaatcctgtgcgattggcagaattgtgtgaccagctgggaaatgtcttgggtcgtccctcatggctgccagtaccggactttgcgctcaaggctgtccttggagaaggtgctactgtggttttagaagggcagagagtgcttcctattcaagctaagaagttgggtttcccattcaaatatccttacgtgaaggatgcccttcaagcaattctttcttga

SEQ ID NO: 2271 - DNA, 1098 bp, Glycine max var. Williams 82
atgaacaatccaactcttttcttattgcttgttgcgttctccctcgttttcgcggccgtgtcggcctcttcggacggcggcaacgaggaaccgctgatcatgcaggtggtcgatggcggtgacgtccggctgggagcagagcaccactttttggagttcaagcgcaggttcgggaaggcgtacgattccgaggacgagcacgattacaggtacaaggtgttcaaggctaacatgcgccgcgcccgccgccaccagagtctggacccttcggcggctcacggcgttacgcgcttctccgatcttacgccgtcggagttccggaacaaggtgttgggtctgagaggtgtgaggttgcctttggacgcgaacaaggctcccattctccccactgataatcttccgagtgattttgattggagagatcacggagcagttacccctgtcaagaatcagggttcgtgcggttcgtgttggagcttcagcaccactggggctctcgaaggtgctcactttctgtctacaggggaacttgtcagtcttagcgagcagcagcttgttgattgtgatcacgagtgtgatccagaagaaccaggatcttgcgactccggatgcaatggtggattgatgaatagtgcttttgagtacatccttaaatctggtggggtcatgcgcgaggaagactacccttattctggtgctgatagcggaacctgcaaattcgacaaaacgaaaattgcagcatcagtggcaaacttcagtgtcgtctcactagatgaagaccagattgctgccaatcttgtgaaaaatggccctcttgcagtggccatcaatgcagcatatatgcagacatatatcggtggagtatcatgcccatacgtatgttcaagaaggcttaatcatggggtcttattggtgggatatggttctggtgcctatgcacccattcgtatgaaggagaagccattttggatcattaagaactcctggggagagaactggggagaaaatggatactacaagatttgccggggacgaaatatttgtggggtggactccatggtttcaactgtggcttctgttcatacaactactcagtag

SEQ ID NO: 2272 - DNA, 1388 bp, Glycine max var. Williams 82
agaatgaatgtgttatggagatttaggggttggtctgtgtatgtgaattgaaaaggacataaagtgagatctgttcttaggttcgttcattccctccctgtcttcgttgtagggagatgatggattggaatggatggattccttgccaagttagaattacaagcacacacacatacacttcttttattattttttaattttcattaaagaggtcgaagcccgtccaagtacgctaaattacagacaggtgttcgttcaatggagatttttcaaagtaaatatgaaatcaatatattgacaaacaaccattgcaacaacagaaatactaagacactctttaatatccttttttaaacatttttttattggttgaaaattatcgaaatttaaaaaaaaaaattgagtctctcatgttattttataattctttcttgtgattttataatttttaataaattttaaaagaatacattaagaggagtgtgttcctaatacttttcttacaaaaatatcttagagatttgagaaagattcaaataatcttttgacaacactttaaaataaagtagtttaaggttaaattaatctagccttttatgaaaatatgttgcatcaacaaatggataacatgagccccaattcatattaataaaatgttaatagttttgaccgctaatttagcaaaattgtaaacattattccttgggggatttcttggactccaatcttggttatggtccaagccttgtctggcgtagcatttggagttcccgggatttaatcaaagatggtactcatgaatcattttgggaacattcagtagaatcaagtacctggggactggaatgatatatgagttggaagttcctcataaggtcaagactctcttatctggcgcgtatgcagagaatgtctccctacacggattcaactccaaacgagagtattgttatgtgggaaaagattggattatggtcttggattgagccattgctgaataatgtagaatcgttttcagagatggtgtttaagtgtttgaagagcttcagtgcagaaaataccaggttttggttgtgtgcttcgagatggagaaggcaattttgtacagggtggattgatgttgtaatggaggtacaagaaaaagagactttagccatgtttaaagctatgaagtgggtggaacaattaccattctcggtagtgatttttgagagtgattgcaaaggcttagtaaatcaagtcaaaagccgaaataatagcactactgaattttgagttttggtagatagcataggacatatgcttatttgtaatccatctttttatattcaatttgcttattgtcgggctaattttgctgcgcatgcattaaccaggacgtcattaaa

SEQ ID NO: 2273 - DNA, 420 bp, Glycine max var. Williams 82
atgtgtgtggatcacttcttgcctataaaaagagatgctcagaggcttaaggtcctagccttcacaaatctaatgagaactccatatcttagcaaaaaaatgaagtcctttgcttttttcgtagtcttttctcttctggttgtcaacctcagctatgcaagaaaagacatgggagactattggaagaatatgatgaatggccaacctatgcctgaagcaatcaaagacctccttgttcaagatccacaagtatcagatgcagtgaaggatcattttattagggactttgatataaagcctaacaccatattatatcacacacatgttgtgcccaacaagcagaagcagaagcagaatattcagcaggccatggccaagaaattagaaccaaagtttcaaggaactgaaagacatggttga

SEQ ID NO: 2274 - DNA, 2625 bp, Glycine max var. Williams 82
atgacaaacgcacacggtggcgccatgttagtagagcataaaacaaacagcaacagcgtacacagacaaaagttcggagccttgttgcactccgaaacgacgtcgctttacacctccaaccacgacgacgatgaattctcctcccataataaccaacggcacagcagcaacaatgcctctccctacatcatgtccccatggaactaccaacctaatggcaataacaattcttcttctcctttcaataaatctccgtggctattgccttcttcgccggcgataaacctcttccaccaccaccaccaccaccacgataacgacctcccgtatcccctgtatgcgttggatccctcgtccgagggccacatatattccctcgccgtttccggcaacttgctatacaccggctctgacagcaagaacataagagtgtggaaggatctcaaagacttcacgggattcaaatcaagcagcggattggtgaaaacgattgttatttccggcgggaaaatcttcaccggccaccaagacgggaagatcagagtctggaaggtttcgtcgaagaatccgagcaaccataaacgcatcgggagcttgccgacgttcaaagagtacgtgaagagttcgatgaatccgaagaactacgtcgaggttcggcggcaccggaacgcggtgaaggtgaagcacttcgacgccgtttcgagcctgagtctggacgaggaggaaggcttgttgtactcggggtcgtgggacaagacgctcaaggtgtggcgcgtggcggattcaaagtgcttggagtcgattagcgcgcacgacgacgccgtgaacgcggtggcggcggcgttcgggggttgcgtgttgacgggctccgcggacgggacggtgaagatgtggaggagggagaaccaggggaagaagttcaagcacgttttagaccgtgttttgctgaagagggagaacgcggttacggcgctggcggtgaaccgtttagctacggtggtttattgcggttcttctgacgggttggtcaatttctgggagcgtgaccagaaaggtggattcttgcacggcggcgttttgagggggcataagcttgcggttctctgtctggccgcggcggggaaccttgtcttcagtggctctgcggataagaatgtttgcgtgtggaagcgtgacgaaaatggcttccacacgtgccattcggttctgacggggcacagtggtcctgttaagtgtatcgccgtagaggaagcagaaccgccgccggagggtcgttgcgagaaggggaacctgcggtggattgtgtacactgggagcttggacaagtcggtgaaggtgtggtgcgtgtctgaacacgcgccggacgcgagcgtgttccagagctgggccacaccgtatcattcctcctcctccgcagctggattcagttattcctcgccggggaaaattagtgttaattcatcaccggcgtggagttattcgtcgccgagaagaattggtgttagttccgtctcagcaggattcaactattcctcacccacttcattcgggctcaattcatcttcctccccagcaggaggaatgatttattcttcgcccagaaaaatcaatgttagcaacaacagtggaaatagcaaccgcaatggtgatagtactcaaagttttgataacgatgatgatgatgatgatagatgtatattcaatggcaatggcaccaacaacaggagcagtagcactaaaagcggcgacaatggcattggcagcaacaaccgcgatagtgttaaaagcagtggcaatggagaaaacaaccgcaacaatggtagttctaaaagcggtgacaatggcagcaacaacgtcaatcgtgataatgctaaaagtggtggcaatgacagcaacaaccgcatcagtgatagttctaaaagtggtggcgatggcagcaacagccgcgacagtgatagtgcttatggcagtggcaataacatccgaaacaaagatggtgctaaaagcaatggtaacagcagcaacattgatagttcttatggtaataggaatagcatacacaatagtgatagtgctaaaaacaatccccgtaatggtgatgatgcttatggcaacaagaacaacaatcataatgctaaaagcaatgggaatagcaatgactatcgcaacagcaatagtgttaaaagcagtggcactagcaacggcatccgaaacagtgattgtgctaaaagcaatagcaatggtgccagtagcaattacagccaaaccagtgaggacgctaaaagcaatgccaatggcaataacaatagcagctgcaagagtgatggtgctagtggcaatggaaagagcaattacaaccgcaacagtgatggtcctaaaagcaatgccattggaaatgacaaccaaaatagtggtgctaaaagcagtgacaatggcaatgaaaagatcaatagcaaccgtagcagcgatggtgctaaaagcaataacatccaaaacagcaatattgcaattaattacagtaaaggcaagagaaatgaagatagaaaacgaggtggagcttacgcgggtgataagcgttggaccaccttcactttcaacgtgcaaaaaaaggctaacacagcatga

SEQ ID NO: 2275 - DNA, 243 bp, Glycine max var. Williams 82
atgaattcctcaaaggcatgcacccttttgaatttggtagcggttgttatgttcgttgccattttgattagccaaagtagggtggaggctagggttttatctcattcggaggaatttgcatttgcaagagctaataatctccaaacatacacctcatcagcctatgagcaagccaagaaaaccatgggtttttggatgcagcgtttggcttctggaccaagtcctaaaggccctggtcattga

SEQ ID NO: 2276 - DNA, 801 bp, Glycine max var. Williams 82
atgttccaaactaaaatggcaactaactctctccattactccatccaacaccaccaatgttcactcaccaaacgccaccacccctcagacaccccaccccccacatcacttttcctcaaaccccctacaccccccatacaccacaacatcactctctcgcacactccttcaaactcatatatcacctattccatctctcaaaccacaccttcctccaccacctcccaaaccaccccgtccttcgacctcctccgccaccatctctccaccaataactttcagctggccgatgaggagacgcgtcgtctcctcatcgtgcttgctggcgaagccgcacagaagcgcggctacgtcttcttctcggaggtgaagttcatctccgagagcgccctcagggccatcgactccctctggagggagcacagcggcggcaaattcgggtacagtgtgcagaagaagctactggagaaggccaacggagacttcaccaagttcttcatcaagcttgggtggatgaagaagcttgacactgagatggagcaatacaactacaggtccttccccactgagttcatctgggagctcaatgatgacaccccagaggggcatttgcctctcacaaacgctctcagagggacacagttgcttaataacgttctcaaacacccagcttttgatgtagttgatgacaaagaagaagaagaagatggtgagaacaaggacaatggggcaatcacagataatggttcttcgtcaaagacattgggtcagaggatcttcaaaccggactatagcttctaa

SEQ ID NO: 2277 - DNA, 1563 bp, Glycine max var. Williams 82
atggcacataacggacatgtacttgtacttctcattgctcttgttacctcattcattattatcacagaaggcgttactacccctaatcctgaaatagcatctctgaatcggaatagtttcccaactggcttcatctttggcacagcatcctcggcatatcaatacgaaggtgcagcaaatgagggtggtagaggaccaagtatttgggataccttcacccataaatatccagataagataaaggatagagacagtggagatgtagccattgattcatatcatcgctacaaggaagatgttgggattatgaaggatatgaatttggatgcttacagattttccatatcttggtctagaatactcccgaaaggaaagctaagtggaggtataaatcaagaaggaattgactattacaacaaccttatcaatgagctactagcaaatggtctgaaaccatttgtgactcttttccattgggatcttccccaatcgttagaagatgagtatggtggcttcttaagccctcgcattgtgaaagattttcaagactatgcagacctttgcttcaaagaatttggagatagagtaaaacattggataactttgaatgagccatggagttatagccaacatggttatgcaacaggggaaatggctcctggtcgatgttctgcttggatgaatcctaattgcaatggtggtgattctgcaacagaaccttatttggtctcgcatcaccaacttcttgctcatgcagcaagtgttcatgtgtacaagaccaagtatcagacatttcaaaatggtctgataggcataaccttgaatgttaattggtacgtgccgttctcggataacaaacttgatcacaaggctactgaacgagctattgacttccagtatggatggtttatggatccactaacaacgggagattatccaaaaagcatgcgattcttagtgagagcacgattaccaaagtttacaaaagagcaatccaaattacttattgattcttttgattttattggcatcaactactattccgcttcttatgcctcagatgcacctcaactaagcaatgccaaaatcagctacctaacagattccctttctaattcctcatttgtacgtgatggaaaacccattggtctaaacgttgcttcaaattggttgtacgtttatccaagaggatttcgagacgttttgttatacactaaaaagaaatacaacaatcctttaatttatattacagaaaatggtataaatgagtatgatgattcatcattatcacttgaagaatctcttcttgatatttatagaatcgattatcattatcgtcatctcttttatcttcaagaagcaatcaagaatggtgtgaatgtaaaagggtatttcgcatggtctttgctggacaatttcgaatggcacttaggttatactgtgcgatttggaatgaattttatagattacaaaaatgacttaaaaagatactcaaaactttctgcattatggttcaaggattttctcaaaattgaaatcaaacttgaggaagattccatgtaa

SEQ ID NO: 2278 - DNA, 1575 bp, Glycine max var. Williams 82
atggcatttaaaggctatttcgttttgggcctcatagctcttgttgtcgttggcacttccaaagttacatgcgaaatagaagcagataaagtttcacctattattgacttttccctcaatcggaacagtttccctgaaggcttcatctttggggcggcatcatcctcctaccagttcgaaggtgcagcaaaggaaggtggtagaggaccaagtgtatgggataccttcacccataaatatccagataagatcaaggatggaagtaacggtgacgtagcgattgactcctaccaccactacaaggaagatgttgcgatcatgaaggatatgaatttggattcatatagattgtccatatcttggtcaaggattctccctgaaggaaagctaagtggaggtataaatcaagaaggaatcaactattacaacaaccttatcaatgagctagtggctaatggtatacaaccacttgtcactctttttcactgggatcttccccaagcattagaagatgaatatggtggctttttaagtccacgcatagtgaaagattttggagattatgcggaactctgcttcaaggaatttggtgatagggtgaagtattggattactctgaatgagccatggagttatagtatgcatggttatgcaaaggggggaatggcaccaggtcgttgttctgcatggatgaatttgaattgcactggtggtgattctgcaacagagccttatttggttgcacatcatcaacttcttgctcatgcagtagctattcgtgtgtacaagacgaagtatcaggcatctcaaaagggttcaattggcataaccttgatagctaattggtatataccgctcagagataccaaatctgatcaagaggctgctgaaagagcaattgacttcatgtatggatggtttatggatccattaacgtccggagactatccaaaaagtatgcgatctctagtgagaaaaagattaccaaaatttactacagagcaaaccaaactacttattggttcatttgattttattggcctaaactattactcatcaacatatgtctctgatgcacctctgctaagcaatgctagacctaattacatgacagattctcttaccactcctgcatttgaacgcgatggaaaacctataggtataaagattgcttctgatttgatatatgttactccaagaggaattcgtgaccttttattatataccaaggaaaagtacaataatccattgatttacatcactgaaaatggtataaatgagtataatgaaccaacatattcacttgaggaatctcttatggatatttttagaattgattatcattatcgtcatctcttttatcttcgatctgctattaggaatggcgcaaatgtaaagggatatcatgtatggtctttgttcgataattttgagtggtcttcaggttatacagtacggttcggaatgatctatatagattacaaaaatgatatgaagagacacaaaaaactctctgtattgtggttcaagaattttctgaagaaagaatctagactttatgggactagcaaataa

SEQ ID NO: 2279 - DNA, 1011 bp, Glycine max var. Williams 82
atgaggaagcccgaggtttctggaaacaacaacaacaacaacaacattaataacaagcttagaaaagggttgtggtcacctgaagaagatgacaagctcatgaactacatgctaaacagtggacaaggttgttggagcgatgtagccagaaatgctggccttcaaaggtgtggcaaaagttgtcgccttcgatggatcaactacttgaggcctgatcttaaacgaggtgcattctcacaacaagaagaggaactcatcatccacttgcattcccttctcggaaacagatggtctcaaatagcggcgcgcttaccagggagaacagacaatgaaattaagaatttttggaattcaacaataaagaaaagactcaagaacatgtcatccaacacctcaccaaatggaagcgagtcctcatatgagcctaataacagagaccttaacatggcagggtttactacttctaatacccaagatcaacaacatgctgattttatgcctatgttcaattcatcatctcaatcaccctccatgcatgccatggttctcaattccataattgacaggttgcctatgctagagcatggactaaacatgccatgttctggtggattcttcaatagcacagggccatgcttctcatcatcacaaagtggagttgacaacaaagggatttatttggaaaatggaggagtatttgggagtgtaaatattggtgcagaaggggatgtgtatgttccccctctagagagtgttagcactacttctgaccataacctgaaagtggagagcacatgcaacacagatactaacaatagttactttgatgacataaacagtatcctccttaataattgcaacattaatagcaacaataagagagctgaaaatagggctggtggggtggagaatttgtttcaggaagagttaaccattggagagtgggacttggaggagttaatgaaagatgtttcatcctttccctttcttgatttttcaaatatccaataa

SEQ ID NO: 2280 - DNA, 804 bp, Glycine max var. Williams 82
atggctgaggcaagcattggcagcaaaagcagcagatggtctttacagggaatgacagctctcgtcaccggtggatccaaaggaatcggatatgctatcgtggaggagttggcacagcttggagccactgtgcacacttgcgctcggaacgaagctgaactcaatgaatccttaaatgaatggaacacaaaaggatacagagtaactggttccgtctgtgacgtggcgtctcgtgcagaaagacaagacctcatagctagagtctccaatgagtttaatggcaaactcaatatccttgtaaacaacgtgggaacaaacgtaccgaaacatacccttgatgttacggaggaagacttctcatttctgataaatacaaatcttgaatctgcttaccacctaagccagcttgcacatcctctcctgaaagcttcagaggctgcaaacatcatttttatatcctccattgctggtgtgctatcaataggtataggatccacttatggtgcaacaaaaggagcaatgaaccaactgactaaaaatttggcatgtgagtgggccaaagacaatataaggactaattgcgttgcaccagggccaatcaaaacccctctcggtgacaagcattttaaaaatgaaaaacttcttaatgctttcatttcgcaaaccccccttggacggattggagaagcagaggaagtgtcttcattggtggcattcctctgcttacctgcagcctcttacataacaggacagaccatttgtgttgatggtggattaacagtgaatggtctctatataaattag

SEQ ID NO: 2281 - DNA, 231 bp, Glycine max var. Williams 82
atgggccagcaagttaatgctctaagcatatgcttggaagatcctctgtctatgtccccacccacatcccccatacccaaaaggaaaataccttcccttcccctttataatttagaaaacgttcattctcttgttctctctttgagcaatcatctattcatactctataattacctagctaggtgtgttgtattaattgcaattcaagatgctaattcggatggcaattga

SEQ ID NO: 2282 - DNA, 414 bp, Glycine max var. Williams 82
atgagtcccattggcttgtccttcctcttcctcatttctttagcacttctctctattgccagaggccaagaaagggcacctcacgggcttgtttacgagagccctgtagcttttccaccagcagcatatgacttctttcatcccaatgctcaaaagcctgagaacaaagacccgtgtgttgcatccaaatgttcaccactgcctctagcagctcaagtggatgccactcaaatatatgaaaacaaagcttcaacaacgcagaaaggtgggaaacaaataggaggtgggggtgtagctggcattatcactgctgttgcttttgctgtgcttttagctatgggaatctactatgtaaaagtcactcgccaagccaacatgagtcgagccagtaacagtgttcaatctcatgcttga

SEQ ID NO: 2283 - DNA, 609 bp, Glycine max var. Williams 82
atggaaaacagtgacatttcctctgccccactttctcactcccccactaattcctcttcttcctcaccaacaccaccttcacctcctactgttgtgatgagtccttgtgctgcatgcaagattttgaggagaagatgtgctgagaaatgtgtcttggcaccttattttcctccaactgaacctgccaagtttaccattgcacaccgggtatttggtgccagcaacatcatcaagttccttcaggagcttccagagtctcagagagctgatgcagtgaccagcatggtgtatgaggctagtgcaagaataagagaccctgtttatggttgtgcaggggcaatttgccagctccaaaagcagatcaatgaacttcaagcacaattggccaaggcacaagctgagcttgtgaacatgcagattcagcaagccaatcttgtggctctaatttgcatgaaaatggcacagagtccacaggaatcaccacaacaattagtggatgatttcatttcaactcctccccacagtggtggtgcctatcaaagtggcatgaacttctttgaggacaacactagcctaaactcactatgggaacagcccctttggacatga

SEQ ID NO: 2284 - DNA, 840 bp, Glycine max var. Williams 82
atgtacacacaccgcaacgcctcactctcacgcgccgccgactccctcggccatttcctctctcccccggacgcatccacggcgtcaccaatgcagtactctcccgccgccgccgccgccgccgctcctcctccccttcaccaccaccaccacggcgagttcgactcgctgctcgaactcaattactcggagatgagttcgaacaacacgtacaacagctgcagcagcgggtgcacgagctacatggggtcgccgagttcgctggcgagtaattacgagagtcgacgagtagtgcagaggagcgttagcagccactcgctgcaaaagaacggtgggacccaccaccatcccttttctgagttctctcctcttttcgctgagttcattgactcggaaaacggtcccgtacggagagcttgcagtaccggtgaccttcagagattcaatggaatgcaacattttcagcattctgatagctcattgtcaagtgaaagtagtttgatcatagaagaaatgagcagaaccagtccttatagcccagaggagaagaaggtgaggattgagagatataggaacaagagaaaccagaggaactactgcaagaaaattaagtatgcttgcagaaagacattggcagatagcaggccacgtatcagagggcgatttgcaaggaatggcgaaattgcaattaaccctccagctcagtggagtcacatgggaaatggagaggaagaggaagaagaggaagagaattgggctaatttctttgattccttagttcctgcaaatcttgctcaggagcctcaaggcagtagttcctcctttggtgtgttctattaa

SEQ ID NO: 2285 - DNA, 2841 bp, Glycine max var. Williams 82
atgttagaggacattgaatcatctactcagctttgtaaaatgggatttggtcgaaattcgacctcgagaagcggtgattacttggaagggatgctcaatgactatgttgggggaaggaacaaactgaaggctcagaaaagtgctgccacaactaagtttgtggcagcactcacgtgccttcaatttttctttgcagtctatgcaacattcctattgtattacatgggcccttccatcgatttaagaaccaagccagagttcacatgggctacaaaaattgcccaacaatggaagcaactcatgatcacaccccatgttattggtcactaccaagaagctgcttcctctctcatcaaggaggatcttcttcccacaactccttcccaagtgtgtgagaatgagaaaatagacttcatgcaaaagaagtccaatgatgtccaaatgataaagataaagagagagctctacgatgaggtgttgaacttccaaagcaaaaccattggcaccgagactctccaagagctaatggcaatgaaatccaaatgggacttaaagggtccaaagaggccaaaaatcacagtgttgctaaaccacttcaagcgaaagacactttgtgcacagcttgattctttgctccaacaaaccctcccttttcatcatgtttgggtgctctcatttgggagccccaatgaggtctcattgaagagaattgtggacacctataacgactcgagaatcagcttcataagctcaagctatgatttcaagtactatggaaggttccaaatggctcttcagactgaggctgatcttgtttatgttgttgatgatgacatgattcctggaaggaagatgctgcagattttggcacacgtggctgggacagacaagtacaagaattctgttttggggagtattggaaggatattgccctttagacagaaggatttcactttcccaagttacagaaaatttcggtctaaggaggcagggttgtatttgcccgatcctgcttatgatatcactgttgataaaattgtgcaggtggattttctttctagttcatggtttctctcagctgatcttgtcaagacactcttcattgagacaccttttaccttctcaactggtgaagatcttcacctcagctatcagcttcaaaagtacaaaaatgctggctcatttgttcttccagtggatcctaaggacaaggaaacttggggtgatagtgaacacaggcttgcatatgtgtctgaaaccacagtgattttcaaggatgtggttcaagtcagagatgatcaatggtggaaagcactttccacaggttatgtgactcagtgggctgcaatgtaccctcaaaaaattgatgcactcttctatgctcactcagttgatgaagtgaaagtccttgcaccacttcttgaaaagttcaggtccacagttggcaagaaggcctacattgttgtctctggaggcaattactgcccttgtgaagatgctgcaagagctctcaaatggcctgcattggtctgcaaggaacgccggtttaagatttttgatttggccgtcgaagccctttcaggggtgtcagattctgaggcaccagtgatacatgcagtgtacaccagcttgaagggtttgatcaaaattcacaatcccagtttagtgatcagtgtggctgaaattgaccctcatgtgagaaaagctctcaagatggcctcagaaaccaactcaaatggcaccacatttgttcttttaccaagttcttcagtttctcaagttctttggatggctgatctgcgttcaacagcattaccaaattggaatcggatgaggatctctgtgaacatcatcacacaaaatagagtcaattcactagcaaggcttctcaaatctctcagcaatgcctactatcttggagatgaaatccccattacttttaacatggatagcaaggtagatgaggcaactataagactagtaggttcatttgagtggcctcatgggaccaaaaccctgagaaggagaatcgtccaaggagggctcatccgggctgtgagtgagagttggtatccatcttctgatgatgactttggactcctactagaagacgacattgaagtttccccttactactacctatggatcaaatatgcactcatggcttaccactatgacccccaagtctctctccctgagctctcctccatctccctctacactccaaaacttgttgaagttgtcaaagagaggccaaaatggaatgccacagaattcttcaaacacatccaccccaacacaccttaccttcatcaactaccttgcagctggggggcagtgttcttccccaagcattggagagagttctatgtgtacatgaacatgaggttcactgaggatgccaaggccaacccagttcaaattccaaagtctagaacaaatggatggcaagcttcatggaagaagttcctcatagacatgatgtaccttagagggtatgttagtctctacccaaatttcccacaacaagcaagcttttcaaccaaccatatggaaccaggggcacacattagtgcaaaagacaatgtggttaagcacaacaaacgagactttgaggtgccactaatgaaagaagactttagaaactttttgccagcaatgaaaatgcctccagcaccaaggcttccatctctgaacctcttcaatcaaccagtttctctaaagggtctcaaagctgctggagctaagttgggacaagatgtgcttagatgtgacaatgccactgaggttgttgctgttgacaaagatactggtctacctcacacttgctccaaattctga

SEQ ID NO: 2286 - DNA, 255 bp, Glycine max var. Williams 82
atgaagcttgtggtgattgcactactagtgttgatgctggcaagctattctatggctacaaataggatgaaattggtgccaaaattggacgagagatcagaactgggtaatgaatctgatgataatgatcaccaccaaatccctcgaaagaagtatggaaaacctggatctgtcgaacgtacagtgagtgaggagtataatcaccattacatccctcgcaaggactatggcacacctggccagggtggaaattaa

SEQ ID NO: 2287 - DNA, 318 bp, Glycine max var. Williams 82
atgtctactactactaccacacatttctcccttctggccctttacctcatcctctctctaaattccctacacatgaccatggctgcaaggatcattccacaaagtgctcctagcacagttacaaggcctcaatttctatcagaagctgaaacttatttgaggccacatcttggtaacaaacaaaatgtcttccaagggagacaagtcaagaattgcttgccaaaagggtatagacataactcagctccaagcagattcgtgaactatgacacactaggctctagtggctgttccggaatgcgttcggagaagccatga

SEQ ID NO: 2288 - DNA, 282 bp, Glycine max var. Williams 82
atgaggtttttgactgtaggcattgccataatgaagctaaggtactcatgtcccgtttgctcaaaatccgtctgtgacatgtcaagtgtgtggaataagcttgaggaattgattgcctcaactccaatgcctgaaacctacaaaaacaagatggtgtggatactttgcaatgattgtggagtaaactctcatgtacaattccaaattatggccttaattgcaactcatacaacacaagacagatacagggagtacctgctacatcaagctcatcttgggtga

SEQ ID NO: 2289 - DNA, 615 bp, Glycine max var. Williams 82
atgcagctagctgtggcggccaacgctgtcgtttcaccgtcgccgttccgacctcatccccttctccggtcatccttctccggcgtctccgttaagctcactccccaatccataacgttttcacgcttgaagcccctcaccgtcttcgccgccaccaagaaggccgtcgctgtcctcaaggggacctccgccgtcgaaggcgtcgccactctcatccaagaagacgatggcccgacgacagtttctgttagcatcactggccttactccggggcttcatggttttcacctacatgagtatggtgataccacaaatgggtgtatatcaacaggagcacattttaatcctaataacttgacacatggtgctcctgaggatgaagtccgtcatgcgggtgacctgggaaacatagttgctaatgcagagggggttgcagaggctacaattgtggataatcagataccactctctggccctaattcagtagttggaagagccttggtggtccatgagcttgaggatgaccttggaaagggtgggcatgaactcagtttgacaactggaaatgctggtggaagattagcgtgtggtgtggttggtttgactccagcataa

SEQ ID NO: 2290 - DNA, 1692 bp, Glycine max var. Williams 82
atgaacctctctctatgcaattcttcaaaccttaacacctcaagaaaaccattgatggcactccctcactccatctctgccttagccaccacactcacactctcctcgccaacaaccaaaccccagaaagttaacccctttccctttttctcgaaccaaaagacacgatttttaacgaaacaaacgcgacccagaagcagaagaagcctctccctaacccctgcacgcgttgcggcgccaccctcaactgttgaagccgatcaatcatacccggagaccgaaaataacgaaactgaggaagagtttaacgatgaaagctcttattctaaattcacttggagggatcactggtaccctgtttcgttgatcgaagatctgaaccctctcttgcccacaccgtttcagcttctgggtcgtgaaatcgtgctctggtacgacaagtccatttcccaatgggttgcttttgatgacaaatgcccccatcgtcttgcccctttgtctgaagggaggattgatgaagatgggaagttgcagtgttcttatcatgggtggtcttttgatgggtgtggatcttgtgttaagatacctcaggctgcatctgaaggccccgaagcacgtgctattggatctcctaaagcgtgtgccactaggttccctaccatggtgtctcagggcttgctcttcgtttggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacaggaaggagagacagagccaagcctctgccattcaagatggattctcgtggttcatggggcttctctggagctaatgaagggaacccacagatcagtgccaagtttgttgcaccatgttatatgatgaacaagattcagattgataccaaactccctgtagttggtgaccagaaatgggtagtatggatatgttccttcaatgtccccatggcacccggtaagactcgctccatagtttgcagtgctcgaaacttcttccagttctcagtgccagggccagcctggtggcaagtcgttcctagatggtatgagcattggacttcaaacaaggtatatgatggagacatgattgttcttcaaggccaagagaaaatcttcctttcagaaaccaaggaaggtggagacattaacaaacagtatacaaacatcaccttcacaccaacacaggcagatcgctttgtcttggcatttcgaaactggctaaggcggcatggcaatggccaaccagaatggtttggcaacagcagcgaccaaccattgccatcaactgttttatcaaaacgtcagatgttggatagatttgaacagcacactctcaagtgttcatcatgtaaagcagcatatgagggattccaaacatggcagaaagtcctaattggtacaacagttgtgttttgtgcaacatcagggatcccatcagatgtccagttgcgtgtacttttggctggactcgcaattgtcagtgcagccataacttttgccctaaatcaactccaaaagaattttgaattcgtggattacgtgcatgccgaaattgattaa

SEQ ID NO: 2291 - DNA, 1371 bp, Glycine max var. Williams 82
atgggtaccctgcttccagatgaaaaatcagagaatccaaatgctttggaacaacttcaacaccaaaaagatgtggatgcaggcgctctctttgtcctcaaatccaaaggttcttggatgcattgtgggtaccacttgacaacttcgatcgtggcaccacctcttctaagtcttccttatgcattcaccttccttggatggacggctgggatcttaagcttagtgattggagctttggtcactttctattcatacaatttaatatctagggttcttgaacaccacgctcagatgggtatgcgtcagctacgctttagagacatggctcgcgatattttaggtccagggtggggtcgttattttgtcggcccaattcaattcgcagtctgttatggtgctgtagtagcttgtactctcttgggaggacaatgcatgaaggcaatttacttgctgtcaaatccaaacgggaccatgaagctttacgagtttgtaattatatttggatgcttcatgctgattttggctcaaatcccatctttccactctttgaggcacattaatctagtgtccttggttctgtgcttagcctatagtgccggtgctactattggttccatttacattggagactcatcaaaaggaccagaaaaggattattctttgaaaggtgattcagtgaatcgcttatttggaatcttcaatgcaattgctatcattgccacgacttatggaaatggaatcattccagaaattcaggcaacattagcaccacccgtaaaagggaagatgctcaagggactatgtgtttgttatcttgttcttatagttaccttctttagtgtatctgtatccggttattgggcatttggtaatgaatcagaaggcctcatcttaagcaacttcgtggacaatgggaagcctctggtgcccaagtggttcatttacatgaccaacattttcactataacacaattatctgcggttggtgtggtttatttgcaaccaacaaatgaagtgctagagcaaacatttggagacccaaaaagccccgagttctccaaacgcaatgtaatccctagagtgatatctcggtcattagctattgctatttcaaccactatagcagccatgcttccattttttggagacataaactctcttataggagcttttggctttatcccacttgacttcatcttgccaatggttttctacaatttgacatttaagccatctaagcgaagccctgttttctggttgaatgtgataattgttgtggctttctccgcattgggagctatagcagcagttgcagcagttaggcagatagttcttgatgctaaaaattaccaattatttgctaatgtatga

SEQ ID NO: 2292 - DNA, 2295 bp, Glycine max var. Williams 82
atgaggtttgccaaaattttgagctctttcacccttctgttcattgggtatactttggtgaatggatccacaccaaagcattatatagtttacatgggagatcattcacaccctaattcagaatctgtaatcagagcaaaccatgagatactagcttcagttactggaagcctcagtgaagcaaaagcagcagcactccaccattacactaaaagcttccaaggtttctcagccatgattacaccagagcaagctagtcaacttgcagaatatgaatcagtattgtccgtatttgagagcaaaatgaataaacttcacacaacacattcttgggattttcttggattagaaactatcagtaagaacaatcctaaagcactggacaccacatccgatgtcattgttggtgttattgactctggcatctggccggaatcggaaagcttcactgattatggactaggtcctgtgcccaaaaaattcaagggagagtgtgttactggtgaaaaatttacactggccaattgcaacaagaaaattattggtgctcggttctattcaaaagggtttgaagcagaagttggtcctctagagggcgttaacaagatttttttccggtcagcccgggatggtgatggacatggaacacacacagcttccacaatagcaggctccattgttgctaatgccagcttattaggtattgccaaaggaactgctagaggtggtgccccaagtgcgagacttgcaatctacaaggcctgttggtttgatttctgtggtgatgctgatattctttctgccatggatgatgccatccatgatggagttgacatactgtctctttcccttggccctgatcctccggagccaatttacttcgagaatgcaatcagtgtaggagcattccatgcattccaaaagggtgttcttgtttctgcttcagctggaaactctgtttttccacgtactgcatgcaatgttgctccttggatcctcactgttgctgctagcacaattgacagggaattcagttccaatatcttacttggtaactcaaaggtcttaaagaaaggtttgcatcttcagggttcttctctgaatccaataagaatggatcattcgtatggtttgatatatggaagtgctgctgcagctgtcggagtttcagcaacaattgcaggcttctgcaagaacaatactctagatcctacattaatcaagggtaaaattgtaatctgcacaattgagaaattcagtgatgacagacgagcgaaggccatagcaataaggcaaggaggaggtgttggaatgatacttattgatcataatgccaaagatattggttttcaatttgtcatcccaagcactctcattggtcaggatgctgtagaagagcttcaagcatatataaagacagataaaaatcccactgctagaatctacccaacaataactgtagttggtaccaaacctgctccggaaatggcagctttttcttccattggaccgaacataataacaccagacattattaagcccgacatcacagcacctggagtgaatattttggcagcatggtctccagtggcaactgaagccacagtcgaacaacgatccatcgactataacatcatttcaggaacatcaatgtcttgtccacacataactgcagttgcagcaattataaaatctcaccacccacactggggtcctgcagccataatgtcttcaataatgacaacagcaacagttatggataacacacgccgcatcataggaagagatccaaatggaactcaaaccacaccatttgactatggatctggacatgttaacccagttgcatcacttaatcctggattagtatatgaatttaattccaaagatgttctcaattttctatgcagcaacggggcaagcccagcacagcttaagaacctaactggggctcttactcaatgtcagaaacctcttacagcttcctccaacttcaattatccttcaattggtgtgtccaacttgaatggaagttcatcagtgtatcgtacagttacttattatggtcaagggccaacggtatatcatgcaagtgttgaaaatccatctggtgtgaatgttaaagttacacctgcagaattgaagttccggaaaactggggaaaaaataactttcaggattgatttcttccctttcaagaatagcaatggaaattttgtgtttggtgctttgatatggaacaatggcattcaaagggttaggagtcctattggtctcaacgtagtatctacataa

SEQ ID NO: 2293 - DNA, 2448 bp, Glycine max var. Williams 82
atgaaggttcaagaaacgaggtcgcatgttcatgcacttggggaagaagagaaggtgatgacaaggaagcagaaggctgagtccaaggcacatgaagtggaacattctccaaagaaggccaaggtggaaaaagaagatggccacatcaacgggaaatctgaaactggcgttgcagaagaatatgatgagttctgcaaagccacaaccgagcaccttcctttggaacaaatgagagacattctggaggccaatggccttgattcttctggctctgatcttgaaattacaagaagatgccaagacttgctgttttatggtgcattggacaaatgctcggtttgcaatgggagtttggagtttgatggcagacgttatgtttgcagagggttctacagtgagtgggctagttgcactttcagcaccagaaaccctccaaggaaacaggaacccattaagttacctgattctgttcagaactctctggcttcagacttgctaaagaaatatcaggacccgagtcacaggcctcacagggatctaggcttagcagaaaaaccctttactggaatgatgatctctctgatgggtcgtcttactcggacacaccattattggaaaacaactattgaaaagcatggagggaaggtggcaaactctataattgggtcaacttgtttggtagcttcacctgctgagcgagaacgtggtggcacatccaaacttgcagaagccatggagaggagtataccagtggttagggaggcttggttgattgacagcattgaaaagcaagaaccacaacctttggaagcttatgatcttgtctctgatctttctgtggatggcaagggtatcccctgggacaaacaagatcctggggaagaggctatcgaatcactctcagcagaactcaagctttatgggaagagaggagtctataaagataccaagttgcaggaacaaggtggaaagatatttgaaagagatgggatactatacaactgtgccttctctgtttgtgaccaagggcgaggactgaatgactactgtgtcatgcaactgattgttgtcccagagaatcgtttgcatctgtactttaagaaagggagagttggggatgatccaaatgcagaggagcgattagaagagtgggacaatgtagatggtgctctgaaagagtttgtgaggctctttgaggaaataacaggaaatgagtttgaaccttgggaaagagagaagaagttccaaaagaaacctttgaagttttaccccattgacatggatgatggaattgaagttagacatggggcactaggtcttcggcagctggggatagcagcaacacactgcaaacttgagcctttggttgcaaattttatgaaggtcttgtgcagccaggagatatataagtatgcattgatggagatgggttacgactgtccggaccttccaataggaatggttacaaatcttcatctgaaaaaatgtgaggacgttctcttagaattcatagacaaggtgaaatcattgaaagagactgggcccaaggctgaggctgtgtggactgattttagccaaagatggttcactctgatgcactccacaaggcctttcaattttagagattaccaagagattgcagatcacgctgctgctgcgttagagggggtgagagacataacccaggcttctcacctcataggagatatgactggctcaaccattgatgacccgttatcagagacatacaagaaattgggttgctcaatttctgccttggacaaaagttcagatgattacgagatgattgtgaaataccttgaaaaaacttatgagccggtcaaagttggtgacattgaatatggggtgtcagtggaaaacatttttgcggttcaaacaggtggttgcccttcctatgaagacattataaaactaccaaataaggttcttctatggtgtggatcacgaagctcaaacctcttgaggcacttgcaaaagggattcttgccagcaatatgctcattacctattccgggttatatgtttggcaaagctattgtctgttctgatgctgcagcagaggctgcaagatatggttttactgctgtggacaggccagaaggattcttggttttggccattgcttctctaggaaatgagattaccgagttgaaaaccccacctgaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggcacgcataagctacttggtgggagtgaagtatgaagagaaggaagagaagggtgcggtgattgacacagctgaatga

SEQ ID NO: 2294 - DNA, 3508 bp, Glycine max var. Williams 82
taatttccagttgattcgaagtaaaccctatctgtgactatcgccaacatatatgatttatcattcaacttttaacagaggtatttctttaccataaaaaaaatattgcaagttcatgtttgctagaggacacacaatgccgataggttcgaaaagctaagctcagatgcgtgcttgacttgaacttgtctgcatgttaactttttcaacccatgaagtaaacaccaactcctttatcttttggggaaagagaaaaaaaagaagaaaaacagaaaagttgtttatctccttcctcgaatatataagcaccgttttctgacgccaatccaaccgaatggtgcatgcaagggtcagcagagtcagattaaaggatgtgaacagaagaataattgatgatgaatggaacaagaaacataatggcatgattttcccacatttcaccgtttaaagcctcaaaatgtacatagttggccacgtgtcaagagctagcaaacgtggcatgttgttgtgacgacaagaagatttggttttcttgtgagaactgagaactcaatgtacgtggcagttcagggctgttgttgttgtctcagctgttcagagaatcaaagcttatttagtgcacatcatatgcgagtcctcagactctgaactacatgcttttgttcatcatagtagtagtggagaggtctttcattattcagttggatttagcaccaccaagatgaaggttcaagaaacgaggtcgcatgttcatgcacttggggaagaagagaaggtgatgacaaggaagcagaaggctgagtccaaggcacatgaagtggaacattctccaaagaaggccaaggtggaaaaagaagatggccacatcaacgggaaatctgaaactggcgttgcagaagaatatgatgagttctgcaaagccacaaccgagcaccttcctttggaacaaatgagagacattctggaggccaatggccttgattcttctggctctgatcttgaaattacaagaagatgccaagacttgctgttttatggtgcattggacaaatgctcggtttgcaatgggagtttggagtttgatggcagacgttatgtttgcagagggttctacagtgagtgggctagttgcactttcagcaccagaaaccctccaaggaaacaggaacccattaagttacctgattctgttcagaactctctggcttcagacttgctaaagaaatatcaggacccgagtcacaggcctcacagggatctaggcttagcagaaaaaccctttactggaatgatgatctctctgatgggtcgtcttactcggacacaccattattggaaaacaactattgaaaagcatggagggaaggtggcaaactctataattgggtcaacttgtttggtagcttcacctgctgagcgagaacgtggtggcacatccaaacttgcagaagccatggagaggagtataccagtggttagggaggcttggttgattgacagcattgaaaagcaagaaccacaacctttggaagcttatgatcttgtctctgatctttctgtggatggcaagggtatcccctgggacaaacaagatcctggggaagaggctatcgaatcactctcagcagaactcaagctttatgggaagagaggagtctataaagataccaagttgcaggaacaaggtggaaagatatttgaaagagatgggatactatacaactgtgccttctctgtttgtgaccaagggcgaggactgaatgactactgtgtcatgcaactgattgttgtcccagagaatcgtttgcatctgtactttaagaaagggagagttggggatgatccaaatgcagaggagcgattagaagagtgggacaatgtagatggtgctctgaaagagtttgtgaggctctttgaggaaataacaggaaatgagtttgaaccttgggaaagagagaagaagttccaaaagaaacctttgaagttttaccccattgacatggatgatggaattgaagttagacatggggcactaggtcttcggcagctggggatagcagcaacacactgcaaacttgagcctttggttgcaaattttatgaaggtcttgtgcagccaggagatatataagtatgcattgatggagatgggttacgactgtccggaccttccaataggaatggttacaaatcttcatctgaaaaaatgtgaggacgttctcttagaattcatagacaaggtgaaatcattgaaagagactgggcccaaggctgaggctgtgtggactgattttagccaaagatggttcactctgatgcactccacaaggcctttcaattttagagattaccaagagattgcagatcacgctgctgctgcgttagagggggtgagagacataacccaggcttctcacctcataggagatatgactggctcaaccattgatgacccgttatcagagacatacaagaaattgggttgctcaatttctgccttggacaaaagttcagatgattacgagatgattgtgaaataccttgaaaaaacttatgagccggtcaaagttggtgacattgaatatggggtgtcagtggaaaacatttttgcggttcaaacaggtggttgcccttcctatgaagacattataaaactaccaaataaggttcttctatggtgtggatcacgaagctcaaacctcttgaggcacttgcaaaagggattcttgccagcaatatgctcattacctattccgggttatatgtttggcaaagctattgtctgttctgatgctgcagcagaggctgcaagatatggttttactgctgtggacaggccagaaggattcttggttttggccattgcttctctaggaaatgagattaccgagttgaaaaccccacctgaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggcacgcataagctacttggtgggagtgaagtatgaagagaaggaagagaagggtgcggtgattgacacagctgaatgatgggaccaaaaaggatgtaagggaagcttttcttttttgtgatgcgggaattgaaagctatgaccatctatgtactagtagtttctctagttagtggaaaatttatgtcattttgatgtatatttacatgtgataaaataggctgtatgtggtgtcacattttgatgtatgtataggtaaatggcccgttagttagggtaagtaaatattttgtcctacacatgacggcatgagaatggaactacatctaacactatgttgtttcagtcctagttgactactctgtctgtatgaatgagatgatatagtagaaatggtataatgatgtccttttgttta

SEQ ID NO: 2295 - DNA, 624 bp, Glycine max var. Williams 82
atgtctaattccaccaccttgaaagttgtctcagttgtcatatcagcttttgccatcgtgcaaatggcacttgcgggtgacccagacattctgagtgacttcataggcccaataaatggcatgataccagatgggaactttttcacctacacaggcttccgtgtcctggtaggtcaaaactcaccaccctcaactttcaaagtattgaaagcaaccatggcagagtttccagcactgaacggacaaagtgtgtcttatgctgttcttcagttcccagcaaataccatcaacccaccccacactcaccctcgttctgcagagcttctttttgttgcacaaggttctcttcaagtagggtttgtggacaccaccaacaagctcttcacgcagagccttcaagctggggacatgtttgtcttcccaaagggtcttgttcacttccaacacaacgccgatgctagtaagcctgctcttgctatttcgtcctttgctagtgccaactccggcacggtttctcttcccaacacgctcttcaacacctccattgatgacactgtcttagctttgtccttcaagactaacgttgccaccattcagactttgaagaaaggctttgctccttaa

SEQ ID NO: 2296 - DNA, 624 bp, Glycine max var. Williams 82; identical to SEQ ID NO: 2295

SEQ ID NO: 2297 - DNA, 624 bp, Glycine max var. Williams 82; identical to SEQ ID NO: 2295

SEQ ID NO: 2298 - DNA, 1083 bp, Glycine max var. Williams 82
atggcggagaagaaagtggtcatcctaggaggtggtgttgccggagccaaccttgcaaaaactatacaacatcaagccaacgtcacccttattgatccgaaagaatattttgagattccatgggcaagtttgaggggattggttgagccaacttttgctgaaaggatagtgatcaaccatagagagtacttcaaaaagggtgaccttgttgtatccagtgctgtcaacataactgaaaccgcagtggtgactgcagatggccagcagatagcctatgactatcttgttattgccactggacacacagaacctatccccaaaaccaggagagaaagacttgaccaatacaaaggagaaaatgcaaagatcaaatctgcaagttcagttttgattgttgggggaggtccaactggtgttgagcttgcagcagagattgctgttgattttcctgataagaaggtcaccatagtgcataaaggaacaaggttgcttgaatacattgggacaaaagcttcaagtaaggctttaaagtggctcaaatcaaagaaagttgatgtgaaactagagcaatcagtagacttgagctcctcctcggaagcaagtaagacatatcaaacttcaaatggagagactatagaagcagatcttcattttctatgcatagggaaaccacttggctcaacatggattagggaaactcttctaaacaatgacttggatgctgatggaaggatcaaggtcgataaacacttgagagtgaagggcaagagcaatatttttgcaattggagatattacagatgttcaagaaatcaaacaagggatgtatgcaagtgctcatgctcaagtggttgctaagaacctgaagctattgatagagggaggaggcaaagagcataagttgggaacatacaaggcacaaccaccaatatctatggtttcactaggaaggaaaatagcggttgcacagttcccattcatgactgtgcttggaaggcttcctggcatgatcaagtcaggagatttgtttgtagggaaaaccagaaaggaattaggagtcgaacctaatgttaaaaaatcttaa

SEQ ID NO: 2299 - DNA, 2955 bp, Glycine max var. Williams 82
atgtatataacaacggcctcttcctctgcctcttcgctcctcagagcaaccaggcctaaactcttctttccctctccttctagaaacttcgcttctttcactccctgcacttcttccttctccgccaccgctcgttccctcctctgctccgttccgcggtggagccaccgcctccattccgcctctccgctcactccccgtcctcggatcagcgccgtcgctcccctcgttgaacgcttccaccgtgaaatcgccaccatggccaatgaaaatcctttcaagggaaacttgaccagtctcccaaagcctggtggcggcgagtttggaaagttctacagtcttccttctctcaatgatccgagaattgacaggttgccatactccatcaggattctccttgaatctgccattcgtaattgtgacaattttcaagtaaaaaaagaagatgttgagaagatccttgactgggaaaacaattctacaaagcaagttgagattccattcaagcccgcccgtgttctcttgcaggattttactggagttcctgctgttgttgacctggcttgcatgcgtgatgctatgaataagcttggaagtgattcaaataagatcaaccctctggttcctgtggatcttgtcattgatcattcagttcaagttgacgttacaaggtcagataatgcagtgcaggccaatatggagcttgaatttcagagaaacaaggagaggtttgcttttcttaaatgggggtcaactgcattccgtaacatgcttgttgttcctcccggttctggtatagtacatcaggtcaatcttgaatatcttggaagggttgtattcaacaatgagggcctactctatcctgacagtgtggttgggactgattcacataccactatgatagatgggcttggtgttgctggatggggagttggaggtattgaagctgaggcagcaatgcttggtcagcctttgagcatggttttgcccggtgttgttgggttcaagttatctggaaaactacgcaatggtgttacagcaacagacttagttctaactgtgactcaaattctcagaaagcatggtgttgtggggaaatttgttgaattttatggtgatggtatgggtgaattatctttggctgacagggccactattgccaatatgtctcctgaatatggtgccaccatgggcttcttccctgtggatcatgttacactacaatatctcaagttaacaggaagaagtgatgagattgtggccatgatagagtcttatctcagggaaaacaaactgtttgttgactataatgagccgcaacaagacagagtgtattcatcgtatcttgaattaaacctttccgatgttgaaccgtgtatttcaggaccaaagagaccccatgatcgggtacctttgaaagaaatgaaggccgattggcatgcttgtcttgataacaaagttgggtttaagggatttgctataccaaaagaggcacaaggaaaagttgcaaaatttgatttccatgggcagccagcggaactcaagcatggcagtgttgtgattgctgcaattacaagctgtacaaatacatcaaacccaagtgttatgcttggtgctggtcttgttgcaaaaaaggctcatgagcttggtttacaggtcaatccttgggttaaaacaagtcttgctccaggctctggagttgttacaaaatatctactccagagtggactgcaaaaatatctaaatgaacaaggttttcatattgttggatttggctgtactacatgtattggcaattctggagagctggaagagtccgttgcttctgccatctcagaaaatgacattgtagcagctgctgtgttgtctgggaatcgtaattttgagggccgagtacatgcattgacaagagctaactaccttgcctctcctcctctagttgttgcttatgctcttgctggcacggttgacattgactttgagaaggagccaattgggacagggaaggatggaaagaatgtctacttgagggatatttggccatctactgaagaaattgctaaggttgtccaatccagtgtgttgcctgagatgtttcgaagtacatatgaggctattaccaaagggaacccaatgtggaatcaactacaagttcctgctgacactctatactcatgggaccctgactcaacatatatccatgaacccccttacttcaagagcatgaccatggatcctcctggacctcatggtgtaaaagatgcttattgcctactgaattttggtgacagtataaccactgatcatatttctccagctggaagcattcacaaggacagtcctgctgccaaataccttgttgagcatggggtggaacgcaaggacttcaattcttatggaagtcgtcgaggcaatgatgaggtgatggcaagggggacttttgccaacattcgtcttgttaacaagcttttgaatggggaagttggcccgaagacaattcacattccaacaggggaaaaactttatgtgtttgatgcagctacgagatacaaggcttctgggcaagacaccattgtgctagctggagctgaatatggcagtggaagttctagagattgggctgccaagggtccaatgctactgggagtcaaagctgtgatagccaagagtttcgagagaattcatcgcagtaacttggtaggaatgggtatcattcctctttgcttcaaacccggtgaggatgcggacacattgggattaactggtcatgaacgttatacaattgaactaccaagtattatcaatgagattaggcctggccaagatgtgacagtcacaaccgataatggaaaatctttcacttgcacagcacgctttgacactgaggtcgaacttgcttacttcaaccacggaggcatacttccatatgtcataaggaacctcattaagcagtga

SEQ ID NO: 2300 - DNA, 3250 bp, Glycine max var. Williams 82
aattacacctcttttgccctccattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactgaatccaagggctcaacctcttaagctttttctctatccaagaacctcttaagagagagaaagaataagagaaagagaaagtgagagagccaattctacatttgttggtggtggtttttgaggcatgtgaaatatgcaagccggtattatgatgattccggcgagaaacatgccttcgatgatagcaagaaacaacaacgttgtagggttttttggatcatctgcacttttcactcttgcccagattgagaaactataagcctctccggaaccttaaaagatctatagcaataataatgttccagccgaacctgatggacgcgttggagatgggtcagaacacttccgagagtgaggttcctcgaatcctagaagacgagttcgacagtgccaccaagtccggtagtgaaaaccatgaaggtgcctctggtgaagaccaagaccctcgtcccaacaaaaagaagcgttaccaccgccacacccaacaccagatccaagaaatggaagcttttttcaaggagtgtccgcacccagatgacaagcaaaggaaggaactgagcagggagttagggttagagccattgcaggttaagttttggtttcagaacaagcgtactcagatgaagacacagcacgagcggcatgagaatacaaatctcagaaccgaaaacgagaagcttcgagcagataatatgaggtatagggaggctcttagcaatgcttcgtgtcctaattgtggtggaccaaccgctataggagaaatgtcattcgatgaacatcacttgaggcttgaaaacgcaaggctaagagaagagattgatcgcatctcagcaattgctgcaaagtatgtagggaagccagtggtgaactattcaaatatttctccttctctccctcctcgtccgttagaactaggggttggtggtgctggttttggaggccaaccagggattggtgtggacatgtatggagctggggatcttcttaggtcaattagtggacccactgaagctgataagccaataatcatagagctagctgttgcagctatggaggagctcattgggatggcacaaatgggtgagcctctttggttaactacccttgatggcacatccactatgctcaatgaggatgagtacattaggtcttttcctcgagggattggtccaaaacctagtggcttcaaatgtgaagcttcaagagaaactgctgttgttatcatgaaccatgtcaacctcgttgagattctcatggatgtgaaccaatggtccacagtgttctctggtatagtctcaagagccatgactctggaagttctatcaacaggggtggctgggaactacaatggtgccttacaagtgatgacagcagaactacaactacctacaccacttgtgccaactcgcgagagttattttgtgaggtattgtaagcaacatgcagatgggacttgggcagttgtggatgtttctttggataatttgcgcccaggtccttcagccagatgtagaagaaggccttctggttgcttaattcaagaaatgccaaatggctattcaaaggtcacatgggttgagcatgtagaagtggatgatagaggtgttcacaatctttacaagcagcttgttagctctggacatgcatttggtgcaaaacgttgggttgcaaccttagatcgacaatgtgaaagactcgctagtgccatggcaacaaacattcccactgtagatgttggcgtgataacaaaccaagacgggagaaagagcatgatgaagctggctgaaagaatggtgataagcttttgtgctggagtgagtgcttccactgctcacacatggacaacactctctgggaccggtgctgatgatgtaagggttatgaccagaaagagtgtggatgaccctggaagaccccctggcatagttctcagtgctgccacttctttttggcttcctgttccacctaaacgagtctttgacttcctccgtgacgaaaactctaggaatgagtgggacattctttccaatggaggagttgtccaagaaatggcacacattgcaaacggaagagacacaggaaactgtgtatctctacttcgagtaaatagtgcaaattcgagccagagcaacatgttgatattacaagagagttgcaccaattcaacaggctcttttgtcatttatgctccggtggacattgttgcaatgaatgtggttctaaatggtggagacccagattacgtggcacttcttccttcagggtttgctattctccctgatggaaccacatcgcataatggaagtggtggcattggcgaaactggccctagtggttctctcttaaccgttgcgtttcaaatattggtggattctgttccaaccgcgaagctttctcttggatctgtggccactgtgaacaatctcattgcatgcactgttgagagaatcaaggcttctttgtctggtgaacctgcttgatcagagcttcaagacttttggattctgcgttgcagtttacaagaaggatcaacgggacgcattgcattgtggaaaattaaaaagttggtgttgaacctcggcttatattacaaagacggggagaagtcaagagcgcaccttgcatgattccttctcagtgccccaaaagagttctgagaggattaaggttcgggaattgacttccctagctagatatagtaaacgttaagagcacattttaagatcttgctaccctttaccatttccaagactaaaatatatatatagctagctaggattaaccttttgagtaactagggtttaacattaatgtaaaactcttgtctttttcaatatctgattttgtgtgatttagaagtagtagcaccggcactagttggtgggaaaatttgcatttagtacgcagtc

SEQ ID NO: 2301 - DNA, 1728 bp, Glycine max var. Williams 82
atggctgcatcattatttatgccttcatccatagtggacgaagaagcgaggtttgaagccgaagtggcggaggtgcaagcatggtggaactctgagaggttcaggctaacaaaaagaccatacacagcaagagatgtggtgtccctccgaggcaacctcagacaaacctatgcctcgaacgagatggcgaaaaagctctggtgccttctgaagaaccaccaagccaacggcacagcctcaaggacttttggtgcacttgatcctgttcaggtcactcaaatggccaagcacttggacacaatctatgtctcagggtggcagtgctcagccacacacaccacgagcaacgagccgggccctgaccttgctgattacccttatgatactgtcccaaacaaggttgagcacctcttctttgctcagcagtaccatgacaggaagcaaagagaggagaggatgagaatgagcagggaagagagggcaaggaccccttatgttgattacttgaggccaatcatagctgatggcgacactggttttggtggtaccacagcaactgtcaagctttgcaagctatttgtggagagaggtgctgccggaatccacattgaggaccagtcttcagtgaccaaaaagtgtggccacatggctggaaaagtgcttgttgccatcagtgaacacatcaataggcttgtggctgcaagacttcagtttgatgtcatgggggtggaaactgttttggtggcaagaacagatgcagaagctgctaatttgattcaatcaaacattgacacaagggaccatcaatttatcttgggagtgaccaaccccaaccttaaagggaagagtttagcaactcttatgcaacaaggcatggctgctgggaagagtggagctgagcttcaggctttggaggatgagtggctctcaaaggcacagttgaagactctctcagaagcagttgtggaggcaattgagaggcagaacattggagaggaagagaagagaaggaagctgaatgagtggatgcaccattcaagctatgaaaggtgtctttccaatgaggagggtagggagatagctgaaaagttaggagtaaggaacctcttttgggattgggacttgcctaggactagagaagggttctacaggttcaaagggtcagtgattgcatcagttgttagaggttgggcttttgctccacatgctgatgtgatatggatggaaactgcaagcccaaatgtgattgagtgcacacagttttctgagggggttaggtcaaagcaccctcagatgatgctggggtacaacctctctccatctttcaactgggatgcttctggcatgagtgatgaacaaatgagggacttcattccaaagattgcaaagttggggtatgtgtggcagttcatcacagtgggagggctgcattctaatgcactcattacttcaacatttgcaagggattttgccaataggggaatgctagcttatgtggagaggattcagagagaggagaggaacaatggggttgacacacttgctcaccagaaatgggctggtgctaactactatgataggtatctcaagactgtccagggaggtgtggcttcaactgctgcaatgggaaaaggagtaactgaagagcagtttaaagaatcatggactaggccaggagctgtagaaattgatagaggcagtattgtggttgctaaggccagaatgtga

SEQ ID NO: 2302 - DNA, 897 bp, Glycine max var. Williams 82
atgtctgggtccttgggattcttctttgtgggtcttacgttgttgttgttggtcggggtggctaatgctgtggccaacacttccaacaaatttgatcaactcttccaaccaagctgggcttttgaccacttcattcatgaaggggatctcctcaaactcaaactagacaatttttccggcgctggttttacttccaagagcaagtatatgtttgggaaagtcaccatccagcttaagcttgtggaaggtgactctgctggaacagtcactgctttctatatgtcatcggacggtccaaaccacaacgagtttgattttgagtttctaggcaacaccacgggggaaccatactctgtccaaaccaatgtgtatgtaaacggagtgggcaacagggagcaaaggctcaacctttggttcgaccccaccaaggattttcactcatactctatcttctggaatcaacgtcaagttgtatttttggtggatgaaacgccaataagggtgcacacgaacatggagcacaagggaattccatttcctaaggaccaacccatgggtgtgtacagttcattatggaatgctgatgattgggccacgcagggtggtcgtgtgaaaacagattggagccacgcacccttcattgccacatacaagaacttcgagataaatgcgtgtgagtgtcccgtgtcagtggctgcaatggataatgctaagaagtgcaccagcagtgaggggaataagtattggtgggatgagcctaatttggctgaactcaacttgcaccagagccaccagcttatgtgggttagggcaaggcacattttctatgactattgcactgacactgctaggttcccagtcacgcctgctgagtgtgtccatcaccgtcacacctga

SEQ ID NO: 2303 - DNA, 1890 bp, Glycine max var. Williams 82
atgcctgaggctcatagccactacctttgcaacaagccaaatggcaaacatgatggtgctactaatactagtagcatcatcgagcacaacaacaagaaagctctgaaatacattgaggatgttactagcaacgctgatgaaattcagaaaagggtccttgctgagatcctttcttctagtgcacatgctgagtaccttcaacgccatggcttggatggacgcacagacagagaaactttcaagaagatcatgcctgtggtgacatacgaggatttaaagccagatattgatcgcattgctaatggtgatacctccccaattttatgttccaaacctatttctgagttcctcactagctctggaacatctggtggggagagaaaactgatgccaaccatagaagaggagctagagcgaagatcattactctacagcctcctgatgccagtgatggagcaattcgtacctggcctagacaaaggcaaaggaatgtactttctgttcataaaatcagaagccaaaacccctggtggactcttagctcgtccagttttaacaagctactacaggagctcacacttcaagaacaaaacacattgttttgacccttacacaaactacactagccccattgagaccattctctgcctagactcttaccaaagcatgtactctcaaatgctctgtggactttcacaaaacgagcatgttctccgtgttggtgctgttttcgcctcaggtttcatccgtgcccttaagttcttggaaaagcattgggtgtgtttgtgccgtgacattagaaatggcaccattggccctgaaatcactgactcatccgttagagaagccatcatgagggtactcaaaccaaacccaaaacttgcggattttatagagggtgagtgcaagaaggggttgtggaaagggataattactaggttgtggcctaataccaagtacgttgatgttattgtgactggaaccatggctcagtatattcctatgttggattactatagcaatggtctccctcttgtttgcaccatgtatgcttcttctgagtgttattttggactcaacttgaaccctttgtgtgatcctagtgaggtgtcttatacccttgttcccaccatggcttactttgagttcttgccccttaataagacgaaggaacatgcgaattcaatttcttacaccgagcaggaacttttggttgatcttgtggatgtggagctggggcaagaatatgagcttgtggtcaccacttatgcaggactttacaggtaccgggtcggcgacatcctccgtgtagcaggattcaagaacaatgctcctcaattcaatttcgtgtgccgaaagaacgtggttcttagcattgattccgacaagaccgatgaggttgagctacaaaacgctgtgaaaaatggagccaaccaccttacactattcggtgcatcactcacagaatacacaagctttgctgatacgtccactatccctggccactatgtactatactgggaaatcagcatgaacaagaacaacaacattgatcaaaatcaaaacccaattccaagttctgtttttgaggagtgttgctttgcagttgaagggtctctcaacagcgtgtatcgacaaggaagagtatcagagtccattgggccattggaaatcaagattgtggagaatggaacttttgataagcttatggactttgctcttagccagggtgcgtctataaatcagtacaagacacctcgttgtgtgaagtatgctcccattgttgagcttcttgactcgaaaactgtttccaattacttcagtccaaaatgtccactgtgggttcctggtcacaagaagtggtgcatgtaccctcttgacaacaaataa

SEQ ID NO: 2304 - DNA, 339 bp, Glycine max var. Williams 82
atgagcacgcttgtacgaaacgccaccctcaccttcagccgcagaaacagatacgagcttcttggtctgcaaggcaaagacaagatggtcaagtccatcagctacagacgcagaagggcaaagcaaagacaaatctttctcacaacctacaaactatcttctttgaacagcaatacttttgttgagccacaaaagcctaagctgaagctgaagaaggttgctgttaaggtcaagaagattgtcacctcggttttgatgttcatgcgagttggttctttcaggtcctgcggttctaggtctcagatttcttccacctcaccaaataggaagaacttttga

SEQ ID NO: 2305 - DNA, 846 bp, Glycine max var. Williams 82
atgactggcagagaaatcctccatatgatgaaggtgaaagcagggtttggaacaccagacacagggaatggaaaaggcaaaatatcaaaacacattacacatggctttcacttgatgaagggcaaatcagcgcatcctatggaagattatttagtttcagaatttaagcaagaaaaggacagagaattaggcttgtttgcaatatttgatggccacttaggccatgatgtagcaagctatttgcagaaccaccttttccaaaacatcttgcaacagcatgacttttggactgagacagaaagcgcagtgaaaaaagcttacgttgaaacagatgagaaaatattggaacaagaacttgtgttggggcgaggagggtcaacagctgtgactgcaatacttattgatggtcagaagcttgtagtagcaaatgttggtgactcaagagctattatctgtgagaatggaaaggcaagacaactatcagtggatcatgaaccaagcaaggaaaaaaaatcgattgagaggcgtgggggttttgtatcaaacattccaggagatgtccctcgagtagatggacagctggcagtagcaagggcttttggtgacaggagcctgaagatgcatcttagttcagaacctgatgtgattgtacaggaagtagatcaacatacagagtttcttattctggctagtgatggaatatggaaggttatgtcaaacgaagaagcagtggaatctattagacaaataaaggatgctcaagctgcagcaaagcaattgattgaagaggcagtttgcaagaaaagtaaggatgacatatcttgcatagttgtgaggttccaatga

SEQ ID NO: 2306 - DNA, 1071 bp, Glycine max var. Williams 82
atgagtagtgttttttcagaacacaaattccaacttcaaccctctcaccaacttctctccctcaagaaatccctgagggacatagacatcccagtcccaccaaggaagctcctcacccgccgctccgccgccgtccacgacgtctccggcgacatgttttccgatgacaccctccggcacaagtaccttccccacaatggctccaccgactcctccgacgatgactccggcgacccctacgcctccgatcaattccgcatgtttgagttcaaggtccggcgctgtactcgcagccggagccatgactggacagactgtccatttgtacatcccggcgagaaggcccgccgtcgggaccctcgccggtttcattactctgcaacagtctgtccagagtttcgccgcggtcagtgtgaccgtggcgatgcatgtgagttttctcatggggtgtttgagtgctggttacacccttctaggtatagaaccgaggcttgcaaggatggtaggaattgcaagcgaaaagtttgcttctttgctcacacccctcgccaactcagggttttgcattccaatgaaaatagcaacaagaaaaagtgcaccaatatgagccctcataacaacaacaacaacaccaacaattgttgtttggtttgccattgctcttcttctactcgttcaccaacttcaaccttgttcggcatgtctcatttttctcctccattgtcaccaccttctccttcttccccttctaggtttgagaccaaccatcatcatggtgttgtgaaatataataaggatgtgctctctgagcttatgtgttccatggagggtttgaattttggtgaggcttcacttttgtctgctgcttctaagcctcacaacaatttgtcttcttggcttgatgtttctgaggatcacaatcaaaaacagttcagtactctttcaccaaccatcactgcttgtggaagcttttccaacaacggaaatgggagatttttgagagaagaaagtggggttgttgatgatgttatttccccagatctcgcatgggtgaatgaattactgatgtag

SEQ ID NO: 2307 - DNA, 777 bp, Glycine max var. Williams 82
atggaaatggaagattttttatggggtggtggcattgctggagatgcccctaagaggaaaagtgatggttttgaaggaagcaatggtgtgattggaagtgggtgtggttcatctttctctctggttttggatagggagagaggggagcttgtggaggcacctgtgagattggaaaggaagggggtgtccactgagagaagcattgaagctttgaagagccatagtgaggcagagaggaaaaggagggcaaggattaatgcacatcttgatacgcttcgcagtgtgattccgggtgctatgaagatggacaaagcgtcattactcggtgaggttattagacatttgaaagagctgaagaagaatgcagcacaagcttgtgaaggtttgatgataccaaaggacaatgatgaaataagtgttgaagaacaggagggtgggttgaatggttttccttattcgattagagcatcactatgttgtgaatataaacccgggctattatctgatataaaacaagcactagatgcccttcatcttatgataacaagggcagatattgcaacattggaaggcaggatgaagaatgtctttgtgataattagtagtaaagaacaaaactttgaagatgctgcataccgtcagtttctcgctggttctgttcaccaagctctcaaggcagtgctcaatagattttctgtttcagaggacattttaggaaccaggaaaagaaggaggatttctatattcagttcttcacctttagaagattttttgtaa

SEQ ID NO: 2308 - DNA, 1014 bp, Glycine max var. Williams 82
atggcttccattggcaaaaagcagcacattttagctcttgtgctccttctctcaatctgcacttcccaagtaatgtcccgcaacctccatgaggcatccatgtccgaaagacatgagcagtggatgaaaaaatatggaaaagtatataaggatgctgctgagaagcaaaaacgtttactgatattcaaggacaatgttgaattcattgaatccttcaatgctgccgggaacagaccttacaagcttagcatcaatcaccttgctgaccaaacaaatgaggaatttgtggcttcccataatggatacaaacacaagggatcacattcacaaacaccattcaagtatgaaaacgtcactggtgttccgaatgcagtggattggagggaaaatggagctgtcacagcagtcaaggaccaaggccaatgtggtagctgctgggcattttcaacggttgcggcaacagaaggtatctaccaaataactacaagtatgttaatgtccctttcggagcaagagttagtggattgcgacagcgtggatcatggttgtgatggaggttacatggaaggtgggtttgagttcattataaaaaacggtggaatcagcagtgaggcaaactacccctacacagcagttgacggaacttgtgacgcaaacaaagaggcttctcctgcagctcaaataaagggatatgaaacagtacctgctaacagtgaggatgcactgcagaaagctgttgcaaaccaacccgtgtcagttaccattgatgccggaggatccgctttccagttctactcaagtggggttttcacaggacaatgtgggactcaactagaccatggcgttactgcagttggttatggtagcactgatgatggcactcaatattggattgtgaagaattcatggggcacacaatggggtgaagaaggttacataagaatgcaacgaggcacagatgcccaagaaggcctatgtgggattgccatggatgcctcgtacccaactgcttag

SEQ ID NO: 2309 - DNA, 837 bp, Glycine max var. Williams 82
atggcgccgcgtctctggtcctgcttccgcagcagcagtagcaagggcagcaccaccggcggcggtgtctccgacgcctccgcctcgcggcgcgtggtgactgcggacctgacatcggaggagcagaagcgcgggggcccggtggtggtggagatgttctcgtcgcaggggtgcgcgacttcgccggcggcggagctggtgctgtcgcggctggggagaggggatttcgagctggaggcgccggtggtggtgctggctttccacgttgactactgggactatatgggatggaaggatccgttcggggccagccagtggacggttcggcagaaggcctatgttgaggcccttgggcttgacaccattttcacgccacaggttgtggttcagggaaaggcccagtgtgttggaaatgacgagaacgcccttgtttctgccattactagtgctcctaggttccctgctccaaccttccaggcaactttcaccaggcctgcaccagattcattgcaagtgtccctaacaggagcattgaggaccaaggtggacagcgatggcgcgaatgtcatggttgcattatacgaaaacggtttggtcaccgattgtccaagaggggagaacaaagggcgtgtcctatccaacgactatgttgttagaaagctcgaaaagctctgcactgtcaaagacatctctgccaagaaaacagtatcaggaatggttaactttcccttatgggaaggattcaaaagcagcaaatgtggtttggctgtctttgttcagagcaaatctcaccagatttttggttcacagagttttcagctgccggatgatatatga

SEQ ID NO: 2310 - DNA, 1707 bp, Glycine max var. Williams 82
atggacttgaatcaatttttaaattttaacgttattagttcggaaggattcccttgcacatcgtcttgtactcctatttcaccaatatccaaccagttgcttggatccttgaaacttgacataggaaactcacctaactcggccctttctagtcattttgattctgatactctttcttctgcattaagtgacagtcaggaattgcacacctctggggaaattcactctggtgtcaactcttgcaagtctttgcaggaaagcaatcattatttgcacaggccagtctcatttgtagaccatctccaagacggtttacatctatctactaggagctttcttccacaggatgcaagttatgaccatgaaactagacatgcattgctggaattagaaacagctttgatggcacctgatggtgaagatcaaatcaccacatcaagcacttctttgggtgttggcagtagaccaacaacatcttgccaaagaaataggtcctggagctctgagggccagtcaagtgatgttgcacatgtagagaagcaccacaaatcagtggaggaagaatcgctgcaaggatttccatcatgcaatttgaaacaattgctgattgtatgtgccaaagccttgtctgaaaacaacatgcaacattttgatcaattgatagaaaaagctagaagtgctgtgtctataactggggagccaatccagcgccttggtgcttatttggtagaagggcttgttgcaaggaaggaggcatcaggaaataacatctaccatgccctaagatgcagagagcctgagggaaaagatttactctcttacatgcagctactgtatgaaatctgtccctacttaaaatttggttacatggctgccaatggcgctattgctgaagcatgtaggaatgaggaccaaattcatatcatagactttcagattggtcagggaactcaatgggtgacacttcttcaagctcttgcagcaagacctggtggagctccccatgtgcggatcacagggattgacgatcccctttctaaatatgttcgtggtgatggactggaagctgttgggaaaaggttggctgcgatatctcagacatttaacatccgagttgagttccacggcgtgcctgttttagctccagatgtgacaaaagacgtgcttgatgttaggcctggtgaggctttggctgtgaacttccctttgcaactccatcatacagctgatgaaagtgttgatatgagtaatccaagggatggacttttgagattggtgaaatcactttctcccaaggtaactacattggttgagcaagagtcaaacacaaataccactcctttcttcaacaggtttatagaaaccttggattactacttggcaatgtttgagtccattgatgtgtctcttccgagaaagagcaaggtgcagattaatatggagcaacattgtttggctcgggatattgtcaacattattgcttgtgaagggaaggaaagggtagagagacatgagctgttaggcaagtggaagtctaggttaacaatggctggctttcgtcaatatcctttgagttcttatatgaattctgtcataagaagcctgctgaggtgctattcaaaacattataatcttgtggagaaggatggggccatgctactgggatggaaggacagaaatttgatttcaacttcagcttggtattga

SEQ ID NO: 2311 - DNA, 2415 bp, Glycine max var. Williams 82
atgagtatcatagtttatacactctttgtctcttctcttgtagtttccatagctgcagacacaccatccaattcacagttccaatccctcagtcctggagagaccatagtttccccaagaggaatctttgaacttggtttcttcaatcttggaaatccaaacaaaagctacctcgcaattcggtacaagagctatccggatcaaacatttgtttgggttgcaaacggtgccaacccaatcaatgactcctcagccatattgaaactaaacagtcctggcagtttggtccttacacactacaataatcatgtttggtccacaagttctccaaaagaagcaatgaatccagtggcagagctattggattctggtaatcttgtgataagagagaagaatgaagcaaagctagaagggaaagaatatttgtggcaaagttttgattacccttctaacacgatgttggcagggatgaagattggttgggaccttaaaaggaagataaatagaagactcatagcatggaagagtgatgatgatccaaccccaggagacttatcatggattattgtgcttcatccctatcctgaaatttacatgatgagtggaacaaagaagcaccacagacttggaccgtggaacggcttgcgtttcagcggcatgcccgagatgaagcctaatcctgttttcaattacaagtttgtctccaacaaggacgaggttacctacatgtggacattgcagactagcttgatcacaaaagtggttctcaaccaaacctcgcaacagcgtcctcgctacgtgtggtccgaggccactagatcgtggaacttctactcaaccatgccaggagagtactgtgactattatggcgtttgcggggccaattcattttgcagctccactgcatcgccaatgtgtgactgcttaaaagggttcaagccgaagtctccggagaaatggaactcaatgtatcggacagaaggatgtcgcctgaaaagtccactgacttgcatgcttgatggatttgttcatgttgatggtttgaaagtgccagatactacaaatacgtctgtggacgagagtattgatcttgagaaatgcagaaccaagtgcttgaataattgttcctgcatggcatatactaattcaaatataagtggatcaggtagtggctgtgtcatgtggtttggcgatttattagacatcaaattgtatccagcaccagaaagtgggcagcgtctatatataaggttgcctccttcagaattagattctatcaggcacaaggtgtctaaaataatgtatgcaacctccgttgctgcagctataggagttatacttgctatttattttctctacagaaggaaaatttatgagaaatcaatggccgaatataacaatgaaagttatgtgaatgatctggatctgccattgcttgatttgtcaataatcattgtagccacaaacaaattctcagagggaaacaagattggagaaggtggctttggatctgtatattggggaaaattagccagtgggctagaaattgctgtgaagagactctcaaagaactcggatcaaggaatgagcgagttcgtaaacgaagtaaaactgattgcaagagttcaacacagaaatcttgtaaagcttcttggctgttgcattcagaaaaaagagaaaatgctagtttatgaatacatggttaacggcagccttgactacttcatatttgattctaccaaagggaaattgctagattggccaaagcgtttccacataatttgtggaattgctcggggacttatgtaccttcatcaagattctcgattgaggattgtccatagagatctcaaagcaagtaatgttttactagatgatactttgaatccaaaaatttcagattttggagtggctaaaacttttggagaagagaatattgaaggaaatacaaatagaattgttggaacatatgggtacatggcaccagaatatgctatcgatgggcaattttctataaaatctgacgtcttcagctttggtgttttactgttggagattatatgtgggaagaaaagtagatgttctagtgggaagcaaattgttcaccttgttgatcatgtgtggacattgtggaaaaaagatatggctttacaaatagttgacccaaacatggaggattcatgcattgcgtctgaagtgttacgttgcatccatattgggctcttgtgcgtgcaacaatacccagaggataggcctacaatgacctcagtggttctcttgttggggagtgatgaggtgcaattggatgaacctaaagagccagggcattttgtgaagaaggaatctattgaagcaaattcaagctcatgtagttcaaccaatgcgatgtccataaccttattaactgctcgctga

SEQ ID NO: 2312 - DNA, 1023 bp, Glycine max var. Williams 82
atgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccatgggttcttccaggtaaggcagcgtttggagagaaggagtggtacttcttcagtccaagagacaggaagtacccgaatggttcacgaccaaacagagttgcgggttctgggtattggaaagccactggaactgacaaaatcatcaccactgaaggtagaaaagttggcataaaaaaagcacttgttttctacgttggcaaagcacccaaaggctccaaaaccaattggatcatgcacgagtatcgccttctcgactcttcccgcaaacacaacctcggaaccgcaaagcttgatgattgggttctgtgtcgtatctataagaagaactcaagtgcgcaaaaggttgaggcaaatcttttggctatggaatgtagcaatgggtcatcaccttcttcatcgtcccacgtggacgacatgctggaatcgttgccggagatcgatgatcggtgcttcaccctgccgcgagtgaactcagtcagaacaatgcagcagcaggacgagaaattcggatttcagaacatgggatccgggtttttcaccgattgggtcaacccgacggatcttgattcagtttccgaatttgggtcgggttgccaaacccaagggatggtgaattatgattgtaatgacttatttgtcccttctgtgccgcccttcggccacagccatgtaaactacatggtgggggcaccaccgtccgaggaggaggttcaaagcggtgtgaggactcaacaggccgatggggccgcatgttttcagcagaacccaaatgcccgattgttaccgggctcgggcgacccatttgggtttgggttcatcatgggtcagcaagttgagttcgggtttagggactga

SEQ ID NO: 2313 - DNA, 1029 bp, Glycine max var. Williams 82
atggttcttcaggctgcttctttccccattgctaaagagggaaagtctggtgtttctctcaggtacaccacaatgttcggtgtttcattgtcggatactctcaaatctgacttcagcttttcctcattgacatgcaaaagggaattccaacaaaaaattggccctttgagggttcagtcagtggcaacaaccactccaggagtcaccaaggcttcaccagaaggcaagaaaactttgaggaaaggcagcctggccacggccaaggctttggctgagacaggaaagtggcatgtgattatgacctgcagggatttcctcaaagctgagagggctgcaaaatctgctggcattgctaaggaaattgtgtctcttgatagtgtgaggcaatttgtggataacttcaggcaatcaggcaggccactagatgtgcttgtttgcaatgctgcggtttacttgccaactgctagggaacctacatacactgctgatggctttgaactcagtgttggaacaaaccatttggggcatttcctcctttcacgccttttgcttgaggacttgaacaaatctgactacccttcaaagtggttgatcattgttggctccatcacaggaaacaccaacaccttggctggaaatgtgccacccaaggctaaccttggtgacttgaggggactagctggaggcttgaatgggctaaacacttcagccatgatagatggaggatcctttgatggcaccaaggcttacaaggacagcaaagtctgcaacatgtttacaatgcaagaattccacagaagataccatgaagaaactggaatcacatttgcttccctttacccaggttgcatcgccacaacaggcttgttcagagagcacattgatccaagcctgacaaaatcaggtgtttactggagctggaatgcagcctctgcttcgtttgaaaaccaattgtcccaagaggccagcgatgcagataaggcttgcaaggtttgggagattagtgagaaacttactggtttggcttaa

SEQ ID NO: 2314 - DNA, 1029 bp, Glycine max var. Williams 82; identical to SEQ ID NO: 2313

SEQ ID NO: 2315 - DNA, 438 bp, Glycine max var. Williams 82
atgttaaaatttgatctttacgtaactttgtcctctttcttggtctacctcctcattgtttgctataaattgattccttccacatcatttttttcatcatgctctctttgtatccctcactggctctccaactctcggtctctctatcttttttcacaaaatattgatggtgttggtgatcgtggttatactggtgtgatttttgcagtccatcatcacgtggggccgttggagcttgttgttgtaaaaagatcattttttcatcatgctttctctgcatccctgactagctctccatctctcaatctcccccatcttcttgcacaaaattgtgatggtattggtgatagcggttataccagtgtgattttttgtaacggaccattgtcgctagatgacgccgattcaaccaacattacgaaaaagattcagttttaa

SEQ ID NO: 2316 - DNA, 612 bp, Glycine max var. Williams 82
atggctgtccaagtttatattgtgtattactcaatgtacaggcatgtggatagactagcggaagaaataaagaaaggagttgattctgtagaaggtgttgaggccaaactatggcaggtaccagagacattgccagaagaggtgcttggcaaaatgagagcaccacccaagagtgatgtgccaattattacccccaatgaactctctgaggctgatggctttgtctttggcttccccacaagatttggaatgatggcagcgcagttcaaagcatttctggatgcaactggaggcttatggaaaacacaacagcttgcaggcaagcctgctggaatcttctacagcactagttcccaaggtggtggacaagaaacaacagcgcttactgctataactcagctggttcatcatggaatgctatttgttccgattggatacacatttggtgctggaatgttcgatatggaggaactcaaaggtggaagtccatatggttcaggaacttatgcaggtgatggttcaagacaaccaactaagcttgagttggagcaagcattccaccaaggcaagtatatcgccagcatcacaaagaagctcaaggaagctgcataa

SEQ ID NO: 2317 - DNA, 1275 bp, Glycine max var. Williams 82
atggaaaatggtgttgtgaccgtgaatagaaaaaaccatgaatccaaagctaattccaccattaccattaagggtttcatgagccttctgatgaaaagtgtagatgagaatggtgatggtagcaagagagttatttctctgggtatgggggatccaactctcaccacttattttcccatctcaaatgtagctgaagaagctgtttccgaagcccttcagtcacacaagtttcgtggctatgctcccactgcaggtcttccacaggccaggattgcaattgctgaatacctgtctcgtgaccttccttaccaattatcaagtgaggatgtttatatcacttgtggatgcacacaagccattgatgtgtcagtggcaatgcttgctcgccccggtgcaaacatcttgcttccaagaccaggcttcccactctatgaacttagtgcttcatttagaggggttgaagtgaggcattatgatctgcttccagagaaaggttgggaggttgatctagatgttgttgaagctcttgctgatcagaacactgttgctttggtgattataaatcctgggaatccttgtgggaatgtgtatagttaccatcatttggagaagattgctgaaactgcaaaacggattgcaacaattgtgattgctgatgaagtttatggtcaccttgcatttgcgggcaagccttttgtgccaatgggaatttttggctctattgttcctgttctgactcttggctcattttctaagagatggatagttcctggatggaggcttggttggtttgttacaaatgatccatctggcacttttagaaatccaaaggtagatgagcgaattaaaaagtactttgatcttttgggaggtcctgccaccttcatccaggcagctctacctcagataattgcgcatactgaagaggttttcttcaagaaaaccattgataatttgaggcatgctgcatatatatgctgtaaagagttaaaggataatccatacattatttgcccttataaaccagaagggtccatggctatgatggtaagactaaacctttcacttctggaggatattagcgatgatattgatttttgtttcaagcttgctaaggaggaatccgttatcattcttccaggaactgcggtagggctgaataattggattcgtattattttcgctactgatccatttgctctgttagagggtttgaagagggtaaaatctttttgtgaaaggcatgcaagaaagtgtttaaagacaactgaataa

SEQ ID NO: 2318 - DNA, 435 bp, Glycine max var. Williams 82
atgaaaaacgtgatcaaagctgtgaagaaactcaagttgtggtccaaaaagaaaaggaagaaaaagacccatggccatgagcatcctcctcactattgctgcagctgctattgttcctcatccatccaaccatcagctccacccttaccttcatcctcatgccttgattttgaatacagcaactatggaacattcttaccaaccccggagccggagccggagccggaaccgcaaccacaagagattgccagcctaaactcatcgtatcagcaatatatggtatcagtttcggaacctgtttatggcattccagtcccggtaattcatgcatctcgaacagaaagatcagctggtcaatttggatgtctttttagctttggttcttatttgttccgctgcttatttccatgtttctacatccgacaagtagtttga

SEQ ID NO: 2319 - DNA, 1095 bp, Glycine max var. Williams 82
atgaatagaggggaaggagcgaatgatggtttttctggacctggaccaaatgattcgcttcttcctggtcttattgatgatgttgccttgaattgtcttgcttgggttagtggatccgattatgccgcactatcatgtatcaataaaaggttcaataaactgatcaatagtgggtatctatatgggttgaggaaacaattgggggctgtggagcatttggtgtatatggtttgtgatccaagaggatgggtggcctttgaccccaagataaacaggtggatgtcattacccaagataccttgtgatgagtgctttaaccatgcagacaaggagtccttggccgtgggctgcgaactgttagtcttcggtcgggaactgatggagtttgctatttggaagtatagcatgatttgtcgtggttgggtgaagtgccaggagatgaaccagcctcggtgtttgtttggatctagtagtcttggatcgattgctattgttgctgggggaagtgataagtatggaaatgttctaaaatcagctgagttgtatgactcttcaacaggtatgtgggaacttttaccaaacatgcacacatcgcgtagattgtgttctggtttttttatggatggcaaattctacgtgattggtggaatgtcaagtacaactgtttcattaagttgtggagaggagtatgatctcaagacaaggagttggcggaaaatagaggggatgtatccatatgttaacgtgggtgttcaggcacctccacttgtggctgttgtggataatcagctatatgcagttgagcatctgactaacatggtgaaaaaatatgacaaggaaaagaacacctggaatgaattggggaggcttccagtcagggcggattcttctaatggttgggggttggctttcaaggtttgtggagagcaacttttggttgtgggtggacaaaggggtccagagggtgaatctattgtgctgagttcatggtgtcctaagtcagggatcagcaatggcaccatagattggcaggtacttggcgtgaaggagcatgtcggggtgttcgtgtataattgtgctgttatgggttgttga

SEQ ID NO: 2320 - DNA, 630 bp, Glycine max var. Williams 82
atggagaaagaaacagagatgaagcaatccaagttcaagaggatttgtgtcttctgtggcagtagtccagggaacaaaactagttataaggacgctgctattgagcttggaagagaattggtgtcaagaaatattgatctagtgtatggagggggcagcattggtttgatggggttgatttctcaggctgtttacgagggtggtcgccatgtaactggagttattcccaagacacttatgccaagagagctcactggagaaacagtgggggaagtgaaggcagtagcaaacatgcaccaaaggaaagctgagatggctaagcgctctgatgccttcattgccttacccggtggctatgggacacttgaagaactccttgaggtgataacatgggctcaacttggcatccatgataaaccggtgggattgctgaatgttgatggatactacaatacctttttgtcttttattgacaaagcggtggaggaaggcttcatcagccccactgctcgccatataattgtatctgccccaacaccaaaagagcttgtcaaagagatggaggaatatttcccacaacatgaaagagttgtctctaagctaagctgggaaagtgaacagctacattag

SEQ ID NO: 2321 - DNA, 552 bp, Glycine max var. Williams 82
atgcaagcagcaattgcagccatggccgcccacactattctcttttcttccttcccagctcctcaatccattgcccttcccgccactaccaagaaagccgttgcaatcctcaagggcaattcctccgtccatggccttgtcactctaacccaacaacaagacaacggcccaacaactgttactgttcgtgtttctggtcttactcctgggcctcatggttttcatctccatgagtttggtgatataacaaatgggtgcatatcaactgggccacatttcaatcctaataaactcaaacatggtgctccggaggataaaattcgccatgcgggtgacctgggaaacatagttgctaatgccgatggagttgcagaagcaacaactgtggacaatcagataccactcattggacccaattcagtagttggaagagccttagtagttcatgagcttgaggatgaccttggaaagggtgggcaagaacttagtttgagcactggaaatgctgggggaagattggcatgtggtgtggttggtttgagtccagtgtaa

SEQ ID NO: 2322 - DNA, 942 bp, Glycine max var. Williams 82
atgttggcacaaatggacatggaggagcttgtctcatgtaacaacaacgatgccaccaacatagccaaagggaagcgcacaaagcggcgcttgaggcctttgtctccttgtgctgttgtcgctgctaccactatcaccaccaccaccactgctatcaccgctatcaccaccgtcatgacatctagctgttcaagtgcttctgccggtggcggtggatcgtcttcatccaccacctttgaggaggaagaggaagacatggctaattgtttgattctcctagcacaaggaagagtaggacgggaccctcctcatcatcacaaggacctatgtggtgatgtcaagacagagaagggtagcaccaaagttgatcatttatatgtttatgagtgcaaaacatgcagccgaacattcccttcttttcaagcactaggtggccacagggcaagtcacaagaagcccaagatggaggagaaaaagttgttatcaccaccactgttattgccaccactgccagcttcgtcttcgtcactatttaattttgaggaagcaaaacaaagtcacatgaagaatattattagcccttctgtctcccttcaattagggtgtggcattaacaaggttggtttaaatttccatggcaacaagtccaagattcatgagtgttccatctgtgggtcagaattcacatcagggcaagcattgggtggtcacatgaggaggcatagagcatctaacaataataacaatattgttcagacaacaacaacaacaacaactacttctaatggtgctgttgatgttaagcctcggaatgttctagagttggatcttaaccttccggcgccggaggacgatctccgggactcgaagtttcagtttccggcgaatccgaattctatgatgctgtcggctgctccggctttggtgggatgccattattag

SEQ ID NO: 2323 - DNA, 1530 bp, Glycine max var. Williams 82
atgggatccgttttgccctcatttcaatggctttctttgttctttctaattatctcagttaatgtttgtgctttcaaaattccaaggttaggaacttggcagagatcaaccaaggaacgcgaccccgaaatcagttcttccttgcacttgtctgatgatgacctcaaaacattttattatacccaaagactcgatcacttcaactacagacctgacagctaccacactttccaacaaagatatatggtcaatttcaagtactggggtggagctaaatcaagtgcacccatttttgccttctttggtgcagaaggaccagtggatgaggatgcaaaatatatcgggtttctcagagataacgctcctcagttcaatgctcttattgtttttatcgagcatagatactatgggaaatcaataccatttgggtcaagcgaagaagcaatgagaaatgcaagtactcgtggctacttcaactcagcccaagcaatagcagactatgctgctgtgcttctacacatcaagaaaactttgtctgctcagaattcccccataatcgttattggaggctcttatggtggaatgcttgcatcatggtttcgcctaaagtatccccacattgctcttggtgctcttgcttcatcagcaccaattctttatttcaacggcattgccccacaagccggatactactatattgtcaccaaggatttcaaagaaactagtgagagctgttaccaaactatacgtaaatcatggtctgaaattgacagagttgctaagaagccaaatggtctttcaatcctcagcaagagatttaaaacttgcgacaaattgaacaaaagttttgatctcaaggactacttggactcgttatatacggacgcagctcaatacaattacccttctgagcacccagttaagatcgtatgtggagcaattgacgcagctgctaagaaaaccgatattcttggccaaatatttgaaggtgttgttgcttataagcaacatcgttcatgttatgacatgaatgaatataaccatccaactgaatctttcctgggttggagatggcagacatgcagcgagataattatgccaataggtcatgaaaagaacgactcaatgtttccaccagcacctttcaatatgaagacatttgttcaagagtgtaggagcttatatggtgtccttccccagcctcattgggtgaccacatattatgggggtcctgatttgaaactgatcctccataggtttgccagcaacatcatattctccaatggattgcgagatccgtacagttctggcggggtgttggagagtatttcgaacactgtcgttgccgttactactgtaaatgggtgtcactgcctggacatacagtcaagaaaggcaaatgatcctcaatggttggtgacgcagagaaataccgaggtcaagataatcaaaggctggattgccgagtacaaagctgatctaatagcacttactaaacaaatcaaagcaccagcagaacccaaaagctaa

SEQ ID NO: 2324 - DNA, 1482 bp, Glycine max var. Williams 82
atggcggcggcggcggctgcttttgttatctccgtcgcgctgttggcggcggtagctggcggatcgccggcgactctgactttggaaagagcgtttccgacgaatcacggggtggagctgagtcagctgagagctcgcgacgagttgaggcatcgcagaatgttgcagtcttcaagcggcgtcgtggatttctccgttcaaggcacctttgatcccttccaagtcgggctctactatacaaaagtgcagttgggtactcctccagtggaatttaatgtgcagattgacactggtagtgatgttctctgggttagttgcaactcctgcaatggttgtcctcaaacaagtgggcttcagattcagctcaatttttttgaccctggaagttcatcaacatcttcaatgatcgcttgttctgaccaaaggtgcaataatggaaaacaatcatcagatgccacctgttccagtcagaacaaccagtgctcctacactttccagtatggagatgggagtgggacatcaggctattatgtgtcagatatgatgcatttgaacaccatttttgagggatccatgaccacaaattctactgcgcctgtagtttttggatgtagcaatcagcaaactggggacttgacaaagtctgatagagcagttgatgggatatttggatttgggcaacaggaaatgtctgtcatttctcagctctcctcgcaagggattgctccaagaatattctctcattgtctgaaaggagatagtagtggtgggggcatattggttcttggggagattgtggagccaaacatagtctacacttcacttgtcccagcacagcctcattacaatttaaatctacaaagtatctctgtcaacggccagacattgcaaattgattcttcagtttttgcaacatcaaacagcagaggtaccattgttgattctggaacaactttggcgtaccttgcagaagaggcttatgatccctttgtctctgcgattacagctgcaattccacaatctgtacgcactgttgtttccaggggaaatcagtgttacttaatcacctccagtgtcactgacgtttttcctcaagtaagtctgaactttgctggcggtgcatctatgattttaaggccacaggactacctgatacagcagaattctataggtggtgcagcagtgtggtgtattggttttcagaaaatccagggtcaagggataacaattctaggagatctcgtattaaaagacaaaattgttgtttatgatctggctggtcaacgcattggatgggctaactatgactgttctttgtcggtgaatgtctctgcaacaactggcacgggcagaagtgaatttgtgaatgctggtgagataggtgggagcatctctttacgtgatggactcaagttgacaaagacaggattcttggctttctttgtgcatctaacgctaatttactgttttggattcttatag

SEQ ID NO: 2325 - DNA, 5610 bp, Glycine max var. Williams 82
ggcaactcgggcgcacgagtgataacacaacaaacctcttcgccatcactagcaaaattttccctccccccttttatctcacccaaccctaacctctccccctcaatcctcacccaaccccccgcactctctataaactcagcacgatctcagcaaaccctaaaccttttggcaaactccaaaatctctctgaaaaactacagagagactcttccttctccttcggattcgacgatggaagaacctcccgtcgtgagatccaggggccgcccgcgcaaacggaggagagaagacgacgcaaccgtcaccggcgacgcgaaaactcttcccgaggcgaagaagatgatgccaattgcattggttggacgatacgtgctgaaagagttccgcagaaacacggttcttctcggcaaagtcgcgcgttacgcgagtggattgtacagagtcgtgtacgagagtggcggtttcgaggatttagatagcagcgagattcgtaggatacttctccttgatagttatttcgacgacgatttgattcggaggaaggttgaattggaggaatcggtgttgccgaagatcgctgcagaggaaccggagaaaggttcgagcgaattgcaaggtgaattatcggttgagaacgaggaggaacgagctaagacggatgatgatgagtcgttcggtgaggctagggattcaagttccggttccgaaatgccagaaacgcagataccgccgccgcttacgctgccgccgtcttccggaacaattggagtgccggaaccgtgcgttttgaatctcttttcggtttacggatttttaagatcgtttagcattcgcctgtttctgagtccatttactttggatgagtttgtcggtgctctgaactgtaaagtttctaacacgttgctcgatgcaattcatgtttcgctgatgcatattttgaaacgtcaccttgaaaatatttcaccagatggctcgcggcctgcaacaaaatgccttaggtgcagtgattggagtttgcttgatgctttgacttggcctgtttttgtgtttcagtatttagcaatttttggatacacaaaaggacctgagtggaaaggattttatgatgaaatcttttatggcgagtattatttattgcctgcaagtaggaaattgacaatattgcaaattctctgtgatgaagttttggcgtctgaggagctaaaagctgaaatgaacatgcgtgaagaatcagaggttgggatcaattatgataatgaagatagccttcctgctgaaaatgggcctagaagagtccatccaagatattccaaaactactgcctgcaaggatgctgaaactaagaagtatgtttcagaattgaatgcggaggatgatggtgatgttgatggaaatggagatgaatgtcgcttatgtggcatggatgggaccttgctttgttgtgatggttgtcctgctgtttatcattcaaggtgtattggtgtgatgaagatgcatataccagaaggggcatggtattgtccagagtgcaaaataaatttgattgggcctacaattgcacgggggacatcacttaaaggggctgaagtatttggaaaagatttgtatgggcaagttttcatgggtacttgtgaccacttactggtactcaatgtcaaaagtgatgacttttgtcttaaatactacaatcagaatgatattcctagagttctccaagtcctttatgcatccgaacaacatagacctgtatacaatggtatttgcatggcaatgttagaatattggaatatttcagaaaacttcttacccctctgtgtcagtaaacttcctcctatgattgaagaagagcataaagctgttagttcggtgaaggcagactacagtttaacgtttgggaatgggatttgtagtgataatttggtgccatctcttgatgcttcattggttacaactcgaagtcctgctcctggaagcagtggcaatgcaagaactactgtgaatctgaagcttcacgaggaaactgcaatggattcgtctgtttcaactaaccatcagtctgacccaaagtgccgaaattatgttaataggtcagctgcagtaagccctgccaagtgctccttggtaagcagccaatttagtaattatggggacgctaatgatatagggttgcctatgaatttgtctttgcaaactaaaggtgaccaatctggttttggaaagtgcaaaagcagtttaattaatgattttgtgtacatgggttgctcctataaaccacagtcatatattaattactatatgcacggtgattttgctgcatctgctgctgctaacctggccgttctttcttcagaggattctagatcagagggtcatgtgtctggcaacttggggaaagctacatctggaaacacttatttgctagcaaaagcattctcccaaacagcttcacgctttttttggccgagttccgaaaagaagcttgtggaggttccaagagagaggtgtggatggtgcatttcttgtaaagcccctgtttcaagcaagaaaggatgcatgttaaatcatgctgctataagtgccaccaaaagtgcaatgaaaatcctttctggttttgctcctgtaaggagtggagaaggaatcatccctagcattgctacatatgttatatatatggaggaaagtttgcatggtttaatagttgggccctttctaagtgaatggtatagaaagcattggcgtaaacaggtggaacgagctaaatcatttagtgatataaagccccttttactcaaacttgaggagaacattcgaacaattgctttttgtggggactgggttaagttgatggatgattggttggctgaattttctacaatgcaaagtgctgcatgtactcttggaacaacacagaaacgtgcaacttgtgggaggcgtaagaaacagttatctatcaataaagttacagctggtggttgtcaggaaaattttgcatggtggcatggcgggaaatttaccaaatctgtatttcagaaagctgttttgccaaaatccatggtcagaaaaggagcccgccaagcaggtggtttgaggaaaatttcgggtatattctatgctgatggctctgagattcctaaaagaagcagacagctagtttggagagctgcagttcaaatgagtaggaatgcatctcagctggcacttcaggtccgatatctagattttcatatcagatggagtgatctgattcgtcctgagcataacctccaggatgtgaaaggtcaagatactgaagcttctgcttttaggaatgcaaatattcgtgataaaaaaattgcagagggcaaaattttatacagagtagcctttggaagccagaaacatcttccttctcgggtaatgaaaaatgttgaaatagagcaaggtcctgaagggatggaaaaatattggttttctgaaacacgtattcctttatatttggtaaaagagtacgaattacgcaatggaaaagtactatctgaaaaagagtacctgcatattacatctcatgtgcacaaaaggcggttgaaagctacctacaaggacatatttttttaccttacctgcaagagagacaaattggacatgttatcatgctctgtatgtcagctggttgttttagttgggaatgctctcaagtgcagtgcctgtcaaggttattgtcacacgggttgttccgtgagttcaacagtctctacatgtgaagaagttgagttcttggccacatgcaaacaatgtcatcatgccaaattacttactcaaaaagagtcctgtaatgaatctccaactagtcccttactcttacaaggacaagaacgtagcactttggcagttctgaaggggccaaggcctaaatgtgatggtcaaggattgatttctactaggacaaagaatagtcgacttgacatgaaactagttgcttctgatttccctttggaaacaaaaggccgtagcagaagttgttcttggggtgttatatggaaaaagaagaataatgaagatacaggctttgatttcaggctcaagaacattcttttaaagggaggttcaggcctgcctcaattggatcctgtttgtcgcttgtgccataaaccatatagatctgatctaatgtatatttgctgtgaaacatgcaaacattggtatcatgctgaagccgttgaacttgaagaatccaaactttttgatgtgctgggcttcaaatgttgcaagtgtcgcaggataaagtcacctgtgtgtccttactctgatttgtataagatgcaagagggcaagaagttactcacaagggcttcaaggaaagagcactttggggcagattctgattctggtacacctattgacacgagaacatgtgagcctgcaactcctatctatcctgcaggggatgtctctagacaagacaatgatcctctgttgttctccctttcaagtgttgagctcattacagaaccccagttaaatgcagatgttgcaggtaatactgtctctgggccagggcttctgaaattacctaaacgtgggagggagaacaatggttcttttagaggtaatcttcatgctgagttttcaacaagcaatgaaaatgaaatggtgtccaaatctgtaaaagatttatcacctgtagaatatggctctgctgactgcaatcttctgaataactccgaaattgttaaatttgatgcattggtggattttgaacctaatacctacttctctctgactgaactgctccacacagacgataatagtcaatttgaggaagctaatgcatctggggacttagggtatttgaaaaattcttgtagattaggtgtacctggagattgtgggactgttaatttagcatccaactgtggatctacaaattcgttacaaggaaatgttaataattgtcggctatgttcacaaaaggaactggcccctgatctctcttgtcagatttgtgggattaggattcacagccattgttcaccttgggttgaatcaccatctcggcttggtagttggagatgtggtgattgccgggaatggcgatagcagattttgtttgtcatcctgttgtttagtaagagttctcttgggtgtggtggtggtgagagatatggtaattgccgggaatggtgatagcatacaaactgactctcgatttcagcattaatcatacaagttggctcagtatgcgtgcattgattggttcaggtatatttcagagtttaattggcatctgcaggtttctatgaatttagttaccgctcaaataattgcggctttcctgcaactgatagatagtgtttgagtaaatgatgacttggacacagtatagttgaatgctctggaaccatattggtttttactcccctagttgcattccccccaatccccacttctaatgcaggattcatagaattttgctccgataatcggtgataagcagttttttatgttgcttatctgtcacaattatttgtatagattagataccacattcttttggaggtcggtcaaaattgaaaccttcacctcggatcttagatatcaagctgtgagatgcctagtgagctccgaccc

SEQ ID NO: 2326 - DNA, 642 bp, Glycine max var. Williams 82
atgtcttcttcataccattttcaatctcagtcctatgctccatctgcgccagaacaacctccatattccaattaccatcacacttcttcatcagcatcatcgagttttccaccagggacaccccatgacgtcattaggagctttcagatggtggatagggaccgaagtggcttcattgatgaacgtgaattgcagcaagctctctcttctggattccaccacttcaacctcaggaccattcgttttctcatgttcctcttcaagagtccaaacctacccctcacaattggaccaaaggaatttgcagcactctggagttgccttggtcattggcgaggcatatttgagaggtacgataaagacaggagtgggaaaattgatccattagaactcagagatgctctatatggtattggctatgctgtaccgggctcggttctacaacttctgctttccaaatacggtgatggaagtggtaggagggttgaacttggttttgacagttttgtcgagtgtgggatgattattaagggtctgactgataaatttaaggagaaggatacacggtatacgggttcggctacactttcatacgatgcctttatgactatggtccttcctttccttgtatcttatgattga

SEQ ID NO: 2327 - DNA, 624 bp, Glycine max var. Williams 82
atgtctccccccatctttaaagtactcacattgatcatatctgtttttgccatcatgcaaatatcaacagctggtgacccagatattcttactgacttcatagtcccccccaacaccatacctgatggcaacttcttcaccttcactggcttccgtgtcattttttcacccaacaacactgtctcagatttcaaagtgttgaaggcaaccaaggtagaatttccagcccttgatggacaaagtgtctcatatgcaatccttgagttcccaggtggcagcatcaacccaccacacacacaccctcgttctgcagagttactcttcaccgttgagggttcccttcaagtggggtttgtggacacaaccaacaagctcttcactcaaacactacaaaccggagacctctttgtgtttccaaagggtctcgtgcacttccaacacaatgcggatcctcagaagccagcactcgctatatctgcctttggaagtgccagtgctgggactgtgtcaattcctagcactctctttaacaccaccattgatgacaatgtattggctctggccttcaagactgatgttgccaccattcaaactctgaagaaaggctttgctcctaaagcatga

SEQ ID NO: 2328 - DNA, 522 bp, Glycine max var. Williams 82
atgacgcagatggtccttctgcgctcgccgccggtcacccgccgcagggggaggcgcggcgtgggcgaggttgccggcagcgcgacggcggagtgcgcggcggtgtgctgctgcgtgcccctcaccgtcatggacatggtcgtactcgccacctacaagctccccgcgtgcctcctcaagaaggcaatgcacaaacgcaagcgacgccttctgcagaaaaaaaagaagaaaaccgaggcgctcttggatcacgggcccgtcaccgcagacaatgctgggcctgggcccaaactggaagatcatcttgcgaaggaggtcgcggaggagaagctggaggcgtcgaggttggaagcggagatgtgggcccagttcaacgggaccgggttctggagaagcgcttctcagcgctaccaacaacaacaaactggtcaaatcaaaccaattattaatctaccaattgaaccattaacctattacatcgaccaagtcactgatcgggttgggtttcccaactatggatga

SEQ ID NO: 2329 - DNA, 522 bp, Glycine max var. Williams 82; identical to SEQ ID NO: 2328

SEQ ID NO: 2330 - DNA, 453 bp, Glycine max var. Williams 82
atgatgggctttgggcccaaacacagccgacttaataaagatcaacaaagcaccaagtatctcaatgatgagattgaggaccctgcccctcacaaagaacatactaagcaacagttgaagatgcatgttgctcatgctcaaaactatgaagttgcatgtaatgcaattatcaaccactgcttcacttcttatgcattttggcattgcttctttcaggctgcggcagtatcttatgctaaacaagttgtaaagctgatggatagtttgctcatggcagggaaggccacagttgaaatgaataaggagctgaacactcagaaaatgagagcacccttgttgcacaaaactgttattattttcacagatatgttactttgccagcacacagacctcattgatggcttttatatattaaagctcctaaaagatgatggtcataatcaaattaattaa

SEQ ID NO: 2331 - DNA, 159 bp, Glycine max var. Williams 82
atgatgacgatgttgttttccactttattttgcttccccactggccgcaaattgatgcgtgtcttaatttgcaaaatacaagctagagagatcttagaagggagaaagaaagatgcagctatccacactctcatgaagagatcaaaaggaattaattga

SEQ ID NO: 2332 - DNA, 1806 bp, Glycine max var. Williams 82
atgcaaatggaaaacatagtgtgtgtagcacagcgcattaatatggggacaagaatcacttttcagttggaagaaaggtataatttacagcacggaatgtctggggcgggtggagctatacgtgtggagagagcaaggaagcaaagagccaccacccatggcttcaaattggaccgtggcctcgtcaagaaacaacgacgtgttggagtgccgttcaaagcagctgcaactgctgaatctgaggcacaagttcgtacaatttccaaagatccaataatgcttgcaaattatgtaccagtatatgtgatgctcccgttgggagttgttacaaatgataatgtcttgcaagatagagtgggactagagaaccaactcaaagagctacaagcagcaggtgttgatggggttatggttgatgtttggtggggtatagtagaatccaaagggcctcaacaatatgattggtccgcttataggaccttgtttcaaatggttcaggactgcaaattgaaattacaagctataatgtcattccacaaatgtggggggaatgtgggagattccgttttgattcctctccctaaatgggtacttgaaattggagaatcggaccctgatatcttttacaccaaccgcaaaggtattaggaacaaggaatgtttatccctcggcgtggacaaccaacctttgtttcatggacgaactgccattgagttgtacaccgactacatgcaaagcttcagagataatatggaagattttcttgaatccgagctcatgatagacattgaagtaggacttggtccagcaggagaacttagatatccctcttatacaaaaaatctagggtgggaatttcctggtattggagaatttcagtgctacgacaaatatcttaaagctgatttcaaaggagctgcattaagggcagaccatcctgaatgggagctacctgataatgctggggaatcaaatgatgtacctgaatctacagaatttttcaaatcaggaggaacttatcaaacagagaaagggaaattttttctaacctggtattccaacaagttgctgacccatggtgatgaaatcctagatgaagccaacaatgtattcctaggttgcaaagtgaagttagcagctaaagttgctggaatccactggtggtataaagcagaaagccatgctgctgagcttacttctggctattacaacttacatcatagagatggatacagacctgtagcaaggatgctctcccggcacaatgctattttaaattttacatgtcttgagatgagaaatcatgagcaaccagctaaagcccaaagtggagcgcaagaacttgttcaacaagtgcttagttgtggttggatggagaaccttgaagttgcaggggaaaatgcacttgcaagatatgaccgtgaagcttataatcaaatccttttaaatgctagaccaaatggtgttaaccaatttggtcctccaacactaaaaatgtatggtgtcacataccttcgtttgtcagataagttaatgcagcaaacaaactttaatatattcaaagcctttgtgagaaagatgcatgctaatctggaatattgtccagacccagagaagtactatcatttcacagtacctatggagcggtcgaagcccaagattccactagaagttcttcttgaagcaaccaaaccagtggagccttatccatggtataaggaaacagacatgagccttgatgttactggttttcttgattatatagttgctattattgtacgtatattcaagctaaaattaaactaa

SEQ ID NO: 2333 - DNA, 948 bp, Glycine max var. Williams 82
atggattttgacctcgaaaaccctcttggaaacttccacgaccttccttgtgacgctgtcccttccctcttcctcatcgaatccgaccacatccctccacccaactactgtcagagtttcaaggccagcgacttcgacatctctgtaagaagagacgttgtctctttgatctcgcagttgtcctgcaccttcgatccggttcttccttacttagctattaactacttggatcgcttcctcgctcaccaaggaatattgcaaccaaagccatgggcaaacaagctccttgcaatctcttgcttttctctagctgccaagatgttgaaaacagagtactctgccactgatgtccaggttcttatgaatcatggtgatgggggtgccatttttgaggcacagacaattcaaagaatggaaggcattgtcttgggggctctacaatggcgaatgcgttcgatcacccccttctctttcattcccttcttcgtcaacttgttcaggcttaaagaccctgcattgaggcaggttctgaaggatggagcatcagaaatcatactcaagtcacaaagagagataaaggtcttggaattcaagccatctacagttgctgcgtcagcccttctgtatgcttcacatgagttgtttccctttcaatatccgtgcttcttaagagcaatatccgattgttcatatattaataaggaaactgtggtgcaatgttataatgtgatacacgacataaccagggaggagtacgaatcagtgttgaatataaattcaacttcagacacaccggttaatgtgttagacgaacattttctgagtttggaaagtgaaaaaaccaacggaaccaacgttgtgacacaagagcaggatttcaaaagaaggaaaaccaccgattatggcaacaatcgcacggtcccgttttcacattttcatcaatgctga

SEQ ID NO: 2334 - DNA, 987 bp, Glycine max var. Williams 82
atgggaagagcaccctgttgtgacaagaatgacctcaaaaagggtccatggactcctgaggaggatctcttgctcaccaactacattcagacttatggaccaggaaattggcgaaccctccccaagaatgctggtctacaaagatgtggcaagagttgtcgccttagatggactaattaccttagacccgatatcaagagagggaagttctcatttgaagaagaagaggccatcattcagcttcacagtgtcttgggaaacaagtggtcggctatagcagctaagttaccggggagaaccgacaacgaaataaagaactattggaacacaaacattaggaagaggttgcttcgaatgggaattgacccagttacacacgctccacgccttgatcttcttgacatgtcctcgattctaaggtcagcaataggaaccgttaacccatcgtttctgaatctgcaaggcctattgggtgcccaagcgttgatgaacccagaattttttaagctcgctgccactgccacacttttatctttgaagaatcatgagaacgcatcaaacttagtttcacaagtgcaacaacaattcaataataatgctgggaatggtcaagtacagaaccaagttgctgctccaaatcagtttcagacaccaactctaagcaacaacaacgtgaacaatggcttatcatcaatttccccagagaattcatcaattccttcttatcttggggagaataattaccagctgaatgctcaacaaattaaccaagttgatttgcttctggaccccgaattggaacattacttaaacagtataaaccaaaacataggccatgaatcagttacacctttgtcaactcctacctcattgaattcatcgtccacgtatgtgaatagttgcgcggaggaagagagggacacctattgcagcgatgtattcaagttagaaattccagagagtcttgacattagcgatttcttgtaa

SEQ ID NO: 2335 - DNA, 522 bp, Glycine max var. Williams 82
atggcctccccaacactaataacccccaaatcagtgaaatcactcacacccatcaagcccaaacccaccaccaccatcgccgccactctcacaccacccacaacaacctccaccgccgccgccacccaccctcgccgccgcgaattcttgtccatcatcaccgccaccacatggctggtccctctgagcccggcactggcttcctcggacgaggaatacatgaaggagaccgaggaagtgatcaacaaagtgaggacaacaatcgtgatggacaagaatgaccccaacgtggcaaccgcggtggcggagttgagagaaacctcgaactcgtgggtggcaaagtacaggagggaaaaagcgcttctgggacgcgtttcctttagggacatgtattccgcgctcaacgctgtttctggtcactacattagcttcggaccaaccgctcccattcccgccaaacgaagggcaaggatcttggaggaggtcgacactgctgaaaaggcgcttctaaggggaagataa

SEQ ID NO: 2336 - DNA, 786 bp, Glycine max var. Williams 82
atgcagtgccaccgcgtctccgccgtgctttttctaagcttatgctttagaattgcgctagtatacgcgcaaggagagcctcatctcactgctctggaccaacattggttcccgggaaccgccacgtggtacggcgaccccgaaggtgacggtagcaccggaggggcatgtgggtatggtacgttggtggacgtgaagccgttgaaggcaagggtgggagcagtggggtcagtgctgtttaagaagggggaagggtgtggtgcttgctacaaggtgaagtgtttggaccatagcatatgttcgaagcgggcagtgacggttataataacggatgagtgcccgggctgcccgtctgaccggacgcacttcgacctcagtggctctgcctttggccgcatggcagttgtgggtgaaaacggtcagctcaggaaccgaggtgaaatcccagtcatttaccgcagaacaccgtgcaagtatgctggcaaaaacattgccttccatgtcaatgaaggctccactcctttttggctatcccttctggtggagtttgaagatggagatggggacattggctccatgcatatacaagaagcagggtcgagtgagtggcagcagatgaatcatgtatggggtgcaaattggtgcattgttaaggggccattaagaggacctttctctgttaaactaagcacatctacagggaaaagcctcactgccaaagatgttattccaagcaattggactccaaaagccacttatacctctcgcttaaatttcctttcttag

SEQ ID NO: 2337 - DNA, 1374 bp, Glycine max var. Williams 82
atgaagtacaagtaccatttatctttctcaattggaatcttatcttttccctacactttctttaaattcacttatattggttcaccaaactcaaacaccatatactgggcgaagagaatggaggatggaagtgagaaatggaattttcaggggaacaagaagctgaatgcttcatccatctctgtgagaggggtctataacatgttgatggagagagtcaacaatagccgagacaagaaacctttggttcctctctgtcgtgtagatcccaccgagaacccattgtttcggactaccccagaagctactgattctgtttcaactgctgttaactcctataacttcaactgttaccctcccaccgttggcttacctgatgcaaagagggctattgcaaattatctctcttctgatcttccataccaattatcaccagagaatgtttttctcaccatcggtggcacacaagctatagatataatcttgcctgcccttgcacgttctgatgccaacattctccttccaagaccagggtacccgcaatatgattctcgtgctagttgttgtctcctcgaagtacgacattttgatcttttgcccgagagaggttgggaggttgaccttgattcccttgaatctcaagcagatgaaaacacagtggccatggtcctcatcaatcctagcaatccatgtggaaatgtcttcacataccaacatttaaaaagggttgctgaaattgctaggaaacttggaatctttgtcatttctgatgaagtttatgcccatgtaacttatggaagcaatccatttgttcccatgggggtgttttcttcaatagttccggtcattacaattggatctttatcaaagagatggttagttcctggttggagaactggttggatagccacatgtgaccctcatggaatttttcagaaaactggggttgtgaaaagtatcatcagttatttggagatcacaactgaccctccaaccttcttgcaggcagcaatacctgaaatccttggcaaaacaaaagatgatttcctttcaaaaaatcttaatatactgagggagactgcaaacatattctatgatttatgtaaggagatcccttgcttaacatgccctcacaaaccagaaggagcaatgtgtgtcatggtggagattaacttctcacaaattaaggacattgttgatgatatggatttctgtgccaagctagctgaagaggaatctgtccttcttcttccaggtgtcacggttggactgaagaattggcttcgaattagttttgctgtcgacacttctaatcttgtagaaggccttagcaggataaaagcattttgccttcgatatgcaaagatgccatga

SEQ ID NO: 2338 - DNA, 483 bp, Glycine max var. Williams 82
atgcatcaagcaattccctatagatcatggcgccctctccataaccccaccacccacttctccccattgccattaattgcacattcccacaacgatgatgataaaatgaggaacattgttaacaataataataataatattcattcttcagcagggagaatggtgctcaacatggtttctgagaacgcggttatagtgattgggagaagaggctgttgcatgagccatgtggtaaagcacttgcttcttggtcttggtgttaaccctgcggtttatgaggtggaggagaaagatgaagagggtgttgccaagcagttggaagaaacagttcgtagtgatgggaacacacaacaggggaaggtgcagtttcctgcggtttttataggggggaagttgtttggaggattggataggatcatggctactcatatctatggtgagttggttcctatcctcaaaaaagctggggctttatggctatga

SEQ ID NO: 2339 - DNA, 591 bp, Glycine max var. Williams 82
atgagtacagcaagattcatcaagtgtgttactgtcggagatggagccgtgggaaagacctgtatgctcatctcttacaccagcaacacattccccacggattatgttcctacagtttttgacaacttcagtgcaaatgtggtggttgatggaagcacagttaatctcggattatgggacactgctggacaggaggattacaacaggcttaggcccttgagctacagaggagcagatgtgtttttgcttgcattttccctcctcagcagagccagctatgaaaatatctctaagaagtggattcctgaactgagacattatgcccccactgtgccaattgtacttgtgggaaccaaacttgatttgagggaagataggcagtatttgattgatcatcctggagccacacctataactactgctcagggagaagagctgaagaaggcaattggtgctgctgtgtacatagaatgcagctcaaagactcagcagaatgtgaaggctgtgtttgatgctgcaatcaaggttgttttgcagccaccaaagccaaagaaaaaaagaaagaagaacaggacatgcgttttcctttaa

SEQ ID NO: 2340 - DNA, 411 bp, Glycine max var. Williams 82
atggcagaaaaggaaggaggagttgtgaagaaggggcacgaggaaggcctaaaactcgcggcttcgctgctgcaagagttcgagctcccggaggggcttctccctctcgctgatgtcgtcgaagtagggtacgtgaagggcacagggtacatgtggatagtgcagaagaagaaggtggagcatgagttcaagatgataagcaagttggtgagctatgacactgagataaaagggtatgtttctaagaagaagataaagaagctgaagggtgtgaaggccaaagagctcatgctgtggcctcctgtgagtgagatcactgtggatgacgctccaactgggaagattcacttcaagagttttgctggtatcaccaagactttccctgttgaggcatttgctgctggccagtaa

SEQ ID NO: 2341 - DNA, 1686 bp, Glycine max var. Williams 82
atggcgatgagagaagctaattccatgatgctcaaagatctaatggaagaaaagcagttaaatttgaatcagccacttttatcagtgaggaggttctcatcaacattggcctctgaaacagaccacaaaagcaaaagtcagaactcattagccagacttccacttcctcctgcttacaaatcagagttaaattcagttccagagaggaatgctggaaatgttccttttgtatgggagaaggcaccaggaagaccaaaagatgaaagcaaattacagacacaagattttgagaagcctcccttcacttcaaactttccacctgggagggtatcaaaaactaagcaacaatcacttgctgagatgagaactggaagcacactttccaactctcaaagtgttgcatccttggacaaaaaagcaacaaaaaattcaaaaggggaaactagggagaaggaaagttctgggtcagatgatggagatgaggcctatgaagatgctcgtgactcactttctaggactgaatcattcttcatgagctgtagtgtgagtggcttgagtggatgggatgaacaagaggtccaaccatttggaagtttctcaagtgatcaccaacaaggtcgcaatttcatgattgataggttcttgcttgcagcaaaggcaatgacatcagaaactcctcaatatgcttccaagaaagcacatattggacaagaacaacaaaagcagaaaaagaaagaagtgaatacagaaagtccatgtcccattaaccagcataggccaaaagctttgccacattacactcaagatattgatggggaagaaagtgatgattgcagtgaatatgaaaactacacaactacaacttgtggcctatttcctcggttctgccttttgaatccaatgcctggattaagaatggtggatagggttccaagaaatgcagctcatggaatgcaagctaaatcagctgcttctcacattggatcttcaaaagagcaaggtagaactccttatgggaaaaagttaagggattcccagtctggatttacagaagaaaaagagattttggatattcttgtaaaatctaagcatggcattgacccatatcaaagaggttgcactcaacatgattcaagttatgaaagccatgtacatgagaaaactctatatgttgattctgtacacaaggttaagtctcaaaccaataacatagggggtgattttgagacttcaataagagatagtggcatttataacaattcttcaatagattcaagtcctaaagtgattaaatctaagaagataaattcagaaagtcaagtatatggcagggacaaaaattctgatatcctaactcagaattcagaacttgatttgaagagacaactagctgccaaatgggttgatgaagaatgcactttggctagctcaaaggtgagatataatgggaagattgacttagaaagccaatgtcttacaaagttaggccatcaagaaatatctggtgcaagctgttttggacttcctcttgcccttcctgcactaaaagctccatcagagtcttggcttaagcgcactttacctaccatttgcaaaagaaacatgacttcacagtccaaccttactgcaaacactaaaactcccaagacaacaccattgcatcctaagtgggaaacaaattgttaa

SEQ ID NO: 2342 - DNA, 639 bp, Glycine max var. Williams 82
atggcttccactgtgttctcatatccttctcttcaccttaacatctatccacagaaaacatcatcaaatcgatcagagttttccattcacatccaacccaaaaagcacttttccattagatgcacatctttggactcaactcctgaggctgactttccaactccagacccttcctcaagcacagtgaacagtgcagagtcctttcccattgagaagagaaggaggtcagagatagtgaggaagagaaggggagagaaacttgtgcagccagagccaccaaactttgaaataggttggaagaggaccaaggagattaacctagagaggccaatagggcatgtcatagctgattttttggagaagttggagaccctcatggggaaggagtttggatccacagaactgctggctaaggttggggagattgtggctgagagggcaagagaggaggctgagattctcatggatgaaggaaaagttgaagagagaatggtaactgagctctttagagtgttgaagctgatggagatggatttggctatggttaaggctgctgtgaaggaggagactttgggtgagaggcttgagctggccaaggcaaggtgcaggcaagccatacttgttgcttattccttttga

SEQ ID NO: 2343 - DNA, 753 bp, Glycine max var. Williams 82
atgaaccatctttcattctcagacctcacacatatgagttccttcaccaccatcatggctcctgtgacaaacttgcatggagcagtctccaaaaccttaattcccatcacatgccaccttccaaatgcacacaaaagcataacaaagagaggacaagtgattggatttcttggaagcaaagcacaaaaggaagcatcagagtgtcaagttcaggccacaagaagagcagcagcattaggccttgccactgtagtgcttacttggcaattcaatgacaaggtttcattggctaaagataatggtttctggtatgaggatcatcctctccctggaccaactgtcactaacaatattgcaaatgagaaaacgggaacacgttcttttcttaagagggggctttacatagcaaacattggagtgaaaggaagtgtgtttaggataaagaaatatgcctttgatcttctggcaatggcggatttgatagcagaagacacactcaactatgtgaggaagtacctaagactcaagtccacattcatgtactatgattttgacaaggttatctctgccattccagtggatgataagcagcaactaactgatatggctaacaaattgtttgataattttgaaaggcttgaagaagcttcaaggaagaaaagtctacctgaaacaaaatcatgctatcaggaaactgaagttatgcttaaagaggtcatggacaagatggatataatgtacaaatcaatttga

SEQ ID NO: 2344 - DNA, 372 bp, Glycine max var. Williams 82
atgagacaagctggtgcatattcagggttactgtgtggtggggtatcgggaaggacagggccccactcactgcccttggcaaggatcaagaagatcatgaagaattctggggagggtgttaagatgatatcaggtgaggctccaattattttctccaaggcttgtgacctcttcattgaggaacttactagaaggtcctggatcatggccattcaaggcaaaaggaggactttgcacaaagaggatttggcttctgctgttatagccactgatatatttgatttcttgatcactttggtttccaattctgacagccatgcagttggtggtgccacaaatgtcatggaggtggaaactatagattactcttaa

SEQ ID NO: 2345 - DNA, 669 bp, Glycine max var. Williams 82
gctacaactcagagaccactgaagctgaagttaactcagaaacataaaggagtgaagtagagagaaaatatgagacaagctggtgcatattcagggttactgtgtggtggggtatcgggaaggacagggccccactcactgcccttggcaaggatcaagaagatcatgaagaattctggggagggtgttaagatgatatcaggtgaggctccaattattttctccaaggcttgtgacctcttcattgaggaacttactagaaggtcctggatcatggccattcaaggcaaaaggaggactttgcacaaagaggatttggcttctgctgttatagccactgatatatttgatttcttgatcactttggtttccaattctgacagccatgcagttggtggtgccacaaatgtcatggaggtggaaactatagattactcttaagccaccttacactacatactgcagctacaaaatttgagttctatttctatatatggctatgtaattattgtaatatatatatatatgtgtgtgtgtgtgtgacataactaaggtaagaactttatgtgtttgttatgcatcctcatactagaatgaaatgaagttgtgttaagatcctcaatacagaggaactttatgttattgttaactttaaagttttttgatacg

SEQ ID NO: 2346 - DNA, 285 bp, Glycine max var. Williams 82
atgctagaaggcaaggcagtgattggggagacagacatgcttcaaaccatgcagcaggatgcactgaatttggcatcaaaagcattggatttctttgatgtcacagaggccactgacatagcccgcttcatcaagaaggaatttgataggacgcatggacctggttggcaatgcattgtaggcactgattttggttcgtttgtaactcattgttgtggctgctttatctatttctgtattggcagcttggctatcttgctctttaggggttctcctcctccatag

SEQ ID NO: 2347 - DNA, 693 bp, Glycine max var. Williams 82
caccttacctttaatccacatttcacaacttactactagaagcagctcacttaaaattgtgcttcctattcagcacattattctccttatttcatttgcagtatattattaatctgtttgtggtaaattagatttatctttatttcaccatgctagaaggcaaggcagtgattggggagacagacatgcttcaaaccatgcagcaggatgcactgaatttggcatcaaaagcattggatttctttgatgtcacagaggccactgacatagcccgcttcatcaagaaggaatttgataggacgcatggacctggttggcaatgcattgtaggcactgattttggttcgtttgtaactcattgttgtggctgctttatctatttctgtattggcagcttggctatcttgctctttaggggttctcctcctccataggtacaggaaaatcacttcttagctttagaggcagctaaagtatatattaatcttcattttcttttattcatatttatgtattactttttaaatgtaaaattgaagatcttagatattagttaattgccaataatttatagaaatattgagaaaatttcagatgtattatttttggtgttataagcttgtctccttggtcttattgaggattcaaaagacatgagtggagagtgagccaaaagttaatagctatggataa

SEQ ID NO: 2348 - DNA, 807 bp, Glycine max var. Williams 82
atggcagcaacattgatggcagcaacaacaagttctggtactcttaaagcaactcctttccttggccaaggcaagggtgccaatgccaatgctcttagggatgttgtctccatgggaactgggaagtacaccatgggcaatgatttgtggtatggaccagacagagtgaaatacttgggacccttctcagctcagaccccttcatacttgaaaggagaattccctggggattatggatgggacactgctggcttatctgctgacccagaagcatttgccaagaacagggctcttgaggtgatccatgggcgatgggccatgcttggagcactaggatgcatcaccccagaggtgctagagaagtggttgagagtggacttcaaggagccagtgtggttcaaagctggagcccaaatattctccgaaggtgggcttgactatttgggaaacccaaaccttgtccatgcacaaagcatcctggcagtgctgggcttccaagttatcctaatgggccttgttgaagggtaccgcatcaatgggcttgatggggtgggagagggcaatgacctctaccctgggggccagtactttgacccactgggcctagctgatgacccagtcacttttgctgagctcaaagtcaaggagatcaagaatggaaggttggccatgttctctatgtttggattctttgttcaagctattgtcactggaaaaggtccattggagaaccttttggaccacctagacaaccctgtggccaacaatgcttgggtctatgccactaagttttccccagggtcttaa

SEQ ID NO: 2349 - DNA, 1237 bp, Glycine max var. Williams 82
tagccacaaatctctctgattctctttccctacatattgatgttacactcttccacacatttctctttaaaccaattagttatcttctatttttcaagtaacttaaggtttcaaacctaggaagttggaagtcatggcagcaacattgatggcagcaacaacaagttctggtactcttaaagcaactcctttccttggccaaggcaagggtgccaatgccaatgctcttagggatgttgtctccatgggaactgggaagtacaccatgggcaatgatttgtggtatggaccagacagagtgaaatacttgggacccttctcagctcagaccccttcatacttgaaaggagaattccctggggattatggatgggacactgctggcttatctgctgacccagaagcatttgccaagaacagggctcttgaggtgatccatgggcgatgggccatgcttggagcactaggatgcatcaccccagaggtgctagagaagtggttgagagtggacttcaaggagccagtgtggttcaaagctggagcccaaatattctccgaaggtgggcttgactatttgggaaacccaaaccttgtccatgcacaaagcatcctggcagtgctgggcttccaagttatcctaatgggccttgttgaagggtaccgcatcaatgggcttgatggggtgggagagggcaatgacctctaccctgggggccagtactttgacccactgggcctagctgatgacccagtcacttttgctgagctcaaagtcaaggagatcaagaatggaaggttggccatgttctctatgtttggattctttgttcaagctattgtcactggaaaaggtccattggagaaccttttggaccacctagacaaccctgtggccaacaatgcttgggtctatgccactaagttttccccagggtcttaaaatgtatatgacttcttcttccctaatccctatgatcccatccctcgtgcttacctttgtgatttatgtgtagattatatgatcacaataattgttggattagtgtacttcttaaggactaaggttcaatttaaacctcggatgtctcttgtttgttaatatagttttgtctgaagcaaccaatgagaaaggtatagcaatgttgaagtcgggatgcaatgtttaaagagaatttgatactctcttttaacactttcaattattgattggtgtttatatgaattctattaattcaga

SEQ ID NO: 2350 - DNA, 558 bp, Glycine max var. Williams 82
atggcttcaaagcttttactcatcactgtcttcgtttttgatttgattgcttttggactggctgtggctgctgaacagagaagaagcactgctagcattgtgccggacaatgaaaagaattataattactgtgtctataactctgatatagcaactggctatggtgttggagcatttttgttcctcttggttagtcaagtcctgataatggtggcaagtcgatgcttctgttgtggaaagcctctaaaccctggaggatcaagggcctgtgcagttgtccttttcataatctgctgggtgtttttcatcatatctgaggtgtgcttgttggctggatcagtggaaaatgcctatcacaccaagtacaggaccatcttcggagagaatcctccgtcttgcgaaacagttaggaagggagtgtttgctgctggtgctgcttttattttcttcactgccatagtttctgaattctactatatcaactactcaagggccagggaaagcttccaaccttatgctggtggcgagactggtgtaggtatgggaacctacaaatga

SEQ ID NO: 2351 - DNA, 1612 bp, Glycine max var. Williams 82
gttagcataattttggaaaatcttttcaagaaaatgggtatgggtgggtggtcgcacacgcaaatatggcccacccatacccatgccccatccaagaaggtgccaaaaaaaggcttccattgattcagattattctatcctgaaaaaccaacctccactccctcaatctctttcagcacagatatttacatttacactccataggccataactagtaatagaaatgtcatggagtggctcctactggcaacggatcaaaaatatcctttctttaagaaatccaaaactcaacactccattggctggttggaaatgacgtggcacatgcacatgctgctaattatcttatcctctcatatcatcacaaccaacacttcaatataaattcatttccatgtagactcacatgaaccacacatttttcattaccgccgtgataacacactaacaccaccacttcatcaactttacttgacaacaatattgtaaaactcaaaatctagtttcatactttttttcttcttcttgaaatggctctccaggctgcttctcttgttcctgcttctttctcggttcttaaagagggaaagagtggtgtgtctctcaaggactccaccttgttcggtctttcattttcagaacctatcaaagctaacttcagctcttctgcattgaggtgcaagagggaattcgaacaaaagctctgtgctgtgagggccgaaacagtggctacagcctctccagcagttaccaagtctacaccagaagggaagaaaacattgaggaagggcagtgttgtgataactggggcttcatctggactaggcctggccactgctaaggctttggctgagacgggaaaatggcatgtaataatggcctgcagggattacctcaaagctgcaagagctgcaaaatccgctggcatggctaaggaaaactacaccatcatgcacttggaccttgcctcgctcgacagtgtccgccaatttgttgataacttcagaagatcggaaatgccgttagatgtgctggtttgcaatgctgctgtttacttgccaactgctaaggaacctaccttcactgctgagggctttgaacttagtgttgggacaaatcatctggggcatttcctcctctcgcgcctgttgcttgaggacttggaaaaatccgattacccttcaaagcgcttgatcatcgttggttcaataacagggaacacaaacacattggctggtaatgtacctcccaaggctaaccttggtgacttgaggggacttcagggtggtttgaatgggctaaacagctcagccatgattgatggtggagacttcgatggtgccaaggcgtacaaggacagcaaagtctgcaatatgctcacaatgcaagaattccacagacgattccatgaggaaactggaatcacatttgcttccctttaccccggttgcattgccacaacaggcctgttcagagagcacattcccttgttcagaactctgttccctccattccagaagtacataaccaaaggctatgtctcagaagatgaagcaggaaagagacttgctcaggtaatatcaataataaccctctagggaagataatgact

SEQ ID NO: 2352 - DNA, 459 bp, Glycine max var. Williams 82
atgctttccataaccatggaagaacaacaagaaccaacaaagctgatccatggctccaaagagaagcataacaaggccatgcacatgcacaccactcccaatcccaacccttctcaaacaatcatgagattggcctcacttgccatcagttccaacgtgcggttgaaatcatccgacatgccttcccacatgcaggaacatgctctgcgccacactagatcactcttcccccttcaccaccctccttctccaaagccatccaacactctcattgctagagctctcaaaaaggagtttgactcgaagtatggattggcgtggcactgcgtgatagggaagagtttcgggtcgtttgtgagtcacacaggtggagggttcatctacttctcaatcgactcactttctgttcttctcttcaaaactgaggttcacttggtcacgcaaccacctcctacttaa

SEQ ID NO: 2353 - DNA, 966 bp, Glycine max var. Williams 82
tcaatttgtcatgtcctacacagtcatctagtcaaagttcaaaacttaatataccatatatcaaacacaacccacttgttctcattcttgtctttgacttctctacctacccagtacccacctcaaatttaatgcaaaaagacccttcttttctctcaaatgctttccataaccatggaagaacaacaagaaccaacaaagctgatccatggctccaaagagaagcataacaaggccatgcacatgcacaccactcccaatcccaacccttctcaaacaatcatgagattggcctcacttgccatcagttccaacgtgcggttgaaatcatccgacatgccttcccacatgcaggaacatgctctgcgccacactagatcactcttcccccttcaccaccctccttctccaaagccatccaacactctcattgctagagctctcaaaaaggagtttgactcgaagtatggattggcgtggcactgcgtgatagggaagagtttcgggtcgtttgtgagtcacacaggtggagggttcatctacttctcaatcgactcactttctgttcttctcttcaaaactgaggttcacttggtcacgcaaccacctcctacttaattttatttttggtaatcttaattaatgttccttaaaacgtatatatacataatgtagtactcttgattttgattccaatgacaactttggttgtgtccttggttggtttcccacgtgtgaactcaatggttaactctttgactacttacccggttttgaagtttccttgtgaattgtggcattcacaaatggcaataggtcattaatagcatgttttcatgttcttctaaaggttgacaagttcgttgtgaaacatgagataatttgaaacttccggcctttaattatgtatgtgcatgtgaagttgtgttcaaattggattgtgtaatttagtttatgggcaatgaa

SEQ ID NO: 2354 - DNA, 2148 bp, Glycine max var. Williams 82
atggaatcagatagagagagaccccatcgcagcacaagtagcagtagcagcacaagcgagttgtttgtttgcttcacttcccgtttgtcctcttcatccatgaaactctcatccaagtccattctcagcccaagccgcagcagagaccctcctcagatttccctctcttcctccctcagcaggagactcaggagcaatggcagcatcaagggtggtggtggtggtggccaagcatctccaatgttcccaaccggtggtggtggcaagagaagaggaggctgtggctttgagaatcctgaaccttcttctcccaaagtcacttgcattggccaggtgagggtgaagaccaagaagcaagggaagaagatgagggcaaggtccaagaggaggggtgaagctagcttcaggaagggtgaacaacatcaacagcaacaagttggtgctaatgctaatgcaagtgcaacaaatctgaatctgaatctgaatccagatctcactagacaaagcagccaagggtttcagcatcaccagaactgtttgaagcataggaataatcagagatgggtgcatcttcccttgactatatgtgaggctttgagggagtttaattgtttttttccttgtaggtcttcttgcatgtcaagtgagaaggaaaaagagaaaggtggtggtggtggagtggaaggaggaggacatgggatgatgagagagggttcatgtgggaatactaataatgctgttgggaggtggctggtggctttgcaagatggggatgggaaggggaggggtattgagcttgtgatggaggaggagatggaggtcagtgggagagagaggagtaatagtcagaggaggcatgtgtttgaggacattgatgttgatttggtggtgggagaggaggaacagaagaagcatgaggaggtagtgggtggagaggaggaagagaaagctagagttagcatatgtattcctcccaagaatgctcttttgttgatgagatgcagatctgatccggttaagatggctgctttggctaaccggttttgggaatctcctgttcacaaagacagatgtcaagaagaacaagatgaagaagaacaaaacatcaaaacaaaagaagatgaacaactagaggaagtacaggaagaacaagttgaaagagaagccatagaagatagcatttgtgagagagaaacagaaactgctgttgtggccactgaagatgaagaacaagaagggaaagaaagctatgaaattgaaagcagagaaatcctggaaagcaaagaatttggtgaagtaaaagaggaagaagaaaagggtgatgaagaagaagcagcaaatggaggaaatgccgttggaaaaggtgaaactttaacacacccagaagctcattcagatctagagaaccttagaaccgaagaaaaagaggttgatctccaagagggtaaagaagaagagagagaaaacaacgaaagctcggaactttcttccacctcagaaaccgtcgcagcttcagatcaagaaaacgacggagcagaaccagaaacagacacgaattcggatccggaggaggaagaagagaaagagagcgaaccgaaggaacaacctcagcaaccagacacgaattcggatccggagtcaaaggagcgagaaaacgggtcaaagtgccaagagagagaaagagaagggttgccggagtgcttgctgctgatgatgtgcgagccgaagctgtcgatggaggtgtctaaagaaacgtgggtgtgcagcaccgactttatacggtggctgccggagagacccgccgccggcggcggcagcaagagggtcgccggagaaacgtttacaaagtccaagccgaagccgaagccacctcagccgatgatgcagctgccaaggtcatcgtgctcgttaccggcggcgggaggcagtgccggagtgtcgatggcggcgatgatcgagcagaagctggtggggtccaaatcgggtaacgggtacgagccgtttgtgctcacgcgctgcaagtcggagccgatgcggtcctcggctaagctcgcgccggaggcttgtttctggaacaacaggaagctcgagccgcaccccccggcggctcagcttggagtcggtgcgccggctggtgttgggttctga

SEQ ID NO: 2355 - DNA, 1224 bp, Glycine max var. Williams 82
atgtatataaatgccacaagcttagtggatagaacaacacaaatactcataactcatcagagagaaaagaaccctctccatacccctttcttctgcattaccatattctttgtctctcctcgtacccaagagagagagattaagaaaatgggtgagggtgttgtctcttgtcgtctgcagctgttcttcttccttcttcatgggttgttgttgtcgaaagtgagaggaaagggttcttcttcggctttggattatgcgcagtgcgatgtgttcacgggaacgtgggtggtggacgaatcgtacccgccctatgatcccgccacgtgtcccttcatcgagcgcgagttcaggtgcaaagggaatggacggcccgatctcctttacacccgctataggtggcacccacttgcctgtaatttactcagatttaacgggctagattttctggagaagatgagggggaagagcatcatgttcgtgggagattcactgagcaggaatcaatggcagtccttgacttgcttgcttcattcagcagtgcccaattcaccttatactttggatagagttggagatgtttctattttcacacttacggagtatagggttaaagtgatgcttgataggaacgtgtatctagttgacgttgtcagagaggatataggcagggtcttgaagcttgattcaatacaaggaagcaagctgtggcaagggattgatatgctcatctttaacacatggcactggtggtaccgtagaggacccactcaaccatgggattttgtcgaattgggaggtcatacttataaagacattgatcggatgagggcttttgaaatagcacttaagacgtggggtgcatgggtagacgccaacgtcgaccctacgagagtgaaagtcttctttcaaggaatttccccatctcactacaatggcagcctatggaacgaaccaagtgcaacgagctgcatccggcagaagacaccggtgccgggatcaacctatcccggagggttgccaccggccgtggcggtgttaaagagtgtgctgagcacaatcaggaagccagtcactctgcttgacatcacaaccctctcactgctcagaaaagatggccacccttccatttatggtctcaatggagccgccggaatggactgcagccattggtgtcttcctggtgttccagatacttggaacgagatactttacaaccttatttga

SEQ ID NO: 2356 - DNA, 3364 bp, Glycine max var. Williams 82
tgcccacttactgcgtgcccacattgtctgacttataagccctttgcccctaacccagctggaaattgacaaactaagtcagaagcgtccttagctggcccttttgaacttgctcctgtaattttcactattctattaagtcttcgcatcagatgaacagcccttacttctcgagtttttctatatactacctttgctctgctttgtttgtattcaatttccattaatgtaacaatctcagacacgctggtaattcccatttgcatatataaactaatgaatgtgaaaatgatttccaactcaactgcccaccctgttgaccccttcttgttgccttctgggaggaagtttggctacttactacgatattgattctcaataccaatggttggattccagagtgaccatatgcctgggaacaagtgcaatggtaattctaatagttttccggttccggatcgtcatgaacgacttatgagaggaagagagctaagaaaaagcagcagggcatctcctgatagtaatagtattagtaatgtgggtagtgaaatttttgagcatgacctgcgcttaagagaagataataactctgctgctcccattgttgaacgatacctggaagaagtggcagcagctgcagcagcagcgcggggagaaaggaaagatgggagacctttcagacaacggcttttggtggtggccaacaggctgccagtctcagcaattaggaaaggcgaggattcgtggtctttggagataagtgctggtggcctggtcagcgctctcttaggtgtgaaggagtttgaggcgagatggataggttgggctggtgtcaatgtgcccgatgagattggacaaaaggcacttacaaaagctttggctgaaaagaggtgtatcccagtatttcttgatgaagagattgtgcatcaatattacaatggctattgcaataacattctgtggcccctttttcattaccttggacttccacaagaagaccgccttgctaccacacggagtttccaatctcagtttgaagcttatcagaaagcaaatcaaatgtttgctgatgttgtaaataagcactatgaagagggtgatgttgtttggtgccatgattaccatcttatgtttcttccacaatgcttaaagaattataaccacaaaatgaaagttggctggtttctgcataccccatttccatcttctgaaattcacaggacattgccatctcgctcagaactcttgcatgctgttcttgcagctgatttggttggttttcacacatacgattatgcacggcattttgtcagtgcatgtacacgcattcttggacttgagggcacacctgaaggggttgagaatcaggggaagctgactcgagttgcagcatttccaataggtatagactcagaacgattcatacgtgcacttgaccttcctcaagtcaaggatcacatcaaaaaattacaagagagatttaatggaagaaaggtaatgttaggtgttgatcgccttgatatgattaaaggaatccctcaaaaaattctagcatttgaaaaatttttggaagaaaatcctggttggcatgataaagttgttctgcttcaaattgccgtgccgacaagaacagatgttcctgagtatcaaaagcttactagccaggtccatgaaattgttggtcgcatcaatggcagatttggaacactgactgctgttcccatacatcacctggatcgctctcttgattttcatgcactgtgtgctttgtatgctattaccgatgtagcacttgtcacatctttgagggatggaatgaatcttgtaagttacgaatttgtggcctgtcaagataaaaagaaaggggttctcattctcagtgaatttgctggtgctgcacagtcacttggtgctggggctattcttgttaacccttggaacatcacagaagttgctactgcaatttccaaggctctgaatatgccatcggcagaacgcgagaagagacataagcataactatgaacatgtaaaaactcacactgctcaggaatgggcagaaacttttgtaagtgaactaaatgatactgttgtcgaggcacagataaggacaaatcaagttccaccacggctcccaacagagactgcagttgaatgttatttgcagtcaaataatcggttgcttattttgggtttcaatggaaccttaactgagccaattgagagagaaggtgatcggtttaaagaaagggaactcacagtgcatccagaactgaaacagcccttggccgaactttgcagtgacccaaagaccacagttgttgtgcttagtggaagttgtagaacagttctagatgaaaactttaaagaatatgacatctggctggcagcagagaatgggatgtttctaaacccttcaaagggagaatggatgacaacaatgcctgagcaactgaatatggaatgggttgacagtgtgaagcatgtttttgattacttcacggacagaacacctcgatcgtattttgaagaaagggaagcttcacttgtttggagttacagacatgcagatgttgagttcggaagactgcaagcaagggacatgctgcagcatctctggacaggtccaatttctaatgcatctgttgaagttgttcaagggagccgatctgttgaggtgcgagctgctaatgttacaaagggagcagctattgaccgcattctaggtgagatagtccacagtaaatccatgacaacaccaattgattacgttctgtgtataggacattttctgacaaaggatgaagatatatacgcgttttttgagccagagctaccacgaagcaaggtaacagaaggagtcaagtttcctgttgagagggtatcgtcatcccaaaataagggacaacggcctgtgtcaaactctgagaagaaaacaaataatcatgtctgccgcctgccacggcggccggctcctgaaaagatctcttggaatgtgcttgacctcaagaaggagaattacttctcgtgcgctgttggacgaacacagaccaatgctcggtatacgcttgcttcaccagatgaagttgttgcatttctcaaggaactccatactttgtctcagagctaagattacctgattttgcaccttaggatacttacccagcttcagaattcggtatatactagcaatcatacctcataattcatatgccaacattgcaagttaaagaaagttggtaattttagtcttcacgatatttcttgtacaagatggcgcctcatatagctaaatttgcttttattctaccgggcttattattgtcactatgggtgtaagtgtctcctgtgttgagttgagttaa

SEQ ID NO: 2357 - DNA, 3554 bp, Glycine max var. Williams 82
aagccatcattagtcacaatttcacattttgagtaatttccaggaaattgcaagtcttctgagaaagtccgcgtccaaatagttgataaagaatacccaaccctttgaacatcctaatcctatataatagagccattgagttcagaggcaagttccagttctgaagagaaaatctcccttctttcactagtaaaattttcagatattcaaatagatcccgttgctgcattcagtaatcacaaccacctggaacgccattattcaattcaattggaaataaatcatgggtcgacctagaggtgatgaaaagtactggaatgaagtaacgagttttgaagagaacgggaagcagaagtggaagtgcaagcattgtgaaaaaacgtatggtggaggttattcaagaattaaactgcatttagataaagaacaaaaaggacaaggcattactaaatgccccgtttattgtagcaatgaagaagttctcaacatcattgcttccacttcaatccatccacaagaaactgtaaatacactgaatccattacaagttgaaaaattgaatcttggattttttttaatccatctcgtattgcattgaagtggttgaagatgttgttgctggcgaaatgattgtccctgttggtgctccaattaaccatcaaacaaataatgaatcaacaagtttattcgaaggttgggcaccagagcatgctattgtcggaagcaacaattcgaatggtattttccaaagtaagattagtgtgataaatgagttggtttccgatctatcaagagaggaagatgacatcaaggaacaattagaatggctagaatctcgcggcaagaagcgcaagggtgatgttgatgactggatggatgaactacgagacctgaagaaacatgttgctgatgtggattggttagggttcactaacttttatgcatcggatttggttgataaattgcgaaagcataagattgataagcctctggtgttgtcaaatgaatttgttggtgaacaatttgagttaaatgttggaaagatgtggaagcttctggtggatgaccaagttttcgttattggcataaatggaatggggggagtggggaaaacattcctagcaacttatatggagaatgagataaaaagaaagggaagtttcaggcatgtcttctgggtcactgtttctcatgatttcaccactttcaaattgcaacatcagattgcaaaaaaaataggggtaaaacttgatggagatgatgagagatgtagagcaacaattttgtcatcggagttggagaaaatagaaaattcagtacttattttggatgatgtttggagatatattgatctacaaaaggtgggaattcctcttaaagtaaatggcaaagtaaatggcattaagttgatcatgacaagtcgtttgaaacatgtgtgtcgacagatggattgcctaccagataatacaatacaaatataccctttgaaaaaagaagaagacgaagaagaagattgggagttatttttgctaaaacttggacaccatggaacacccgcaacacttccccctcaagtagtggagattgcaagatctgttgtaaggaagtgtgatggtttaccacttgcaatcaatgtgatggctagaaccatgaaaggttgttatgacactattatgtggaaacatgaattgaataaacttgaaaatttggagatgggagaagaggtgaaggaagaagtcttcacagtactaaaacgtagctatgataatttaattgaaaaggacctgcaaaagtatttgttatattttgcacagataccaaacaattctggtttccagtcaaaaagctacttagttaaaaagcttgttgagagtggtttgttaaaaaatgtaaagaggagtttgagggaagtatttgatgaggcgtgtgccatggcgaataaactcgtagaccattctttgtttgtgggttatgattaccatacaaaaatgcatggtctggtgaggaacatggcatgccgtatcttgaatgagagtaacaattacatggtgaaatgtgaaggaaatttgagtgagatacctgacgtgaaggagtggatagttgatttggaggtagtttcattggggggaaacagaataaaagaaatcccagaaggcatatcacctaattgtccacgcttgtccaccttgattttatctggtaattgtatcggccacattccggagggttttttcatacacatgaatgctctaacagtacttaatatatcatataatgatttcttgacatctttgccgcattcgctgtccaacttgaggtctcttgtttctttagtgctccaaaattgttcaaatttggaatatatacctccattgggagagctacaagcattgtcaagattggacatttcaggttgttcgattcgccaagtaccagaaggcttgaaaaatctaataaacttgaaatggcttgatatgtccataaatgagcatttaacgctggcaccaagatgtgtactgcccggtttgaccaatttgcaatatctggatctccgttgtgattcagctataatagcagaagatgtacaagggatgagtatgcttgaatgttttggaggaatctttctcggcaaagataattacaatagttacgtgcaagaaattctggacagaggtcatggacctaaaacttatgatatccatgtagaagatgttagggatctgatatttgcatttgatattgatgatccagtttctctatacgaagatcatcaaaatgtacggttttggcaatgcgaaggattgctgtatttactacccagagaccttaagaaattgagtatggaacgcaatgatcaatgggtgtgcttatgtggtgctctgtcatcaagtggtcctctttcttctttgaatcaaattgatattattggcggctgtaagctgaagagcttgttctgtttgtctagctcttgttccttatgcactaatatccaaaaccttcaagttttgaatatttatggtttagatagtttcactgcaatctgtgaggaagatgctgttgatttaacacgatctttgtctccaaggggtgtgttctcaaatctcaagaaatttcagctcagccaatgccatgaaatagagacgttgctgacaccattgttagtgccacaacttcaaaacctagaggttttatcggtcgagagctgtaggtccatgagagagatatttgcagtgagtaatagtggcaatgatgataatttcaacattatactccccaaattgatcagattgcggttgtggaatttaccagaattgacgaccgtgtgcagagaaattttagtatgtggatctgcggatatattgttcattaatcattgtcccaaattagaaaggctaccaagaatcgtcgtgtatgattgattgtgttgattctgattttgatattttattatgtctcttagtattcacattcctaattcatgtacatacaaaataaaattctgatttacttgctgaaatacaaaactgatttttactgttgtgagtcctaatcca

SEQ ID NO: 2358 - DNA, 1224 bp, Glycine max var. Williams 82
atggccgacgcactgattaggttgttttcagtagtcttgctttgcattacagcagcacaagggaaagaacagcttcactcaaacagtgaatggccaaaatctttttcagttattcgtgatactgatggtatctgcaaagtggcagagacacaaggttacacatgtgaagaacataaggctacaacagaggatggctacatcctgagtttgcagaggttgcccgcgggacagtctggtaagaaagcccacaagccaccggtgctattacaacatggtctcttttgtgatgccatagtatgggtggtcaatcctccagatgaatcattgggatttatcttggcagacaatggatatgatgtgtggcttgccaatgttcgtggcacaaaatatagccgcgggcacatatcacttcatcctaatgacatggcttattgggattggtcatgggatgaattagctaggtatgatcttcctgcttttgttcagtatgtgtacaatcaaaccggccagcgaatgcactatgcaggtcattccttgggaaccttaatggttttagcggatttgtctcgagggaaactgttggacatgttgagatcagctgcattactttgcccaattgctcacttgaatcatgtcacgtcgccggtggcaagaactgctgctcaatcatttatagctgaccctctatactggttaggcctccgtgaattcattccaaacggggatgctgcaagcaaattagtgggaggcatctgccatattctaaacctgatcaactgctcaaacaacctactgacactaatcacaggtccaaactgctgcctaaattcatctgcattcaatgcctatcttgatcatggattaccgccaacagcaaccaagaacttgatccatctatgtcaaatgattagaacagcaaaaatagcaaagtatgattacggtgaccaaagacaaaatatgcaacactatggacaacgggttcctcctctttatgacatgaccaaaatttcaaatgaatttcctcttttcctcacctatggaagacaagatgcgctatccaatgtaaaggatgtgcaacttttgctcaatgaccttagagatcatgatggaaacaagttagtagtattgtttacggaagattattctcactatgattttattatgggtgtcaatgttaaccaaattatctatgatcctatgatagttttcttcgaggttaattga

SEQ ID NO: 2359 - DNA, 1239 bp, Glycine max var. Williams 82
atgtccactccatattacacacttgttcttcttcttcttcttcttattgtactcatttccccatcctcctcctctcttcatccaacggacctgaatgcccttctctccatcaagaacaccctcaccgaagtctcacccacgaagcccttcttctccacgtggaacctcaccgcaccggatccctgctcctccttctccggcgtcacctgcttcctctcccgcgtctccatcctctccctcggcaccccctcccttccactcgccggcaccctccccgccgagtcaatctcccaactcacagagttgactcagctcatcctctcccccggaatcgtcaccggccccatccctccccaactcgcccgactcaccaagctccgagtcatctcgctcccttccaaccgcttcacgggaaccatcccttccttttcctctctcattaagctccacactctcgacctgagtcacaaccaactcgccgggtcactcccaccgagtctcaccgagttgccccaactcaaagttctcatcctcgcctcaaacactctcacaggcaccttgccaagaaccatcaattcgccgttactccacctagacctaaaaaacaaccaattcacaggaccgttaccaatcgcgcttccgtcatctctccgttatctgtctttttcacagaacctcatgtggggccccctcaccaacggcctagaagcactctctgagttagtcttccttgaccttagtatgaatcatttcagcgggcccatcccggcccaactcttctccttccccgcactctccaacattttcctccaacggaacaatctctctggtgagcttgggcttggacccaggtctggattcgggcccaagcccggatcgatagtcgatctgagccataatgctctgggcggggagctctccacggtgctcgagggagtggagagcctgttcttgaacaacaacaggttcgtggggagtgtgccggaggtgtacattaagagcgtgtgccgcggcagcaccagaacgctgtaccttcagcacaactacctcacggggattccgataagggacggaaccgtggtgcccgatacggcgtcgttgtgcttgtcgtacaactgcatggtgccgccgccgacggtgatgatgacgtgtccggccagcgccggcggggtgtcggcgaggccggaggctcagtgctccgtgtttaaccatcaacggaggttaattggattggagtga

SEQ ID NO: 2360 - DNA, 747 bp, Glycine max var. Williams 82
atgaatagtcctaaaccaacagccccagaatcagatgtcgatctgttagaatttcccttaaacttagaatacttggaggctgaatttttcttgtttgggtctttgggtcatggattggatgtggttgctccaaatttaattgagggaggaccccctcccattggtgtcagattggccagacttggcagccttgtcaggaatattatcttgcagtttggtttccaggaagttggacacttgagggccataaagagcacagtgagagggtttcctaggccattgctggatctaagcacaacatcttttgccaaacttgcatcttatgtgattccctatgttggcctcacgggttatgttggtgctaatccactgttgcaaaatgctacttccaagaagtcttggcaagatgcggttattcgagcattgttgtatgaacatcgaacgttatcggtgcaaccatacaatgtgactgtggcagagtttacagatcgcatatcaatgcttaggaacaacctaggaggttcaggtttgaaagatgagggtcttgtggtgcctagagagcaaggtgctgagggtagagtcaccgacaacattctcgccggcgacaaagattcactgtcatatcccaggactccaaaggaaatattaaggataatatatggaggaggtgatgaacatgttcccggtggcttctatcctaaaggagcaagtggtagaatagttaaatattacttgaaaacaacctaa

SEQ ID NO: 2361 - DNA, 3141 bp, Glycine max var. Williams 82
aactggataatgattttatatattcttgccttacttgtcacttatgcttttggagtatctagaaaatcatgtggaaactgaacaagtcaattgcaaaagaacttttacctacacaacctgtggattttcctattgaaccttggtggggagtttgtctggtgaactttactttggaagaatttaagaaactttcagaagaggaaatggccatgatagataaagtatgtaaggaggaagcaaattcatttatcctgtttgatcctgatgttgtgaagggtctttatagccggggattgatctattttgatgttcctgtatatcctgatgatcggtttaaagtttccaggcttgaaggtttcgtttccaacagggagcagtcttatgaagatcccattgaagagttattatacgcagtttttgttgtttcaaatgaaaatgcatctgttgctgaattggcagcaaccctacaggctgacttgtcacaactgcaggctgctgcatcttttgtatgtcgattgggatgggcgacaaaagtaattgatccagcctctattcttcaagatacaaacatacctggttctccaaaaagtgcagtcaatgatgaagatgcttctattgctagtcatggttttgataatatgcttattgataatgacaacaatcaaagcgatgcctatggtcctcattcttgccatactcgtgttgctttcatagttgatgctaatataacatcatatcttatgatgggttctgtttcaccaggcctgaaatctcatgctgttacactctatgaagcgggtaaattgggtcatgccagtattactgatctttgcaaggatcttagcactctggaaggtgccaaatttgagggagaactgcaggaatttgctaatcatgcatttagcttgcgttgtgtattagaatgtctacaatcaggtggagttgcttctgatgcaaaagtgggtgaagataagatggatttggctactgtaagcaatgatgagtttagttctctaatatccgaaatctctctgactgaaaaatcaggagaatctggtattacagaagctgggatgaatagctatgatatattaagttcagatttagagaagtcagtagaggctcctgcttccactgaatctgctcctagtaatatggttggtggaacccgttctattcctttggaaggtgatgatagtcatgtacaggaagccaatgaagatgggaatctccagaatgatgagaaactaatggttgaagagtcggatgttggaactgaaatgttaaaaagaaaaaagaaatatcgtgtaaacattctccgctgtgaaagcttagcttctcttgcaccagcaactgttgatcgattgtttgttcgtgattatgatgtagttgtgtccattgtgcctcttcctcattcatcagttcttcctggatccacaggtctggttcattttggtcccccctcctattcttttatgactccttggatgaaattggtattatattcaactgtagctagtgggcctctatcagttgttctgatgaaaggacagtgtctgcgcttgcttcctgctccattggctggttgtgagaaagctctcatatggtcctgggatggttccgcagtaggagggttgggagggaagcatgaaggaaatttagtaaagggaagtatactcctgcattgtttaaattcacttcttaagcattcagctgtgctggtgcagcccctaagtaggtttgaccttgatgaatctggaaaggtgattacaatggatatccctttgcccttaaagaattctgatggatcaaatacctatgttggaaaagacttaggattatgtgaaggggaaagttcaaaactgaattctctcctgactgatttggcaaacaagatggaactgtggacggttgggtatattcgcctactgaaattatataatggacgagaatcaaaccagttctcacctgaagaagagaagtatgaatgggttccgttgagtgttgaatttgggatgccactattcagtccaaagttgtgtaatgatatatgtcaaagggttgtttcatctgaattacttcaatctggctcatttgaaaaacaccatcatgcaatgcaaagtttaaggaaaaacttgcgtgacatttgtgctgagtaccaagcaacaggtcctgctgcaaagattctttaccagaaggagaaagctaaggaatcctctcgacaacttatgagttatgcaagtggaaggtggaatccgctcatggatccttcttctccaatttcaggggcctcaagtgaacatcaaaggttaaaacttgccaatcgaaaacactgccgaactgaagttttaagctttgatggcagcattcttagatcttatgctttaactcctgtttacgaagctgctacaaggcccattgaagaagctactcaagccaactcagtaaaagctgaaacagatgagagtgatagtaaagaagtaatccttcctggagtggatcttatttatgacggttctgagttgcatccatttgatataggtgcctgcctccaggcacggcaacctatttccttaatagcagaggcagcagctgcctcagcatctttagcaatcaaatagttctacagttaatgtagattacactacttcgaagtgcatgaatggtaatgctagcgagtgatgtgccaatgttattgctactgtttggtttgttaccatcttcgagatttttcgttgcccttattgttgggctctgaaggtaagtttcacatttttcctgttgtaacgctgttttagttgttaaaaactactttcaatgctcaaccttgtcgtagtaccagcagcagccttaagtctttgaaacgaggatgtattaaaatgatgccccaacagatttgcggaaatcaagaaattcacgtcagttagagccaaggacagaagaactgtgtaatcattgttaatcaagtccatagatgtacaacaagattctttttacatgcttgcggcaaaacggacattgagccaccctaattcatattggagaaaaataggcagaatgacatatttgatcattattttatttttttggtttcctttgattctttatcttttaaaaaattcagtttggtctttaatcttt

SEQ ID NO: 2362 - DNA, 1736 bp, Glycine max var. Williams 82
aacaagatgaagaaactttctctgcatgcttgttttctcaatttgagcctcttggttcttcttccctatagcaaagccagccaggctgacaaacttgaagagttgattctatctaggagttcacagaagcctccagtgaccctttcttgggcagaggaagatgcattgaaaactcattcttctgcttatgttgcatcccaagaggggcaaaagcaagctgacaagattgcggcattgcctggccaaccctatggggtgaattttgaccaatattccggctatgtcactgttgatccaaaggctggaagagcacttttctattattttgtggaatctccatacaacccttcaactaaacctttagttttgtggctaaatggaggacctggttgttcctcattggggtatggtgcctttgaggaattgggacctttcagaataaactccgatggcaaaacactatatcgcaacaaatatgcttggaatgaagtggcaaatgtgctgttcttggaatcccctgctggggtgggcttttcctactcaaacactacttctgactatgatcattcaggagataagcctactgcaaaagatgcatatgttttcctgatcaattggttagagaggtttccagagtacaaaacccgcaatttttacataactggagaaagctatgccggacattatgtgcctcagcttgcatacactattttggtgaacaataaattcagtcaacaaaatattaacctcaaaggcattgctatagggaacgcttggattgatgatgttacaggtacaaaggggatagttgattacttatggactcatgctttgaactcggatcaaacacatgagttgattgagaagtactgcgattacagttctgaaaacatttcgcaaatatgttccaatgcaacaagaagggcattaactgaaaaaggaaacatagacttttataacatctatgctccactgtgtcatgactcttctctcaaaaatgaatcatcatctggttctgtatatgattttgacccgtgttctgattactacggggaagcctatctaaataggccagaggtccaactagctcttcatgcaaaacccacaaactggtcccattgcagtgatttaatagactggaacgacagcccaactaccatcctacctgtcatcaagtatctcaccgacagtaacattgtattgtggatatacagtggtgatacggatgcaagggtgccagttacatcttccagatatgcaatcaacaccctcaagctacctatccaggttccttggcgtccatggtattctggaaatgaggttggaggatatgtggtgaaatacaaaggagtgacatttgttacagtaagaggagcaggacatctggttcctagctggcaaccagcacgggctttgaccttgatcttctcattcctctacggaagcctgcctcctgcttcaccatggaagggttactaagcatgatccatgagctcaacttttacaattcacacacttaagatgccctttgtgcaaactctgttagattataatgaaattttcagtttagaataaatgttttgttatgcatcagttgatagacatgccatgtaactttgttgtgtacatggcataaatgctctcgcttgttatgttagtgttccatgtttgctttttgatgtatcagtttatcaaacggctccctctttggctatatgattggaaactagaaatta

SEQ ID NO: 2363 - DNA, 2757 bp, Glycine max var. Williams 82
atgatgacgttaaagaattcacatgttcaccaaataagcgtcctcaatagtgcatcatctttccctctatatatatgtgggaaagatactcgcaatagccatagaattagttggtttttaaatcactctaaactctctttgcctagtacttggagagagagtaagtttcacatagggcgtgtgtctcgtggcatgaaagttgtgatggcaaccacaaccaaaaacgccaacaccatcaccacatctcaaagtgtgaaggcccttgtgactgtgaagcaaagtgggggtgggattataagaaatcttgtcaatggaggtcttgatgggatcagagaattggttgggaaaactcttgttttggagcttgtgagcgatgagattgattcaaaatcgaactcggagagaaagacaaagaaaagtaatgtgcacaaaacagagacaaaggaggatgaagttctatatgaggccacatttgacttaccagaagctttcgggaatgtgggtgctgttttagtacagaatgaggaccacaatgaggtgtttctaaagagcatagtccttgatggcttccctaatggtcctctgcactttacctgcgattcatggattcagccaaagagtgatagtcctgtgaagagagtcttcttttctgacaagtcatacttgccatcacaaacaccaagtggattgagaaagttgagggaagaggaattgaagcaaaaaagaggaaatggagaaggagaacgcaaaagcactgataggatatacgactatgatgtatacaatgatcttggtgatcctgatagcaacattgacctcaaaaggcctgttcttggcggcaccagacaatatccatatccaagacggtgtcgtactggtcgaaaacactcagaagcagacccttcttctgagaagaaagcatcgaatttctatgttcctcgcgatgagattttttctgagataaagcaaacacagttcacaacaactacaatatcctcagcagtaagtttagttttggaatctttagatgcaattctcactgaccaaagccttggatttgtgagcttcgaagacatagacacgctctataaagaaggatttcacgtgccagcgcttcaagccaatgggaatgcacttcaaagagtaattcccaagttactcagtgttgttaatgataaacagaaccttttgcgtttcgatactccggatgcatttaagagggacagattcttttggttgtcagatgagcaatttgctagggaaactttggcaggtgtcaacccatatagcatccaattggtcaaggaatggcccttgagaagtaaattagatccccaaatctatggtccacccgaatcagctatcactaaagaagtcattgaaccacaaataattggctattgcacagttgaagaggccattaaggagaagaagttgtttatgttagactaccatgatttattcttaccatatgtaagaaaagtgagagaaatcaagggaaccacattatatggatcacgaactctattctttctaactgaacaaagcacattaaaaccattagctattgagctcacaagaccagatatggaaggtaagccacaatggaagcaagtcttcacacctgctactcattcaagttctcatgcaaccaaactctggctttggaggcttgccaaagctcatgttcttgctcatgattctggttatcatgaactagtaagccattggttaaggactcattgtgcagtagaacccttcatcattgcaacaaatagacaactaagcaccatgcaccctatctatagattactgcatccacatatgagatataccatggagatcaattcactagcccgcgaggtgcttatcagtgcaaatggggtcattgaaagttcgttctctcctagaaaatattcaatggaaataagctctgtggcatacgatcaactctggcaatttgatttgcaagcactccccaatgatcttatttttagaggaatggctgtggcggatccaaatgcaccacatggcctaaagctaacaattgaagattaccctttcgccaatgatggtctccttatatgggatgccatcaaagaatgggtatctgagtatgttaaccattactatccaagctcaagcacaatagagtttgaccaagagctccaagcatggtggacagaaattagaacagttggtcatggagacaaatctgaagaaccatggtggccaaatcttaaaacaccaaaggaccttattgaaatcattacaactatagcatgggtatcatctgctcatcatgcagctgttaactttgcccaatatacttatggaggctatttccctaataggccaacaattgttagaaataacattcctacagaggacccctcgaaggaagagttggaaaaactcataaacaacccggagaaaacatttttggagtctttaccatcacaaattcaagcaactttggtgatggtagttttgaatttattatcgaatcattcgccagatgaagagtacattgggcaatatgtggaacaatcgtgggttgagaatcaaactataaaggcagcctttgaaaggtttagtacgaaattgaaggagattgaaggtattatagactcaaggaatgcaaattgtgatttgaaaaataggaatggagctggggtggtgccttatgaactaatgaagccattctcagggcctggagtcactggaaagggtgttccatatagcatatctatttaa

SEQ ID NO: 2364 - DNA, 807 bp, Glycine max var. Williams 82
atggccgcagcaacacaactccacttaccccctggattccgattccaccccaccgatgaagaactcgtcgttcactatctctgccgcaaatgcgcttcgcaagaaatcgcagttccaataatcgccgaaatcgatctctacaagtacgacccatgggaccttccaggaatggctttgtacggagagaaagagtggtattttttcacgccgagggaccgcaagtacccgaacggttcgcggccgaaccggtccgcggggaccggatactggaaggcaaccggagcggataaaccggttggcaaaccgaaacctgttgggatcaagaaagcattggttttttacgccggaaaagcgcccaagggagtgaaaactaactggatcatgcacgagtatcgtctcgccgacgtggatcgttcggttcgcaaaaagaacagcttaaggctggatgactgggtgctgtgtcgaatttacaacaagaaaggtgcaattgagaagcagcaaccagcaccgccaccaccgagtggtgtccacaaaattgaatgttacgaaatggaagacgtgaagccggagtatacggcggcggattgcctgtacttcgaggcttccgactcggtgccgcggctgcacacgacggagtcgagctgttcggagcaggtggtgtcggcggagtttgcgagcgaggtgcagagcgagcggaagaggcagggcaacagcgagttttcgtataattacatggatgccactctcgggaataatcagatgtcgccgctccaggatatcttcatgtacctctccaggcccttctga

SEQ ID NO: 2365 - DNA, 1854 bp, Glycine max var. Williams 82
atggaaaacaacgtcacaatattactctttcttcccctcttcaccattctcacaaccgttgcagcttctaattcctcctcctcatcatgccccatcaacttcacctacgttgaaaccttcccatggaacacttcatcttgcacaaacccaatcaacaaacaaccttgttgcatagcattaaacaccatcttccacataggcctcacccaacacctcaaagaaacctcattgtttcaacttcccaatgaaaacacttcctcaacttgcttatcagatttccaaaccaagctaaaagccttgtcaatagacctttctttggtccctttttgcttccctaacccctcacaatttgttaccaactcttccacatgtgcaggtattataaccacacaagattgggaacaaaaagtggactcggttaggcttggtccattatactcttactgcaaagaaagccttgatgacgaaactcggtgtcaaaattgcattgcatcaagttttaaagtggcttttcagcttactagtactaaccaaaatgctagtgtcaaagaatgtttttcctttgcatcactatatgctgcagcagttgttaatccacaaggtgcaagtgatgcaaccacgattggttgcatattgagggtgccactgaatggtgaagtaacaacaaaagggtcatcaaagaagagaagaaaagttgtgaagctggtttttgcggtattgggtggcatggttggtgttgttgtcattgcttttgtggtgatggttgtgtacaggaagtgggataggagaaggaaggaaagggtttattatcatagggaaattgaaaacggtgtgaggaacagtgttttgcctaacactggtgcaaaatggtttcacatatcggagcttgaacgtgccactgatagattttcaaggaggaacatgcttggccaaggtggtgatggggttgtgtacaaagggaagctttcagatggcactttggttgcaattaaggagaattttaatttggagagtaaaggggatgaagagttctgctatgaagtggagatcataagcaagataaagcataggaaccttcttgctctcaagggttgttgcattgcaagtgatgatttgaaaggtaagaggaggtttttggtttatgatttcatgcctaatggaagcttatgttaccaattatctcttaatgtggccaataggttaacatggccacaaagaaagaacataatcattgatgtggcaaaagggcttgcttatttgcactatgaaatcaagcctcctatttatcatcgtgacattaaggctaccaacattcttttggactccaaaatgagtgctaaattatcagattttgggttggcaaaagaaggtagtgaggaggaacaatctcatgtaactacaaaagttgctggcacatatggttatgtggcaccagaatatgctctatatggacaactaactgagaaaagtgatgtgtatagttttggtattgtgattcttgaaatcatgagtggtagaaaagtgcttgataatttgaattcatcagcggatgccatcactgattgggtgtggacacttgtggaatcaggaaagatggtggaagtttttgatgagtcaataagagaagggccagaaaaagttatggaaaggtttgttcatgttggaatgctgtgtgctcatgctgtggtggctttaaggcctactattgctgaggctcttaagatgttagagggtgacactgatgttcccaaattaccagataggccggtgcctttgggtcatgcttcttttcaatcttctctgttgcatggtttgcaaggaagtggaagatctaaggcacatgtttcatcttaa

SEQ ID NO: 2366 - DNA, 1842 bp, Glycine max var. Williams 82
atggataagcaaattttgtttcttcttccccttctcatcatgtccctcttcactgtttcaatagccgctgaatcttccagctcatgccccatggatctcaactatgttgagacctttccatgggactcttcatcctgcagagaccctgttgacaagaaccactgctgccaagtcttgctaagtgtaattggcataggactttcccaacatctcaaacaaacttccttgtttcaacttcccaatgaaaccatttcctccaattgcttatccaatttccaagccaaactcacagccttgtcaattgacccatctttggtcaattcttgttttcccaactcctcccagtttgtcactaattcctccacttgtgcaggtattataaccattgatgattggaagcaaaaagtggggttgattagccccttagacacttcttgcaatggggacctgagtgatcaaactcgttgtagcatatgctctgatgctggcctcaaagtgacatcagggctcaacagtaactccacaagatgtttctacttcacaattctgtatgctgcagctattgttaaccagtttggtccaacaaatttaggcacggcaagttgcatactaggcatgccactttctgtaaaagggtcatcaaatagaggactagtgttgaagcttgttattgggctattgggtgcttttgttggtgttctgcttgcttttgtgttgattgttgtctatagaaagtgggataagagaaggaaggaagatatgcatcacagggaaattgaaagcggtgtgaggaacagtgttttgcctaacactggtgccaaatggtttcacatatcggagcttgagcgagccacaagtaaattttctcagaggaacatgctaggccaaggtggtgatggtgttgtgtacaaagggactctttcggatggcaccgtggtcgcggttaaggagatttttggtttggagactaaaggggatgaagatttcacctatgaggtggagatcataagcaagataaagcacaggaatcttcttgctcttcgcggttgttgcatttcaagtgataatgtgaagggtaagaggaggtttttggtttatgacttcatgcctaatggaagcctcagtcaccaattgtcaattgctggtgctaataggctaacatggccacaaagaaagaacataatccttgatgtggctaagggtcttgcttatttgcattatgaaatcaaacccccaatttatcaccgtgacattaaggctaccaacatacttttggattccaaaatgaaagccaaagtttctgattttggtttggccaagcaaggtaatgagggacaatctcatctcaccacaagggttgctggcacatatggttatttggcaccagagtatgctctatatggccaactaactgaaaaaagtgatgtgtatagtttcggcattgtgattcttgagatcatgagtgggagaaaagtgcttgacacaatgaattcatcggttgttttgatcacggattgggcatggacacttgcaaaatcagggaacatggaagatatttttgaccaatcaataagagaagaaggaccagagaaggtcatggaaaggtttgttcttgtggggatactttgtgctcatgcaatggtggcattaaggcctaccattgctgaagcacttaaaatgttagagggtgatattgacattcctcaattgcctgataggccagtgccacttggtcatgagtcttttccatcttctttgttgcaaggtttacaaagtggaagatcaacggcatatttttcatcatatctttcatctttttcaacaaggatgagcacagtatag

SEQ ID NO: 2367 - DNA, 2028 bp, Glycine max var. Williams 82
atgtggagacagagagctttattggtgttcgtgttattactagtccagcaaatttgtgctaccagtgagcaagagcatgcttgccccccttcttcctgtggcaaaatcacccacataacttatccatttcgattaacaggcgacccaaaaggttgcggtgacaaatggtatgagctagcttgtgaaaataatgttacggtgttatatttgtactctggaaaatatcatgtgcaggctatcaactacaacaatttcacaatccgtgtggtggatccgggtgttcaacagccaaattgctcctcccttcctcgccacttcttgtctccagccaattttagtgaaattggttgttcaactgaagtgaattcatcccatctatttagaaatcgagattcttgggagcgcgctttccagcatatagttttcttaaattgtaggcatgcagtgattgacaatgagaagtatgtggaaactgatccttgcatcaagtggcacttctccaaagggtacatatacgctattgctggtgacttaatagcaaaggactttgaagttggttgtgaggtaaagctggttgctcccacatcatggtggggtttggatacaaataattcttcatacactcagatgcacagagcgcttctctatggatttgagctttcatggatcaatctcgcctgtgacgatcagtgtggaaattccaactgcgcatttcacgcttccagtcacatgcttcaatgcacccaaaatatgaatgaaactattttggctgtcaaaataggattgtttggagttataagagacccaaaatttagacttggtcattatgatgagtatggatataactcatttgtatttattacctttggacactactttctaccattcttggcaggcaagtttttgtttgggatgacattgtttattgtgcttttgatatacaaatggagaaaaaggcatttgtcaatatatgaaaatattgaaaattatctggaacaaaataacctgatgcctattggatactcatacaaagaaattaagaagatggctagaggtttcaaggagaaattgggtggaggaggctatggcattgtattcaagggaaagttgcatagtgggccttctgtggcaattaaaatgctacataaagcaaaaggtagcggccaagactttattagtgaaattgcaacaattggaagaatacatcatcaaaatgtagtacaactaattggatattgtgttgaaggctcaaaacgtgcccttgtttatgaattcatgcccaatggatctcttgacaaatttatttttcccaaagatggaaatatacatttaacatatgacgaaatatataatatagcaattggagtagctcgtgggattgcttatctccatcatgggtgtgagatgaaaattttgcattttgatatcaaaccccataacatccttcttgatgaaacattcaccccaaaggtctctgactttggattggcaaaactatatccaatagataatagcattgtgactaggacagaggcaagagggacaattggatatatggctccagaattattttatggaaatattggaggaatatcccacaaggctgatgtttatagctttgggatgcttttgatagatatgacaaataagaggaagaacccaaatccccatgcagatgatcattcaagtcaactttactttcctacttggatttataatcaacttggaaaagagacagatatagaaatggaaggtgtcacagaggaggaaaagaagatgatcattgtttcactttggtgtatacagttgaaaccaagcgatcgcccctcaatgaacaaagtagtggaaatgcttgaaggagatattgaaagcctggaaatacctccaaagccttctctatatccacatgatacaatggaaaatgatcaaagcatctactctagtcaaacaatgtcaacggacttcattagttcttctagttattccaaggaaattgtgactaatcctttggtagaggatgttatttga

SEQ ID NO: 2368 - DNA, 2097 bp, Glycine max var. Williams 82
atgtggagacagagagctttattggtgttcctgttattactagtccaccaaatttgtgcaaccaatgagcaagagcatgcttgccccccttcttcctgtggcaaaatcaccaacataacttatccatttcgattaaaaggcgacccagaagtttgcggggtcaacaggtattggctagcttgtgaaaacaatgttacggtgttatatttgtactctggaaaatatcatgtgcaggctatcaactacaacaatttcacaatccgtgtggtggatccgggtgttcaacagccatattgctcctccattcctcgctacttcttgtctccaaccaatttcagtgcaattgatgaagggtatccatacctagccttacaaaatcgagattattcttgggagcacgttttccagcatatagttttcttaaattgtaggcatgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcatggcggggtttggatacaaataattcttcatacactcagatgcacagagcgcttctctatggatttgagctttcatggatcaatttcgcctgtggcgatcagtgtggatatttttattccgactgcgcatttgacgcttccattcagaagcttcaatgcccctgccgcaatttcctggggggacagctgttccagcttcaatgtgctaaagggacatggtccaggctgctaacatctgcagaagaagcttttaatgctgtcataaaaggattgtttgaaactataaatgggccaaacccagaacttgaacgtgaaatcggtgcctatgactcaatatttattgcctttggacactacattctaccatacttggcaggcaagtttttgtttgggatgacattttttattgtgcttttgatatacaaatggagaaaaaggcatttgtcaacatatgaaaatattgaaaattatctagaacaaaataacttgatgcctattggatactcatacaaagaaattaagaagatggctagaggtttcaaagacaaattgggtgaaggaggctatggctttgtattcaagggaaagttgcgtagtgggccttctgtggcaattaaaatgctacataaatcaaaaggtaacggccaagactttattagtgaaattgcaacaattggaagaatacatcatcaaaatgtagtacaattaattggatattgtgttgaaggctcaaaacgtgcccttgtttatgaattcatgcccaatggatctcttgacaaatttatttttaccaaagatggaaatatacatttaacatatgacaaaatatataatatagcaattggagtagctcgtgggattgcttatctccatcatgggtgcgagatgcaaattttgcattttgatatcaaaccccataacatccttcttgatgaaacattcaccccaaaggtctctgactttggattggcaaaactatatccaatagataatagcattgtgactatgacagcggcaagagggacaattgggtatatggctccagaattattttataaaaatattggaggaatatcccacaaggctgatgtttatagctttggaatgcttttgatggagatggcaagtaagaggaagaacctaaatccccatgcagatcattcaagtcaactttactttcccttttggatttataatcaacttggaaaagagacagatatagaaatggaaggtgtcacagaggaggaaaataaaatagcaaaaaagatgatcattgtttcactttggtgtatacagttgaaaccaagcgatcgtccctcaatgaacaaagtagtggaaatgcttgaaggagacattgaaagcctggaaatacctccaaagccttctctatatccacatgagacaatggaaaatgatcaaagcatctactctagtcaaacaatgtcaatggacttcattagttcttctagttattccaaggaaattgtgactaatcctttggtagaggatgctatttga

SEQ ID NO: 2369 - DNA, 1848 bp, Glycine max var. Williams 82
atgctccaagggaattccatattgatcacactgttactaatgctacttcttatcagaaatggcaactgtcagaacaagtgcaataaggaattgtcttgtgggcctgacgaaccccttattagattccccttccaactggtgaaggggatgaaagatgaatgtgctaatcccgggttttgtttatattgtactcaaaaaaatgaaaccatggttgtgctctctacaatagaattccatgtccttttcataaactacaaacgtaactactttaggttgagggacccagaaaattgtcttccgaacaagtttctacaaatcaacaatttttttcttcagcacaaccaacttgaactaggatttcctggacatgaaggaacaaacaacttgagcttctttaactgttcttcagttgggcatagatacctcacaagatgggtttgttatagtgaatacgttgttggtcaacaagatatgatctcctgtccgattcacgtgtctagatattacgacagtgtcctcgaatgggatctaacatcctgtaccaagatgttcgacaccatttcgccagttgaggcatacgacctgcagtcgaattctttgaatatgagatggtccataccaaattgtactaagtgcgaagcaaaaggcaagagatgtaaatggaagaacaacaacacagaaggagacattgaatgttttgactgcaaaccgaaaagaatccatgttccccaatcttttattttcgctactacaggctcaatttttttggggctggtggtcattgttgtctttaagatagccctctattttagacagaaagaagacgaccaagcaagagtggccaagtttttagaggattacagggcagaaaagcctgcaagatttacctatgctgatttgaaaagaatcactggtggctttaaagaaaagttaggggaaggagctcatggagctgtattcagaggaaaactttcaaatgagattctagtggctgtgaagatcctcaataataaagagggagaagggaaggagttcattaatgaagtgggaatcatgggaaaaattcatcacatcaacgtggttcgtttgcttggcttctgtgcagaaggatttcatcgtgctcttgtctacaatttgtttccaaacggatccttacaacgatttatagttccaccggacaacaaggaccatttccttggctgggagaagctgcaaaagattgctcttggtatagctaaagggattgagtatcttcatcaaggttgtaatcaacccattattcattttgacatcaatcctcacaatgtgctacttgatgacaacttcactccaaaaatttctgattttggcttagccaaattgtgttccaagaatcctagtttggtgtccatgacagctgcaagaggaaccgtgggatacattgcacctgaagttttctccagaaactttgggaatgtgtcttataagtctgatatttacagttatggaatgttattgttagaaatggttggaggaagaaagaatgtagacatgtcttctgcccaagatttccatgttttgtatccggattggatccataacctgattgatggagatgtacatatccatgttgaggatgaagttgatattaaaattgcaaagaaattagcaattgttggactttggtgcattcagtggcagccagtcaatcgtccatctataaaatctgtcatacaaatgttagaaactggagaggaaaaccagttaaatgtgcctcctaatccattcaactcaaccacttcaactattactagtggacacactagagttacaagacgacctttggagttagaagttattcaagaatga

SEQ ID NO: 2370 - DNA, 2124 bp, Glycine max var. Williams 82
atgtggagacagagagctttattggtgttcctgttattactagtccaccaaatttgtgctaccagtgagcaagagcatgcttgccccccttcttcctgtggcaaaatcacccacataacttatccatttcgattaaaaagcgacccaaaaggttgcggcaacaggtatgagctagcttgtgaaaacaatgttacggtgttatatttgtactctggaaaatatcatgtgcaggctatcaactacaacaatttcacaatccgagtggtggatccgggtgttcaacagccaaattgctcctcccttcctcgctacttcttgtctccaaccaatttcagtgatgtttatagtttcttcgataatgaggtggatccatacctagcctttcaaaatcgagattattcttgggagcacgttttccagcatatagttttcttaaattgtaggcacgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcatggtggggtttggatacaaataattcttcatacactcagatgcacagagcgcttctctatggatttgagctttcatggatgaatctcgcctgtgaccatcattgtggatattccacctgcgcacttgacacttccagtcagatgcttcaatgctcccgtggcaatttcctgggaagggagtaccctcctaagtaccctcctgagtaccccactgaacgagggaaattgtccaagctgctatcatatgcagaaggagctgtttttgctgtcaaaataggattgtttaaagctataagacacccagaatttgaaagtcgtcattattctgcgtatgcatatcactcaataatatttattacctttggacactacattctaccatacttggtaggcaagtttttgtttgggatgacattgtttattgtgcttttgatatacaaatggagaaaaaggcatttgtcaatatatgaaaatattgaaaattatctggaacaaaataacttgatgcctattggatactcatacaaagaaattaagaagatggctagaggtttcaaagagaaattgggtgaaggagactatggctttgtattcaagggaaagttgcgtagcgggccttttgtggcaattaaaatgctacataaagcaaaaggtaatggccaagactttattagtgaaattgcaacaattggaagaatacatcatcaaaatgtagtacaactaattggatattgtgctgaaggctcaaatcgtgcccttgtttatgaattcatgcccaatggatctcttgacaaatttatttttaccaaagatggaagtatacatttaacatatgacgaaatatttaatatagcaattggagtagctcgtgggattgcttatctccatcatgggtgcgagatgcaaattttgcattttgatatcaaaccccataacatccttcttgatgaaacattcaccccaaaggtctctgactttggattggcaaaactatatccaatagataatagcattgtgactatgacagcggcaagagggataattgggtatatggctccaaaattattttataaaaatattggaggaatatcccacaaggctgatgtttatagctttggaatgcttttgatggagatggcaagtaagaggaagaacctaaatccccatgcggatcattcaagtcaactttactttcccttttggatttataatcaacttggaaaagagacaaatataggaatggaaggtgtcacagaggaggaaaataaaatagcaaaaaagatgataattgtttcactttggtgtatacagttgaaaccaaccgatcgcctctcaatgaataaagtagtggaaatgcttgaaggagacattgaaagcctggaaatacctccaaagccttctttgtatccacatgagacaatggaaaatgatcaaagcatctactctagtcaaacaatgtcaacagacttcattagttcttctaattattccaaggaaattttgactaatcctttggtagaggatgctatttga

SEQ ID NO: 2371 - DNA, 2076 bp, Glycine max var. Williams 82
atgtggagacagagcgctttattggtgttcgtgttattactagtccagcaaatttgtgctaccagtgagcaagagcatgcttgccccccttcttcctgtggcaaaatcacccacataacttatccatttcgattaacaggcgacccaaaaggttgcggtgacaaatggtatgagctagcttgtgaaaataatgttacggtgttatatttgtactctggaaaatatcatgtgcaggctatcaactacaacaatttcacaatccgtgtggtggatccgggtgttcaacagccatattgctcctccattcctcgctacttcttgtctcaatcaaatttcagtgcaattgatgaaggggatccatacctagcctttcaaaatcgagattattcttgggagtacgttttccagcatatagttttcttaaattgtaggcatgcagtgattgacaatgagaagtatgtggaaactgatccttgcatcaagtggcactccaaagggtacatatacgctattgctggtgacttaatagcaaaggactttgaagttggttgtgaggtaaagctggttgctcccacatcattgtggggtttggatacatacactcagatgcacagagcgcttatctatggatttgagctttcatggatgaatctcgcctgtgaggattattgtggaaatccctcctgcacatttaactcttccagtcagatgcttgaatgctcctccctccgcgtctgccgcaatttcgtggtgggatggcagtaccttactcaatgtgggatatggtccaagctgcaatcatatgcagtagaagccggtactaatgtcttaagaggattgtttgaaattataagaggaccaaacccagaacttgaacataaattagatgcgtatgtctcactatttgttatctttggacactacattctaccattcttggcaagcaagtttttgtttgggatgacattgtttattgtgcttttgatatacaaatggagaaaaaggcatttgtcaatatatgaaaatattgaaaattatctggaacaaaataacctgatgcctattggatactcatacaaagaaattaagaagatggctagaggtttcaaggagaaattgggtggaggaggctatggctttgtattcaagggaaagttgcgtagtgggccttctgtggcaattaaaatgctacataaagcaaaaggtaatggccaagactttattagtgaaattgcaacaattggaagaatacatcatcaaaatgtagtacaactaattggatattgtgttgaaggctcaaaacgtgcccttgtttatgaattcatgcccaatggatctcttgacaaatttatttttcccaaagatggaaatatacatttaacatatgacgaaatatataatatagcaattggagtagctcgtgggattgcttatctccatcatgggtgcgagatgaaaatattgcattttgatatcaaaccccataacatccttcttgatgaaacattcaccccaaaggtctctgactttggattggcaaaactatatccaatagataatagcattgtgactaggacagaggcaagagggacaattggatatatggctccagaattattttatggaaatattggaggaatatcccacaaggctgatgtttatagctttgggatgcttttgatagatatgacaaataagaggaagaacccaaatccccatgcagatgatcattcaagtcaactttactttcctacttggatttataatcaacttgaaaaagagacagatatagaaatggaaggtgtcacagaggaggaaaagaagatgatcattgtttcactttggtgtatacagttgaaaccaagcgatcgcccctcaatgaacaaagtagtggaaatgcttgaaggagatattgaaagcctagaaatacctccaaagccttctctatatccacatgatacaatggaaaatgatcaaagcatctactctagtcaaacaatgtcaacggacttcattagttcttctagttattccaaggaaattgtgactaatcctttggtagaggatgttatttga

SEQ ID NO: 2372 - DNA, 948 bp, Glycine max var. Williams 82
atgttccccggaccccttataaatgcaacaacaaatgataatattcatgtcaatgttttcaatgatttagatgatcccttgctgtttacatgttttaggagtagcactaaacttacactctatagacatggcaagacatatttgcttaggatatcaaacgtagggacagcatggagcttcaatttcaggattcaaaatcatcaattggttttggttgaaactaaaggttcttatgtcaatcaaatagagttggagtctcttgatgttcatgtaggccaatcctactcagttcttgtcacagcaaaccaaaatgctgctgattactacatagtagcctctcctaaactgagtaatgccacaaataataacactcttgttggtgttgctgtgcttcattatgacaactctaccacaccggctaatgggtctcttccaagtggtccagatccatttgatctgcaattctccatcaaccaagcaaaatccattaggtggaacctcaccactggagctgcaaggcctaatccccagggaatgttccatgtaacaaatgtgacaataattgaaactttcattctaaatgcatcaacaacaactattgatgggttatctcgctactctgtcaacaatgtgtctttcttgatcctagatacaccactgaaactagctgatttcttttccaatagaactggtgtatatgaacttgatgctttttctaagaacacttcaaatgctaacgccgtgcgtggagttttcgtagctagtgcattacataaaggttggactgagatagtgctagaaaacaatttagacatcattgatacttggcatttggatgtatatagcttctttgttgttgggtataatctctatgtgagggtttatgatgttgatcccaaccctgccaaggagaagcctcctccacagaatctccttctatgtggttag

SEQ ID NO: 2373 - DNA, 300 bp, Glycine max var. Williams 82
atgggggccaacgtcactgtgaattgtgttcatcctgggatcgttagaaccagactcactagagagcgtgagggcttactcacagatttggtgttctttttggcttccaagctcttgaagaccattcctcaggcagctgctacgacatgttatgtggccactcatccaaggcttttcaatgtctccgacaagtactttgctgactgtaacgaaatttcaacctcaaaattgggatctaactcaactgaagctgcaaggttatgggctgcaagtctaaaatataattgctttagatgctag

SEQ ID NO: 2374 - DNA, 1140 bp, Glycine max var. Williams 82
atgtctacagctggtcaggtcatcaagtgcagagctgcggtggcatgggaagcagggaagccactatcgatagaaaccatagaagtggcaccaccccagaaaggtgaagtgcgtttgaagatcctcttcaactccctttgccgtacagatgtttactggtgggatgctaagggccagactccgctgtttcctcgtatcttaggccacgaagcttcggggattgtggagagcgtgggcaagggtgtgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtcgccaagatcaaccctgctgcccctcttgacaaagttgctgttgtcagttgtggattctgcacaggttttggggctactgtgaatgttgcaaagccaaagcctaataatactgttgctgtatttggattaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagagtaa

SEQ ID NO: 2375 - DNA, 1128 bp, Glycine max var. Williams 82
atggttggcaaggagagtttgagaactcatgaggtcttgaactttagctttgagaagcttatgatggttgactgtggtggaaatagtgggaaaggagtgaactttaaagcgggggtgatcacagaatggaaggatattccagttgagcttttgatgcagattttgtcacttgtggatgatcaaacggttatgatagcttctgaagtttgtcgtgggtggagagaggcaatttgctttggcctgactcggttatcactctcatggtgtagcaagaacatgaataatttggtcctatccctagctcctaaattcacaaaattacagactttaatccttcgtcaagacaagcctcaactagaggacaatgctgttgaaactatttcaaatttttgtcatgacctccaaatcttggacctcagcaaaagtttcaagcttaccgatcattcgttgtatgccatagcccttggttgtcaggatcttacaaaactgaacatcagtggttgttcagcctttagtgacaatgctctggcttacctggccagtttttgtagaaagctgaaagttttgaatctctgtggatgtgttaaagctgcatctgatactgcgttacaggcaattgggcattactgcaatcagttacagtttttgaaccttggatggtgtgaaaatgtcagcgatgttggagtgatgagtttagcatatggctgccgtgatcttagaacactcgatttatgtggttgtgtccttataacagatgacagtgtaattgccttggcaaacagatgtcctcatctgaggtcccttggactttacttctgccaaaacatcacagacagggcaatgtattccttggcacaaagcaaagtgaacaacaggatgtggggttctatgaaaggtggtggaaataatgatgataatgatgatggactaagaactttgaacattagccaatgcacagcactcaccccttctgctgtgcaagctgtgtgtgactcatgcccttccctccacacctgttctggaagacactcactcatcatgagtggttgtctgaatctgacttctgtgcattgtgcttgtgctggccaagcacaccgtgctttcactctcccacatgcagctcattga

SEQ ID NO: 2376 - DNA, 999 bp, Glycine max var. Williams 82
atggacagagaacaagaagagatgcaatttcttgggttctttgacatatacaaagaagcctctaagatcatactttcatggaggaaaatcttcacccaaatcacctcaacactaatcctgcctctctccttcatcttcctaatccacatggaaatctccaacctccttttcaggaagatcctcatcaacgaaatagtcatggacgaaacaaggcgtaacacaccccaatacaacaagcttgaccgcatgatctcttctgaattgatcactcttgtgctcttcaaaatcgcatacttcactcttcttctcatattctctctcctttctacctcggcagtagtctacaccatcgcatcaatctacaccgcaaaagaagtgacattcaagagggtcatgagtgttgtccctaaggtgtggaaaaggttaatgttgacctttctatgtgcctttgctgcttttttcatttacaatatcgtgaccatgttggttatgttcttgtcaatagtcacaatagggataagtagtggtggggttgtggttttggttttgataacggttttgtacttcattgggtttgtgtacctcaccgtggtgtggcagctagcaagtgttgtgaccgtgttggaggactcgtgggggattcgagccatggccaagagcaaggagttgataaaggggaagatggttttatccatattcgtctttttcacccttgtggcttcttttgtttccattagggttttgttcaaggtgatggtggttgatggatggagggtgagttctgtggacaaaacagcatatggggttctctgtttcttgctcttgtcttgtttgttcctctttgggcttgttcttcaaactgtgctctactttgtttgcaagtcctatcaccatgagaatattgacaaatcggctttggcagatcatcttgaagggtatagaggagagtatgttccattgacagctaaggatgttcagctggagcaataccaagtttga

SEQ ID NO: 2377 - DNA, 579 bp, Glycine max var. Williams 82
atggcttcaaccgcttctgaggttagccaacaagtacaatccaataacagaacaagtttcacaagtgtgaaagcactaactaaatcaccagaactcacttccctcccaccctcatacacaaccaccaattcagatgatgaaatagtggcagacccagatgaagatgatccaattcccatcattgactattctctcttagttactggcacacttgatcaacgtgccaagaccatccatgacttgcgcaaggcttgtgaggagtggaggttcttcatgctcatcaaccactttgtgtcaaagaccatcttggagaagatggttgatgaaatttttgctttcttcaatcttagagaggaggagaagcaagagtatgttggtaaggatgtgatggaccctgtaaggtatggcaccagctccaatgtttcgatggacaaagtcttgttctggagggattttcttaaaatcgtggtgcactcggaatttcactcacttgacaaaccacctgggttcagcctatccctcttaagattattgaggccacaaggttcaacagctacgaggttacctttgcaattttga

SEQ ID NO: 2378 - DNA, 762 bp, Glycine max var. Williams 82
atggttgttgagatttgctcagaaaactgtggggtgtcaatgacaatgagtccaaggatttcattctcacatgacttctcccaatcggatgtcatcccagttgagaagcaccctttgagatcaaactcatctggcttgaactcaagcatggactttgatttctgtgttcgtgaaagcttagagcttgagtcctcttcagcagatgagcttttctcacatggggttctccttcccacacaaatcaaaaagaataacatcaacaacaacaatgctcttttgaagccaaaaagtcaactagcaccaccaccacctcaacctcaattaccaccaccctcgaaagctatttgtgacagtgcttcttccaccaccagaaaaagctcaaagaaagagagccacaaagatggcaaggagttgaatgatgaagtgaatgagaagcaaagttccaagtcattttggaggttcaagagaagtagcagttgtggaagtggatataggagtagcttgtgccctttgccacttctatcaagaagcaattcaactgggtcttcaccaagtgttagaaggataccactttcaacagagggtcatcatcattctcactccttggcttcacacaatcatcaaaagcctccattacagaggagtcatgggtctcatgctaatggtgttagagttagtcctgttctcaatgttccttctgcaaaccttttgggtttaggctcaatcttctccaacaatagagacaagagcaagaagaagtaa

SEQ ID NO: 2379 - DNA, 537 bp, Glycine max var. Williams 82
atggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagcacggtttcgtgtaccgtgagcacaacaggtcacctggatactatgatggacgctactggaccatgtggaagctgcctatgtttggctgcactgatgcttctcaggtgttgaaggagcttcaagaggctaagactgcataccccaatggcttcatccgtatcattggatttgacaacgttcgccaagtgcagtgcatcagcttcatcgcctacaagcccccaggcttctaa

SEQ ID NO: 2380 - DNA, 2067 bp, Glycine max var. Williams 82
atgggcttcaaagtagagtctatggctataaattcctcagcagatgactattgtggttcatgctgttatggttgcagaacaggagataagaagggaactgactccacttggttggttgattctgtaggcaatggtgcagtgatcctcactggatgtaaagctgagagattcatacttgaaaatgtaaagaatggaatgaagaaaaagaagtgcttaggagtgattgttgcagcaagttggaggactaagccaccaactttcagatgtcaattatttttaagtatattaggtgaactattgaagaagaaggcagaggaaggagtggctgtgagggttctgttttgggatgatgaaacatctttaccctttgttatgaacaaaggtgacttgaacaaccaagatgaggaagcttttgcttatttcaaccacacagaagaccttgctagagtagaagctgaaaaggaagctacccttgttcaatataaccagtgcttagagacaatatctaaactggaggagagaataaaagaagttgaggataatgcaataaggattcaggagcatgctgatatagcagaaaaagaaatgaaggctttgaaattacaagtcactaaacttaatgaagaaaaggaagatgccactctccgttatcagcaatgcttggagataatttccagtttggagtataagctctcttgtgctgaagaggaggtgcgtagtcttaattccaagatagttgatggggttgaaaagttacagagttctgagcagcagtgtcttctcttggagacatcaaatcacacgctgcagtctgaattacaatctttggcacaaaaaatggggtctcaaagtgaagaacttaacgagaagcagcaggaattgggtacactttggggttgcatacaagacgagagactgcgattcattgaggctgaaactgctttccaaactcttcagcagttgcattctcagtctcaggcagagcttagatctcttgattctaaacttaccagtaaagatgagatttcgaatttgagggaaacaatagagaaagttgaacaggaggtggagcttcgaattgatgaaacaaatgctcttcagcaagaaatttattgtcttaaagaggagcttaatgatgttaataaaaaacatgaagccatcatagaggaggtcaggtcaactgacatacacccacagtactttggatcagctgtgaaaaaaatgcaagatgagaatttaaagttgaaggaaacttgtgcggctgacaaaggagagaaagaagctcttttgctaaaattggaaaacaaggagaaacttctggagaaaaatacagttttagagaattccctttcagacttcaatgccgagcaggatagtgtgagaggaaaagtaaatgtgttggaagaaacatgccaatctcttctagaggagaaatcaaatgttgctgctgagaaggccaccttgttttctcagttacagtccacaactgaaaagctggagaagctatcagaaaagagcaacctattggaaaattcactgtttgatgtcaatgctgaacttgaaggattaagggtgaagtccaaggtattagaagacacatgccaatcacttgaccatgagaagtccagtatctttcaagagaaagaaactttagtttcacagttgaacataactcatcaaacactaaaagatcttgaggaactgcacagtttattggaattgaagcatttggaacaaaaaggagaaagggagtctgcacttcaaaaggtagaagagctactagtttccttatattctgagagggaagagaattccagagttttgaaattgaatgaagatgaattggctgagaaggaattacaaattcatattctacaagaagatgcaaattgtaagaaaaaggaatatgaggaggaactggacagagctatacatgctcatgttcaaattttcatcttgcagaaatgtgttgatgatttggagaaaaagaacttctcccttctagttgagtggcagagacttttggaggcttccaaaatgtcttacaaaatgatatgtaaattgtaa

SEQ ID NO: 2381 - DNA, 2067 bp, Glycine max var. Williams 82; identical to SEQ ID NO: 2380

SEQ ID NO: 2382 - DNA, 1299 bp, Glycine max var. Williams 82
atgacaatgaagtttccggccaatgaggttctcaatgggaagtacacaacaagaaccacagccaaaagtgttttcctggtacccttcactcttcttctcatcatgctccctctttctctcatgagaagctctcgtgaaccaactcctgagatatcttctgtaagtgttagcagtttggacaacaacacagaagtaaaacaatgtaacatcttttctggaagatggatgcataatcctgcagcaccttactacagcaatgaaacatgccattggataatagaccaacaaaactgcttgaagtttgggagacctgatagagagtacctgcattggaggtggaaaccagatgaatgtgagcttccactcttcaatgcaactcgattcttaaatcttgtgagaggaaagaagatggcatttgttggagactcagtggggagaaaccagatgcagtctttgttgtgcctcctaagtcatgtgtctgagcctgaggatgtttctcacaaatactcttcagatgtggtatacttcaaacgttatttctatcatgattacaatttcacacttggaaacctgtggtctccatattttgtgagatccagtgatgcagaccccagaggccacacctacaacagcatcatgaagctgtatgtggatgaggcagatgaagcatggacaagcctggttgaaaactttgacatagtcataatctcatcagggcaatggttctttaggcccctattgttctatgaagagggaaagcttgttggatgcaacaagtgtaggatagacaatgtgacagacctcacatacctctatggatacaagaaggcattcaggacagcatttagggcactcagcagccttgaaaactacaaaggggtcacattcttgaggacattctcaccagcacactttgagaatggggattggaacaagggagggaggtgtgtgaggactatgccattcaccaagcaagaaatgaggcttgaggatggggcagtggagtacattctagagatgtatgtgacacaagtggaggagtttagagaggcacaaagggtggccacaaagagagggttggagtttctgatgatgaacacaactgaaatcatgttgcttaggcctgatggacaccccaacaactatggatattcaaaggacaaaaatatgacactgaatgactgtgttcattggtgcctgccagggcctgttgacacatggaatgagtttttgctctatatgttggatactatgggaagtgaggcattttttagttctaagctagagagagttttttaa

SEQ ID NO: 2383 - DNA, 1404 bp, Glycine max var. Williams 82
atggcagagacaccaaccctcagaatccacgaagtctgccccatctcgccgccacaagaaaccccatcaaccactattcccttcaccttcttcgacgtcctatggctacgcctccccccagtggagcgtctgttcttctattccttcccaaacccaacaacaacctcttcattcttcgacaccaccattctcccaaatctcaaacactccctctccctcactctccaccacttccctcctctcgccggcaccatcacatggccacttcacacacccctccccctcatcacctacacccccggaaactcaatccccttcagaatcgccgaatccaacgcagacttcaacaccctctcttcaaacctctcagaagttaacaaccaccgccgaaacctaataccccacttacccacttcccacgaagaagcttcggtgttagcccttcaactcacccacttcccaaaccaaggctattcgataggaataacaagccaccacgcagcacttgatggaaagtcttcaactttgttcatgaaatcgtgggcgcatatttgttcttacctcaatacctcaccggaagaaccgttgctgttttcactaccgaagcatctaacaccttcgtttgatagatctgtcataagagaccctttggggatcggtgagatttacgcgaagtcgtggacgagcttcggtggagccaccaatgaccgaagcttgaacgtgtgggataccctcggtggaaatcaaaccgatttggttaaaggattgtttgagttgacaccgttggatatcaagaagctgaagaagttagcggagtccaagtttgttgtcggagacaacaagaagaaagttagggtgacatcatttacggtcacgtgcgcttacctgttgtcatgcgcggtgaaagcggagcaacccaactgcgaaagagtgccttttgtcttcaacgtggactgtagggcgcgtttggaccccccaattccggaaacgtacttcgggaactgcgtcgtggctttgttggcttcggccaagcgagaagagcttttgggggaagaagcgtttttcaaaagcgttatagggataagcgaggagttgaacgggttagagggtgacgtgttgaacggcgcggacaaatggattccgaagattcaatcggtggtatcggagactcctaggttgttctccgtcgccgggtccccgaggtttgaggtttacggcattgactttgggtggggaaggcctgagaaagtggatgtcacatccgttgataaaacgggtgcgttttcgctctcggagagtagggatcatagtggagggattcaaattgggttggcgttgaccaagaatcaaatggaggcgttttctagggtttttgctcaaggacttgagtccttggaatcatga

SEQ ID NO: 2384 - DNA, 1443 bp, Glycine max var. Williams 82
atggtgaagatttgctgcattggtgctggatatgtggggggtccaacaatggcagtcattgctctgaagtgcccctccattgaagtggctgttgttgacatctccaaatcccggattgcagcatggaacagtgaccagcttcctatctatgagccaggccttgatggtgtggtgaagcaatgtcgtggcaagaaccttttcttcagcactgatgttgagaaacatgtctatgaggcagacatagtgtttgtctctgtcaacaccccgacaaaaactcgcggtcttggagccggtaaggccgcggatttaacgtactgggagagtgcagcacgcatgattgctgatgtatccaagagtgacaagattgtggtggagaaatccactgtccctgtgaaaactgctgaggccatagagaaaattttgactcacaatggcaagggaatcaagttccaaatcctttcaaaccctgaattccttgctgagggaactgcaatccaagatcttttcaatccggaccgtgtcctcattggaggcagggagaccccagaaggccaaaaagccattcaaacattgaaggatgtatatgctcattgggttcctgagggaagaatcctaaccacaaacctgtggtctgctgaactgtccaagcttgctgctaatgccttcttggcacagagaatttcatctgtgaatgctatgtcagcactttgtgaggccactggggcaaatgtcacacaagtgtcctatgctgttggcactgacacaaggattggaccaaagttcctgaattctagtgttggttttggtggctcctgcttccagaaggacatcttgaaccttgtctacatctgtgagtgtaatggcctgccagaggtggctgagtactggaaacaagtgatcaagatcaatgattatcagaagagccggttcgtgaaccgtgttgtttcgtcgatgttcaacacagttgcaaccaaaaagatagccattctggggtttgcattcaagaaggacactggggacacaagggagacaccagcaattgatgtgtgcaagggactactcggtgacaaggcacgcctaagcatatatgatccacaagtcactgaggaccaaattcagagggatttatggatgaacaagtttgattgggaccaccctattcacttgcagccaactagtcctacaactgagaagaaagttagtgtggtttgggatgcatacgaggcaacaaaggatgcagatggtgtctgcattctcactgagtgggatgagttcaagactcttgattatcagaaagtgtatgacaacatgagaaaaccagcatttgtttttgatggaaggaacattgtggatgtggagaagctacgtgatattggtttcattgtgtactcaattgggaagccactggatccatggctcaaggacatgccagctgtggcataa

SEQ ID NO: 2385 - DNA, 2561 bp, Glycine max var. Williams 82
tttctgttcctctcccttttggcacttaaaattcctccaaccccccattcccctctgggaaacaggggaagagagagagagaaaaaaaacaggggagggaaggggttgctctatcactttgttctgttccacaacaaagccaccattttcccctgtgaatctcgcacaccctctggggaaaagaaaatcccaaaaagggttgcatcgaattgcacggaacagagacacagagataaaaaaaaaacaaaaacaaaaaacaggggaggagagagaaaaaaaaacaggggaggaacgaagctgccatttttgctgcaattccaaatgccattgtttctgagttttgctcatcacgctctcttttgaatccccttgtgctggggaagcaaccacattggggggtgctgatgtaggggaaactctcccctaccatcaacatcatccaattctttcttcttcttaataaaaaaaaatgggttgcataagctccaagaatgcggttgccagaacttgttctccgtcgcccgcagtactcgacattgcagagccgaaccccgcttatgccaagggccattcctggttgccggttttggaatccaaaacgggttcagaggatgagaggagcaatagcaagttcaggaagaacagttcaaagaagagtagtgggtctttcagcttcaggcatgtggaggctgaacagaatgctgctggttggcccccttggctcatagctactgcagcagaagccattcaaggatggatccctctcaaagctgattcttttcaaaagttggaaaagattggagaaggtacatatagcagtgtgttccgagcacgtgaagttgaaactgggaagatgtttgctttgaagaaggtgcgctttgacaatttccaacctgagagcattaggttcatggcaagagaaataacaatcctccgcaggcttgatcacccaaacatcatgaaattggaaggcataatcacttctcgcctatcaaacagcatatatcttgtgtttgaatacatggagcatgatcttgctggcctagtatcacgtcctgatattgtgttctccgaatcacagataaaatgttacatgaggcaactattaagtggacttgagcattgtcatatgcgtggcatcatgcatagagacatcaaattatcaaatatcttgttgaacaatgaaggtgttctcaagataggagattttggattagcaaatacaattagcacaaatagcaagcatcatttgacaagtcgcgtagtgactttgtggtatcgccctcctgagctcttgatgggatcaaccaactatggagtgtcagtggatctgtggagtgtgggctgtgtatttgcagaactttttcttgggaagcctatccttaaggggagaactgaggttgaacaattacacaaaatttttaagctgtgtggttctccacctgaggagttctggaaaaagactaagcttcctcatgcaacaatgtttaaacctcagactaattatgaaagctctcttcgggagaggtgtgcagattttcctgcatctgctgtaaatctactcgagactttattgtcgattgatccaggcaaccgagggactgcctcatctgccctaatgtctgagtatttcagcaccaagccatatgcttgtaatgcatcaagcctgccaaagtatccacctagcaaagaaatggatgccaaaagtatgggagattcatccaggaaaaagactggaggtaaaatgagagaggttgcaacatcaagaaggcagcaaagacgggttagtaaaattttgcaagatccaaacaatttcggcaaatcaatttcaaaagaggacacgcagaacatttctgaaaatgctcgtagagatgatggtaaagcacatcttacaaagggaaaaggaggggccatgcacaaagattatacaaagtctcatttggatgctatgtctgagacctcccaaatgaatgttgctaatggtaatggctatagtgtgggatctaataatacctttacatgggtaaaaaggagaaaacaagatgcatcttcaactctatcagatggatcaagaagcaaaattagtgcactggatccaaactttgcaaaacgcacatatgacttaaccacactcagggtgtccatggatttagatcctgaagaactgatgaatgctcagggtgacagagggcgtgctgttcgtaaatcaagatttggaagagacaacagatgaggcaaggattgcaggagtggtgcaatgctaaccactttaagggtgcctgacatcttgctgaaccatcatagtttttgacttacctctaccaacatcttggtggcacttccttccttttgatcacaagagtttactgttcatacccttctattgtacaggattaacaataatcaaatataggattacagtatacacatgtaacgatgccaaaatggaagatgatacaattatgaatgatttacttttctgatggaatttcactatcttggtacatgccaattttctctcaatgtaagatttaaaaaaagaagaataaactacaaagaaa

SEQ ID NO: 2386 - DNA, 1467 bp, Glycine max var. Williams 82
atgttggaggcaaaagactcaacgatgatgaagctcttcgggaatacgatcccggcaccggagatccccgccggagctccggcattttcttctggtgatgtttttggtgacagtgttggtcagaaccgtggttcttcaagtgtcaatggggatggtgaagaacacgagattcagcaggacataatgggagaggaaacaactgagagtaagaaggaagatgaagtgaccaatcttgatactgtctcaagatcaggggaagggtctattaacccctctaccgagaaggaggatcttacattgaaaacttcaaaaaagactgagcaagaacaaggtgaaaattcacaaaataaaacactgagaaagccggacaaaatactgccttgcccccgctgcaatagcatggacaccaagttctgctactacaataattacaatgtcaaccaaccccgtcatttctgcaagaattgccagagatactggactgctggtggagtgatgaggaatgttcctgtgggtgctggtcgcagaaagaacaagaattttgcttcgcagtatcgtcatataactgttcctgaagcagcactctcgagttcccagccggacttgtcaaatggagtcagtaatccttccttgaactgtaatgccacactccttgcatatgggtctgatagacccttgtgtgaatcaatgacatctgttttgaaccttgctgataaagcagtgaacaattccacaacaaatggatttaatggctctgaagaactagaaattcctgttacttatgttggtggagagaaagtgaatgatgattccaataaatcttctgacacgtcaacgaagccaatgaaaggtgaaaccaccaataggtcccaagaacaagtcatagagaattgtcatcccttcccacctcatgttccctactttcctggtgccccttggcctttcccttggaatccagcaccgtggaactccccggtaccattaccacctccttttttcccacaaggatttaccatgcctctctatcctgcagcagcttattggagtcttactataccgggtgcacggagcatcccatggctagcgcaaccatcattactgaatagtacagtgtctaactctggtcctaactcactaaccttgggcaaacattcaagggaagaaaacatgcataaatcaaatggggtagcagttgaggatgaacatagcaaggaaaataataaagaaaagtgtctatgggttccgaaaacattgaggattgatgacctaggagaagcagcaaaaacctctatatggacaacactaggtattaaaaataataaagcagacttatttcctgggggaggactcttcaaatcactcccatcacagggtggtgaaaaaaatcgtgtaataaaaaactcacctgtccttcatgccaatccagcagcactctctaggtcaattaactttcaggagacctcataa

SEQ ID NO: 2387 - DNA, 1002 bp, Glycine max var. Williams 82
atgggaaggccaccatgttgtgataaagaaggtgtaaagaaaggaccttggactcctgaagaagacatcattttggtgtcttatattcaggaacatggtcctagcaattggaaagctgttcctgccaatactgggttgtcaaggtgcagtaagagttgtagacttagatggactaattacctgagaccaggaatcaaaaggggtaacttcacagaccaagaggagaagatgataatccatcttcaagcacttttagggaacagatgggctgcaatagctgcttacctaccacaaagaacagataatgacataaaaaactattggaacacctatttgaaaaagaagctgaacaaattggaagcaggttctgatcagggacataatattggggtttcagtttctcagccaatgtcaagaggccagtgggaaagaaggcttcaaacagatatccgcatggctaaaagagcacttattgaagcactctcatcaaacaaggcatcatcatcatctaccttgttattagctgaatcaaattcaaacctctccagtgaaaatagcatcttctataatagtaacactaataaacccacaacacaatctatgtgctatgcttcaagtgctgacaacatagctcgtttgttgaaagggtggatgaaaaatacaccaaaattagcctcatgtgctgcctcagctgtgactcaaaattcctttaacaacttggctggtgctgacactgcttttagtgaaggaattacaacaacaaagggaagcacaagcactagtactgttgagttgtctgagacttttgactccttgtttggttatgagtctttggattattcttcaaattctgagttctcaccatctctttctcccgaggctactcctttccaagatgagagcaagccagatataactgcagatggaatagacatgcctttctctttgcttgagaaatggcttctagatgatgctgcttgtcaagagaaacttggcttctag

SEQ ID NO: 2388 - DNA, 2667 bp, Glycine max var. Williams 82
atgtggaatcctctttcatgggtcatggaagctgcagcaatcatggccattgctttggccaatggaggaggaaaacctcctgattggcaagactttgttgggattatcacactccttattatcaattcaacaataagtttcattgaggagaacaatgctggtaatgctgcggcagctctgatggctcgtttagcacctaaagctaagttccttcgagatgggaaatggattgaggaggatgctagcattcttgttcctggtgatataattagtgttaagctaggggatattatccctgcggatgctcgtctacttgaaggtgatccactgaagattgatcagtctgcacttacaggcgagtctcttcctgtcacaaaaggccctggtgatagtgtttattcaggctccacatgcaagcagggagagatcaatgcagttgttattgccacaggagttcataccttctttggcaaagctgctcatcttgtggactccacaaatcaagttggtcatttccagaaggtcctgactgcaattgggaacttctgcatatgttccattgctgtgggaatgatagtagagataattgtcatgtacccaattcaacaccgggaatatcgtcctgggattgacaatctgcttgtgcttcttattggaggaattcctattgccatgcctactgttttgtcagtgacaatggcaattggatcccatcgcttagctcagcagggtgctattactaaaagaatgacagcaatagaagagatggcaggaatggatgtattatgtagtgacaaaactggaactttgactttgaataaactgacagttgacaagaatcttattgagatttttgctaaaggagttgacgtagatactgttgttctcatggccgctcgggctgcacgattggaaaaccaagatgctatagatgccgctattgtagggatgttgggtgatccaaaagaggcaagggctggtattcaagaggttcacttcctacccttcaatccaactgacaagcgaactgcaatcacttatatagacggtgaaagtaaaatgcatcgtgtcagcaaaggagcaccagagcagattttgaatcttgcacgcaataaatcagagatagaacgcagagttcattctgtcattgataagtttgcagagcgaggattacggtctcttgcagtagcttaccaggaagttcctgatggaaagaaagaaagccaaggtgggccttggcaatttattggactcttgcctctatttgacccacctagacatgatagcgctgagacaatacgaagggcattaaatcttggagtaaatgttaaaatgataacaggtgatcaactagcaataggaaaagaaacaggacgccgtctggggatgggaaccaacatgtacccttcatcggctttattgggccaaaacaaggatgaagcaattgctaccttgccagttgatgagttgattgaaaaagcagatggatttgctggtgtttttcctgaacacaaatatgagatcgtgaaacgtttacaagctaggaaacacatatgtggaatgactggtgatggggttaacgatgctcctgctcttaaaaaggcagatattggaatagctgtcgccgatgctactgatgcagctcgtagtgcttctgatattgttctgactgaacctggtctcagtgttatcatcagtgctgtactgaccagtcgagcaatattccaaaggatgaagaattacacaatctatgcagtttccatcacaatccgtattgtgcttggtttcatgttactggccctcatatggcattttgattttccaccattcatggtgctgattattgctattcttaatgacggtaccattatgacgatatcaaaggacagggtgaaaccatctccatatccagatagctggaagttggccgagatctttaccactggaataattcttggtggttatttggctatgatgacagttattttcttttgggcagcatataaaacagattttttccctcaaacatttggagtctcaagtcttcagaaaaaggatagggatgactttagaaagcttgcctcagcaatatacctacaagttagcacaattagtcaggccctcatattcattacacgggctcggagttggtcttatgttgaacgtccgggtttgttacttgttgcagcttttgttatcgcccagctgatagctaccttaattgcagtttatgcaaattggagtttcgctgctattgaagggattggatggggttgggctggtgttgtttggctttacaacctcatcttttatatcccacttgactttatcaagttcataattcgatatgccttgagtggaagggcttgggatcttgttattgaacaaaggattgcttttacaaggaaaaaagattttggaaaggaagaacgtgaacttaaatgggcacatgcacagaggacgcttcacggccttcacccaccagagactaagatgttcaatgaacgtacaagttacacagaacttaatcagatggctgaagaggctagaagacgagcagaaattgcaaggctgagagaactgcatacacttaagggtcgtgttgagtctgtggttagactgaagggtcttaacattgacacaatacagcaagcatacactgtctag

SEQ ID NO: 2389 - DNA, 1932 bp, Glycine max var. Williams 82
atgtggtctgcggtaacagatcccattagaactttttttgcaaattttgtcccccatttcatccacaaagactttcatgaagcagtggccagaatgaccataattgacgctttcctcttcattattgtgcactccgttgataagttggggatatggccacgcttgcctgttttcttagggctattgtacctagcgtttcgccgccaccttcatcaggaatacaacctcttcaacgttggaacaacgccggtgggggttaggttcaaccattctgattttccatacagaacagctgatggaaaatataatgaccccttcaacgaagtttctggcagccacggaactttctttggcagaaacattctccctgtggatcagaaaaaaaagctattgaagccagatccaatggttgtagccacaaaactactagctaggaggacatacaaggacactgggaagcaatttaatgtgatagcagcttcttggattcaatttatgattcatgattggatcgatcatctagaagataccaatcagattgaactcatcgcaccaagagaagttgcaagccaatgcccactaagatctttcaagttctacaagacaaaggaaattcccactggcttctttgagatcaaatccggatcctcaaacatccgcacaccttggtgggatgcaagcgtagtatatggaagcaacggagaagttttacagagagtgagaactttcaaagatgggaagataaagatatcaaaagatggtcatcttctccataacgaaaatggaacagcaattgcaggtgacatccgcaatagttgggctggtgtttcaaccttgcaatcccttttcattcaagaacacaatgcagtctgtgatactcttaagaaacattatcctcacttgggagatgaagaactttatcgccatgctagattggtgacctcagctgtgattgcaaaggttcatacgattgattggactgtagagctccttagaactgatactttacttgcaggcatgcgtgctaattggtatggattattggggaagccatttaaggatacatttgggcatgttggtggagtcatcttgggaggattagtgggtcttaagagaccagaaaatcacggtgtcacatactctctaacagaggaatttgcgactgtttatagaatgcactcactcctacctgataacctacaactgagagacatatctgctactccagggcccaacaaatctctaccattaatcaaagaaattcctatgaagaatttgattggactgcaaggagaaaaaacattatctgaaataggacttgcaaggcaacttgtgtcaatgggtcaccaagcttgtggggcactagagctttggaactacccagagtggctcagagacctcgtaccacaggaaatagatggcacagataggcctgatcatgtggatctagctgctcttgaaatttatagagatagagagaggagtgtggctagatacaaccaattcaggagggcattgctgttgatacctatctccaagtgggaagatttaacagatgacaaggaagcaattcaagtattggaagaggtatacggtgatgatgttgaagagcttgatgtgctggtaggccttatggcggagaagaaaataaagggttttgcaatcagtgagacagcttttgtaatattcctactcatggcaaccaggaggttaaaagctgacaggttcttcacaagcaactttaacgaagagacatataccaagaagggactggaatgggtgaacacaactgagagtctgaaagatgttattgatcgtcactaccctgaaatgacacacaagtggttaaactcttcaagtgctttctctgtttgggactcaccaccaaatactcacaatcatatacctctctatcttcgtgttccccactaa

SEQ ID NO: 2390 - DNA, 825 bp, Glycine max var. Williams 82
atgtcaaccgtcactgcttcttacaatgtcactcccaatgagccaactccaaacgtttctatggggctgtccgagagtgaccaagtggtacgttggactcacgccccaaccatttacatttacaaagaaaaccaaacccaaaacgcccttgaaagaatgagagattctctaagcagaattctagtgcactactaccctttggccggtcgattgacttggatagagggtggtagagtagcactgaattgcaatacaaagggagtgacactgatcgaagccgaatctccaaaaacaatggatgattatggcgatattaccacgaacgaaaaactgatgagtgaactcattcctatggttgattattctcaacccattgaggagcttcccttgttgcttgttcaattgacaaggctcaaaggaagcagcaaccaaggccttgcaattggagtggctattagccatgttttgtgtgatggggtagcagccattacattcatcaatgcatgggcaaagcttactagaggggaagctttggactcaattgaaatgtttccatttcttgatagaacaatcatcaattccacatacccaccaaggactccacgttttgatcaccctgcgttgaagcctctacctctcaaactaggcagcactgacaccaaagaagaacaggaaaaggagaaaacttctatgatgttgagactcacatcacagcaagttgagaaattgaagaagaaagccaatgatgaacgacctaaaaaagatgaaatgtcacgaccatatagtagatacgaagtcatggagatgtgcatcaaaggcacgtga

SEQ ID NO: 2391 - DNA, 1212 bp, Glycine max var. Williams 82
aaacctctcaagaatgtcaaccgtcactgcttcttacaatgtcactcccaatgagccaactccaaacgtttctatggggctgtccgagagtgaccaagtggtacgttggactcacgccccaaccatttacatttacaaagaaaaccaaacccaaaacgcccttgaaagaatgagagattctctaagcagaattctagtgcactactaccctttggccggtcgattgacttggatagagggtggtagagtagcactgaattgcaatacaaagggagtgacactgatcgaagccgaatctccaaaaacaatggatgattatggcgatattaccacgaacgaaaaactgatgagtgaactcattcctatggttgattattctcaacccattgaggagcttcccttgttgcttgttcaattgacaaggctcaaaggaagcagcaaccaaggccttgcaattggagtggctattagccatgttttgtgtgatggggtagcagccattacattcatcaatgcatgggcaaagcttactagaggggaagctttggactcaattgaaatgtttccatttcttgatagaacaatcatcaattccacatacccaccaaggactccacgttttgatcaccctgcgttgaagcctctacctctcaaactaggcagcactgacaccaaagaagaacaggaaaaggagaaaacttctatgatgttgagactcacatcacagcaagttgagaaattgaagaagaaagccaatgatgaacgacctaaaaaagatgaaatgtcacgaccatatagtagatacgaagtcatggagatgtgcatcaaaggcacgtgagctagaagatcttcaaccaaccgtggtaagggtacctgtggacattcgcaataggctgaacccacccctcccaagaaactactttggcaacgcattggccgcggcattgacaccaaaatgcctcactaaggaactcataaccaacccattaagactctcattccttatcgaactcataattactatatatattttataaatattctttaagactctcattcctaaaaacctaatttagttttcaacaaaaaaaaataataatttagtgagaataaaaaaatcctgatattaagtgtcaccttaaataaaaataccatttaacctttttatttaattttaaatgattttaaaaaatcatgaaaagatttaatatt

SEQ ID NO: 2392 - DNA, 282 bp, Glycine max var. Williams 82
atgagtttgagatatggcagtgtggtcttggttgctttagtgcttctgccacacatggcttctgctgcttcaattgtgaagaacctaccgggttacaagggtgatcttccattcaaacttgaaactgggtacataggagtgggagaagaagaagaggtgcaaatatttcacttatttgtggagtctcagagaaatccattcattgatccactgttaatttggtttgttggaggtcctggttgctctgccctatctgcgttcttttttgaaaatggtaaataa

SEQ ID NO: 2393 - DNA, 651 bp, Glycine max var. Williams 82
atgacaattcacaacaacaaaatgacttcaattgccaccaatagcactgttgtcgccactagaatgctagttgtgatcactttagtccttgcactagtatgttgtgtcacatccgcgcaatcaccggcagcagcaccagccccggagagcaacgggtgcttgatggcactaacaaacatgtcagattgcctgacatatgtggaggatgggagtaagttggcaaagcctgacaaagggtgttgccctgagttggcagggttgattgatagcaaccccatttgcttgtgtgagttgctaggaaaacctgactctattggcatcaagattgatttgaacaaagccctcaagcttccttctgtttgtggagtgaccactccccctgttagcacttgttcagctgtgggagtccccgtgtccttgcctccatcaatgagtgaaggttctttgtcaccaggtattgcaccaggagtctccagtccttcaaatacagatgctagtcctgcttctagtcctggtggtccaggcccttcctctgaggaagctgctgccagcccttctcaaaacaaaaatggagtttctgccattcaagcctctgctttgactaatttcatttttggcctttccactctatttgtctccgtattcttctga

SEQ ID NO: 2394 - DNA, 2940 bp, Glycine max var. Williams 82
atgaaaatcataatggatgagcagaatatgataagggctgttgcttcttcctctaactcttcttctatggtatcttctaaaaaatatgatgtttttctaagctttcgaggcgaggacactcgtaagaacttcacaagccatctttatgaagctttgaagcaaaagaagattgaaacctatatagactaccgccttgaaaagggagatgaaatctcggcagcgctcatcaaagccatcgaagattctcatgtatctgttgtcatcttctcagagaactatgcttcctcaaagtggtgcttgggtgaactgggcaagattatggaatgcaagaaagaaagaggacagattgtgataccagtattctataatattgatccatcccatgtgaggaagcaaactgggagctacgagcaatcctttgcgaaacatacgggagaacccaggtgcagcaaatggaaagctgctctcactgaagcagccaatttagctgcatgggactctcaaatttacaggactgaatctgaattccttaaggatattgttaaagatgttttgcgaaaattggctcctagatacccaaaccaccggaaagaactggtaggagttgaggaaaactatgaaaagatcgagtcattactaaaaattgggtcaagcaaagttagaattctgggaatatggggcatgggtggaataggtaagaccaccctcgctagtgctttatatgacaaattgtctcctgaatttgaaggttgttgcttcctcgcaaatgtaagggaagaatcagacaagcatggatttaaagctttacgtaataaacttttttctgagttgttagagaatgaaaatctttgttttgatgcatcatcctttttagtgtcccattttgttttgagtaggcttggacgcaaaaaagttttcatagtcttggatgatgtggatacctcagagcaactagaaaatctaattgaagattttgatttcttgggacttggaagtagagtcattgttacaacaagaaataagcaaatatttagccaagttgataaaatatataaggtcaaggaattgagcattcatcactctcttaagcttttctgcttatctgtatttcgagaaaaacaacctaaacatggatatgaagatctatcaagaagtgcaatttcctattgcaaaggtattcctttggctttaaaagttcttggtgcaagtcttcgttcaagaagtaaacaagcatgggagtgtgaattgagaaaactccaaaagtttccaaatatggaaattcataatgtattaaaattaagttatgatggcttagattattctcaaaaggagatatttctagacattgcatgcttcttaagaggaaaacaaagagaccatgtaacaagcatattggaagcttttgattttcctgcagcatcagggatagaagttcttttggataaagctctcataacaatttcaggtggcattcaaatagaaatgcatgacttgatacaggaaatgggttggaaaattgttcatcaggaacatatcaaagatcctggaagacgaagtcggttatggaaacatgaggaagtgcatgatgtcttgaaatataataagggaactgaagttgttgaaggcgtaattttagatttgtctaaattaaccgaggatctatacttgagctttgatttccttgcaaagatgactaacgtgaggtttcttaaaatccatagttggtccaagtttaccatatttaatgtataccttcctaatggtcttgactcattgtcttataaactgaggtaccttcactgggatggattctgtcttgagtctttgccatctaggttttgtgctgaacagcttgtagaactttgcatgcattgtagcaagcttaaaaagctttgggatggggttcagaatcttgtgaatttgaagacaattgacctttggggatcccgagacctggttgagatccctgacttatccaaggcagaaaaacttgaaagtgtttctctttgttattgtgaaagcctatgccagctccaagttcattcaaaatctcttggtgtacttaacctctatggttgttcatcacttagggaattcttagtgacatcagaggaattgacagaactgaacttggcttttactgctatatgtgcattgccatcatcaatttggcaaaaaagaaaactcagatctctttacctaagaggttgtcacaatctcaacaagttatcagatgaacccagattttgtggttcttacaagcactccatcacaacattggcctctaatgttaagagattgcctgtgaacattgaaaatctttcgatgatgacaatgatttggttagatgattgcaggaaactcgtgtctttgccggagcttccgctgttccttgaaaagttaagtgcctgcaactgcacttctttggacacaaagatcactcagcagcaagtgttacaacacatgttacaaagtcgcataccctacttacgcaaacactatcttaagtgttatgatgaagaatatttcttcccgggggatcatgtgattgatgagtgtaggtttcacacgacacagaattcaataaccattccttatcttcagaaacctgaattgtgtggtttcatttattgcatcattctctctatgggaccactcttagagtgtgatgtttcctgctctgtctatcaagatggcataagggttggctggctcgaaaggttgttggaatacgaaaatttgatttcagatcacgtggtgattttgtatcatgacatcagtgaatttgacaaaataagtgaagtgcatgatcatttcttcagcaacataacatttatatttgaaaacaatgaagaccgcataacagagtttggtgtcttcccggtatatgcctcagaatcagggttgaagttggttggtagcaaggaaatttttgaatga

SEQ ID NO: 2395 - DNA, 3890 bp, Glycine max var. Williams 82
tcaacgttattgaaaagtcaagagacatgaaacgcatgaaattctgaagactagactctgcatcatagcatatgaaacttcttagaaacacatgacatagacaccactaacatactagaatatttacacctgcggtctaattcttctttaatacttgacaaagagtttaatcattttgatctaattccggtgtagttattctatgtggcgcccaagaagctcttgtgttgaagtaaagaaacagtgtattcttctctgttgcaagaaattggattgagtccgaggtacaacacatgaaaatcataatggatgagcagaatatgataagggctgttgcttcttcctctaactcttcttctatggtatcttctaaaaaatatgatgtttttctaagctttcgaggcgaggacactcgtaagaacttcacaagccatctttatgaagctttgaagcaaaagaagattgaaacctatatagactaccgccttgaaaagggagatgaaatctcggcagcgctcatcaaagccatcgaagattctcatgtatctgttgtcatcttctcagagaactatgcttcctcaaagtggtgcttgggtgaactgggcaagattatggaatgcaagaaagaaagaggacagattgtgataccagtattctataatattgatccatcccatgtgaggaagcaaactgggagctacgagcaatcctttgcgaaacatacgggagaacccaggtgcagcaaatggaaagctgctctcactgaagcagccaatttagctgcatgggactctcaaatttacaggtaaataaaatgaattgagacttgaaagtgagtaaaattgagttgtccaaatttgattataaattgagcatacatttgttatacaacacctttcatggtagtttgcttaggaaatctattgcctagaaaaaaaaaaggcattgattttgttgtcaaagtcattgtatttcattcctcaatttatttttgtttctttctcttctacactaccatattcaccatagattatgcataatcatttttatgtatttcattcctcatctatttctttgttgccctgttcatgtgcaaggactgaatctgaattccttaaggatattgttaaagatgttttgcgaaaattggctcctagatacccaaaccaccggaaagaactggtaggagttgaggaaaactatgaaaagatcgagtcattactaaaaattgggtcaagcaaagttagaattctgggaatatggggcatgggtggaataggtaagaccaccctcgctagtgctttatatgacaaattgtctcctgaatttgaaggttgttgcttcctcgcaaatgtaagggaagaatcagacaagcatggatttaaagctttacgtaataaacttttttctgagttgttagagaatgaaaatctttgttttgatgcatcatcctttttagtgtcccattttgttttgagtaggcttggacgcaaaaaagttttcatagtcttggatgatgtggatacctcagagcaactagaaaatctaattgaagattttgatttcttgggacttggaagtagagtcattgttacaacaagaaataagcaaatatttagccaagttgataaaatatataaggtcaaggaattgagcattcatcactctcttaagcttttctgcttatctgtatttcgagaaaaacaacctaaacatggatatgaagatctatcaagaagtgcaatttcctattgcaaaggtattcctttggctttaaaagttcttggtgcaagtcttcgttcaagaagtaaacaagcatgggagtgtgaattgagaaaactccaaaagtttccaaatatggaaattcataatgtattaaaattaagttatgatggcttagattattctcaaaaggagatatttctagacattgcatgcttcttaagaggaaaacaaagagaccatgtaacaagcatattggaagcttttgattttcctgcagcatcagggatagaagttcttttggataaagctctcataacaatttcaggtggcattcaaatagaaatgcatgacttgatacaggaaatgggttggaaaattgttcatcaggaacatatcaaagatcctggaagacgaagtcggttatggaaacatgaggaagtgcatgatgtcttgaaatataataagggaactgaagttgttgaaggcgtaattttagatttgtctaaattaaccgaggatctatacttgagctttgatttccttgcaaagatgactaacgtgaggtttcttaaaatccatagttggtccaagtttaccatatttaatgtataccttcctaatggtcttgactcattgtcttataaactgaggtaccttcactgggatggattctgtcttgagtctttgccatctaggttttgtgctgaacagcttgtagaactttgcatgcattgtagcaagcttaaaaagctttgggatggggttcagaatcttgtgaatttgaagacaattgacctttggggatcccgagacctggttgagatccctgacttatccaaggcagaaaaacttgaaagtgtttctctttgttattgtgaaagcctatgccagctccaagttcattcaaaatctcttggtgtacttaacctctatggttgttcatcacttagggaattcttagtgacatcagaggaattgacagaactgaacttggcttttactgctatatgtgcattgccatcatcaatttggcaaaaaagaaaactcagatctctttacctaagaggttgtcacaatctcaacaagttatcagatgaacccagattttgtggttcttacaagcactccatcacaacattggcctctaatgttaagagattgcctgtgaacattgaaaatctttcgatgatgacaatgatttggttagatgattgcaggaaactcgtgtctttgccggagcttccgctgttccttgaaaagttaagtgcctgcaactgcacttctttggacacaaagatcactcagcagcaagtgttacaacacatgttacaaagtcgcataccctacttacgcaaacactatcttaagtgttatgatgaagaatatttcttcccgggggatcatgtgattgatgagtgtaggtttcacacgacacagaattcaataaccattccttatcttcagaaacctgaattgtgtggtttcatttattgcatcattctctctatgggaccactcttagagtgtgatgtttcctgctctgtctatcaagatggcataagggttggctggctcgaaaggttgttggaatacgaaaatttgatttcagatcacgtggtgattttgtatcatgacatcagtgaatttgacaaaataagtgaagtgcatgatcatttcttcagcaacataacatttatatttgaaaacaatgaagaccgcataacagagtttggtgtcttcccggtatatgcctcagaatcagggttgaagttggttggtagcaaggaaatttttgaatgagaattcattactcaaatatctgaaatgagtcacagaaagaattgttgttttttcttaaatgaaactagtccttcaaatatagaaattatcaattgaaaatactattgaatcttgattcgagataattatgcgtttttctttttattgcattaacatttttctgtaattatgttgaacaggttttcttttaaaagaatattaattggtgggaaatgagcattagcttattcagagagccaaagcagtactcaagaatattttcgttgatcattttcatactgtgattatgtatttatttaaatgctaaactatgcttttaatcattaaattttttgacatttttggttttgattcttaaactttat

SEQ ID NO: 2396 - DNA, 2241 bp, Glycine max var. Williams 82
atggctcagaattatgtaattgttgcattgggtttggtggtgtatgcttggacatggatgcaaggtgcacatggtgagtacttgattggggttgggagttatgacatgactggtccagctgctgatgtgaacatgatgggttatgccaaccctttacagaacactgctggtattcatttccggctaagagctagaactttcattgtggccgagagccttcaaggccctaggtttgtttttgtcaaccttgacgctggaatggcatcccagcttcttactataaaggtgcttgaaagacttaattcaaggtttggaaatttgtatactgaagaaaatgtagcaatcagtgggactcatacacatgctggtcctggcggttacctgcaatatgtggtttactctgtgacttctctgggttttgtgaaacaatcctttgatgccattgcgaatgcaatagaacaaagcattattcaagctcacaacaacctcaagcctggttccatttttatgaatacaggagatgtgaaggatgcaggtataaacaggagtccaagtgcatatctgcaaaaccctgcagatgagagagcaagatatcccacaaatgttgacacacaaatgacccttatgaggtttgtggatggagcaagtggtaaaaatattggagcattcagctggtttccaacacatggaacctccatgagcaatcaaaacaagcttattagcggagataacaagggtgttgctgctagactctttgaagattggtttgcttctcaaaacaattctactaacaccaattcaacagtaccagatattggacaactaatgaagaaagcacaatcaattaaggccacaagaggaaaggattgcaagaaactagcaagccaagcgtccaaggtgaggaagaatgatggatccttatttgttggagcattttgccaatcaaatgttggagatgtgtcaccaaatgttctaggagcattttgcatcgacagtggaaaaccttgtgacttcaaccgttcttcatgccatggcaatgaccaactttgtgtaggcaggggacccgggtacccagacgaaatattaagcacaaagattataggtgaaaggcaattcaaaactgctgtgaaactgtttgagtctacttcagaggaactgtctgggaagattgactaccgccatgtgtacctgaacttcacagacattgaagttgaattggacagcaacaaggtggttaaaacatgccctgcagcacttggtcctggttttgcagcaggcactacagatgggccaggtctttttgggtttcaacaaggtgatacaaagatcaatccattttggaagaatgtgagagattttctgacaaaaccaagtcaatatcaagtggactgccaaaacccaaagccagttctgttgagcaccggcgaaatgttttatccttatccttgggcgccagcaattcttccaatccaaatcctaaggctgggaaagttgatcattctttctgtaccaggagagttgacaacaatggctggcagaaggctaagggaggcagtgaaggagacattaatatccagcagcaatggagaattcgatgatgaaacacatgtggttatagcaggactgacaaatacttactcacaatatattgctacttttgaagagtaccagcaacaacggtatgaggctgcttcaacattgtatggtcctcacacattatcagcatacatccaagaatttaagaaactagcacaagcaatggctgaaggagagaacatcactataaaaggtccttctccgccagatctctcatctgtacaaataagcttcttacttgatccccttggagaatcacctccaaaaggagtcaaatttggtgacataaaggaagacgtggcgtttcctaaaagaggctactttactaagggagatacaccaagtgctacattctggagtgccaatccaagatatgaccttctgacagaaggcacatttgctgcagtggagaggcttcaaggggaaagatggatttctgtatatgatgatgatgatttaagcttgtttttcaagtggaaagtagataatagttccttgcatgggttagctaccatagaatgggaaataccaaatgatgctgtttctggagtatacagattaaaacactttggagcaactaggaccaccattatctcccctattaattactttactggtgcttcaagtgcatttgcagtgcaatag

SEQ ID NO: 2397 - DNA, 2261 bp, Glycine max var. Williams 82
atggctcagaattatgtaattgttgcattgggtttggtggtgtatgcttggacatggatgcaaggtgcacatggtgagtacttgattggggttgggagttatgacatgactggtccagctgctgatgtgaacatgatgggttatgccaaccctttacagaacactgctggtattcatttccggctaagagctagaactttcattgtggccgagagccttcaaggccctaggtttgtttttgtcaaccttgacgctggaatggcatcccagcttcttactataaaggtgcttgaaagacttaattcaaggtttggaaatttgtatactgaagaaaatgtagcaatcagtgggactcatacacatgctggtcctggcggttacctgcaatatgtggtttactctgtgacttctctgggttttgtgaaacaatcctttgatgccattgcgaatgcaatagaacaaagcattattcaagctcacaacaacctcaagcctggttccatttttatgaatacaggagatgtgaaggatgcaggtataaacaggagtccaagtgcatatctgcaaaaccctgcagatgagagagcaagatatcccacaaatgttgacacacaaatgacccttatgaggtttgtggatggagcaagtggtaaaaatattggagcattcagctggtttccaacacatggaacctccatgagcaatcaaaacaagcttattagcggagataacaagggtgttgctgctagactctttgaagattggtttgcttctcaaaacaattctactaacaccaattcaacagtaccagatattggacaactaatgaagaaagcacaatcaattaaggccacaagaggaaaggattgcaagaaactagcaagccaagcgtccaaggtgaggaagaatgatggatccttatttgttggagcattttgccaatcaaatgttggagatgtgtcaccaaatgttctaggagcattttgcatcgacagtggaaaaccttgtgacttcaaccgttcttcatgccatggcaatgaccaactttgtgtaggcaggggacccgggtacccagacgaaatattaagcacaaagattataggtgaaaggcaattcaaaactgctgtgaaactgtttgagtctacttcagaggaactgtctgggaagattgactaccgccatgtgtacctgaacttcacagacattgaagttgaattggacagcaacaaggtggttaaaacatgccctgcagcacttggtcctggttttgcagcaggcactacagatgggccaggtctttttgggtttcaacaaggtgatacaaagatcaatccattttggaagaatgtgagagattttctgacaaaaccaagtcaatatcaagtggactgccaaaacccaaagccagttctgttgagcaccggcgaaatgttttatccttatccttgggcgccagcaattcttccaatccaaatcctaaggctgggaaagttgatcattctttctgtaccaggagagttgacaacaatggctggcagaaggctaagggaggcagtgaaggagacattaatatccagcagcaatggagaattcgatgatgaaacacatgtggttatagcaggactgacaaatacttactcacaatatattgctacttttgaagagtaccagcaacaacggtatgaggctgcttcaacattgtatggtcctcacacattatcagcatacatccaagaatttaagaaactagcacaagcaatggctgaaggagagaacatcactataaaaggtccttctccgccagatctctcatctgtacaaataagcttcttacttgatccccttggagaatcacctccaaaaggagtcaaatttggtgacataaaggaagacgtggcgtttcctaaaagaggctactttactaagggagatacaccaagtgctacattctggagtgccaatccaagatatgaccttctgacagaaggcacatttgctgcagtggagaggcttcaaggggaaagatggatttctgtatatgatgatgatgatttaagcttgtttttcaagtggaaagtagataatagttccttgcatgggttagctaccatagaatgggaaataccaaatgatgctgtttctggagtatacagattaaaacactttggagcaactaggaccaccattatctcccctattaattactttactggtgcttcaagtgcatttgcagtgcaataggatagcagctccgcgttatt

SEQ ID NO: 2398 - DNA, 432 bp, Glycine max var. Williams 82
atgctgctcggaaagagacctcgtcctccaatgaagagaacaacaagcatgtccgaaatgaccttggatctgaacacagccgccgatgccgccgccgccgccgaccaacagagatcaggtgttggtccctcggcagcagcagatcagactacgaggatgttggcatcacccaaaatcctcagaagacattcttcgtatttcggcgacgcgcgtcacttccttcgtgcgtgttccctctgcaaacgccctctcgtgcccggtcgcgacatctacatgtacaggggtgatagtgctttctgcagcctggagtgtcgccaacagcagataaaccaggacgagagaaaggagaagtttgtcatggcgtcgaagaaaaaagttgtggctcctccgccgtctgggtctcaagtcgtggctaccgccaccaagggttaa

SEQ ID NO: 2399 - DNA, 1017 bp, Glycine max var. Williams 82
atggctgctggagtgtataaccaaccaattgttgcttttcaatcccattctcacatcaacaattttaatcatcagcaaaagtttaataatttggtaagactggtgacaaaggactttatcggcagtaatttcctctcaagaagggattgtagagtaattcaatctttagcatctcaaacatctgtggttgacacagtttcatccccttcaaaaagcaaaactagtgatagagacactcacaagaaatcaaatgaagcttctttaatccttattcgacatggtgaatccttgtggaacgaaaagaacttgttcacaggctgtgttgatgtccctctaagcaagaggggtatagatgaggcaattgaagctggcaaaagaattagcagtattcctgtggatctcatatttacatctgctttgattcgagcgcagatgacagccatgcttgccatgacacagcaccgccgcaggaaggtgcctatcataatgcacaatgaaagtgaacaagcaaggggatggagtcaagtttttagtgaggatacagaaaagcaatccattccagtcatagcagcttggcaattgaatgaaagaatgtatggggaactacagggtctcaataagcaagaaacagcagacagatatgggaaagaacaagtacatgagtggcgtcgaagttatgacatacctcctccaaatggtgaaagtttggaaatgtgtgctgaaagggcagtttcctatttcagagaccaaattgaacctcaacttttatctggaaagaatgttatgatttcagctcatgggaattcactgagatccattattatgtatcttgacaaactaacttcccaagaggtgattagtttagaattgtcaactggaattccaatgctttacatttttaaagaaggaagattcgttaggagagggagtccgatagggcccactgaagcaggagtttatgcctacactaggcgtttggctctttacaggcagaggttggatgatatgttccaataa

SEQ ID NO: 2400 - DNA, 1104 bp, Glycine max var. Williams 82
atggctggtttggctagcaatcttcctctaattgttatgataggtctgcaaattcattatgcagcacttgccatattcacaagagccgctctcttagatgggttgagtacaacggtgtttgtagtatacaggcaaggcatagccactttggctttggcgcctatatttttctctcctaagaggagacaatcagtgaaagattctttgggattcaggagcttctttttgatgtttgtgaccgctcttgttggagtcacggcaaatcagaatgcatacttcaaaggattattttatgcatcttctactgcagctaccgctatgagtaatctgataccggcattaacgtttgtaattgcagcaattgcgggatttgagaaagttgacataagcttaagaagcacggccaagatattagggacagtttgttgcgtggctggagccttaaccatggcattggtcaaaggacagaagctgttacacacggagttccttccttctatacatctcaccggcagtcaaggtgatgattggctgctgggttgcctattgctcttagcaagcagtgttttttggtcatgttggatgatcctgcaggtaccaatcacttcgtgctgcccagaccatttattatcaaccttttggatgtgtctgttttcaacaatacaggctgccctatttgccctgctttcagagtcggatcttcaagcatggattttgcaatcacctttacagatttcatgttctttatatgcaggaatcggaatagcggttagcttcttcattcaatcctggtgcatctcagaaagaggtcccctgtactgtgcaatgttcaaccctttggcaacagtcatcactgctttgataagtgcaactttcctagaggaagaggtgtacgttggaagtttggtaggggctgttggagttattgccggtttatatgttgtgctttggggtaaagccaaagagtttgctgagattaaaccagaggcaccacaatcatcaaacttactagatgatgagataagtagtaggatagatttggaacaaccccttctatcagagaaattgtctgaacatgcaacagaagcagatagcaaggtgtag

SEQ ID NO: 2401 - DNA, 1934 bp, Glycine max var. Williams 82
ataggaaaaaaatcattaccttactcatcttattttaaacaattttttttctctgttaataatgataaatttatagaaaagtggattacaaattgagtttgtcttgatataaatagatctacccccttctcttcctcttcatatatgtaatagaaggtgtcaaaggatttcaactttaggctccatctaaaaaaaatggctggtttggctagcaatcttcctctaattgttatgataggtctgcaaattcattatgcagcacttgccatattcacaagagccgctctcttagatgggttgagtacaacggtgtttgtagtatacaggcaaggcatagccactttggctttggcgcctatatttttctctcctaagaggtaataattaaaccactttctcctctttttatagcttagtctcatcttctttcactaactcacatatacatgcttacttttgataacaggagacaatcagtgaaagattctttgggattcaggagcttctttttgatgtttgtgaccgctcttgttgggtacactactctgccaaactcacttgtaacatgctgttgaatttataccaaagagaaaattttaaaacttacccttaattttttttattttttccttgcagagtcacggcaaatcagaatgcatacttcaaaggattattttatgcatcttctactgcagctaccgctatgagtaatctgataccggcattaacgtttgtaattgcagcaattgcgggatttgagaaagttgacataagcttaagaagcacggccaagatattagggacagtttgttgcgtggctggagccttaaccatggcattggtcaaaggacagaagctgttacacacggagttccttccttctatacatctcaccggcagtcaaggtgatgattggctgctgggttgcctattgctcttagcaagcagtgttttttggtcatgttggatgatcctgcaggtaccaatcacttcgtgctgcccagaccatttattatcaaccttttggatgtgtctgttttcaacaatacaggctgccctatttgccctgctttcagagtcggatcttcaagcatggattttgcaatcacctttacagatttcatgttctttatatgcaggaatcggaatagcggttagcttcttcattcaatcctggtgcatctcagaaagaggtcccctgtactgtgcaatgttcaaccctttggcaacagtcatcactgctttgataagtgcaactttcctagaggaagaggtgtacgttggaagtttggtaggggctgttggagttattgccggtttatatgttgtgctttggggtaaagccaaagagtttgctgagattaaaccagaggcaccacaatcatcaaacttactagatgatgagataagtagtaggatagatttggaacaaccccttctatcagagaaattgtctgaacatgcaacagaagcagatagcaaggtgtagccatgatgattaaacaaatagaagttttggtgaagttttgatcatttcagaattgaagaaactgaaacatggaacaagttgcagcttaaacaaatttggcttaatttctttcaccaaaatttctaacgaatagagtgtgaaaataaattcaagctcatggcctggactaatggtaattatgtaagagtgataatatgttttaggagaaaaaaagatatgaattaaattttgtttccttccatctcgttttcttacatccgttattccgattatgctgggaaaattaggagtgctgagctcgtattattattatttttcctgtaaattgtttccctcatgtttgtgttttattttcatcatagatattgcaaaccacttattcatttttaaaatttaaataaatatcctatatgagaaaataaataaaaaattatgcaacgaaaaa

SEQ ID NO: 2402 - DNA, 1876 bp, Glycine max var. Williams 82
ataggaaaaaaatcattaccttactcatcttattttaaacaattttttttctctgttaataatgataaatttatagaaaagtggattacaaattgagtttgtcttgatataaatagatctacccccttctcttcctcttcatatatgtaatagaaggtgtcaaaggatttcaactttaggctccatctaaaaaaaatggctggtttggctagcaatcttcctctaattgttatgataggtctgcaaattcattatgcagcacttgccatattcacaagagccgctctcttagatgggttgagtacaacggtgtttgtagtatacaggcaaggcatagccactttggctttggcgcctatatttttctctcctaagaggagacaatcagtgaaagattctttgggattcaggagcttctttttgatgtttgtgaccgctcttgttggagtcacggcaaatcagaatgcatacttcaaaggattattttatgcatcttctactgcagctaccgctatgagtaatctgataccggcattaacgtttgtaattgcagcaattgcgggatttgagaaagttgacataagcttaagaagcacggccaagatattagggacagtttgttgcgtggctggagccttaaccatggcattggtcaaaggacagaagctgttacacacggagttccttccttctatacatctcaccggcagtcaaggtgatgattggctgctgggttgcctattgctcttagcaagcagtgttttttggtcatgttggatgatcctgcaggtaccaatcacttcgtgctgcccagaccatttattatcaaccttttggatgtgtctgttttcaacaatacaggctgccctatttgccctgctttcagagtcggatcttcaagcatggattttgcaatcacctttacagatttcatgttctttatatgcaggaatcggaatagcggttagcttcttcattcaatcctggtgcatctcagaaagaggtcccctgtactgtgcaatgttcaaccctttggcaacagtcatcactgctttgataagtgcaactttcctagaggaagaggtgtacgttggaaggtaattaatacactactagtattatttttctacgtaccttttatctattcatgaagaaactcaaacatcattattattattagtattatatgtgtggcctgatcataattcatatgcgtgattcattttcagtttggtaggggctgttggagttattgccggtttatatgttgtgctttggggtaaagccaaagagtttgctgagattaaaccagaggcaccacaatcatcaaacttactagatgatgagataagtagtaggatagatttggaacaaccccttctatcagagaaattgtctgaacatgcaacagaagcagatagcaaggtgtagccatgatgattaaacaaatagaagttttggtgaagttttgatcatttcagaattgaagaaactgaaacatggaacaagttgcagcttaaacaaatttggcttaatttctttcaccaaaatttctaacgaatagagtgtgaaaataaattcaagctcatggcctggactaatggtaattatgtaagagtgataatatgttttaggagaaaaaaagatatgaattaaattttgtttccttccatctcgttttcttacatccgttattccgattatgctgggaaaattaggagtgctgagctcgtattattattatttttcctgtaaattgtttccctcatgtttgtgttttattttcatcatagatattgcaaaccacttattcatttttaaaatttaaataaatatcctatatgagaaaataaataaaaaattatgcaacgaaaaa

SEQ ID NO: 2403 - DNA, 555 bp, Glycine max var. Williams 82
atggaaaacagagcgcgcctcaaagttcaaaagaagagacccattaagcgcagcggaaggaaagtgttactgaaaaatgttttagattatcttaaggctgatacttacatgtatgcccctctcctctctcctccaacctctgattttccctcacccaacgccttcccttcctcagctaaaggggtggaatataaaaaaccagtaacagagaagcagtggtttgggaaacaagttggaaagtatctcaaatatgatggttatatgtatgatccgctgcttcgtcttccccattcatctctagaacctttgcaggactgtggaatgatgaggatggatgattcagctagaacgttgagaatgaaagttaaccaacgaactaatcatttaggaaatgcaaaccaaagttctgaaagtcatcttcctcaaacagacctctctgatcagcatattgggggacacacggaaactgtgaagcatactgtgtaccaaagttgtcgctcaacttctgccacaagaattgttaccctcaactcgcagccgagagctcatagttga

SEQ ID NO: 2404 - DNA, 2094 bp, Glycine max var. Williams 82
atgctacccatgtcgccgagccaaggcgcgcgtttcgaccgcgagcagtggaaggcgtatgtgctcgcgaacaggatcttcgcagaaaaggtcaccgagattatcaacccggacgaggattatgtctgggttcacgattaccacctcatgatactacccacgttcctccggaagcggttccaccgtgtgaagctgggcttcttcttgcacaacacgtttccgtcgtcggagatataccggactctacccgttcgcgaggacatcctccgcgcgtttctgaactgcgacctgatcgggttccacaccttcgactacgcgcgacattttttgtcgtgttgtagcaggatgctggggctggattacgagtccaagaggggttacattgggttggattactacggtcgcaccgtgacggttaagatcctccccgcggggattcacatggggctcttggagtcggtgttgtctttgccgcagacggcgttaagggtgaaggaattgaagaaggagtatgaaggaaaggttgtgatattgggagtggatgacatggacttgttcaaaggtattagtttaaagttcttagctttggggaagcttctggaagtggatgaaagcttaaggggtcgtgtggtgttggttcagattctgaacgcggcgaggagcagagggaaggacattcaggacgtgaagaacgagagcgaggccattgccagagagatcaatgagaaatattcacaaccggggtaccagcctattgtttacatcaatggaccaatctccacgcaggagaaggctgcgtattacgctgtttctgagtgctgcgttgtgaatgcggtgagggatgggatgaatttggtgccttatgagtacactgtttgcaggcaggggagttttgctttggacaaggcgcttggcgttgaaggtgaggataagaaaacccttaagcagagcgttatcatcgtgtctgagttcatagggtgttccccttcgctcagtggagccatcagggtgaatccgtggaacattgatgaagtcgctgaggccatgaattcggctgtcacaatgtcggaggcagagaagcatttgcgccacgagaagcattacaagtacataagctctcatgatgtggcttactgggcaaggagttttgatcaggatttagatagagcttgtagggagcattactctaagaggtattggggtgttggattgggcttggggttcagaattgttgctttggatcctacctttaggaagctctctgtggatcacattgcctctgcatatagagatacacacagtcgattgatccttttggactacgatggcaccatgatgccgcaggcgacaatcaagactccgagcaaggaagttattactgtcttgaattatttatgcagtgatcctgaaaacatggtgttcattgtgagcggcagggataaggattgcttgagcaagtggttttctccatgtgagaaattgggtctctctgctgagcacggttacttcactaggtggaccaaggattctccttgggagacttgcggattgacgaccgattttgaatggaaaatgattgcagaacctgtgatggcgctttatactgaagcaactgatggttccttcattgaacataaagaaagtgcaatggtttggcaccatcaagaagcagatccttattttggatcatgccaagcaaaagagcttcttgatcacctggagagtgtgcttgccaatgagccagtaggggttataaggggacaacatatagttgaagttaaacctcagggtgtgagcaagggtaaagtggtggaagaccttatctcaatcatgcgaagtaaggggaagtcaccagattttctactgtgcataggagatgatcgctcagatgaagatatgtttgaaagcattgctctttcagtatctaatccagctctttccaccataatatcaaaagtgtttgcatgcactgttggacaaaaaccaagtatggccgaatactatttggatgatactagcgaagtaatcaagttacttgaaggacttgcaactgcagcaggaccttctgcgtccataatttatcaggatttgtga

SEQ ID NO: 2405 - DNA, 1143 bp, Glycine max var. Williams 82
atgggatcctccatcagttgctgcggctcggagagggtagaagaagtaccaacatcatttggcgtagttcacaattcatggagaatattcacatacaaggagttgcatgcggccaccaacggattcaatgatgataataagcttggtgaaggtggttttggaagtgtctattggggaagaaccaacgatggtcttcagatagcggtgaagaaactgaaagcaatgaactcaaaggcagagatggaatttgctgtagaagttgaagttcttggaagggttaggcacaaaaatttgctgggtcttaggggttattgtgttggagatgatcaacggctcatagtctatgattacatgccaaatctcagcctgctttctcatctgcatggccagtttgctgttgaagtgcaactcaactggcaaaggagaatgaagattgcaattggctctgcggaaggccttctgtacttacaccgtgaggtcgcaccccacatcatccatagggacatcaaagcaagtaacgtgcttctgaattcagactttgagcctctagttgcagattttgggtttgcaaagctaatcccagaaggagttagccacatgactacccgtgtgaagggtacattgggatacttggcacctgaatatgccatgtggggaaaagtctccgaaagttgtgatgtttatagctttggaattcttctcttagaacttgtaaccggtagaaagcccatagagaagctcccaggtgggctcaaaagaacaataactgaatgggccgagcccctaataaccaacggaaggctcagggaccttgttgatccaaaactaagagggaactttgatgaaaaccaagtcaagcaaacaatcaatgtggctgctctttgtgtccaaagtgagcccgagaaacggcccaatatgaagcaagtggttaaccttctgaaagggtatgaatttgaagagaagaaagtcactgccatgagaatagatagtatcaagtataatgaagaattattggcacttgatcaacctagtgatgatgatgatcatgatgatgcaacagctagctatggtgtttttagtgccattgaagttcaaaagatgaaggatccatacatgcgcggtgataacaagaatataggctaa

SEQ ID NO: 2406 - DNA, 1438 bp, Glycine max var. Williams 82
aaaagttgagttagccggccaaagtcgttcggccggcattaattacatgtgtgatttgagaggaccaaattaaaccactgcagtatactttaaaaagaaaaaaaaaatcatttgggcacaagctccttaagttgagcactccattattccataacattgtgccaattatgggatcctccatcagttgctgcggctcggagagggtagaagaagtaccaacatcatttggcgtagttcacaattcatggagaatattcacatacaaggagttgcatgcggccaccaacggattcaatgatgataataagcttggtgaaggtggttttggaagtgtctattggggaagaaccaacgatggtcttcagatagcggtgaagaaactgaaagcaatgaactcaaaggcagagatggaatttgctgtagaagttgaagttcttggaagggttaggcacaaaaatttgctgggtcttaggggttattgtgttggagatgatcaacggctcatagtctatgattacatgccaaatctcagcctgctttctcatctgcatggccagtttgctgttgaagtgcaactcaactggcaaaggagaatgaagattgcaattggctctgcggaaggccttctgtacttacaccgtgaggtcgcaccccacatcatccatagggacatcaaagcaagtaacgtgcttctgaattcagactttgagcctctagttgcagattttgggtttgcaaagctaatcccagaaggagttagccacatgactacccgtgtgaagggtacattgggatacttggcacctgaatatgccatgtggggaaaagtctccgaaagttgtgatgtttatagctttggaattcttctcttagaacttgtaaccggtagaaagcccatagagaagctcccaggtgggctcaaaagaacaataactgaatgggccgagcccctaataaccaacggaaggctcagggaccttgttgatccaaaactaagagggaactttgatgaaaaccaagtcaagcaaacaatcaatgtggctgctctttgtgtccaaagtgagcccgagaaacggcccaatatgaagcaagtggttaaccttctgaaagggtatgaatttgaagagaagaaagtcactgccatgagaatagatagtatcaagtataatgaagaattattggcacttgatcaacctagtgatgatgatgatcatgatgatgcaacagctagctatggtgtttttagtgccattgaagttcaaaagatgaaggatccatacatgcgcggtgataacaagaatataggctaaagcccaaagattatatatatatatatatagagagagagagagagagagagagagagaatttatttgttttgtgaagcctttatatctattggtaatgtaatcaactttcaacttctaagtataatttt

SEQ ID NO: 2407 - DNA, 1815 bp, Glycine max var. Williams 82
atggtacttccctgccctgcccaaatactagttggcctctccttagacccagatgacagcaaggagcttctgtcatgggcaataagagttctagccaatccaaatgacaccattgtggctgtgcatgttcttgttgctgcggataagaagaagcgtgtctcagtcagaagaaggcaatcacaacttaggcaggcaaaagcatatgttatatctgtgcttggagaatttgcacagtccagttggtctaagcaggttaatttggaggccagggtggcactcaattccacagttggtgaaggtttagtggaggaagtcaagtccatcaatgctgactatcttcttatccgtggctcaagaaaccgaacaaataaaattggaacttctaaaggaatcaccaagtattgctttgagcatgcacatgatgggtgtacaatggtctcagttgggagacgtacaaaggcagatcaaaatgccaattcaaactcaacacgttttcaagataaaaaacaaccaagttcaagatggtttaagaagaataaccaatatggcaagggtgcctcccctattctggaggattatatatcaggaaccaaggctcagaaccgttcaccaagaacagtactagatggtctagagggacaatcgaacagcactgaagatgatacctttagcactagggtctcaagcaccacaaataccccatcatcggattctaagaggcgatccaagataagaaaaccacagttcccattcaggttcatagtctcattccttgcttcaccatttagaagcaaaaactttagcatatccaaaaatgaaaagcgtcagcctttgttgaagtgcttcagctatgaacagatttccaatgctaccaaagacttccaccaagataatttggttggacgaggtgggtactcggaagtatacaaaggtgatctttcagatggacgaaccattgctgtgaagaggttggccaaggacaacaaggatcctaacaaggaaaaagagttccttatggaattgggtgttattggacacgtctgccatcctaatactgcaactttagtgggctgctgcattgaaaatgggctttatctgattttcaattactctcaaaatggaaatttggcaactgcactgcatggtaaagctggagatccactagactggccaatcagatacaaaattgccattggtgttgcaaggggccttcattatcttcataaatgttgcaaacaccgaataattcaccgtgacatcaaagcttctaatgttcttctgggtcctgattatgaaccacagattaccgattttgggcttgcaaagtggcttcctaacaagtggactcaccatgctgtgatccccgtggagggcacatttggatacttagcaccagagtactttatgcatggaatcgtggatgagaaaacagatgtttttgcatttggaattctacttttggagattgtaactggacggagacctgttgattcttcaaagcaaaaccttctcctatgggcaaagcctctgatggaatcagggaatattgctgagctagctgatccaagattggaaggcaagtatgatggagagcaactctatagggtagtgctaacggcttcatactgtgtgagacaaactgccacgtggcgtcccccaatgagtgaggtattagagctgctaactagtggccaagagagtgaggttggaaagagctggaggatcccaaagttcacttctgatgaattggatgattactccatggttttcggatatgatgtaccctcagacgtatctttggaggattatctgtga

SEQ ID NO: 2408 - DNA, 882 bp, Glycine max var. Williams 82
atggttgttttctcttgtgttaaaacaatggttgtgcttgtccttgcgtttctaatctctgtgccttctatggttgcttctgctgtcagcttgtaccaagatgttgatgtcacgtggggagatggcagaggtaagattctgaacaatggtcagcttcttactctgtctctcgacagagcctctggctctggctttcagtccaagaatcagtatctatatggcaaaattgacatgcaaatcaaacttgtccctggaaattccgctggcacggtcaccgctttttacttacgttcagaagggtcatcttgggatgagatagactttgagttcctgggaaatctgagtggtgatccttacatagttcatactaatgtgtacacacaaggcaagggtaatagggagcaacaattctatctttggtttgacccaactgcagattttcacacctattcctttctctggaatcctgcacatgttgtattctatgttgatggaagaccaattagggagttcaagaacttggagggtgcgggtattgaatacccaaagaaacagcctatgaggttatattcaagtctatggaacgctgatgactgggcaacaagaggagggcttgtgaagacagattggagtgaagcaccattcactgcttctttcaggaacttcagagccaatggttgcgtttggtccaatggggtttcttcatgcaactccagcacctcttctgaaaaagcttggctatattctcaacagcttgattccacaaaccagaagaagctaaaatgggtgcagaagaattacatgatttacgattattgcacagacctcaaacgattccctcagggtcttcctctggaatgcacggttcgcaccaagtcataa

SEQ ID NO: 2409 - DNA, 2850 bp, Glycine max var. Williams 82
atggcagctgacaaggcagcaatcagcctcgaggaaatcaagaatgagaccgttgatctggaacgcattcctattgaggaagtgtttcagcaattgaaatgtaccagagaaggattgtcctcggacgaaggagccaatcggcttcaaatatttgggccaaacaagctagaggagaaaaaggaaagtaaatttctcaagtttcttgggttcatgtggaatcctctgtcatgggtcatggaagctgcagctgttatggcaattgctcttgcaaatggggatgggaagcccccagattggcaagattttgtgggtattgtttgcttgttggtgatcaactccaccatcagtttcattgaagaaaataatgctggtaatgcagctgctgctcttatggctggtcttgctcccaagacaaaggtccttagagatggtaaatggactgaggaagaagcggctattctagttcctggagacatcataagcatcaaactaggagatatcattcctgctgatgctcgtcttcttgagggtgatcctttgaaggttgatcaatccgctttgacaggagagtcacttcctgtaaccaggggtcctggagaagaagttttctctggctcaacttgtaaacaaggtgaaattgaagctgttgtcattgcaactggtgtccacacatttttcggcaaagcagctcacctggtggatagtaccaaccaagttggacatttccagaaagtgcttacagcaattggaaacttctgtatttgttccattgcagttggtatgttggctgagatcatagtcatgtacccaattcagcaccgtaagtacagagatggaattgacaaccttttggtcctcttgattggaggaattcccattgctatgcccactgtgttgtctgtgacaatggccattggttctcataggctctctcagcagggtgctataaccaagagaatgactgccattgaagaaatggctggtatggatgtcctttgcagcgacaagacaggtacactcacacttaacaagctgagtgttgacaagaatttgattgaggtcttcgcaaagggtgtggaaaaggatcatgtgatccttcttgctgcaagggcttccaggactgaaaaccaggatgcaatagatgctgccattgttggaatgcttgccgatccaaaagaggcaagggctggggtaagagaggtgcacttcttaccatttaatcctgtcgacaagagaactgctttgacttacattgatgctgatggaaattggcaccgggcaagcaaaggtgctcccgagcagatcatgaccttgtgtaacctcagggatgatgcaaagaggaaggtccatgctattattgataagtttgcagagagagggcttcgttcacttgctgttgctagacaggaagttcctgagaaaacaaaagaaagcgctggtgctccatggcagtttgttggtttgttgtcactgttcgacccccctagacatgacagtgctgaaactattcctagagctctccatcttggtgtaaatgtcaagatgatactgggaagtatccaggagaccggccgaagactggggatgggaactaatatgtacccatctgcttctttgcttggtcaagacaaagatgcaagtattgctgcacttccagtagaagagctgattgagaaggcagatggttttgctggagtatttccagaacacaaatatgaaattgtaaagaagttgcaagagaggaagcacatctgtggaatgactggagatggtgttaatgacgctccggctttgaagaaggctgatattggaatcgctgttgctgatgcaactgatgctgccagaagtgcttctgatattgtcttgacagaacctggtttgagtgttattattagtgcagtcttaactagcagggctattttccagagaatgaaaaactacacgatatatgcagtatctattactatccgtatagtgtttggcttcatgttcatagcactgatatggaaatttgacttctctccttttatggttttgatcattgctattctgaatgatggaacaatcatgacaatttcaaaggacagggtgaagccatctcccttgcctgatagctggaaactgcaagaaatatttgctactgggattgtacttggaagttacttggcgctgatgactgtcatattcttctgggcaatgaaagaaaccgatttcttccctgacaaatttggagttagacacttgagtcatgatgagatgatgtctgctttgtatttacaagtcagtatagtcagccaggctttgatatttgtaacccgttctcgaagctggtcctttattgaacgccctggaatgctgttagtttgcgctttcgttattgctcagctgattgctacaatcatagcagtatatgctgactggggctttgcaaaggtgaaaggaattggttggggttgggcaggagtcatctggctctacagtattgtcttctatattccacttgatgtcatgaagtttgccacccgttatgtattgagtggcaaggcttgggtaaacatgctagaaaacaagactgccttcaccaccaagaaagactacggtaaggaggagagggaagctcaatgggctcatgctcagagaaccctgcatggacttcaaccaccagaaacttctggcattttcaatgagaagaacagttatagagaactctctgagattgctgagcaggccaagagaagagctgaagttgcaaggcttcgtgagcttcacacactgaagggacatgttgagtctgtggtgaagctgaagggtttggacattgatacaatccagcagcactacacggtgtga

SEQ ID NO: 2410 - DNA, 3863 bp, Glycine max var. Williams 82
cttgtccttgatttagtgcatctttaattctttcccttttatgccccaccgagaagttgcctacttaagctcccattcctctttcaccgcttcacaccactggcatcaccaccacattctttatctttatgcgcgcttagaagaattgaagggattttgataaaaatcaaagctttggaatttcactcatcatggataaggcagagaaagctgtgcagaagagctactttgatgtattgggtttgtgctgttcctcggaggttcctcttattgaaaacatcttgaaacctctcgaaggaatcaaagaagtttcagtcatcgttccatcacgaactgtcattgttgtccatgacactcttgtcatttcgcaacttcaaattgtgaaggcactgaatcaagcaaggctagaagcaaatatcagagtgtatggggacgaaaagcaccaaaagagatggccaagcccttactcaattgcctctggtgtgttacttttgctttctctcctcaaatttgtgttccatcccttaaaatatttggcactaggagcggttgctgtgggtgcctacccaatcatcttaaaggccattgtctccattcggaaccttaggctggacatcaacattcttatgcttatagcagttattgggacaattgttatgaatgattatttggaagcaggcaccattgttttcctcttctcaattgcagaatggctagagtcaagggcaagtcataaggcaaatgcagtaatgtcatcgttgatgaacataacccctcaaaaagcagtcatagctgaaacaggagaggttgtggacgctgatgaggtgaaaatagacactgttttagcagttaaagcaggcgaggtgatacccattgatggagttgttttagatggaacctgtgaagttgatgagaaaactttgactggggaatcattccctgtggcaaaacaaaaggattctactgtatgggctggcaccatcaatttaaatggttatattagtgtgaaaactactgcactagctgaggattgtgtggtggctaaaatggccaagcttgttgaagaagctcaaaacagcaaaaccagcattcagagattgattgacaagtttgccaagttttataccccaggcgttgtaatcatatcagctcttgtagcggtgattccacttgcgttaaaacaacataatgagaaacattggcttcattttgcactggttgttttagtaagtgcatgtccatgtgcactcatcctttcaacgccagttgcaactttttgtgcttactccaaagcagccacatcaggtcttctcatcaaagggggtgatcatcttgaaacacttgcaaaaattaaggtcatggcctttgacaaaacgggtaccataacgaagggtgaatttgtggtcacacattttcaatctctttcagatgacattgatttgaacacattggcttactgggtgtcaagcatagagagcaagtcaagccatccattggcagcagcaattgttgattatggaaggtctctctccgttgaaccagagccagaaaaggtgactgaatttgaaaatttccctggagaaggaatatgtggtaaaattgaaggcagagttatttacattggaaataaaaaaattgccacaagagctggttctgaaacagttcctatcttacaaggtgaaattgaaagaggaaagaccactggatacatatacttgggagcaaccccacttggatttttctctctttcagatacctgcagattaggggttcaggaggcaatagggcagttgaagtcattgggaatcaaaaccgctatgctcactggagatagtcaatctgctgcaatgcaagcacaggagcagctggggcattctctggagttagtccatgcagaacttttgccagaggacaaggtcaaaatcatctcagaatttaagaaggaaggcccaacagccatgattggagacggcctaaacgacgcgccggcattagctgcagctgatattggaatctcaatgggcatttcaggttctgcattggcaagtgagacaggcaatataattcttatgtcaaatgacattaggaagataccagaagccattaaacttgcaagaaaagctcgtaggaaagtgttagaaaacattgttttgtcaatcatgactaaggctgcgattcttggtttggccattggtggtcatccacttgtttgggcagcagttgtggctgatgttggaacatgtctattggtcatctttaacagcatgttacttctgcgaaaaggacacaaccatggaggaaaatgttgtagatcttctactaaaccacataaccacaaaaatggatgtggtggcagtcatggtagttcctctcatcatcaccatcatcatgagcatgatcaacaacatcaacatgagcatcatagccacaagcattgttgctcagacaagacaaaaaagatgtcccaacctcagaaatgtggtggtgctcatggtagttcctctcatcatcatcaccatcaacatcaacatgaacaacataaccatgaccaacacgatcaacatgaacatcataatcatgaccaactcgatcaacgtgaacatcatggacatagtcaacatgatcaacatcatcagaagtgtgcctcacaaacatgttcctcaacatgtccaccctgctcttcaaattcaagttttggtggaattgttaaccattgtaacaccatgaaggctcatgatcaatgtaaaggaagtgatgaattccatgaacatgatcactgtcatcatggaagatgtgacaagaatcacgatgaagtccacaagcatgacaccgaagataatcatgcagttgcagaaaaaaggcatggtagttgtttgggacataagaaccatgggacaaagcactgccacaaccaaaatcttgacaaggttactcatgatagtgcttcacatagttctccttgccacctcaatctcccttgtaaaaaagaaagccaacaatttactcataatcattgccacctgatccatggttgtgaaaatctgaaagaccatgaatccaaagatgttttaagatccaaccatgacatccagcatgaaaaatcaggttgtcattctgattttgagaagcatgagacaggtgaaatatccattgacatcatcactgagtatgttgaattagcttcaagtttggaggagaaaggaaaaggttcctgcagggaagactgctcagacacatgcgggaatttggctgctgtgtgtggctgtgagagttcaaatgagagagaagacatcgcatgttgcagaaacgaggactcttcaaaagaatgcaaggaatctccaattatgcatgtttgtgatggtttaaataagagagaagttggtggatgttgcaagagctacatgaaggaatgctgtgccaaacttggtcactcatcaagacctagatttgtaggaggtttgtcagaaattattacagaataggtgcagttgactccagcgtaagcaacagatgtcagcatgctagcttgttcttgcaaatttatatttatttagaagatttttagtgacatgaatgaaagcccgtaaaatattactgctcatgtatatagtttgaggagcttgacatgaccaacatagatttttacgtaagtctggtatggccctttattttggggttttagttatagggaattgggctcctaaaggagaaggggaattcactttggcagttgtttggatatatgttaagggcttcttcctttttttatatttaatatatgttgcttatatactatactatgaacgtagtactcattaacattaatataagaagttgacaactatatgtcaatctcatctcaa

SEQ ID NO: 2411 - DNA, 1161 bp, Glycine max var. Williams 82
atgaaggtaaccaaagggaaggaaactaaaattgttctgacaaaacccttccaattggaaggtgaatcagatttagaaccgtcttatagagctcccaatctcctacatcgcttgttaagtttactcaagaacgtgcggccaggatcagatctcacacacttccaactgccagctgtgtttaacttcccaaaatctcaacttcaatgctatggtgaatcagtgtactgcacatcttcaaacttgctgagcaaatgcaacaatgggcagagtccactggacaggttcacatcagtagtagcatggagcatatctaccacacgccccacatcttttggtgttgctccttataatcccactcttggagagacccaccatgtttccaagggcaatctcaacgtcctagttgagcaggtatcagtcaaccctccagtatctgccctccatgcaacagatgagaaggaaaacattgagatgatatggtcccagcaacctgttccaaagtttcggggtacatctattgaagctcaagtgcatggtaaacgtcagctgaagctcctaaatcatggagaaacatatgaaatgaattgtcctcacctttcaattagaattcttccggttcctgggattgattgggttggcaatgttaatataaggtgcccagagacaggtctggtagctgaaatatcatacagatcaagccattcttttctaggatttgggggaagtcgtaaatttatcaaagggaaaatccttgactcatcattattcaaagttctctatgaagttgatggtcattgggataagacagttaaagtgaaggatacaaatagtggagaagtgagagtgatatatgatgcaaaagaagttatttcagggctcaaaactcctattatcaaggatgcggagagtgtgtggccaaccgaatcagcccttgtttggagtgagttgagccaagccattatgaacaaagattgggaaagagcaagagaagcaaaacaagatgtggaagaaagacagaggaaggtgttgagagacagagccatgaaaggagaaacttggtttcctaagaattttagggtgtcctacggtaaagacacgtgggaatgggactgttcaccaactcataaatgggtccctgaggcccccatcatagctcaataa

SEQ ID NO: 2412 - DNA, 723 bp, Glycine max var. Williams 82
atgggaatcagtaaaacagaagtaaacttgaagaggttgcttgcagctgctcctcagcagcaaaaccaggcaaaacttgtgcattatgttgctactttgcgtgaacaattggaacaattggctgaggaaagggcaccggaaggcttaccaaggatttcaaaggctgtgttgaatgattattcagagaagattgaagccattgcttccaaattggttaatcatgtgagtgacccaccagtacccaagaaggacttcgaaaggaattctgttgaagaaaactcttctgaaatagaggaaacaaagcagatactcctttcttctggactgagaagaaggcctgtacctgcctcaagtacggaagaaagagcacacaagcctgctgagactgatcatatatcacctgttaaactggatgctgcagcacatgcacacattgaaaagcacagaatgcttcaagataatttgactgatgagatggtagtgttggcaaaacaactcaaagagagtagtctcatgatgagccagtccctgcaaaacactgaaaagatacttgattctaccgaaaaggctattgagcatagcttggcaagcaccggtcgtgccaatgtgcgagcaacggcaatatactcggagagttcaaagacttcttgcttaacatggcttgtgatgtttgtgatgacatgtgtgtttgtcatggttattcttctaatccgtgtcacatag

SEQ ID NO: 2413 - DNA, 5411 bp, Glycine max var. Williams 82
atcaaaacaccggactccatggcttcgccttgtacgaatttggagctccaactcagagtcgggcaactcaactcttcctaattccaactttcccttcgattctctccatcgccaattgcactctctcatcgttgcgatattcaaggtcttcaaatttgaatttcgctctatttttttccatctctcctgattcaacttctagggttttgtttttctgcagtttgtaatgctcttgctgcttcacgaaggtgctttgttcaattgttctcttgtaatttagatttgccctttatgtgccatagtgctgcatccttgtcatgcaccagtctctgctctgtatttttgactcaaaggatgtgtgggaactagggcaatggcaacatctagcaagtttgatccatcttctagtagcccggacaaaccattgtaccctgggcaacgtggatcccacatagctgcttcattagatagatcaggtagctttcgcgaaagcatggaaaatccaattctgtcttctcttccgaacatgttaagaagcagttctctagcaacaaatggagatgtggaaagcttcttcaattatgtgcgttttgatccaaagttgttaacactagagcataagtctaatcgtcaaatggattttaagcgacatgttaatgctgctcttggaatttcacctgatgaatctccatctagttcttcaaaaggcaagctactgccatcgcctgtaccagaagacatgaaacgggtaaaggatgctttgggtgcaaacattgtgaaggcaagggaacgtgtgaaaatgtttagtgaggctttatctgtattccatgaagttttcccagctataacttcaaagaaaagatctcgagctgaaggtttttctaatgaccgttctaatgtcatgttaagtgatcgtccagtcttggggccaagcataggcaaggttggagttcaaggtcatcctgtcacaggtggttttgaacttgagcagcaaaagtctgatgaacgtaccaaaaatgttgttccaaacaagcgcactcgaacttctatggttgatgtaaggatggatgtgcggactaattctctcgtcaggccatcagggacagttgacagagataaggaaaagctacggattgccaacaatggtgtcgttcagagtgaagaacgaaccttacctattggaggtgatggttgggaaaagtcaaaaatgaagaagaagcgttcctgtatcaaactagatgtttctccaagtacaacattgactaaacctgttaacaccttccaagaaactaaacagggaatgcaacaaagacttgctaccgattcgcgatcaaaattgactaatgattctcattctttcaggccagtagtttctaatggaactgttggagctggaaaatcagatggtatctctcaacaaactgggttgggcatacgagcttctacccctagaaacaaccaagataataattcccttgtcaatgataggaggggtcgtcctgttagttcagacaaggaaagggtgaacttcagagctgtaaacaaggcaactgcacgtgatgaatttaattcagctagccctacctcaagtgccaaaataaacactgctattcgggctccacgatcaggttctggagttgcccccaagttgtcaccagttgtccatagagcaggtgtttctaatgattgggaactgtctcactctaccacaaagccccctgctgctggtggtactaacaatcgtaaacgtgtagcatcagcacggtcatcttccccacctgttgtcccctggcagagaccacaaaagagctctcgcactgctagaagaacaaatttcatgcctattgttccaaatagtgatgaagcttcagctttggatactgcatctgatgtggctggtaatgatcttgggttaggatttgccagacgcttggctggcagttctcctcagcaaattaaacaaaaaggtgatccttcatcttcagctgccttgtctgaaagtgaagagtcaggggtagctgatgttaaaccaaaagaaaagggtaggaaagcggaagagatagatcagaaatctggacaaaatgttcaaaaggtgtctaatatggtattgccaacaagaaagaataagcttgtttctggggaagaacatggagatggtgttcggaggcaagggaggacaggacgcagtcttgctgccacaaggtcaatgattccaatgacatctgagaagcttgggaatataggaactgcaaaacagcttagaagtgcaagactaggatccgataagaatgaaagcaaggcaggtcgtccaccatccaggaaactttctgatcgcaaggcctatgcacgtcaaaagcctgctattaatgcagctgcagatttttttgttgggtcggaagatggacatgaagagctgctagctgctgtaaagggtgttatcaactctgctcatgcattctccagccccttctggaggcagatggagcctttcttcagtttgataactgaggaggatattacttactggaagcaaaaggtaaatcttgaatcaagcactctgacaccaactcccgttccttcaaatatagatggctgtgaaaccattgttaatggatatgggttgatgggctgtgaaagagatgctggatttgatgctcaatggaatgctggaattgttgcagaacagtcacaactatctaagggagatcataatgtgattcctctctgtcaaaggcttatagctgctttaatctcagaggaggagtgtagtggtggaagtgaacacttcaagtttgatgcatatgataatgaatttgagcctgatcgggaaccagaattgaatggtttggatcaccactcaggaacagattttcagtttgcttgtcattctgcttataatggtttcaggattttggacaagccagaacaggatgaaactgaaagggatatagttggtattcctccaactgggttgaattcaagctttgataaatccgtaaatggttttcttcatgataaagcaatgtctagcttcacctgttcagagttacaatatgatagcttggatataaatgataagcttctcttggagcttaaaagtattggaatttccccagcaccagtgcctgatatgttgcaaacagatgatgaaggaatatcagaggatattattaggttggaggagctttacctaggacagatttccaagaagaaaaacttgctatatggattgttcgaatctgcctcagtggataaagaacttcaagaaaaggattttgagcaacgtgctctagataaacttgttgtgatggcttatgagaaatacatggcttgttggggtcctagtccctctggtgggaaaaatacaagcaacaaaatggccaagcaagctgcattgggatttgtcaaacggacattggggcgatgccatcaatttgaagatactggcaagagctgcttcagtgatcctttattcaaggatatgttccttgctgaatcctcaaaaccttatgcctcttccctttctgtggaagcaagaacagcttccatgggttcacagcagagcccatcacagtttagtcagaatatggataatcatgatctcaattcatcagatgtgcttcctggtttaaattactcatctgagcaaacaagtgggaaggaagatctctggtcaaacagagtgaagaagagggaattgtcccttgacgatgttggcggtactccaggtatttctagtgctccaggcatcggaagttctgtaacaagcagtgcaaaaggaaagagaagtgagagagacagagacggaaaggggcacagcagggaggtactatccagaaatggaactactaaagttggtaggccagcatcatccagtgctaagggagatagaaaatctaaaacaaagcctaagcagaaagcaactcagaattctgtttctgtgaatggcctccttgggaagctaacagagcaaccaaaaccagcattgccttctgttccaaagtctaatgaaatgcctacaaatagcaatgcaaaggaaaaggatgagtttggcttgggtggattggatgaccacgagcctattgacttgtccaacctgcagctacctggaatggatgtacttggtgttggtgatgaccaaggtcaggatcttggttcgtggttgaatattgatgatgatggattacaagatcatgatgactttatgggcggccttgaaatcccaatggatgatctatcggacttgaatatgatggtttgaagctgctttttttgtatagtcctgttcagtataccaataacaaagcaaacaaagtacgttgaagaaatgactagttacataggatggtcttatggctaatcccgtccacaattaggttatatagattctttggtagactattccctccaagttgtttttgagtgacctttccagctgtttcggattttgctcgtgttaaagttcatgacttccactgtaaagatctttttgttcaaggtacaagttagcattcctggtaattatatcttagcaaacacttcctggttgtagctcttacaaatcagagaacaagacctcttgtacatacatttaatatttctaataaaatcagcttttcatttgccgaaattacacctagctggtcactctgttggtctcccttctctccccctgctccttgggttttcttttcctggcactttgtgttttgcagatacgtaactcaatgtgatatagtgcaagtggtttgcttcagtggcttcatccagataatccagttgctgtgctactttaggtatatgaagcagattctgggtatttcatcgctcagtctctctctctctctgtccaattaaggttgaaaatgaatctggattacacatgttgcctgatattgtaataacccatgcataaaaggtcttgcaaaagagctgagagttgttaatattcattctagttgattttgacttctcagatgccgtcattggatgaattacaacctttgatgattgaagggagacctttttgagtaatttcaagtattcttgacaggattaacctttgtaagaaattaatgtgtcagggaattttcttccctgatgaaattgagctgcagttccctttatgcagggaggtaagttttgaatcctttctggccttcctaacttcaaactttctatttaaattttcatgtgtatatagtggaagactattcgatgatattgtagtaaaattacattgggacatcaaacacgcataaaattcatgcggctcacatggattatcttcctccttaagccagagactttcctctatgtaattacatattataggttgctgtgaccagggttttcctttatattgggacttgatgtgaacaagtcaacaatttagtttagtttttaatttt

SEQ ID NO: 2414 - DNA, 1167 bp, Glycine max var. Williams 82
atggcagataactcaattagcttattttctccatacaacaagatgggcaaattcaacctctctcatagggtggtattggctcccatgaccagatgcagagcgctcaatgggactccactggcagcacatgctgaatactacgctcagagatcaacaccgggtggatttctcatcactgaaggcaccttgatctctccaacttcttctgggtttcctcatgttcctggaatatactcagatgaacaggtagaggcatggagaaatgtagtggacgccgtgcatgccaacggcagctttatcttctgtcaactctggcatgttggccgtgcatcacatccagtgtatcagcctggtggggctctaccctcttcgtccaccagcaaacccatatcagacaagtggaaaattctcatgcccgatggctcccatggcatctatccagagcctcgtgcacttaccacttctgagatatctgaaatagtgcatcattatcgccaagcagctattaatgcaattcgagcaggttttgatggaatcgagattcatggagcacatgggtatctcattgatcaattcttaaaggatgcaatcaatgatagaacagatgaatacggtggaccactagaaaaccggtgcaggttcttaatggaggtagttgaagctgttgtctctgccattggagcggaaagagttgctatcagaatttcaccagcaattgatttcaatgacgcctttgactctgacccacttgggctaggcttagcagtgattgaaagactcaacaatttgcagaaacaagtgggcacaaaactcgcttatcttcatgttactcagcctcgattcacacttttggcgcaaaccgagtcagtgagtgaaaaggaggaagctcatttcatgcagaaatggagagaggcttatgagggaacattcatgtgtagtggagcttttactagggactcaggaatggaagctgtagctgaaggccatgctgatttggtatcctatggtcgtcttttcatctccaatccagacttggttttaaggcttaagctcaatgcacctcttaccaagtataacaggaacacattttacacccaagatcctgttataggctacacagattatcctttctttaatggaacaactgagacaaaattaagtaactag

SEQ ID NO: 2415 - DNA, 756 bp, Glycine max var. Williams 82
atggcaacctctcaaatcacttcatcattgaggaacttgcctgcatttgaaaggtttcaaccttcaacgcttcgatttccttctgctgggcacgtcagaattgggacactgacacaaacctcgtttccctctttcgttgtcaaagccgccactgttgtcgcccccaagcacaccactgttaagcctctgggtgatagagtactggtgaaaattaaggatgcagaggagaagactgcaggtgggattttactgccagcaactgctcaaggcaagcctcaaggaggtgaagtggttgctgttggggatgggaagtcggttgggaagagcaaagtggatgttagtgtgaagacaggtttgcaggttgtgtattcaaagtatgcagggactgaggtggagttcaatggttcaaaacatcttattctgaaggacgatgacatcgttggtatccttgaaacagatgaggtcaaggatcttaaacccttaaatgatagagtcttgataaaggttgcagaagcggatgaaaaaactgctggagggttgttgctcacagaggcaaccaaggaaaaaccatctattggaacagtgatagcagttggtccggggcctctggatgaggaaggtaatagaaagccattgtctgtcgtgcccgggaatacagttctgtactccaagtatgcagggaatgacttcaagggcaaagatggttctgactacattgccttgagggcctcagatgtcatggctatcctgtcctag

SEQ ID NO: 2416 - DNA, 543 bp, Glycine max var. Williams 82
atgaacggtgtttctcctctagaggcccaagccttcaactacctgagcttcggtttcctcaccctcctcaacaatttctggacatggctcgccttcactttctggaggacccgagcccccacctccgagttgctgccaccacccgatgacccggttcgcgacgagtcggatcctgttgccgtgaccgggccaagtccaactgtggttgacgttgacggtgcgaggaaggggaaatttaccttgtattacgaggatgagtctgagagggaatgcgagagccaccaggagacgacggcgctaacggagagagacggaagaggcctgaagtggtgggagagttgggaagagttgttgaaaataagacgaggagaagaccagaacggatggtacacgtgccaggatttaacggtgcttaacggcagcgttgttaggttatgggatggtggcttcggctttggtacctcaccacagaacccagggacactacaagatgtgttcttgtatggtaaattatataatagcatatctaccgatatttattag

SEQ ID NO: 2417 - DNA, 882 bp, Glycine max var. Williams 82
tgaggaggcatcttaggttgtcgattcggagcatcttatgtgagatcccatattctccaaccatataataaccttcaccacatttctctctcgcattcaattaattcaacatacacgtcatgaacggtgtttctcctctagaggcccaagccttcaactacctgagcttcggtttcctcaccctcctcaacaatttctggacatggctcgccttcactttctggaggacccgagcccccacctccgagttgctgccaccacccgatgacccggttcgcgacgagtcggatcctgttgccgtgaccgggccaagtccaactgtggttgacgttgacggtgcgaggaaggggaaatttaccttgtattacgaggatgagtctgagagggaatgcgagagccaccaggagacgacggcgctaacggagagagacggaagaggcctgaagtggtgggagagttgggaagagttgttgaaaataagacgaggagaagaccagaacggatggtacacgtgccaggatttaacggtgcttaacggcagcgttgttaggttatgggatggtggcttcggctttggtacctcaccacagaacccagggacactacaagatgtgttcttgtatggtaaattatataatagcatatctaccgatatttattagcttaagactgttagattatatattattcagaatatgtgtatatggtaatttgctagtagtacttgtttggatgatgataattaatgatcatcgtgtatgataatttgaaacgcaaatgatcaaagcaatcttaatttgcgtacttttttttttttatctccttcatggatcctatgtctacattcgatttaatttgttgatggtttacactagatttttt

SEQ ID NO: 2418 - DNA, 1563 bp, Glycine max var. Williams 82
atggctattccatctcctaaaattttcctcctcttaacattcttcttctcacattctatagctgtgaagtcctccaatgtttccacaaccccaacattgcatgcaaccttcccatttcctgaagttagcagcttcaattcatctaagctttcaatctcaataaacataaatccaaacatcatcaacacccttcttcagtccctccaagcagcaatatctgaagccacaaaactatctgatctattaaacaacgctggacataacatcatagagaacaaaataggagcagtccaagactgtagagaacttcaacaatccaccttagcttccttaaaaagatcactatcaggaatccgttcccaagactccagaaaactagttgatgcaagaacctacctcagtgcagcactcaccaacaaggacacgtgtctagagagcttagattctgcttctggtacccttaagccagttctagtgaattctgtgatcaactcttacaaagatgtcagtgactctctctcaatgctccccaagcctgagaggaaggcttccaaaggacacaagaaccggcgtttgttgtggttgtcaacgaaaaatcgccgtctcttgcaaagcaatgatggaggagagcttgttgtggctgcagatggaactgggaactttagcaccatcactgaggctatcaactttgctccgaataacagtgttggtaggacagtaatctatgtcaaagaagggacgtacgaggaaaatgttgaaatcccaagctataagaccaatattgttctgcttggcgatggaaaggatgtcacatttattactggcaacagaagtgtcattgatggctggaccactttcagatctgcaactctagcggtctctggtgagggctttctggcacgtgatatagcttttgagaacaaggcagggccagagaagcatcaagcagtggccttgagagtgaatgcagacttcactgctttctacaggtgtgctatgtatggttaccaagacactctctatgtccactcctttagacaattctatagggagtgtgaaatttttggaaccatagattacatatttgggaatgcagcagtggttttacaagcatccaacattatcacaaggatgccaatgcttggtcaattcactgtcatcactgcacagtccagagattcccctgatgaggacactggcatttcaatccaaaactgttcaattctagccaccacagatttgtactccaattctggtagtgtcaagagctaccttggaaggccatggagggtctattctcgtactgttttccttgagtcctacattgatcaatttattgacccaatggggtggaaagagtggtctggtgatcaaggcttggacactttgtattacggagagtatgctaattatgggcctggttcagggactgataaccgagtcaattgggctgggttccatgtaatggattatgacagtgcctacaacttcacagtttcggagtttattattggtgatgcttggcttgggtctacttcattcccttatgatgatgggatttaa

SEQ ID NO: 2419 - DNA, 3147 bp, Glycine max var. Williams 82
atgcttgggaacggggttgttgggatcttggcagaatctgtgaataaatgggaaagaagggcacctttgaccccatcacactgtgctcgattactccatggtgggacaggtgtttctaggatcattgtgcagccttccactaagcgaattcaccatgatgctctctatgaagaagttggtgctgaaatatcacaagacttgtcacaatgtggtctcatccttggcattaagcaaccaaagctggagatgatattaccagatagagcttatgccttcttctcacatacacataaagcacagaaagaaaacatgcctttgctggataagattctagctgagagggcatcgttatatgactatgaattaattgttggggacaatgggaaaagattacttgcatttggaaaatttgctggtagagctggaatgattgactttttgcgcggattaggacaacggtttttaagtcttggatattcaacacctttcttgtcacttggatcatcttacatgtatccttccctggctgctgctaaggctgctgtgatttctgttggtgaagaaattgcgacccagggattgccattggggatttgtcccctggtttttgtatttactggttcaggaaatgtttgttctggtgcacaagagatatttaagcttcttcctcatacctttgtagatccatctaaactacgcgatctacatagaacggacaaagatcaaccaaggcatgcttcaaaaagagttttccaagtttatggttgtgttgtgactgcccaagacatggttgaacccaaagatcacgtgatagtgtttgacaaagcagactactattcacatcctgagcattacaatcccactttccatgaaaaaatagcaccatatgcatctgttattgtcaattgcatgtattgggagaaaagatttcctcaattgctgagctataagcagatgcaagacttaatgagccaggggtgcccccttgttggaatagcagacataacgtgtgatatagggggttcaattgagtttgttaaccgtgctacatcaattgattcaccctttttcagatatgatcccttaacaaattcctaccatgatgatatggaggggaatggtgtgatatgcttagctgttgacattcttccaacagaatttgcaaaggaggcttcccaacattttggaaacatactttcccaatttgtcataaatttggcttctgctacagacattacaaagttgcctgctcacttaaggagagcttgcatagccaataaaggagtgctaacctccttatatgattatatcccacgcatgcggagttctgattcagaggaagtatcagaaaacgcagaaaattctctatctaacaaaaggaagtacaatatatcggtgtctctgagtggtcacttatttgatcagtttctgataaatgaggccttagatattattgaagctgcaggaggctccttccacttagtcaactgccatgtcggtcagagcgttgaagctgtatcattctctgaacttgaagttggtgcagatgacagggctgttctggatcaaatcattgattctttaactgctattgctaatccaactgaaaatgatagattttcaaatcaagattcaagtaaaatttcacttaagcttggtaaagtcgaagagaatggcatagagaaggagtctgatcccagaaagaaggctgcggttttaattcttggtgctggtcgggtctgtcaaccagctgccgaaatgctttcatcatttggaaggccatcatcgagccaatggtataaaacattgttggaagatgattttgaatgtcaaattgatatagaaatcattgtgggatctctgtacctgaaggatgcagagcagactgtagagggcattccaaatgtaaccggagttcagcttgatgtgatggatcatgccaatttgtgtaagtacattgcacaggttaacgttgttataagtttgctgcccccaagttgtcatattatcgtagcgaatgcttgcattgagctgaaaaaacatcttgtcactgctagctatgttgatagctccatgtcaatgctaaatgataaggctaaggatgctggcataacaattctgggagagatgggcttggacccaggaattgatcatatgatggcaatgaagatgatcaaccaagcacatgtgcggaaggggaaaataaagtctttcacttcttattgtggtggacttccatctcctgaagctgctaacaatccattagcatataaattcagttggaatcctgcaggagcaatccgagctgggcgtaatcctgccacctacaaatggggtggtgaaactgtacatattgatgggaacgatctttatgattctgctacaagactaaggctaccggaccttcctgcttttgctttggaatgtctcccaaatcgcaattcattacttttaagggatttgtatggaataactgaagcatcgaccattttccgtggaaccctccgctatgaaggatttagtgagatcatggggacactgtctaggattggcttatttaacaatgaagctcattcgttgctaatgaatgaacagagacaaactttcagaaaattcttatttgaacttctcaaagttgttagcgataatccagatggaccattgataggagagaatgacatcatggagcatatattaacacaagggcactgcaaagatcaaagaactgcaatgaagacagcaaaaacaatcatattcttgggacttcttggcgaaacagaaatccctgcttcctgcaagagtgcttttgatgttgtttgtttccgcatggaggagaggttatcatacaccagcacagaaaaggatatggtgcttttgcaccatgaactggaaatagaatacccagatagccaaattacagagaagcatagagctactttacttgaatttgggaagactcttaatggaaaaaccacaactgccatggcccttactgttggcattccagctgctgttggagctttgctcttattgacaaacaaaattcagacaagaggagtcttaaggcctatcgaacctgaagtatacactccagcactggatattatagaagcttatggcatcaagttgatagagacgaccgagtaa

SEQ ID NO: 2420 - DNA, 3684 bp, Glycine max var. Williams 82
tgtcgtatgcctaactatatagccatatagtacacgtcacatgtcacacttcaacctttttaaatattacaagattgttgtgctgacaagcctgacattgacacaaacaccaacgaagtacacgacttggccgttctagttcagttgttaacactcatatcctgttacaaatcacttctgctcttatcgttgtttgttcctcacttttttctttcattcagtttcagtgtcacaatccatcacaaaaacgtgttcaactatactgatattggaggtacaaggatcatgcttgggaacggggttgttgggatcttggcagaatctgtgaataaatgggaaagaagggcacctttgaccccatcacactgtgctcgattactccatggtgggacaggtgtttctaggatcattgtgcagccttccactaagcgaattcaccatgatgctctctatgaagaagttggtgctgaaatatcacaagacttgtcacaatgtggtctcatccttggcattaagcaaccaaagctggagatgatattaccagatagagcttatgccttcttctcacatacacataaagcacagaaagaaaacatgcctttgctggataagattctagctgagagggcatcgttatatgactatgaattaattgttggggacaatgggaaaagattacttgcatttggaaaatttgctggtagagctggaatgattgactttttgcgcggattaggacaacggtttttaagtcttggatattcaacacctttcttgtcacttggatcatcttacatgtatccttccctggctgctgctaaggctgctgtgatttctgttggtgaagaaattgcgacccagggattgccattggggatttgtcccctggtttttgtatttactggttcaggaaatgtttgttctggtgcacaagagatatttaagcttcttcctcatacctttgtagatccatctaaactacgcgatctacatagaacggacaaagatcaaccaaggcatgcttcaaaaagagttttccaagtttatggttgtgttgtgactgcccaagacatggttgaacccaaagatcacgtgatagtgtttgacaaagcagactactattcacatcctgagcattacaatcccactttccatgaaaaaatagcaccatatgcatctgttattgtcaattgcatgtattgggagaaaagatttcctcaattgctgagctataagcagatgcaagacttaatgagccaggggtgcccccttgttggaatagcagacataacgtgtgatatagggggttcaattgagtttgttaaccgtgctacatcaattgattcaccctttttcagatatgatcccttaacaaattcctaccatgatgatatggaggggaatggtgtgatatgcttagctgttgacattcttccaacagaatttgcaaaggaggcttcccaacattttggaaacatactttcccaatttgtcataaatttggcttctgctacagacattacaaagttgcctgctcacttaaggagagcttgcatagccaataaaggagtgctaacctccttatatgattatatcccacgcatgcggagttctgattcagaggaagtatcagaaaacgcagaaaattctctatctaacaaaaggaagtacaatatatcggtgtctctgagtggtcacttatttgatcagtttctgataaatgaggccttagatattattgaagctgcaggaggctccttccacttagtcaactgccatgtcggtcagagcgttgaagctgtatcattctctgaacttgaagttggtgcagatgacagggctgttctggatcaaatcattgattctttaactgctattgctaatccaactgaaaatgatagattttcaaatcaagattcaagtaaaatttcacttaagcttggtaaagtcgaagagaatggcatagagaaggagtctgatcccagaaagaaggctgcggttttaattcttggtgctggtcgggtctgtcaaccagctgccgaaatgctttcatcatttggaaggccatcatcgagccaatggtataaaacattgttggaagatgattttgaatgtcaaattgatatagaaatcattgtgggatctctgtacctgaaggatgcagagcagactgtagagggcattccaaatgtaaccggagttcagcttgatgtgatggatcatgccaatttgtgtaagtacattgcacaggttaacgttgttataagtttgctgcccccaagttgtcatattatcgtagcgaatgcttgcattgagctgaaaaaacatcttgtcactgctagctatgttgatagctccatgtcaatgctaaatgataaggctaaggatgctggcataacaattctgggagagatgggcttggacccaggaattgatcatatgatggcaatgaagatgatcaaccaagcacatgtgcggaaggggaaaataaagtctttcacttcttattgtggtggacttccatctcctgaagctgctaacaatccattagcatataaattcagttggaatcctgcaggagcaatccgagctgggcgtaatcctgccacctacaaatggggtggtgaaactgtacatattgatgggaacgatctttatgattctgctacaagactaaggctaccggaccttcctgcttttgctttggaatgtctcccaaatcgcaattcattacttttaagggatttgtatggaataactgaagcatcgaccattttccgtggaaccctccgctatgaaggatttagtgagatcatggggacactgtctaggattggcttatttaacaatgaagctcattcgttgctaatgaatgaacagagacaaactttcagaaaattcttatttgaacttctcaaagttgttagcgataatccagatggaccattgataggagagaatgacatcatggagcatatattaacacaagggcactgcaaagatcaaagaactgcaatgaagacagcaaaaacaatcatattcttgggacttcttggcgaaacagaaatccctgcttcctgcaagagtgcttttgatgttgtttgtttccgcatggaggagaggttatcatacaccagcacagaaaaggatatggtgcttttgcaccatgaactggaaatagaatacccagatagccaaattacagagaagcatagagctactttacttgaatttgggaagactcttaatggaaaaaccacaactgccatggcccttactgttggcattccagctgctgttggagctttgctcttattgacaaacaaaattcagacaagaggagtcttaaggcctatcgaacctgaagtatacactccagcactggatattatagaagcttatggcatcaagttgatagagacgaccgagtaattttcatctatgaattgatgtataggtgtaaattaatgtacaccatgcaatgtttgacgtgaataggataaaatataataattactgagtttatggaattgcaactaccattctataccagtgtcagaaatggaccacacggtaccagcatagttataacacttacacatgaagatgccaatttcaattgcagcagtacaatccaaccggtaatgaaattctagaaaaattgttaattggtgatcaatgaaa

SEQ ID NO: 2421 - DNA, 1146 bp, Glycine max var. Williams 82
atgcagatattcgtgaaaactttgaccggcaagaccatcacccttgaggtggaatcctccgacaccattgacaacgtaaaagctaagattcaagacaaggaagggatcccacctgaccagcagagacttatctttgcgggtaaacaacttgaggatggtcgcacccttgccgattacaacatccaaaaggaatcaaccctccatctcgtgcttcgcctcaggggtggcatgcaaatctttgtcaagactttgaccgggaagaccatcacccttgaggtggaatcctcggacaccattgataatgttaaggccaagatccaggacaaagagggcatccctccagatcagcagaggctgattttcgctggtaaacaacttgaggatggaagaacccttgctgattacaacattcagaaggaatccacccttcacttggtgcttcgtttgagaggtggcatgcagattttcgtcaagactttgacaggaaagaccatcaccttggaggtggaaagttctgatacaattgataatgtgaaagccaagattcaggataaggagggtattcccccagaccagcagaggcttatctttgccgggaagcagcttgaagatggaagaacccttgctgattataacatccagaaggaatctactttgcacttggtgttgcgacttcgtggtggcatgcaaatcttcgtgaagactttgacgggaaagaccataactttggaggttgaaagctctgacaccattgataatgtgaaggcaaagatacaggacaaggaaggtattccaccagaccagcagaggcttatttttgcagggaagcagctggaagatgggcgtaccctggctgattataatatccagaaggaatccactctgcatttggtgttgaggcttcgtggtggtatgcaaatatttgtgaagactctgacagggaagaccgtaaccttggaggtggaaagctctgataccattgataatgtgaaagcaaagattcaggacaaggagggtattccaccagatcagcagaggcttatttttgctgggaagcaattggaagatggtcgtaccttggcggattacaatattcagaaggaatccaccctgcatcttgtcctccgccttcgtggtggtttctga

SEQ ID NO: 2422 - DNA, 3825 bp, Glycine max var. Williams 82
atggaaggggatatcagtgtgaatggagatcctaacacttacagtaacagcaatcaagactcaaagaagagtgaggccaaagatgaacccgccaaaacagtacccttatacaggcttttttcatttgctgatcctttggatcatttgttgatgtttgtgggaactgttggtgctattgggaatggaatctccttgcccttaatgactctgatatttggaaatatgatcaatgcatttggagaatccagtaacaccaatgaggtcgtcgatgaagtttccaaggtgtctctgaaatttgtatacttggctgtgggtaccttttttgcgtcatttttgcagttgacatgctggatgatcactggggacagacaagctgcaagaattagaggattataccttcaaacaattttgaggcaagatgtcagtttctttgataaagagactaatactggagaggttgttggaaggatgtcaggtgatacagttcttattcaagatgccatgggtgaaaaggtgggacagttcatacagttaatatcaactttctttggaggttttgttgtagcattcatcaagggatggcttttaactgttgtcatgttagcttgtattccactccttgtcatgtctggtgctatgataactgtgattatttcaagagcatcatccgaaggacaagctgcttattctacagcagcaagtgtagtagagcagacaattggttctatccgaactgttgcatcatttactggggagaggctagctatagccaaatacaatcagtccttaaacaaggcatataagactggagtgcaagaggcactagcctctggtttgggatttggtttgctctactttgtttttatctgcagttatggtctggctgtatggtttggtgcaaaaatgataatagagaaaggatatactggaggcaaggttttgactgtaatatttgctgtattgactggctccatgtctctagggcaggcatctccaagcttgagtgcttttgctgcaggacaagctgcagcctttaagatgtttgaaacaattaaaaggaagccagaaattgatgcctatgacactactggtcggaagcttgaagacattcgtggtgatatagagcttcgggaggtttgctttagttatcctacaagacctgatgaactgatattcaatggattttctctttcaataccaagtggcactaccgcagctttggtaggacaaagtgggagtgggaaatccacggttgttagtttgatagagagattttatgatccacagtctggtgcagtgcttattgatggtatcaacctcagagaatttcaactgaaatggatcagacagaaaattggcctagtcagccaggaaccagttctctttacttgtagcattaaagagaatattgcctatggcaaggatggtgcaactgatgaagaaatcagagctgcagcagaacttgctaatgctgccaaatttatagataaacttcctcagggactagacacaatggttggtgagcatggtactcagctctctgggggtcaaaagcagagagttgcaatagcaagagcaattttgaaagatccaagaatcctacttttggatgaagctacaagtgcccttgacactgaatcagagcggattgtacaagaggcattggacagaataatgataaacagaacaactgtcatagtagcccaccgcttgagtactataaggaatgctgataccattgctgtaatccatctaggaaaaatagttgaaagaggttcacatgttgagctcaccaaggatcctgatggagcctatagccagcttatcagactacaagaaattaaaagattagaaaagaatgtagatgtcagagagcctgaaagtatagtacattctggaagacattcaagtaaaaggtcttctttcttacgatctataagccaagagtcactgggagtaggaaacagtggccgccattcattctcagcatcatttggtgtgcccacatctgttggcttcatagaacctgcaggtgaagggcctcaagatcctccttcaacagctccttcaccaccagaagtgcctctttatcgcctggcttacctaaacaagccagagattctagtgttactgatggggactgtatctgcagtgataaccggagtaatattacctgtttttggtctattgctttccaaaatgataagtattttctatgagccagctcatgaactccgtaaagattcaaaagtctgggcaatagtatttgttggacttggggcagtatcattccttgtttatcctggtagattctacttttttggtgttgctgggggtaagttgatccaaaggattcggaaaatgtgttttgagaaagtagttcacatggaagtaagttggtttgatgaagctgagaattcaagtggagcaattggagctaggctttctactgatgcagcttctgttcgagctttggttggggatgcacttggtttgctggttcaaaatactgccacagcaatagctggattggtaattgcctttgaatcgagctggcagcttgctcttataatccttgctttggtgcctcttctaggactaaatggatatctgcaattcaagttcttaaaaggattcagtgcagatacaaagaaattgtatgaggaagcaagccaagtggcaaatgatgctgtggggagtataagaacagttgcttctttctgtgctgaagagaaggtgatggaattataccaggaaaaatgtgaaggaccaattaagacaggcaaaaggcaagggataataagtggaattagttttggagtatcattctttgtgctgtattcagtttatgcaaccagtttttatgctggagctcgactggtcgaggatagaaaagcaacattcacagatgttttccgggtcttttttgctctcagcatggccgccataggaatctctcaatctggctctttggtccctgattcaactaaagcaaaaggtgctgctgcttccatatttgccattcttgaccgaaagtcagaaatagacccaagcgatgacactggaatgacactggaagaattcaagggagagattgaacttaagcatgtcagtttcaagtatcctacccgacccgatgttcaaatattcagagatcttagcttgaccattcatagtggcaagacagtagcactggttggagaaagtggaagtggaaaatcaacagtgatttcattattacaaagattttatgacccagactcaggtcacattacactggatggaacagaaatccaaaggatgcaagttaaatggctgagacaacagatgggcctggtgagtcaagagcctgtgctgtttaatgacaccatccgagccaatattgcatatggaaaagcagacgcaaccgaggcagaaattataactgcagcagaattggcaaatgctcataccttcattagtagtttgcagaagggttatgacacgttagtaggggagcgaggagttcaattatctgggggacagaagcagcgtgtggcaattgcacgagctatagtgaagagtccgaaaatattactactagatgaagccacaagtgcactggatgcggagtctgaaaaagtggttcaggatgcactagaccgtgttatggtggaccgaaccacaatagtagtggctcataggctatctactataaagggtgcagatttaattgcagtagttaaaaatggggtcatagcagagaagggcaagcatgaagcattactcaacaagggaggtgactatgcttctttagtagcattgcatacaagtgcttctacatga

SEQ ID NO: 2423 - DNA, 2613 bp, Glycine max var. Williams 82
atggaaatggaatcttcgtcgactcctcctcctaagttccggttcagagaccactcagaaccggaatctcagaattcattggagccaagctccgatgttgtttctgcagcgtcaccgtctatcggtgatcctgatgcagaccttgaaattgaatccatgaccggaagaggcatcatgcatctgtgtgatgaacttcgggaactaaaggaagcagcaaatgaagatttacagaaaaacatatttagcaaatattccactttccttagaatactagaggaagtgataggagtggaaaatgagctcgtgcaactggaaaaccattttgtatctcataaaaggcaagtaaaggatcttatagatcgaatatatccaaagatattgtccatagacatagccttcgatgatcatgtcaatattgtcccatctcaccccaccgaattgaaagctcacattaatgaatgtttagagaatttggatattctcttatcagaaaacaagatggatgaagccctgaaccatctagaatctgcagatgaacattatcaaagccttcaatttcaagattgttcccatagagagatcatgctatatgaatctgcaatttctgagaaaaagtccatgctgatacaacaattatcacaaatagctgagaataaaagaacaccgggaccagaacttcaaagggcactagctagactttgcagacttggtgatactcaacttgctattaatctgttgcttaaacattaccatttgcgtgttgcgaatggaactgataatttgcagtgggcaaaatcatcttcaattgagatatacataagggaacttgcaaggtttgtgttctcaatggtttcacaagcggcaaggagctttgtgatgttgtgtggagaaacttctccttatgcctcagagcttatgttgtttgcatatgaagaaacaaaatcattcatcatttgttttgataaatacgtcaaaggcacctcagcaataagtggagggttgtcttctgccataaaagctgtcaagtttgctgtcatgtactgttctttgttagaaaatcagaaattggtgttgcggccatacttagtgaagcatctctttccatgcatggaagaggttttgaatacacatataaaccattttaagaaagtgattgttatcttctcagcgagcgatccttggattttggagaagtaccttgtttctggagtgtttgttggggctggatcttcaactttagccgttggagaacaacatgactattgcttgctaactaccagtggccggaaggttgtgacactattgcaggccattgtggaagatatttcttctttagtttcccttcatatggggagtttagtcattagtggaatcacaatcctcttcacagagtatattgtcatacttgaaaaagcccttacttatgaagcaagctcaacagaacaaggtagtccaagaataaagctagctgagtcactaccacaacaggtttctattttggccaatttgtcaactttagtgcagtttctctctatcatggtcaaagatatctttagcagcagtgatcacatagaatttcaagtattggaaaactattcaattgttcatcagcagcaaggacttgatgatttcctattgtttattgaagagggttccaataagttgagaaacgtgttctgccagcaattaattctcagagtattgtctacttaccacaggcatgaaatattttctgctagccattgcaatgaccagtttgatgctaacactgtccacgatccaatgccgtctggtatctttcaggttttatttctagaattaaagaaaatagaacaacttgaggaagaaaatgtgtttgaagtgaattggttgatgggattactgagagaattaatggagtcgatgtttatttgggtttccaacaacaaagagatccttgcaactacggaaaagaatgtgagctcacaaactgatgaagccaaacagtttattttggatgtgcaattcttggtggaaattggaatgtacggaggatatttctccagcgatcctttgctccttctaactctcatgaaatcaaccttcaattcagcaggactagaccctttcaaagatgtagatgatgattattgggctatagatgctgctactaaaacaattcaaaagctgttggagattgagaaaacaagtttgcatccaaaggagcctgtagttaccattaaagaggagtcacatgagcatgagaaccaaatcaatcaatcagcatatgaatgtaatttttccaaggaaaatgatataagttcttcagagaataacgtagtaaaacatgaactagatgaggttgcaaaacatgaactagaagttgccattgatgcaaagatggcttcactagacacggtatttagccccggagagggatctttagtgaagagagattatgttgatacagactcttcaaatttgagaccaccttctatcatgactttgcaattagaggatgctgattttgtagaggcaacggatacaaaaaatgatgaattgactccaacatcttccgtgggtgaggtaggactaaattctgaggaggaaactaaatcaaattcagacgaatga

SEQ ID NO: 2424 - DNA, 4554 bp, Glycine max var. Williams 82
atgggtgtcgcacgttttttccatgatgtcctaggattgcccgtgttggaacttgcgacaatctgcatgaacctgacttttgtacttttgtttctctttgttgtctcggtgaggcgtgttcttgtgtatgggggtggatttcgattcggtaaggatggaaacagcggcaatgctagcccaatttgcagtgtcattgatgaagaaacgcgtggtgttagaatcggtgtggggttcaagttgtcagtgttgtcttgtttctatgttctgtttgtgaatgttttggcgttgggatttgaagggggtgctttgatttggggtgaggctaatggggatgctgacgtggatttgtctcttcttgctgtccctgctgcacagggtttggcttggtttgtgttgagcttctcggccttgtattgcaagttcaaggtgtcagagaggttcccatttttgttgagagcttggtggtttttgtcctttgttatttgcttgtgtactttgtatgttgatgggagaggattttgggaggagggttctgaacatctatgttctcgtgctgttgcaaatgttgctgtcacaccagctcttgcatttttgtgtgtggttgcaattaggggtggtactggtataagggtttgtgggaactctgatcttcaagagccattgcttgttgatgaggaaccggggtgtctcaaggttactccttatagagatgctggactttttagtttggccactctttcttggctgaatccacttctttccattggtgctaagagaccgctcgagcttaaggatattccacttgttgcaccaagagatagagccaagactagttataaggttttgaattctaattgggagagattgaaggctgaaaatgagaatccctctaagcagccttcgttggcttgggcgattctcaagtcattctggaaggacgcagccctgaatgccatctttgctggtatgaatactttggtgtcatatgtaggtccatacatgataagttactttgtggattacttgggtggcaaggagactttcccccatgagggatatatccttgctggtattttctttgtggcaaagcttgtggagactgtgacaactaggcagtggtatctgggagtggacatcttgggtatgcatgttaggtctgctctaactgcaatggtatataggaagggacttagactgtcaagctcagccaagcagagtcacacaagtggggagattgtcaactacatggcagttgatgttcagagggtaggggactactcttggtaccttcatgacatgtggatgcttcctatgcagattgttcttgcccttttaattttgtataagaatgttggaattgcttctgttgcaacattgattgctacaatcatttccattgttgtcactgttcctgtggctagggtgcaagaagattatcaggacaaattgatggcagctaaggatgaaaggatgagaaagacatcagagtgtcttaggaatatgaggattctcaagctgcaagcttgggaggatcgatatcgattgaagttggaggaaatgcgtggagtagagttcaagtggctaaggaaagcactctattctcaggcttgcataactttcatgttctggagctcccctatatttgtttcagctgttacttttgctacttccatattgttggggggtcagttgacagcaggtggtgttctctctgctctagctactttcaggattctccaagaacctctgaggaattttcctgacttggtatcaaccatggctcagacaaaagtttctcttgatcgcatatctgctttcctgcaggatgaagaattgcaggaagatgcgactatcgtcttgccacctggcatttctaacacggccatagaaattatggatggtgtcttctgctgggactcttctttgccaaggcctactctatcgggaatacatgtgaaagtggaaagagggatgactgtggctgtttgtggcatggttggttccggtaaatcaagttttctttcttgcatccttggagagattcccaagctgtctggtgaagtaaaaatgtgtggttctgttgcatatgtctcccaatctgcttggatacagtcaggaaatatagaagaaaatatcctgtttggcaccccaatggacaaagcaaagtacaagaatgttcttcatgcttgctcattgaaaaaggacctagaacttttctcacatggagaccaaacaattattggtgacagaggtataaatttgagtggtggtcagaagcagcgggttcagcttgctcgagcactctaccaagatgctgatatttacctacttgatgatcccttcagtgcagttgatgcccacactggatcagaattatttagggagtatgtattgacagcactagcagataaaacagtcattttcgtgacccatcaagttgaatttcttcctgctgctgatatgataatggttcttaaagaaggccacatcatacaggcaggaaaatatgatgatcttttacaagccggaacagattttaaaactctagtttcagctcaccatgaagcaatagaggctatggatattcctaatcactcagaagattcagatgaaaatgtacccttggatgacactattatgaccagtaagacatccatttcttctgcaaatgatattgagagtttggctaaggaagttcaggagggatcatcagatcagaaagtaattaaggagaagaagaaagcaaaacgctcgagaaaaaaacagcttgttcaggaagaggagagggttagaggtagagtcagcatgaaggtgtacttgtcatacatggctgcagcatacaaaggtgtattgattccactcataatcattgcacaaacattatttcagttccttcagattgccagtaattggtggatggcttgggcaaatcctcaaactaagggagaccaacccaaagtaactcccacagttcttcttcttgtttacatggcccttgcttttggcagctcatggttcatctttgtaagggctgttctcgtggctacatttggtctagcagctgcacagaaactattttttaacatgcttagaagcatattccattcaccaatgtctttctttgactctacaccagctggaaggatcttgaatcgtgtttcaattgatcaaagtgttgtggatcttgatattccttttagacttggagggtttgcttcatcaacaatacaacttattggcattgttgctgtaatgacagatgttacatggcaagttttgctcctagtagtcccgttggctattatttgtttgtggatgcagaaatactacatggcttcctcaagggaattagtacgtatcgtgagcatccaaaaatctccaattatacatctttttggtgaatcaattgctggagcagccaccattagaggttttggacaagaaaaaaggttcatgaagaggaacctctatcttctggattgttttgcacgaccattcttctgtagtcttgcagctattgagtggctctgcctgcgcatggaattactttcaacctttgtttttgctttctgcctggtattacttgtcagccttccccatggaagtattgatcccagcatggctggacttgcagtaacatatggcctgaatttaaatgcacgtctatcacgatggatacttagcttttgcaaacttgaaaataaaatcatatccattgaaagaatttatcaatacagccaaattcctagtgaagcaccagcaattgttgaagattctcgtcctccatcctcatggcctgagaatgggacaatccaattaattgatctgaaggtacgttacaaggaaaatcttcccgtggtgcttcacggagtatcctgcacatttcctggtgggaagaagattggaatagttggtcgtactggcagtggcaaatctaccttgattcaagcattatttcgattggttgaaccggaggcagggagtatccttatagacaacattaatatttcatcaattggtcttcatgatcttagaagtcatttgagtatcataccacaagatccaaccttatttgaaggcaccattcgaggcaatcttgatcctcttgatgagcactctgataaagagatttgggaggcccttgataagtcacaacttggagatataatccgtgagacagagcgaaagcttgatatgccagtgctggagaatggagataattggagtgtaggacagtgtcaacttgtttctttgggtcgagctctgctgaagcaatcaaagatacttgtacttgatgaagcaacggcatcggttgatactgctactgataatcttatccagaagattattcgaagagagtttagagattgcactgtgtgcactattgcacatcgtattcctactgttattgacagtgatctagtgctggtactcagtgatggtcgagttgcagagtttgatagtccatctaggctgttagaggacaagtcatctatgtttctgaagttggtgacggagtattcatcgcggtcaagtggcataccagacttttaa

SEQ ID NO: 2425 - DNA, 898 bp, Glycine max var. Williams 82
gtgtcttcttcactagcatccctcggtggaaatttggatggtaaaaattgcttgcttctaggttccaaaagttcagccaatggtttcacagaacaatcagcagtcaatacaaccgaatattcagcctgctccattattgcctggccttaggggtgcacgagatcaagcaggagtatctcaaacccagcttcctccgaggaaacaccagaaccaaccttcagtgccatgaattctgatgagggagcaattaggccctatggcacctgcattattggttgggaatatgcctttagggcctgaatttggcaatcaagctggaaatgctacacaagtagacagagggtcttctttgatgcccagtccctcagataacctagctcatctttctggtcctcctggatacgtagtttctgctcagatgggtgctgctaatcagcctcttcggcctcctgtgttgacaccagatatggagaaggcactgcttcaacaggtcacgagcctcaccctggggcagataaatctcctatcaccagaacaaagaaatcaagtgctgcagctacaacaaatgttgcatcaatgatgcaatacacacacaccataaagttaggcaatctttaatccttccagtttggcagagattgttgtgtcatatatatatatatatatatatatatatatatatatattatgtccaaactattggctgccaagttttgtagaattaattcaaattcatgtaacaaattgtagacaatagcattattttcttctggaatttggctctttaaatatcagcctttagttggtggagctatttgcaaaacttctccccatattccatattttattattaatcggttatccatatctatgtatctgtatatactatgacatgatg

SEQ ID NO: 2426 - DNA, 390 bp, Glycine max var. Williams 82
atggcttcagcagcatctgggtttgtgctgtctcttaatgttgcagcttccaccacaaactcaagggtggtcttgttcaacacaaagaacaacgcttctagacttcttgtgagggcttcagatgagcctgcagcggcggcacctgccaccgccacacccccagctgaagctgaagccaaaccaaaaccaccaccaattggtcccaagagaggtgctaaggtgaagattcttaggaaggaatcctactggtacaaaggcactggttcagtggttgctgttgatcaggaccccaacactcgctaccctgttgtggtccgattcaacaaagtcaactatgccaatgtatcaacaaacaactatgctttggatgagatcgtggaagtggaatga

SEQ ID NO: 2427 - DNA, 2703 bp, Glycine max var. Williams 82
atgcagatgctcatagacaaagagatgtccaaaaaaaaagactccaagcacaccctaccaaatgtagtagcaaaactaatggggcttgaggcccttccaaggggagagcctcatttatctatggaaagaagccacagaagagactattctcaacaaatgtatggtcctgtaggcttaccattcaagcattggcaacaggaagataggtttatggatagggaaatgcttcatgaagttcatccaagcacagaacaggttgcttacaaagatatgtatgaaatatggcagcaatctcagagagcaagccatgacagaggaaagtggagtgaagatgttgatgagaaaagaatggctctgattcgacagaaattcatggaagcaaaacgtctgtcaaccgatgagagactgcaccaatctgaacaatttaaagatgccttggaagttttaagctccaatagtgatctcttgatcaggttattggattctcaaaatgtttctgatttatactcaacttcacctaatgagacaaagcgcattactcttattaaacctttgaagatggttgacaacgacaaatctgccagaaaggagaaaacgaataatagaccgattaagaaaccatctagtgttgatcaagcaaatcctggaaactctccagatagtcagaaagttgatgaatctccggtccgaaccactcgaatagtgttactaaagccaagcccagggaggacacctgagcaaaaggctgttgtttctccaacaacttcgctgaatctgaaaagcagaaatttccatcatggacctgaatatgatgatgtactagaatccattagagtggcaaatgagatcacacagcaaatgcataaaggcccgaggagctatcaaaaggataaaactctgtattcctcagtgttttccaatggctattctgatgatgagagttcattcaacaaatcatatcatgagtatgcatctgcgaatttcagtgattttgaagctacgtcaatgtcaccattgccaaggctttcgtgggattacaattacatcaatggctatggcagcccttattctagaatgtccttgggccgtgtgccatgctctcccgagtcatcggtgtgcagagaggcaaagaaaagactttctgaaagatggactatgatgacatcagataataagggtcatcaagaacaaaggcaagcaaggaaaagctctaccttgggtgagatgctttctcttacccacaaaaagaaatctgtaacatctgaggttgagagtatcaatgaggaccaagaacctggcaaatctgtttcttgtagtcattctttcaatgcagaaataagcattgagggttctcctaaaaatctccccaggtcaaattctgtgcctgcatcttctactgtatatgaaaatggcctcacagttaaagtaaatgatcataagaatactggcaaagcacaaggctccaaggagcagaaaaagcctaagagtatgagatcatcttttaaagggaaagttgctactttcttgttctcaaggagtaagaaatcaaccaaggaaaaaccaagttcatctcaatctaaagatgcatcccaatctacttccactgtcactgcaacattagttcttccagcaaattcacctggagtccttaggggtgatgtgtctcaaagcatcaatgtggatggttttgaagagtgttctcttgcagcgctatgtgaatcatcagggaaaaattcaacagattcagtctctaacggacatgaagaagacatgattacactagagcctggattgactatgccaaggcccatggtgccagagattcattcaagcgaaaacccagatcagccaagtccaatctcagtgttacaacctccatttgaagattataataataataatgcatcacatgagtccttgaactgtatgaagagtggtgaccaggggtcacaggtgccactgaagtccaatttaattgacaaatcaccacctatagaatcaatagctaggaccctatcatgggatggttctagtgcagaagtggcaagttcctatgcattaaaacccttaatggtttcttccttggactccaaggtagaggatcaagagtggcttctcttggtccacaaactactatcagcagctggacttgatgatcaacaccaacatgactcatcttacactagatggcattcccttgagagcccattggacccatcactgagggacgcattatacgccaatctaaatgagaaggagcctcagccaattatgcatgagcgcagaagaaggaagatgagatcaaaccacaaacttgtgtttgactatgtcaatgctgcactattggaacttgttggttatgggtcagaaaagtgcttaaagagaagtaagagccactacagggtccaagtccaagagggtgcatcagcagcagcatctcccttattggtggaccacattgtggcccaaatgaaggaattaatagcaagtggggtgaggtgtgagtgggaaaatggtggggccagcaccagcctggtggtagaaaatgttgtcagaaaagaggttgtgcaaatagggtgggttgagcttatggaattggagattgatattttggggaaggagattgaaggggacttgattcaagagcttgtggagaatgcagtggttgatttgacaggcagggcctctgagtccctctcttga

SEQ ID NO: 2428 - DNA, 783 bp, Glycine max var. Williams 82
atggaagaaacaacatcaaccatcatcatggctgcactctccaccctcacaccttcccaattctcagatctcactcgctccattatctccgccaccaaccaccaccatcgccgcctctcctccctcctctcctccccaacgctcttctctttaacccttcaccatctccacactctcacactcccccagaagaccctcctcatcgcccgccacctcctctcctccctccacctcctcaccgccacgtcgccgcctctgtccaccaccacacggcagcgcgacctcgacgccgcgctgctcctccttctcctctgcgaaacgcacaaccacaacccacatgccctcgaggcaccgttctccgaatggagaaaaaacttgagcaaagtgttctctgattcgttgttaactgtttctcttgcaccccttgggacggttatgattcccttcgttgagacggtgtcgcggtgctggaggcttgtgggtgcgctgaattgcggcggagggaaggaggcggcttcggcggcgataatggtggcgctgccgtcggtggaggtgaggcacagtgggagggagtgcgtgatatgcaaggaggagatgggaataggaagggacgtgtgcgagttgccatgtcaacacttgtttcattggatgtgtattttgccgtggctggggaaaaggaacacgtgtccttgctgcaggtttcggttgccgtccgatgatgtcttcggagagatccaacggctgtgggaagtcttggttaaaatgactgcaaaagattcatag

SEQ ID NO: 2429 - DNA, 732 bp, Glycine max var. Williams 82
atggcaatggcaatggcagcaattgcttcttctctcggcgtgggtctccgtcctctttctctgtcttctccctcctcagcactgttccagtcccgccactccttcactataacaaccacaacacccaagtgctgcctcgcaccaaaacaagactcacccctggaactggaactagtgaaatcaacacagaacacccaaatcatcttacactctttctctccattcccattgctctgcgccgctgctctcttacccggaagtgaagcggtaacatctgtgtttgggcctttcgttgagctcgtcaagtcgtggaatctcccagactggctcgtccattggggccaccctggcaacatggccgttgtgctctttgccatgggtggctacggtacctatctgggttttcgcattcgttattctgataatctggaggaaaaggctaaggccaaggatttgcatcccaagcttttagctggtatgtttttcttctttgctcttggagctactggtggaattacagctctactcacttcggataaacccatttttgagagtcctcacgctgttacaggagtcattggtcttgctttgttgacaatacaaactatactgcctacactctttgagggaaatcctggactaaggaatgttcatggtatcctgggtagtggtatcatgacactttttcttgttcattttgcccttggacttcaactaggcttcagttactaa

SEQ ID NO: 2430 - DNA, 918 bp, Glycine max var. Williams 82
atggcagcaacctcaacatcactcttcttctccaatctccattctctcaaccctcaacctttctcttcctcactctccttcttccgaaatgtccattccaccctctctttcccttcctcttctaaaccctcccgtggcgttgttgccatggctggctctggcaagttctttgttggtggcaattggaagtgtaatgggaccaaagactccatcagcaagcttgtctctgacttgaacagtgcaacattggagcctgatgttgatgttgttgttgcacctccctttgtgtacatcgatcaggtgaaaaactcaattacagataggattgaaatttctgcccagaattcttgggtgggaaaaggtggggctttcacgggagaaatcagtgtggagcaactaaaagaccttggctgcaagtgggttattcttggacattctgagcgaagacatgtaattggagaaaatgatgagtttataggaaagaaaactgcctatgctttgagtgagggtcttggtgtgatagcatgtattggggaacttctacaagaaagagaagctggtcaaactttcgacatttgtttccagcaattgaaggcttttgcagatgcagtgccaagttgggataatatagttattgcatatgagcctgtatgggcaattggaactggcaaagtggccacacccgagcaagcccaggaagtccatgcagctgttcgtgactggcttaagaagaatgtctcagctaaagttgcatctaaaacacgaattatttatggaggatctgtaaatgcaagcaacagtgctgagcttgcaaagcaagaagatattgatggatttcttgttggtggtgcttcattaaagggtcctgagtttgctaccattatcaattcagtcacttccaagaaagttgcggcttaa

SEQ ID NO: 2431 - DNA, 213 bp, Glycine max var. Williams 82
atgctccttttctttcaaggctatgctaaaacgctccttcttgagggcggtttctcttggaaagggcaacttcaatcctttggcatttttcaactcctccacctcacttcacacactgtgatttgggctcttgagggacctctcagaatggcaacaccccttttatgtgtaccgtactctcttctagttcttttcttgtacaacaaaatttag

SEQ ID NO: 2432 - DNA, 1395 bp, Glycine max var. Williams 82
atgccaatgttgtcttcaagaggcttcatcgcttatgtcctatctgctttctcttgtgctgttctgtctgcgctttttatcaccaaccacatccatgatgatgataacaaggcagttactttgttagcctctcgtgtgtctgaaactcttaaagtttggcccgacttggagccaagttggagacttttgttggcaacggttattgggtttcttggttcagcatgtggaaccgttggtggggttggagggggaggcattttcgttcccatgctcaatctgattcttggctttgatactaagtctgctgctgctctttctaaatgtatgataatgggggcatcaacatcatcggtttggtataatgtgagagtgccacatccaacaaaagaggtgcccatattagactatgatctggctcttctgtttcagcctatgctcatgcttggaatcactgtcggtgttgctctcagtgttgtcttcccctactggcttatcactgttctcatcatcattctcttcatagggacttcttcaaggtctttcttcaaaggaatcgagatgtggagggaagagaccattttcaagagagaaaagaccatgcagcgagcgactttggttgattctcagggtgaagataagacagttagaatcgacacaaaatatgaaccgttgattcctaaagaaaagaaatcaactatggaaattttatgtctcaaccttaggtggaaaaggattctggtactgatagtggtgtgggttggtttcctactagttcaagtcatcaagaatgatgtagaggcatgcagtgcatggtattgggtgctttttggcttgcagcttccaattgcacttttggtgtttggctatgaagcagtgaagttgtacaaggagcataaaaggaggatgaacacagggaactcagaatgcatctgtgaggcttctatagaatggactgctattaaccttgcattttgtgcattgtgtggcattgtagggggaattgttggaggcctacttggttctggaggtgggtttgttttaggacctcttcttctagagattggtgtcattcctcaggttgctagtgctacagcaacatttgtgatgatgttttcatcatctttgtcagtggttgaattctaccttctcaagaggttccccattccttatgcattatacctcacctcagtgtctgttttggctgggttctggggacagttctttgtaagaagattgattacatgtcttgggagggcatcaatcattgtattcatcctctcaggtgtcatttttgctagcgccctcaccatgggtgtcgttggcattgagaacagcattcaaatgataaacaaccatgagttcatgggattcttaggcttctgttccagtcagtga

SEQ ID NO: 2433 - DNA, 366 bp, Glycine max var. Williams 82
atggcttgcatgtggctcaagaatgcccgtggtggcagtgggaagaagccgccgacggacgtcccacgtggccacttggcggtgatcgtgggagaagcaaagagaaggtttgtgataagggctgattaccttaaccatccactgcttcaacaactactagaccaattatatgaaggttatggcttcaacaagagtggtcctctggctataccttgtgatgagttcctttttgaagatattattcagaccctgagagatggaacatcctctagccatgtgcctctcaagaagctagacttcggcttttccaaggactctatgcccttacttcagggccttgaaagcaaaaggaggagcagcaactaa

SEQ ID NO: 2434 - DNA, 546 bp, Glycine max var. Williams 82
atgggaacagcaatccttcgttcccacgattgcctccaaggccggttcctccacaacgaagccttcgcgatcgccacgtcacgtgttgcatcgcgaagaaaccctaactctaacaacaataaccataatagcttcgcctcctccgcaaaccagaattgccgccggaagcggagtccggtcactgatcgagagcgccgtcgatcgccgccgaatctcgtcacgggacacgttaagatcctgaagcgaggcgagaaattgagcctccagaataaaaaccaaagactcgctgtttccgcggagaacgttttggtgaagaacgatgtgggcctggatttgttattgggttccacggatcgattgggcccgggtccattaaccgtgaagaagcagattagggtttcggatgcgaacaacaacggcgtgtacgcgggatcggcgttcgtttcgtcgccgcacccgagttctgttccggtgccgggatttctagtgcggaacggcgccgccaccagcaatcttcgacggttgctgcgactcgatttggaatga

SEQ ID NO: 2435 - DNA, 888 bp, Glycine max var. Williams 82
atggactggttctcttggctatccagaaccactcttgagccttccttaatctacgactatggcctcacctttgcccgcaacgagctccaattggaagatgctcgctacttcaaccacgagtttcttcagagcatgggaatctcaattgccaagcacaggctagagattctcaagcttgtgaagaaacaagaaggaggagcaacagcacggcccaataagaagctctctggggtcatcaagaagtgcctaaggaagtgcatgaacaagtttgtttctcgtgaagatcatcatcatcatcatgcagtgaaacacgtgccatgctccatggtgcctgtgtcagtgccaccaccaccaccaccccctgagattagttggtatcaccaagggaaattgaaagggtcacttgtgaggaagcaacaagggagtgaggaacttaaggaagaagaaaaagaaaagcctttacctgtgccacccatgtacagaagcaggaccatagcactatcaggacctttggaatatggtagtagaatgcatcatgagaaaatggcccagaacagggccttgaagctatctgggccacttgatggaagaatgcatgagagaatgatgatgaacagtactaatagtagaagccctttgatgcctaggcctttggatgcaagatttgtggccacaacaaggagtccaagagtgtctgggcctctggatccaagagtgatggttgagaatagaagcccgagactgacacggccttcgaatgcaactagggctgaaactcagagcccaatgggttatagtccttataacaagcccaaagctgattttgattttgatgatgatgatcacacactctggccttcactgtttcaagatctcaaaccaacttga

SEQ ID NO: 2436 - DNA, 1152 bp, Glycine max var. Williams 82
atgtgtgtgaaagatggcgaacaagttggtgaagatcatatagagaagaacgttgataacaataggagagtttcatggcctttgcattgtgatctcttgcgtgcccacatggataacaaagaaaaagactcttcttttagaattccctctgaccagatcagtgttgtaaattcatctcctctggaaagcatatgtgaggatgcagaaattgtggacaaaaaacagaacatgatgaactttgtccctactcttcggtctggagagtgttctgatattggagatcgcccttccatggaggatacccacatatgcattggagacttggcagaaaaatttggcaataacgaactttgcaaggaagctatttccttttatggtgtatttgatggacacggagggaagagcgctgcacaatttgttcgtgatcatctgccacgggtgattgttgaggatgctgacttccctttggaattagagaaggtagtcacaaggtcatttttggagattgatgcagagtttgcaagatcatgttctaccgagtcttccctgtcttctggtacaactgcactgactgcaattatatttggaaggtctttactggttgccaatgctggagactgccgcgctgtattgtcccgtggtggaggggctatagaaatgtccaaagatcacaggccattgtgtattaaagaaaggaagaggattgagtctctaggtggatacatagatgacggttacctgaacggccagttaggagtgactcgtgcactaggtgactggcatcttgaaggaatgaaagaaatgaatggaaagggtggaccattgagtgctgagccagaacttaaattgatgacattaacaaaagaagatgaatttttgataattgggagtgatggaatctgggatgtttttcgcagccaaaatgctgtagactttgctcgaaggaggcttcaagagcacaatgatgtgaagcagtgttgcaaggagataataggggaagcaataaagagaggagcaacagacaacttgacagtggtgatgatatgtttccactcagaaccaccacctcctatggttgtagaaaggcctagagtcagaagaagtatatctgctgaggggcttcaaaatctcaagtgcttgctagaaggataa

SEQ ID NO: 2437 - DNA, 1746 bp, Glycine max var. Williams 82
atggaggagaaaatgagttggacagttgcagacgctgtgaactataaaggcttccctgcagacaggtccaaaacaggtggttgggtacccgcagctcttattttagggattgaaatagtggagaggctctccaccatggggattgcagtgaacctggtaacatacatgatctcaatcatgcatctgccaagctcaactgcagccaatactgtgactgactttatgggcacatcatttctcctgtgtttgctgggaggttttctagcagattccttccttggcagatacaagacaattggaatctttgcttcaatacaaacgctgggtactgctacattagcaatctcaacaaaattgccagggctacgtccaccaccttgccatgctaacagtgacagttgcaaacaagccaacggattccaaatgggaatcttgtacttgtcactgtaccttattgcactaggaactggtggcctgaagtccagtgtttcaggatttggttctgaccaattcgatgagaaagatgagaaggagaaatcccaaatggcctatttcttcaacaggtttttcttcttcatcagttttggaactctggcagctgtcacagtacttgtctatctgcaagatgaagtgagtcgcagcttggcgtatggaatatgttctgtttctatgatcatagccattatcgtgttcttatcaggaactaaaagatacagatacaagaggagtttgggaagccccattgtccacattttccaagttatagcagcatcaataaagaaaaggaagaggcaactcccatacaatgttggttctttgtatgaggacactcctgaggcttcaagaatagagcacaccgaacagttccgtttcttggagaaagctgccattgtggcagaaggtgattttgagacaaatgtatgtggttctgaatcaaacccatggaaattatgctcactaacaagggtagaggaggtgaaaatgatggtgagacttctgccagtgtgggccacaaccatcatattttggaccatttacgcacagatgatcaccttttcagttgagcaagcctccaccatggaaaggaatattgggagtttccaaatccctgctggctctctcacagtcttttttgtggctgcaatactaatcactctggctgtgtatgaccgactcatcatgcccctttggaaaaagtggaacgggaaaccaggtttcacagacctacaaaggatagcaattgggcttgtattttccatttttggaatggcggctgcttcagtgtgcgagaggaaacggttatccgcggcaaaaagtgtaagtggtggaaaccaagcaacaacactgcctataagcgttttcctcctgatcccacagttcttcttggtgggttctggtgaagcattcatatacacaggccagcttgatttcttcataacaaggtcgccaaaaggaatgaaaaccatgagcacgggtctctttctcacaactttgtctctcggtttcttcatcagcagtttccttgtctcggttgttaagaaagttactgggacaagagacggccaagggtggctagcagacaacataaacaagggcaggctcgacttgttctatgcactgcttaccatacttagtttcattaattttgtagcgtttgcggtatgtgcactttggttcaagcctaagaaacccaaacaaccagctatgcaaatgggtccacagcagaggaaaagtgttgaaggctga

SEQ ID NO: 2438 - DNA, 504 bp, Glycine max var. Williams 82
atggccaatcccctgcaactcaagtcattgaatcatatctcaattgtgtgtgcatcagtggagaaatccgttgatttttacgtgaacgttcttgggttttctcctattaagagacctagttctttagacttcaatggtgcatggttattcaattatggcattggcatacaccttctccaatcagaaaacccagaaggcatgcccaagactgctcccattaatcccaaggacaaccacatttctttccaatgtgaaagtatagcagcggtggagaaaagactgcagcaaatgaaaatagagtacgtgaagaacagagtagaggaaagtggaacctacgttgatcagctattcttccacgacccagatggcatgatgattgaaatctgcaactgtgacaacatccctgtggtgcctttaacagaggacaaagtatggtcatgctcacgcttcaattgcaatattcaaaatcaccagcagcagattcaacaaatgataccaatgtag

SEQ ID NO: 2439 - DNA, 1167 bp, Glycine max var. Williams 82
atgagtgatcccacactagcacaaccacacctagtcgaagtccacacaacactcgaaaccgttgttaccacacacaaccataaccatagaccctcaataaatgcctcaggtgaaaagaagaaaattgtgggggtgttctacaaagggaatgagtatgctaaattgaaccccaatttcgtggggtgtgttgaaggagcattgggtatacgtgagtggctggaatcacagggtcatcagtacattgtcactgatgacaaagaaggaccagattctgaacttgagaaacacattccagatgcccatgtcatcatatctactccatttcaccccgcctatgtcaccgcggaaagaataaagaaagcgcaaaaattggagctgcttttgactgctggcattggttctgatcacgttgatctcaaagctgcagctgctgctggtttaactgtggcagaggtcacgggaagcaatgtcgtgtcggttgcggaggatgaactcatgagaatcctcattctaatgaggaatttcttgcctgggtaccatcaggctgttaagggtgaatggaatgttgctggcattgcacatagagcttatgatcttgaaggcaagacagtaggaaccgttggcgcgggacgaattgggaagcttttactccagaggttgaaaccttttaactgtaatcttctgtattttgatcgacttaggatcgatcctgaattggagaaagagattggagcaaaatttgaggaggaccttgatgcaatgcttccaaagtgtgatgtaattgttatcaacacccctctcactgagcagacaaggggattgtttgacaaaaatagaattgcgaagtgcaagaaaggtgtcttgattgttaacaatgctcgaggggcaattgcggacacccaagcaattgcagatgcttgctccagtggccacgttgcaggttatagtggtgatgtttggttcccacagccagctccaaaggatcatccatggcgttacatgccaaaccatgccatgactcctcatatttctggcaccaccatagatgcacagttacgttatgctgctggggtcaaagacatgcttgataggcacttcaagggtgaagactttccagaacaaaactacattgtcaaggagggtcaacttgcaagccaataccggtga

SEQ ID NO: 2440 - DNA, 1581 bp, Glycine max var. Williams 82
atgctctcaattttgtactcttccgtctcccaatattttcttcttcttcttcttattatcatttttgtgtataaacctcaccttaattactctactcttctctctaattacagttttcaattttgtttcagtgaaattacttgcatagatagagcatcatggccatgatgaaacgtgctgcttcctcttcggttcgctcgctactttcctcatcctccaccttcaccagaaaccttcatgcctcaggtgaaaagaagaaaattgtgggggtgttctacaaagggaatgagtatgctaaattgaaccccaatttcgtggggtgtgttgaaggagcattgggtatacgtgagtggctggaatcacagggtcatcagtacattgtcactgatgacaaagaaggaccagattctgaacttgagaaacacattccagatgcccatgtcatcatatctactccatttcaccccgcctatgtcaccgcggaaagaataaagaaagcgcaaaaattggagctgcttttgactgctggcattggttctgatcacgttgatctcaaagctgcagctgctgctggtttaactgtggcagaggtcacgggaagcaatgtcgtgtcggttgcggaggatgaactcatgagaatcctcattctaatgaggaatttcttgcctgggtaccatcaggctgttaagggtgaatggaatgttgctggcattgcacatagagcttatgatcttgaaggcaagacagtaggaaccgttggcgcgggacgaattgggaagcttttactccagaggttgaaaccttttaactgtaatcttctgtattttgatcgacttaggatcgatcctgaattggagaaagagattggagcaaaatttgaggaggaccttgatgcaatgcttccaaagtgtgatgtaattgttatcaacacccctctcactgagcagacaaggggattgtttgacaaaaatagaattgcgaagtgcaagaaaggtgtcttgattgttaacaatgctcgaggggcaattgcggacacccaagcaattgcagatgcttgctccagtggccacgttgcaggttatagtggtgatgtttggttcccacagccagctccaaaggatcatccatggcgttacatgccaaaccatgccatgactcctcatatttctggcaccaccatagatgcacagttacgttatgctgctggggtcaaagacatgcttgataggcacttcaagggtgaagactttccagaacaaaactacattgtcaaggagggtcaacttgcaagccaataccggtgaagtagtgtgtgtcaatgtggcctttgaatcttccatttttaaggccaatcgatgagcaaataaatatctagaaggcactttaattatgtaatgtacttgctttgttgtgtctgaactcgtttaattgatctcagaaataaaattttaaggaacactctccatgttccatgtattgttcttgtggtttttgaattcgaatttacctctacttgtagtgtaacattgcaaggaaattagtacgcatagttaacaaataagtgattgaaaagttaccaac

SEQ ID NO: 2441 - DNA, 180 bp, Glycine max var. Williams 82
atgtggctgaggaagtttggtggagattctctctgcttatatttatgtaattatgtcattttccacacctgtggttgtgagcttcgaccagggaaagaatctttgaccagaagttgcttccaaaagttgaagtcaaccatatatgcagctgaagcacggcctagtgtgatgcagaactga

SEQ ID NO: 2442 - DNA, 727 bp, Glycine max var. Williams 82
aaatatctaaagagaacaaagcatctttctttggtggtggatattgcatcatccaaatattccgagtttcacaccatgtgagcatgtgaaagtcattgatttccctatagtataccaatcttatagcatgtctgcaattaccttcctcgtctccaacatcatatgtggctgaggaagtttggtggagattctctctgcttatatttatgtaattatgtcattttccacacctgtggttgtgagcttcgaccagggaaagaatctttgaccagaagttgcttccaaaagttgaagtcaaccatatatgcagctgaagcacggcctagtgtgatgcagaactgattcaaaaatggttccatgatctaattctgtttatgtagctggtatcttatcatatgaagtttcttctgaagttgtaacccaaaagaagagttaaaagcaaagtggcccctaataatgaaccttttagatgacaaaagtgatggataatttgaagcagagatttgatttgagaacatggcttgttttggatgatgtttggaatgaacattgggccaactggttaatttcatagaagaaaccttttcaatctgagctttgatggttagtatttgcaaacatctggaactttttttttgtttttttgaaatggtcaaaactgttgatacatcttgacattatgaagggaatttgatattctcacaaagattttcacatttaaaatatc

SEQ ID NO: 2443 - DNA, 207 bp, Glycine max var. Williams 82
atggctatgttaacgagatttttgggttgcatttgcttgatcttgattttaagtgcaggaagtgaggcacggcctttgaacccaacaattgtaagggacgtccttggaaccttgaagtggacaccaatacaaccaattgcagaagaaggtggacagcgtggtacacaaagattgagtccaggaggacctgatgctcatcatcattaa

SEQ ID NO: 2444 - DNA, 2553 bp, Glycine max var. Williams 82
atgaatcttccatccactattcctctagcacttccaacctatttattcatttcgtttgttctagttaattgctaccatgctgaggctacaaatggagacgacatggttatatctataggagcaataattgatgttaactctcgggttgggaaagaacagcttgtagccatggaccttgcagctcaaagtcacaataacacttccaagagccacaagatggcccttcattttcaggaacccaccaaagatcccttcggacccacttctcttgctagaaatatgattaaaacacagaaggcgcaagtgattatagggatgcacacatggacagaagcagcttcagtggctgaattaggacgcgaaactctagttcctgtcatatcctttgcagcacctaccatcaccccaccattgatgccaactcgctggcctttttcggtaagaatggccaacaatggtactgcatatgcaaaatgtgttgcagatgtagtacatgcttatggttggcaaagagtagtagtcatttatgaagatggagattatgagatgctagctttgctatctgagaccctccaagaagttggttcaatgattgagtaccgtttagctcttccatcgccttcttatctacctaatcctggagagtttattcgcgaagagttgtataatttgattaaaaatatacaatcccgggtgttcattgttctgcaatcatcattagaaatggtgatccatttgttcagagaagcttcacacatgggacttgtggaaagagaatcagcttggataatcccagagagcataactaatttgcttgacactgtcaacaagtctgctatttcctacatggaaggagctttaggaatcaagacctactactctaaccatagcaatgaatatcaagactttgaggctcagttccgaaaatcttttcgggccaagtatcctgaggaggataactgtgatccgggattttacgctctgcaagcatatgatagcattaaaattgttgcgcaagcaatagatagaacggccagtggcagaaagactttgctaacagaaatactatctagcaatttccctggcttaagtggagaaattcgatttgaagcagcccaactcttgcagaatcctaccttcaggatggtgaatgtagataagaagagttacagagaattagacttttggactctaaaacgcgggttcatcactagcctcactacagaacaaggttcagatagtgtttctaggaacacagagagtttacgtggtgtaatatggccagggaaactagttagatttccgaagggctggaatctgcctactaaacaaaatccaatgcaaatagcagttcctggaagaacctcctttcccgcgtttgttaaggttgatcctgacgagcatcataattcatataaatttaatggattctgcattgaactttttaataaggtgatagggattttgaagtatgatctgccgcatgagtttcatcccatcaacggaacctataacgatctggttcaacttgtctataacaagtcttacgcggcagctattggagacgtgaccataacagaagacagattgaaatatgtagactttactgcgtcatatgcagaatcaggattgtcaatgatagttacagaagagttcaaagcaccgacatggatgtttacgaagcccttcacctggcaaatgtggttggcaactggtgccgtgttgatttatacaatggtagttgtgtggtaccttgagagggaacccaatcctgagtttcatggcaatttgcaaagccagatcagcactgctcttacgtttaccttctcctctctattctttgctcacagggagaaaatctatagccacttatctcgcatggtgatggtatcgtggatgtttctagtattgattcttagctcaagctacactgctagtctttcttcgattctcacagttcaacgactgcaaccaactgtgacagacatccagatcctgaagaacaacaacaagaaaattggttgtgacggagattcatttgttaggacatacctggagacagtcgaagagttcaagccagagaacatcataaacattggcagtgaaaacagttatgatgatgcattcaaaaacaactcaatagcagctgcttttctcgaactcccttatgagaaagtatatatcagtaaatactgcaagggatactatgcctttgcaatcaacaaaaaatttggaggactgggatttatcttccagaaaggctcaccagtggccagagatttttccaaagctatactgcgtctcttggaggatggaacagtgaaggaattagaagacaaatggttgaaacctgatggagactgccacaataattcgacctcacagggtacagaaagtttgaggcttgaaagtttctgggttctgtatgtgatctatggtgccgcttctactatttgttttctacttcatacaatcctgtcgctgaaatctagacaaacaacccgggatgaggcacgagaaggtaatgccaacccaggtgaggaaagccgatga

SEQ ID NO: 2445 - DNA, 1110 bp, Glycine max var. Williams 82
atggaagcctctaactcacattcgtttctctctcttgtgcacctttttgtgcttttcttattgttatgttttgtggttacaattgaagctaattcaaagaagaaggtctcagccttttatgtgtttggagactccacagtagacccaggaaacaacaacttcatagacacggctttcaggagcgattttcctccctatggtagagattttgttaaccaggctgccactggaaggttcaccaatgggaagcttggcactgattttcttgcttcatatctgggcctaaaagagttggtgccgccatatttggatccaaatctcagcgacaaagaacttgtaactggtgtcagttttgcctctgctggttctgggtttgaccctctcactccaatgctggggaatgtaattccagtagcaaagcagttggaatatttcaaagaatacaaaaagaggttagagggtacgcttggtaagaaaagaaccgaatatcatataagcaatgctttatttttcatcagcgcaggcacaaatgactacgtcattaactatttttcgttgccaatacgaagaaagacctacaccacccccttaacctacggacacttcttgcttcaacacgtaaaagaattcatacagaatttatggaaagaaggtgcacggaaaatagctttggttggagtacctccaatgggatgcttgccgatcatgatcaccttgaattcccataatgtctttctcgaacgtggttgtgtggacaagtattctgctgttgcaagagatcacaatatgatgcttcaacatgaattgttcttaatgcaactaaatttctccaatactaaccctgccggtgctaaaatatcttacctcgacatatatggacccttggatgacatgattcaagcgcatcaaaacctaggttttgatgaggttgatcgtggttgttgtggaagtggttacatcgaagcaacttttatgtgtaatggggtttcatatgtgtgctctgatccatctaagtttgtcttctgggattcaatacaccctacggagaaggcatactatgacctatttatggccgcccgtcccacaattgatgcccttatcaatggctag

SEQ ID NO: 2446 - DNA, 642 bp, Glycine max var. Williams 82
atgatggaacaattgagcgcactccgtccagaacaaagagaagataagacaatgagtacggcaaggtttatcaagtgtgtaacagttggagatggtgctgtgggaaagacatgcatgcttatatcctataccagcaatacctttcccacggattatgttccaacagtgtttgacaatttcagtgctaatgtaacggtggatggtagtactgttaatcttggtttatgggacactgcaggacaagaagattacaacaggctaaggcctttaagctatagaggagctgatgtgtttttgttgtgctattctctcatcagcaaagccagttatgagaacatctccaaaaagtggatacctgagctaagacattatgctccaaatgtgcctatagtgctggtgggaacaaaactagatttgcgagataacaagcaatttctgattgatcatccgggatccgcacgaataacaactgctcagggtgaagaattgaagaaaatgattggtgcagtcacttatattgagtgcagctccaaaacacagctgaatgtgaagacagtttttgatgctgcaataaaggttgcattgaagccaccaaagccaaagaagaaaccacgcaagaaaaggacctgtactttcctctga

SEQ ID NO: 2447 - DNA, 1098 bp, Glycine max var. Williams 82
atggttttctgtggcaacagcactgaagagagtgaactgcatcatgctcaaattcatttgtacaaacacgtatacaactttgtgagttccatggctcttaagtctgctatggaattaggcatagcagacgtaatccatagccacggaaaacccatgactatttccgagttatcctcagctctcaaattgcacccttcaaaagtgagtgtcctccaacgctttctccgccttttaacgcacaatgggttctttgcaaaaacaatattgccgtcaaagaacggtgtagaaggaggagaagaaatagcgtatgctcttactcctccttcgaagcttctaataagaaacaagtcaatatgtttggcgcctattgtgaagggagctcttcattcgagctcccttgacatgtggcattcctccaagaaatggttcagtgaggataaggaactgacactgtatgagagtgcaactggggagagtttctgggactttctcaacaaaaccactgaatctgacacgctgggtatgtttcaagatgccatggctgcagattctaaggtgttcaaacttgcactcgaggaatgcaagcatgtgttcgagggattgggttccctcgtcgatgtgggtggtggaactggtgttgtcacaagactcatcagtgaaaccttccctcacttgaaatgcactgtgtttgaccaaccacaggttgtggctaatttaactggaaacgaaaatttgaactttgttggtggagatatgttcaagtccatcccctctgccgatgcagttttactcaagtgggttctgcatgattggaacgatgaactctctgtgaagatattgaagaactgcaaagaagctatttcagggaaagggaaagaaggaaaggttataattatagacatagcaattgatgaagtaggtgatgatcgcgaaatgactgaattgaagctagactatgatttagtgatgttgactatgtttaatggaaaagaaagagaaaagaaagagtgggagaaactaatttacgaggcaggattcagcaactacaaaattattcccatatgtggattcaaatctctcattgaagtttatccttaa

SEQ ID NO: 2448 - DNA, 3027 bp, Glycine max var. Williams 82
atgacaaacccaaaaaaccaaacaacactctccatcatcatcatagtctacattctcttcttctcactagcaacgacgttggtgtcgtgtctgaaccaagaaggcttatacctctaccagctaaaactctccttagacgacccagactcgaaactctcctcatggaactcacgagacgccactccctgcaactggtacggcgtaacctgcgacgccgcaacaaacaccaccgtaacggagttggacttgtccgacaccaacatcggaggcccattcctctctaacatcttgtgtcgtctcccaaacctcgtttctgtgaacctgttcaacaactccatcaacgaaaccctaccttcagaaatctccctctgtaaaaacctcatccacctcgacctctcccagaatcttctcacgggcccactcccaaacacgctcccgcaacttcttaatctccgctacctcgacctcaccggcaacaacttctccggccccatccctgactcattcggaacattccagaacctggaagttctctccctcgtttcgaatcttctagaaggcacaatcccttcctccttaggtaatgtgagtactctgaagatgctgaacttaagctacaacccttttttccccggtcggatcccgccggagatcggaaacctaacgaacctccaagttctctggctaacgcaatgcaacctcgtcggcgtcattccaacctccctcgggaggttgggaaagctacaggatttggacctcgcgctcaacgacctctacggttccattccgagttcgctcaccgagttaaccagcctgagacagatcgagttgtataacaactcgctctccggggagcttccgaagggaatggggaacctcactaacttgaggctcatcgatgcttccatgaatcacttgaccggaaggattccggaggagctctgttctctgccgctggagagtcttaacctttacgagaatcgcttcgagggcgagttgccggcgagcattgctgattcgccgaatttgtatgaattgaggctcttcggtaaccggcttaccggaaagttaccggagaatctcgggagaaactcgccgctccggtggcttgatgtttcgagcaaccagttctgggggccaattccggcgacgctgtgtgacaagggggcgctagaggagcttctggtgatttacaatcttttctccggggagattccggcgagcctcggcacgtgccagagcttgacacgtgtgaggctcggttttaacagactctccggcgaggttcccgcggggatctgggggctgccgcacgtgtacctgctcgagcttgttgataactcgttttccggttccattgcgaggaccattgctggtgctgcgaacttgtcgctgttgattttgtccaagaacaacttcacgggaacgattcccgatgaggttgggtggttggagaatctcgtcgagttttcagctagtgataataaattcactggttcgcttcctgatagtattgtgaatcttgggcagcttgggattcttgattttcataaaaataagctctctggggagcttccgaaagggattcgttcttggaagaagctcaacgatttgaatctggcgaacaatgagattggtgggaggattcctgatgagattgggggtttgtccgtgctgaattttctggacctttctagaaaccggtttttggggaaagtccctcacgggttgcagaatctgaagctgaatcagctcaatttgtcttataaccgattatccggtgaattacctcctttgttggctaaggatatgtataggtctagttttctagggaatcctgggctgtgtggggatttgaaggggttgtgtgatgggaggggtgaggagaagagtgtgggttatgtttggctgcttcgaacgatttttgttgttgccactttggttttccttgttggtgtggtttggttttactttaggtacaagaatttccaggactcgaagagggctatcgataagtcgaaatggacgttgatgtcgtttcataagctgggttttagtgaagatgagattttgaactgtcttgatgaggataatgtgattggaagcggatcgtccgggaaggtctacaaggttgtgcttagcagtggggaggttgtggctgtgaagaagatatggggaggggttaagaaggaggtggagagtggggatgttgagaagggtggtagggttcaggacaatgcttttgatgctgaggttgaaactttaggtaaaatcaggcataagaacattgttaagctgtggtgttgctgtaccactagggattgcaagctcttggtttatgaatatatgcctaatggaagtcttggtgatttgcttcatagcagtaagggagggttgttggattggccaacaaggtacaagatagctgtggatgctgcagaaggcctctcttatctgcaccatgactgtgttcccgcaattgttcatagagatgtgaaatctaacaatattctgttggacgtggactttggtgcgagggtggctgattttggagtagctaaggcggttgaaaccacgcccaaaggagctaaatccatgtccgtcattgctggctcttgtggctatattgcaccagaatatgcatatacacttagagtgaacgagaagagcgacatatacagtttcggggttgtcatactcgagttggtcactggaaaacgccccgtggaccctgaatttggggagaaagacttggttaagtgggtgtgcacaaccttggaccagaaaggcgtggaccatttaattgatccaaggcttgatacttgtttcaaagaagagatttgcaaggtcttcaacattggactcatgtgcactagtcctcttcctatccaccggccttcaatgagaagagtggtgaagatgttgcaagaggtgggaacagagaaccaaaccaagtctgcaaagaaagatggaaagttatccccttattactatgacgatgcctcggatcatggaagtgttgtttaa

SEQ ID NO: 2449 - DNA, 552 bp, Glycine max var. Williams 82
atgggcacacgtcaaggaaacaaaccttcctctaaaaaatctcatgctgcagaagatagcatttcagctgactcactctcttttgcaggcctagtttctattcaagaccagaattcaaagcctcctattcctaaccacaccacacactactacaaggtaagcaagcaagacttagattttgaattttccaccatacaagaacacctaaattctggttccaacccattcaagatcacacctgctgatgtgctcatttccaatggaaaaatcaaaccatttcaaccaaatcgacctgtcctcacagatccccccatttccttaagatcattgctagctattgatcatgccaataatagcaagatgtcaaatgtgcaacaagctagaaaatatgatgagcaacgtgtcaaagcaagaatccacaaaagcaaggaaaggagtagtagtgtgacaagaacttggtttggccacaaagtgtttaggtcttttctatctccatgcaggaaatgccaagccactcagccaggtgccgttaaaggacaaagtgtgaaatga

SEQ ID NO: 2450 - DNA, 941 bp, Glycine max var. Williams 82
gaccccaacataaatcaatgggcacacgtcaaggaaacaaaccttcctctaaaaaatctcatgctgcagaagatagcatttcagctgactcactctcttttgcaggcctagtttctattcaagaccagaattcaaagcctcctattcctaaccacaccacacactactacaaggtaagcaagcaagacttagattttgaattttccaccatacaagaacacctaaattctggttccaacccattcaagatcacacctgctgatgtgctcatttccaatggaaaaatcaaaccatttcaaccaaatcgacctgtcctcacagatccccccatttccttaagatcattgctagctattgatcatgccaataatagcaagatgtcaaatgtgcaacaagctagaaaatatgatgagcaacgtgtcaaagcaagaatccacaaaagcaaggaaaggagtagtagtgtgacaagaacttggtttggccacaaagtgtttaggtcttttctatctccatgcaggaaatgccaagccactcagccaggtgccgttaaaggacaaagtgtgaaatgagaaaagctcaacatataccactgacatgaagcagaaaattaatgtcatgaggagttttttgcatttcaaagtagtaaagattaagacattaatgttattctatggatcgatgttagtgttagtgttctcggtttttatatgggttcaattttaatgtaatgaatgtgaagtatttttgtatcgagacacaacacaatcatagattgccgactatttatggtgtgcttgatttgtccctgaatcacaaccaacattaaggttgtgtgatagatagattcaagttcaatgggaaaccaaagcaaataaacacacactttggcttgctacaatcttttatcattaatgcatgcctcaagatcaagcacattaaga

SEQ ID NO: 2451 - DNA, 990 bp, Glycine max var. Williams 82
atgggtgctacctctatggtccgaggaggagtcacgaggtttctaccccgaagggaatcattggggtgcgagaaactacaacttggagttggagatgtggagtttgaatttctcgatgatggtgagatgatgatgtcgttggtcaaaagtgatgaaagttctggcgatgagtttcgtcaatccaatgaaatggaattggatgatgatgatgatggtgagagggttgatggtggcagcgttgaggagaatagaagcttttgggataatcaacaccagcttttgcagaactacctatatagatcaacttctattgagtcaaggataaggaatgccaccaaagaagccgttcaggaaatacaaaacgcagaaatagtgtgcagttgcagtagacagataatttccagatcctgtagaaactgcttcattatagaagtctcaagacgccttcagaattctggttataacagtgccatttgcaaaacaaaatggagaagctcaccaagtaatattccatcaggagagcatactttcctagatgtaatagacagcacaagcaaaaagcaagaagttagggtgatcatagaactgaattttcgagcagagtttgagatggcaagggcaagtgaagagtacaacgggctagtgagcaagctccctgaggtgtacgtggggaaaatagagagattaagcaacatcatcaaggtgttgtgtatgggagcaaaaaagtgcatgaaggaaaacaaaatgcacatgggaccatggaggaagcacaagtacatgcaagctaagtggctaggttcatgcaaaaggaacacctcaacaactacttcatcacttaattcaatgatggggtattccgaggtggtgatgccaaaaccaaagcctagagcatcactgctaacagtggatctgatgctagaaaataataattttaagacagaaatgttgaagcttcccaatatgcattgtacagctgttgaagttttgtga

SEQ ID NO: 2452 - DNA, 1315 bp, Glycine max var. Williams 82
ggcgattagagattgatatatctcaccactactcacttttttttcgtatatataaataaccctttccttaatccaatttccacactctaatttgttttagtaaaagaaagaagaccaccttgttcggttgttgtgttgttctaaatgggtgctacctctatggtccgaggaggagtcacgaggtttctaccccgaagggaatcattggggtgcgagaaactacaacttggagttggagatgtggagtttgaatttctcgatgatggtgagatgatgatgtcgttggtcaaaagtgatgaaagttctggcgatgagtttcgtcaatccaatgaaatggaattggatgatgatgatgatggtgagagggttgatggtggcagcgttgaggagaatagaagcttttgggataatcaacaccagcttttgcagaactacctatatagatcaacttctattgagtcaaggataaggaatgccaccaaagaagccgttcaggaaatacaaaacgcagaaatagtgtgcagttgcagtagacagataatttccagatcctgtagaaactgcttcattatagaagtctcaagacgccttcagaattctggttataacagtgccatttgcaaaacaaaatggagaagctcaccaagtaatattccatcaggagagcatactttcctagatgtaatagacagcacaagcaaaaagcaagaagttagggtgatcatagaactgaattttcgagcagagtttgagatggcaagggcaagtgaagagtacaacgggctagtgagcaagctccctgaggtgtacgtggggaaaatagagagattaagcaacatcatcaaggtgttgtgtatgggagcaaaaaagtgcatgaaggaaaacaaaatgcacatgggaccatggaggaagcacaagtacatgcaagctaagtggctaggttcatgcaaaaggaacacctcaacaactacttcatcacttaattcaatgatggggtattccgaggtggtgatgccaaaaccaaagcctagagcatcactgctaacagtggatctgatgctagaaaataataattttaagacagaaatgttgaagcttcccaatatgcattgtacagctgttgaagttttgtgattgtaattactacagaaaagtaggttttatttctctaatctctaattaaattatttgtagcaataggttggtacttcaaagtcgttgccctgaatttggaagatccattaaacaatttacctagctattttgttgattgatactctctttagacctaaatataataaaaaaaaataatctc

SEQ ID NO: 2453 - DNA, 774 bp, Glycine max var. Williams 82
atgttgggaattttcaaggacaagttggtcaatccaccagaagagctaaacagccctgcttctttgaattcatcaaaaaggtctaaacttccaaatgaaatccttcaggaattccagtcctacaatccctccaatgctttctccgttagctttggaaatgatgctttgctagcttattccccttcaaacaaggcctccattcatcacgggttttgtgttttggataacatatactgcattttccttgggagcctaaacaacctaagcaagctcataaagcagtatggtctatcaaagggaacaaatgatgcaatgtttatcatagaagcctataggacacttcgtgacaggggtccatacccagctgatcaggtcctcattgaacttgaaggcagttttggatttgtgatctatgacaataaggatggaacagtttttactgcattgggttctaatggacaaattgagcttttctggggtgttgcagctgatggttctatagttatttctgagaatttggagctgataaaagcaagttgtgctaaatcatttgcaccattccccactgggtgtatgcttcatagtgggcatggtctaatgagctatgagcatcctacgaggaaaatgaagccaatgccaagagttgatagcgaaggggttatgtgtggagccaatttttctgtggactctcaatcaaagtcaatgatgccacgtgttggaagtgaggccaattgggctccttggggggactcacaagcatgcattcaaccatga

SEQ ID NO: 2454 - DNA, 552 bp, Glycine max var. Williams 82
atggcttcgtctctcttactggcggtggtggttgtgcttgatatggttgcttttgctctcgctgttgctgcaaagcaaagaaggaatactgcctcgttaaataaagacagtgcaggtagaaactactgtcaatatgactcagacattgcaaccaacctaggagtggggtccttttttatcctagttgccagtcaagtgatcattatggttgtaactagatgcctgtgctgtgggaaagctatgagacccagtggatcaagatcatgggcaatttgcttattcatcactagttgggtaacatttttcattgctgcttcgtgcctgctagcgggttctgtgaggaatgcttaccacaccaattaccgcgatctcatgggagagagagcaccttcatgccagaccttgaggaagggagtgtttggagctggagctgctttcattattttcaaaggcataacctcagacctttattatgttagtttttcgaaagctaataataatggtcctcctccctatgctagggacactggtgtgaggatgggaaatttgtag

SEQ ID NO: 2455 - DNA, 831 bp, Glycine max var. Williams 82
ctttactctcccatttgcttccgaacaagctttttatttatttatttatttgttacaatctcaagagcttaatataatgtttccattttttagtctttaatccattcttttcttcttcctttttgtggtgtttttgtgtatacatattcagatttaagtggtgggtcagctactatggcttcgtctctcttactggcggtggtggttgtgcttgatatggttgcttttgctctcgctgttgctgcaaagcaaagaaggaatactgcctcgttaaataaagacagtgcaggtagaaactactgtcaatatgactcagacattgcaaccaacctaggagtggggtccttttttatcctagttgccagtcaagtgatcattatggttgtaactagatgcctgtgctgtgggaaagctatgagacccagtggatcaagatcatgggcaatttgcttattcatcactagttgggtaacatttttcattgctgcttcgtgcctgctagcgggttctgtgaggaatgcttaccacaccaattaccgcgatctcatgggagagagagcaccttcatgccagaccttgaggaagggagtgtttggagctggagctgctttcattattttcaaaggcataacctcagacctttattatgttagtttttcgaaagctaataataatggtcctcctccctatgctagggacactggtgtgaggatgggaaatttgtagtagtagtagtagtgttgggaaatcgtttgtaatattaactattaagttggatgtgaaaagctacttgtaaattattatgaattattggttgaaaataagaccccc

SEQ ID NO: 2456 - DNA, 1818 bp, Glycine max var. Williams 82
atggcttctatcttccctatttctcgtatgtccttcactgatttctctgcacccctttcccatttccataacaaaccaaaacgccatcatgtttccaaagtgtcatgccatagtaaccaaaacaactcagcaccaaacccagaagaaggaaaaccatcacacaacattgtagctggaaaaaataggagggatgttctcattggctttggaggactttatggtgcttcaactcttaccaacaataacaacaacaaccctttagccatagctgctcccattctccctcctgacctaaaaacctgtggtccacctgacttagcaactggtgcaaaacctgttaattgttgccctccaatatcttctaccatcatagacttcaagctcccttcttctggagcaccccttagggttagaccagctgctcatttagtcaacgatgtctacatagccaagtatagggaagcccttaagcgcatgaaagccctttcacctaatgaccctcgaaatttcacccaacaagctaatgtccattgtgcttattgtgatggtgcctatcaccaagtagggtttcctaaccttgacctccaagtccacaactgttggctattcttcccttaccaccgttggtacctttatttctatgagagaatcttgggaaacttgattggtgacccaactttcgctcttccattttggaactgggacaatcctaaaggtggcatgacaatcccttccttttacgtagataaaaactcacctttgtatgaccctcttaggaatcttaatcatcaacccccagttctcatagacctagactataacagaagggacgatgatgatcctagtgctagtgaaagtgtagatcccaatgaacaaatcgctagcaacctttctataatgtataggaatgttatctccaatgggaaactcccaaggcttttccttggaagcccttatcgtgctggagatgaacctgaacctggtgctggctctttggagaacgttccacatggtcctgttcactcttggactggtgataagagagagcctaaccgtgagaacatgggaatcttctattctgctgcgagagaccccattttcttttctcaccatgccaacgtggataggatgtggagcatatggaaaacaataccaggtgggaaaagaagggatttcactgaccctgattggttagagtccgcatttttcttctacgatgagaacaagaaccttgtgcgcgtgaaggtgaaggattctcttgacacaagaaagttggggtatgtttaccaagatgttgacattccatggctcaagaataagcctaaacctaaaagatctaaagctaagaagttggcattggcacaagattttatagttggtgcagcacaagctgttgagactacaccaaagagtgttaagttccctttaactttggattcaaaggtaagcacacttgttaaaaggccaaagctgttgaggagcaaggaggagaaggaagaagaggaggaggtgttggtgattgatgggattgagtttgataggaataaagcggtgaagtttgatgtatttatcaatgatgaagatgacaaggtgataacacctagtaatactgagtttgcgggaagctttgtgagtgtgcctcattcacatgtgcacaaaaacaagaagatcaaaacttgctttagagtgggattaacggatttgttagaagacttagaagctgaaaatgatgatagcattttggtgacgttggtacctaagtatgggaaaggacttgttacaattcgggacattaagatagagctcgaaacggaatga

SEQ ID NO: 2457 - DNA, 1829 bp, Glycine max var. Williams 82
atggcttctatcttccctatttctcgtatgtccttcactgatttctctgcacccctttcccatttccataacaaaccaaaacgccatcatgtttccaaagtgtcatgccatagtaaccaaaacaactcagcaccaaacccagaagaaggaaaaccatcacacaacattgtagctggaaaaaataggagggatgttctcattggctttggaggactttatggtgcttcaactcttaccaacaataacaacaacaaccctttagccatagctgctcccattctccctcctgacctaaaaacctgtggtccacctgacttagcaactggtgcaaaacctgttaattgttgccctccaatatcttctaccatcatagacttcaagctcccttcttctggagcaccccttagggttagaccagctgctcatttagtcaacgatgtctacatagccaagtatagggaagcccttaagcgcatgaaagccctttcacctaatgaccctcgaaatttcacccaacaagctaatgtccattgtgcttattgtgatggtgcctatcaccaagtagggtttcctaaccttgacctccaagtccacaactgttggctattcttcccttaccaccgttggtacctttatttctatgagagaatcttgggaaacttgattggtgacccaactttcgctcttccattttggaactgggacaatcctaaaggtggcatgacaatcccttccttttacgtagataaaaactcacctttgtatgaccctcttaggaatcttaatcatcaacccccagttctcatagacctagactataacagaagggacgatgatgatcctagtgctagtgaaagtgtagatcccaatgaacaaatcgctagcaacctttctataatgtataggaatgttatctccaatgggaaactcccaaggcttttccttggaagcccttatcgtgctggagatgaacctgaacctggtgctggctctttggagaacgttccacatggtcctgttcactcttggactggtgataagagagagcctaaccgtgagaacatgggaatcttctattctgctgcgagagaccccattttcttttctcaccatgccaacgtggataggatgtggagcatatggaaaacaataccaggtgggaaaagaagggatttcactgaccctgattggttagagtccgcatttttcttctacgatgagaacaagaaccttgtgcgcgtgaaggtgaaggattctcttgacacaagaaagttggggtatgtttaccaagatgttgacattccatggctcaagaataagcctaaacctaaaagatctaaagctaagaagttggcattggcacaagattttatagttggtgcagcacaagctgttgagactacaccaaagagtgttaagttccctttaactttggattcaaaggtaagcacacttgttaaaaggccaaagctgttgaggagcaaggaggagaaggaagaagaggaggaggtgttggtgattgatgggattgagtttgataggaataaagcggtgaagtttgatgtatttatcaatgatgaagatgacaaggtgataacacctagtaatactgagtttgcgggaagctttgtgagtgtgcctcattcacatgtgcacaaaaacaagaagatcaaaacttgctttagagtgggattaacggatttgttagaagacttagaagctgaaaatgatgatagcattttggtgacgttggtacctaagtatgggaaaggacttgttacaattcgggacattaagatagagctcgaaacggaatgaaaatatgtaac

SEQ ID NO: 2458 - DNA, 1863 bp, Glycine max var. Williams 82
atggcttatatctcctctctatcatctttctccctctccaatttctctgcacctcttcccatttccatctgttcctcatcttccgccttcctaacttcccaaataccatgcaaacccaccaaacgtagcaaaccaaaaggccatcatgtttccaaagtgtcatgcaacagtaaccaaaacaccccaacaccaaacccagaagaagaaaaaccatcgtcatacaacattctaggaaaacatcggagggatgttctccttggcattggaggcctttacggtgcttctgctcttagcaacaccaaccctttagccatggctgcagctcctattctcgagcctgacctagaacattgttgtataactgatgatgtaccacctaaaggggtcatcgaggcacaagtctattgttgcccaccaaaatcttcttcccctcctatagatttcaagttgcctaaaggaacacccctcagggttagaccacctgctcaatttgtgaccgatgagtacctagaaaagtataagttagcccttaagcgcatgagagagcttccatctgatgatcctcgaagtttcaagcaacaagctgatatccattgtgcttattgtgatggtggctataagcaattagggttcccagttgagctagacttcaaagtccacttttcatggatatttttccctttccaccgttggtacctctatttctatgagcgaatcttgggtagcttgattgatgacccaacctttgcacttccgtattggaactgggacaatcctgatggtggcatggtattgccttccattttcgcagatgaagactcccctctatatgaccctcgcaggaatccagacatcacaccaactactctcgtagacctaaactatggcagtggaaaggaaccaagcgtagaacaaaacctcggtgtaatgtatacgagtgttgtctctggtgcgaaacgcgcatcgctcttccatggaaaaccatttcttgctggaaagcagcctgagctaggtggagggaccgtagagcttggtcctcatactgctgtccaccgttggaccggtgatccaagacaacctaacaaagaggacatggggaggttctattctgctggaagagaccccgctttctattctcaccatgccaacgtggatcgtatgtggaatatatggaaaacaataccaagtggaaaaagaagggatttcaaaaaccgtgattggttggaaacctcctttttcttctacgatgagaacaagacccttgtccgtgtgaaggtgaaagacagccttgacacgaataagatgggttatgtttaccaagatgtcgccattccatggctcgagaaaaagcctaaacccaaaagaactagaaaggctaagaaggtggcgttcgcacaacaatttggcggcattggtgcagcaatggctgctgagactgggccaagttccaagtttcctctcactttgttggactcaaaggtaaccctactagttaaaaggccaaagcagttgaggagcaagagggacaaggaggaagaggaagaagtgttggtgattgatgggattgagtttgatggggatgatgatgtgaagtttgatgtctatattactgatgaagatgtcgaggatattggaccagagagcacagagtttgcaggaagcttttcgactctgggtcattcccattcgaacatgaacatggacaagaagatcaaaactagcttgacactgggaataacagatttgttagaggacttggatgctgaaaatgatgatagtgttttggtcacattggtaccacgatctgagaatgtaagcatcacaattcagaacataaagatagagtttgagaaggatgagtga

SEQ ID NO: 2459 - DNA, 2093 bp, Glycine max var. Williams 82
aaagaagatcgatcatggcttatatctcctctctatcatctttctccctctccaatttctctgcacctcttcccatttccatctgttcctcatcttccgccttcctaacttcccaaataccatgcaaacccaccaaacgtagcaaaccaaaaggccatcatgtttccaaagtgtcatgcaacagtaaccaaaacaccccaacaccaaacccagaagaagaaaaaccatcgtcatacaacattctaggaaaacatcggagggatgttctccttggcattggaggcctttacggtgcttctgctcttagcaacaccaaccctttagccatggctgcagctcctattctcgagcctgacctagaacattgttgtataactgatgatgtaccacctaaaggggtcatcgaggcacaagtctattgttgcccaccaaaatcttcttcccctcctatagatttcaagttgcctaaaggaacacccctcagggttagaccacctgctcaatttgtgaccgatgagtacctagaaaagtataagttagcccttaagcgcatgagagagcttccatctgatgatcctcgaagtttcaagcaacaagctgatatccattgtgcttattgtgatggtggctataagcaattagggttcccagttgagctagacttcaaagtccacttttcatggatatttttccctttccaccgttggtacctctatttctatgagcgaatcttgggtagcttgattgatgacccaacctttgcacttccgtattggaactgggacaatcctgatggtggcatggtattgccttccattttcgcagatgaagactcccctctatatgaccctcgcaggaatccagacatcacaccaactactctcgtagacctaaactatggcagtggaaaggaaccaagcgtagaacaaaacctcggtgtaatgtatacgagtgttgtctctggtgcgaaacgcgcatcgctcttccatggaaaaccatttcttgctggaaagcagcctgagctaggtggagggaccgtagagcttggtcctcatactgctgtccaccgttggaccggtgatccaagacaacctaacaaagaggacatggggaggttctattctgctggaagagaccccgctttctattctcaccatgccaacgtggatcgtatgtggaatatatggaaaacaataccaagtggaaaaagaagggatttcaaaaaccgtgattggttggaaacctcctttttcttctacgatgagaacaagacccttgtccgtgtgaaggtgaaagacagccttgacacgaataagatgggttatgtttaccaagatgtcgccattccatggctcgagaaaaagcctaaacccaaaagaactagaaaggctaagaaggtggcgttcgcacaacaatttggcggcattggtgcagcaatggctgctgagactgggccaagttccaagtttcctctcactttgttggactcaaaggtaaccctactagttaaaaggccaaagcagttgaggagcaagagggacaaggaggaagaggaagaagtgttggtgattgatgggattgagtttgatggggatgatgatgtgaagtttgatgtctatattactgatgaagatgtcgaggatattggaccagagagcacagagtttgcaggaagcttttcgactctgggtcattcccattcgaacatgaacatggacaagaagatcaaaactagcttgacactgggaataacagatttgttagaggacttggatgctgaaaatgatgatagtgttttggtcacattggtaccacgatctgagaatgtaagcatcacaattcagaacataaagatagagtttgagaaggatgagtgaaaatatgtcactcatttactactaaactattgcatgcttggtgaggtgtttccaacacgcaaatgagtttaaatttatatcagcatgtttagcaatttcaaagcaaaaaaaaaataatcatgttttaattgctcaatatggcaaaagtaatatgttgttgttttattggcaaataccctcttattgtatgttttgtttaatgttggttaagagctt

SEQ ID NO: 2460 - DNA, 4155 bp, Glycine max var. Williams 82
atggcggatgctgatgtggacctttcgggattgttcaccggtaatgccgacgaagacgacgacatgttttatatagatatgcagacggtccagaaggttcttgatgaagacgacgattgttactttcaggagagtagtcccgaggattcttcatcaaaagatgtttcacctagtgaatccggcattcatgacacttttcagatacaaaatgggtctcaagtgcaagaagaacctcatttttctaggttgggccttgcagattcagtcacgagctgttctccattcttctcagatgtgtcagattctggggtcagatgttcagttggtgtatctgattctgcagcaaattctatgctagattgtgaacgtgaaagtgaacgtgaaaaccggggacctcaatctcaggcttgctcttccccaaaagcttttcctggtaatttcagtgactcattctctccaggtgaaagtcatgaggttttctgcacagaaaggaccggagtttttaaacacgagatacctgcttatagtgtagaagcaagtttccccaaggcacagtcaaacaaaatatcaatttgtggagataatttgaatctgagtatgtggattggtgaaaatgagagtcaattcaagcatgtgggagaggatgttgaatctgaacatgcttcactcagttctattgttgacaatgatgatgtaaatgctgaagacatcattaccggagtttctgggcaacaggaaaatgactcatgtacatcttttgaagcatcatttatggatgctgatagatctttgcatgtcactacctcaactgattctactattggtcaaggttcccatgtttccagtgatttcattgactaccatgtatcttcaaactgttaccagggaacatatcatggaccctttgttgctgactcttctcttggttttgtgcctaatggtatttattctcaattgtggccagatgaagaaatgatgaataacattaaggctgaaaatgtggagttaaatgctgatattgcatgtatgagtaatggcttgccctcaagcactactgggtggatgccttttcaggatagtcaaattatgttagctgataatggttatccatcatttcattctggtaaagttaatgttgatgacatgtcatcactgtctctttcagcttgtgcttcatacatgtcatatggagaccattaccaaaacaattttcactgtgatgatgctgagttcaatgtaggccaagaggtgaaagaaacacctggtattttttcttctgtagggtgtcaggcttaccaatgttttgagaatgagaataattttgcagttatatctgggatatccaatcaatatcaagatagcattggtggaacggctagttttcaaggaaacttggacaatttgaatttaaaagctgcagatatatcttggacccatccccaagcactaattaccaatgagcagcagtttggtagtgttaagagcgaaggagggattcaacataactttattaattctcatctttcaaaaggaagaactgagaatttctatgttgaggaagaccctgatgtttgcattattgaagacatcagtcatcctgctccgacgagtcgatctgcagacattgggaattcccttaatatatctcaatcttctagatatgttgattcccagtcttacacggttggaagtacaaggatgaaggcatgtgatgaacggaatatattacgagttgcattgcaggatctatctcagccaaagtcagaagttagtccaccagaaggattgctggcagttcctcttttaagacatcagagaattgctttatcatggatggttcaaaaggaaacatcaagtttatattgctcaggaggaattcttgcagatgatcagggacttggaaaaacagtatcaactattgcattaatattaaaggaaagacctccattacttaatgggtgcaccaatgcccgaaaaagtgaattggaaactctgaatctggatgtggatgatgacgtgcttcctaagactggtagagtaaaggaagaatctaatatgtgtgaggataatccaagtagatatccaaccaagagcatgagtttgttgaagcaagacaagggaaggccatctgctgggacccttattgtttgccccactagtgtcctgcgccaatgggctgaggagctgcgtagcaaggtaaatggtcaggcaagtctctctgtgctagtataccatggaagcaatcggacaaaagatccttatgaggtggctaggcatgatgttgtcctaacaacttattccattgtcagcatggaggttcctaagcagcctccagctgacaaagatgacgaggaaaaggaaatttttgaagaccctgccacagcaagtaggaaaagaaaaagcccttccaattctagtaaaagtggcaagaaaaaattggatggcacaattcttgaaggtgttgctcggccacttgcaaaggtggcatggtttagggttgtcctggatgaggcccagagtataaagaatcacaaaactcaagttgcaagggcctgttggggtcttcgtgctaagcgcagatggtgcttgtcagggactcctatccagaatgcaattgatgatctctacagttacttcagatttctaagatatgacccttattctgactatgcatcattttgtactagaattaagagccaaattaccaaaaacccagaaaatgggtatagaaagttacaagctgttttgaagacaataatgttacgccggaccaaaggtacacttcttgacggggaacctattatttccttgccgcctaagtatatagagctgaaaaaagttgatttttctatggaggaacgtgatttctattccaaactagaggctgattcacgtgcacagtttcaggaatatgctgatgctggaactgtcaagcaaaattatgtaaacattttgctgatgcttctgcgccttagacaagcttgtgatcaccctttgcttgtcaagcgatacaattcaaactctctatggagatcttcggttgagatggcaaagaagcttcctcaggaaaaacagatctctcttctgaaatgtttagaggcttccttggccctctgtagcatttgtaatgatcctcctgaagatgcagttgtttcagtttgtggccatgttttctgtaaccaatgcatctgtgaacatcttaccggcgatgacaatcagtgccctgctgcaaattgcaaaagtcgactgagcacatctatggtattttcaaaaaccacactgaacagttgtctttctgaccagagttgtgataattcacccagtcgctctggttctgaagtggaagaatctgagccttggtctgaaagtaagccatatgattcttcaaaaataaaggctgcacttgaggttttgaagtcattgtgtaagccacagtgctgtacaccaaaaagtacttctgagcatggcactttcagggaagataatgattgccctaggaacccctccattgctaacaatgggaaatccttaaaagattctctggagagtcaaaatttgtctgatgagagtagaagctctaatggttcagttactgttgtaggggagaaagctattgtgttttctcagtggacgaggatgctagatttgcttgaagcgtgtctcaagaattcttcgattaactatagaaggcttgatggaacaatgtcagttgttgcaagagataaagctgttaaagattttaacacttgtcccgaggtaaccgtgataattatgtctttgaaggccgccagtcttggtctcaatttggtggtagcttgccatgttcttatgctagatttatggtggaatcctacaactgaagaccaagcaatagatagagcacatcgaattgggcagactcgtcctgtgactgttttacggttaaccgtgagagatacagttgaagatcgtatcctagatctgcagcaaaagaagagaacgatggttgcatctgcatttggggaggatggaactggtgtcatcttgggtgtctttccggtgactgctgaagaaacagaaacagaaagaaacagaaacagaaacagaacattttctaacaaaggattggaagtggtaacaaggttgcatttgacttttgacattcagattatatga

SEQ ID NO: 2461 - DNA, 4681 bp, Glycine max var. Williams 82
agcggcgcacgacttcttaacatgcgcacccttccgtaacgaacccaaatcgtatttaaactgcgcacactgcgttcttcaccttcaaccactctctctctataattttttttttttaatctttttgatttgattcgcttctagcttttttcctgactctaaattgggacgaaaagtcgaaccttcgaagaaactcagaaaactcagaaaccatcgctgactccgcaattttcgtcgattccacacacactctctctttttttctccgctatgcgattcgatgaagtgattctgaattcggagcaagagtttttgtttctgcggaagtgtaacagcttaagaaagcgcttttagggttttttttttggttgttgttgtggtggtgctgttgtgatggcggatgctgatgtggacctttcgggattgttcaccggtaatgccgacgaagacgacgacatgttttatatagatatgcagacggtccagaaggttcttgatgaagacgacgattgttactttcaggagagtagtcccgaggattcttcatcaaaagatgtttcacctagtgaatccggcattcatgacacttttcagatacaaaatgattcagtcacgagctgttctccattcttctcagatgtgtcagattctggggtcagatgttcagttggtgtatctgattctgcagcaaattctatgctagattgtgaacgtgaaagtgaacgtgaaaaccggggacctcaatctcaggcttgctcttccccaaaagcttttcctggtaatttcagtgactcattctctccaggtgaaagtcatgaggttttctgcacagaaaggaccggagtttttaaacacgagatacctgcttatagtgtagaagcaagtttccccaaggcacagtcaaacaaaatatcaatttgtggagataatttgaatctgagtatgtggattggtgaaaatgagagtcaattcaagcatgtgggagaggatgttgaatctgaacatgcttcactcagttctattgttgacaatgatgatgtaaatgctgaagacatcattaccggagtttctgggcaacaggaaaatgactcatgtacatcttttgaagcatcatttatggatgctgatagatctttgcatgtcactacctcaactgattctactattggtcaagatgaagaaatgatgaataacattaaggctgaaaatgtggagttaaatgctgatattgcatgtatgagtaatggcttgccctcaagcactactgggtggatgccttttcaggatagtcaaattatgttagctgataatggttatccatcatttcattctggtaaagttaatgttgatgacatgtcatcactgtctctttcagcttgtgcttcatacatgtcatatggagaccattaccaaaacaattttcactgtgatgatgctgagttcaatgtaggccaagaggtgaaagaaacacctggtattttttcttctgtagggtgtcaggcttaccaatgttttgagaatgagaataattttgcagttatatctgggatatccaatcaatatcaagatagcattggtggaacggctagttttcaaggaaacttggacaatttgaatttaaaagctgcagatatatcttggacccatccccaagcactaattaccaatgagcagcagtttggtagtgttaagagcgaaggagggattcaacataactttattaattctcatctttcaaaaggaagaactgagaatttctatgttgaggaagaccctgatgtttgcattattgaagacatcagtcatcctgctccgacgagtcgatctgcagacattgggaattcccttaatatatctcaatcttctagatatgttgattcccagtcttacacggttggaagtacaaggatgaaggcatgtgatgaacggaatatattacgagttgcattgcaggatctatctcagccaaagtcagaagttagtccaccagaaggattgctggcagttcctcttttaagacatcagagaattgctttatcatggatggttcaaaaggaaacatcaagtttatattgctcaggaggaattcttgcagatgatcagggacttggaaaaacagtatcaactattgcattaatattaaaggaaagacctccattacttaatgggtgcaccaatgcccgaaaaagtgaattggaaactctgaatctggatgtggatgatgacgtgcttcctaagactggtagagtaaaggaagaatctaatatgtgtgaggataatccaagtagatatccaaccaagagcatgagtttgttgaagcaagacaagggaaggccatctgctgggacccttattgtttgccccactagtgtcctgcgccaatgggctgaggagctgcgtagcaaggtaaatggtcaggcaagtctctctgtgctagtataccatggaagcaatcggacaaaagatccttatgaggtggctaggcatgatgttgtcctaacaacttattccattgtcagcatggaggttcctaagcagcctccagctgacaaagatgacgaggaaaaggaaatttttgaagaccctgccacagcaagtaggaaaagaaaaagcccttccaattctagtaaaagtggcaagaaaaaattggatggcacaattcttgaaggtgttgctcggccacttgcaaaggtggcatggtttagggttgtcctggatgaggcccagagtataaagaatcacaaaactcaagttgcaagggcctgttggggtcttcgtgctaagcgcagatggtgcttgtcagggactcctatccagaatgcaattgatgatctctacagttacttcagatttctaagatatgacccttattctgactatgcatcattttgtactagaattaagagccaaattaccaaaaacccagaaaatgggtatagaaagttacaagctgttttgaagacaataatgttacgccggaccaaaggtacacttcttgacggggaacctattatttccttgccgcctaagtatatagagctgaaaaaagttgatttttctatggaggaacgtgatttctattccaaactagaggctgattcacgtgcacagtttcaggaatatgctgatgctggaactgtcaagcaaaattatgtaaacattttgctgatgcttctgcgccttagacaagcttgtgatcaccctttgcttgtcaagcgatacaattcaaactctctatggagatcttcggttgagatggcaaagaagcttcctcaggaaaaacagatctctcttctgaaatgtttagaggcttccttggccctctgtagcatttgtaatgatcctcctgaagatgcagttgtttcagtttgtggccatgttttctgtaaccaatgcatctgtgaacatcttaccggcgatgacaatcagtgccctgctgcaaattgcaaaagtcgactgagcacatctatggtattttcaaaaaccacactgaacagttgtctttctgaccagagttgtgataattcacccagtcgctctggttctgaagtggaagaatctgagccttggtctgaaagtaagccatatgattcttcaaaaataaaggctgcacttgaggttttgaagtcattgtgtaagccacagtgctgtacaccaaaaagtacttctgagcatggcactttcagggaagataatgattgccctaggaacccctccattgctaacaatgggaaatccttaaaagattctctggagagtcaaaatttgtctgatgagagtagaagctctaatggttcagttactgttgtaggggagaaagctattgtgttttctcagtggacgaggatgctagatttgcttgaagcgtgtctcaagaattcttcgattaactatagaaggcttgatggaacaatgtcagttgttgcaagagataaagctgttaaagattttaacacttgtcccgaggtaaccgtgataattatgtctttgaaggccgccagtcttggtctcaatttggtggtagcttgccatgttcttatgctagatttatggtggaatcctacaactgaagaccaagcaatagatagagcacatcgaattgggcagactcgtcctgtgactgttttacggttaaccgtgagagatacagttgaagatcgtatcctagatctgcagcaaaagaagagaacgatggttgcatctgcatttggggaggatggaactggtgatcgtcagactcggcttactgtggatgatttaaaatatttgttcatgatgtgattagacatacatatttacagatataattacattttttggattggtgattttttgacctggggacaggtgtcatcttgggtgtctttccggtgactgctgaagaaacagaaacagaaagaaacagaaacagaaacagaacattttctaacaaaggattggaagtggtaacaaggttgcatttgacttttgacattcagattatatgaaatgtttatatggtgctagaatgagatgtttcattctttgacctggaaattttagtttaatctcacatctttgtaggatgtagagagcagtagcatatatagcaacatagaaattttttatggattgttcttttcattgtaaataatatagaaatttttgctttaccattttgctcctttttattgctccattt

SEQ ID NO: 2462 - DNA, 1104 bp, Glycine max var. Williams 82
atggttgaacaaaaaaatcaggtcatccctcttcttactccttacaggatggggaacttaaatctttcacacagaatcgttttggcgccactatttagagcaagatcttacaacaacgttgctcagccgcatgctattctatattactctcaaagagctaccaagggaggtcttctgattactgaagctactactatttcacccacttctaaataccatccaaacgcagttggtatatggtcaagagagcaaatcgaagcatggaaacccattgtggatgctgttcatgccaaaggtggtatattcttctgtcagattgttcatactggaagggcttacgatccagatcttaagcccgatggacaaaccttaatatcatcaaccaacaagccatttacacataatgccaccgaaccaacggcactaaggacggctgaaattcctgatatcgtcaatgaattcagacttgcagcaaggaatgctattgaagcagggtttgatggagttgagatccatggggcacatggttttctaattgatcaatttttgaaagaccaagttaacgacagaacagacaaatacggtggatcattggagaatcgttgtcgttttgcattagaagttgttgaagctgttgttgaggagataggggcagatagagttggaatgagactttcacccttttcagacttcaatgaatgtagtgactcaaatcctcaagcattaggtctctacatggccaaatcacttagcaaacatggtgtgctttattgccacatggttgagccaagatgggacatttctggggagaataaggaaacccttcacactctttcaccaatgaagaaagcttttgatggaaccttcattgttgctgggggttatgatagagaagaagggaacaaggctgtgaccgcggacaaggcaaatcttgttgcttatggccgtttgtttttggctaatccggatttgcctaaaaggtttgaggttgatgaaccactcaacaagtacaatagggataccttctacactcctgatccagttgtgggttatactgactacccatttcttgaaggtagtgtgcttaaggaccacatgaactag

SEQ ID NO: 2463 - DNA, 1467 bp, Glycine max var. Williams 82
atggcagaggagaatatcaggcaaccattgttggagaaaaagtactatgaggactgccccggttgtaaagtggatcaagccaaagagttgagtaagggacagggtgtttccattagaaatcttttgataatatggatggtggtgttgtgttctgcattgcctatatcatctctctttccattcctttatttcatggtaagggattttaatattgcaaaaacagaagccgatattagttcttatgctggttatgttggttcttcctacatgcttggcagatgtttgacatctgtattgtggggaattgtagccgatcgctatggtcgaaaacctgttatagttatagggataatttcagttgtccttttcaacacactatttggccttagcacaagtttctggatggcttttatcatgagatttcttctggggagtttccatggtttgctcggaacagtgaaggcgtatgccactgaactttttcgagaagaacaccaagctctaggactctctactgtcagtgcagtttggggcataggtttaatcattggcccggccttgggaggctatttggctcagccagcagagaagtacccagatatatttccaaaggattccttttgggataagtttccctacttcttgccctgttttataatatcagcagctgcatttgtagtagctattggctgcatctggattccggaaacacttcacaaccacaattctaacaatgaatccatagacaattcagaagctttagaaaatggaagcagtggggctagcaatgaaaagacaatccaaaagaatgaaaacctcctgcggaattggcccttaatgtcatctatcctttcttattgtgttttctcacttcatgatattgcttatcaagaggttttctcattatggtctgtcagtcctcaaaggctggggggcttgaactttacaactaatgatgttggtaatgttctttcaatatcaggtcttgcacttatcacttaccaacttaccatataccaatctgtggaaaaagctagtggacctatcagtattgcccgcatctcagcgatgttatccatacctcttttgcaaagctaccccttcatagcattgttgtcaggcttagcactatacatagtgctaagtattgcttcaattctgaaaaatattctgtctatcaccattgtaactggtttgttcattctacaaaaccgagcagtggaacaacaccaaaggggggcagctaatggcattgctatgacaggcatgtctctattcaaagctattggccctgctgcaggtggtgcactattaacttggtcagaaaagcgaatggatgcttcttttctccctggcacccatatggtcttctttgccttgaacatagttgaaggatttggattactaatgttgttcaaaccattccttgttgaaaagatgaaaacacactcagatgagttacactga

SEQ ID NO: 2464 - DNA, 1338 bp, Glycine max var. Williams 82
ccaaccctatatgtagcaattagtgagtgatgatgagttcatcctttgccttttgtctttccatggaatgcacaaaaactaaaaagtaggaatatccctgccttaccctccaagtaattgttgcttaaatacatatggttggtggactatatatttacttgaacctgaaccaaaacaaaaccattaattccatttgtttccttcatatggctaacaacattcttaccatgacaaacctcaatttcgaacttgattgcaagagaactcatgattctttggggagtttgagtcaattgatcacatctctggcttgtgtaacccaccatgaaagacaacaactcagggagacctttaaggcagtgaatggagaagacttgataagtcatcttcaaagatatgaagatgcgttttattctccttcttcttcttcttcttcttcttcttcttcttcttcttcttcttcttcttcttctatgaactgttctgctatttccttgtggatgcttgacacacatgacagggatgctgttgtggctagagaagctctccaacaagatgagaccaatttcaaggctcttgtggagatttttgtgggtagaaaatcaagtcatgttcttctcatctcacaggcctaccagaaaatgttcaaaagacacttggaccaagatattatcaatttggaccctccacacccctttcaaaagattattgtggcattggctgcatcacacaaagctcatcaagcagatgtcaaccatcatatatccaagtgtgatgctaggaggctctatgagactggggagggaagcttaggaactgtaattgaagctgttgtgttagaaattttaagcaagaggagcattccccaactgaagctaacattttttagttataaacacatttatggacatgactacacaaagtctatcaagagggggaaatacggtcaatttggtaaagctttaaaggtggttgtgaaatgcatttgtaatccagcacactattatgcaaagatactgtactcaagcatcaaaggggaaacaagggacagaagagttttggcacgaacattggtaagcagggctgagatagacatagatgaaattagaagggttttcaaagaaaagtatgggaaggaacttgctgatgctatatgtgaaggctttccatctggtgactactacagagactttcttgttgccttggctacaagatctaagtagaccctgttgcatctgatcttaacttgtattgcaacaaaatttgttgagaatagtataattcatatcaactttttgagtttcttttgtgggtaacatgaattgaaagaagcttgtt

SEQ ID NO: 2465 - DNA, 1053 bp, Glycine max var. Williams 82
atgcctccaacaaatctcgcagatttcacgaacaaaaaaatggatcatgagcaagaagcaagtgaagaaaacaaattaagccaagattgtaaggagttaattctatctcttcctagagagaagggttggataacaccgtatctctatttattccaaggcttttggtactcatcaactgaaatccaagccataaacacttttcaaaaccaattccaagctaaggacaatgatgttgttattgctagtgttccaaaatcgggcaccacttggttgaaagcccttacctttgctattctccatcgccagtattttccttccttagagaaccacccattacttattttcaatccccatgaacttgtgcctccatttgaatttgtcatttatgatgaaattaatggccaaactcatgacctatccaaaatgcccgagccaagaatttttgggactcatgttccattcacttcattggccaaatcaattaaagagactgactgtaagatcatttatatttgtaggaatctatttgacacctttgtttctacttgggtttttgtcaacaaaattatgccaaagtttttgcctacattacctctagaggaagcttttgaaagatactgtgaagggataattggctttggtccatcttggaaccatatactagattattggaaagagagcattgctaggccgaagaaagttttgttcttgaagtatgaggaccttaaagaaaatgttcattttaatgtgaagaaaatagctgagttcttgggttgtcctttcactaaagaggaagaaaatagtgaagtgattgaaaatataatcaaattatgtagctttgagaagatgaaggaattaaaggtaaataaatctggaacaatgggaaaaggcaggattgttgagaataagtacttctttcgaaaggcagaaataggagattgggtaaattatttctccccttcaatggttgaaaaactatccaaaatcatagaagaaaagttaagtagatcgggtctatcatttagagtgtacgacttcaatagtagtagctag

SEQ ID NO: 2466 - DNA, 1415 bp, Glycine max var. Williams 82
attctttcctacttgatactaccattaatcagcacgccaaccactattatataacaagctacatttaccacttctaatgcctccaacaaatctcgcagatttcacgaacaaaaaaatggatcatgagcaagaagcaagtgaagaaaacaaattaagccaagattgtaaggagttaattctatctcttcctagagagaagggttggataacaccgtatctctatttattccaaggcttttggtactcatcaactgaaatccaagccataaacacttttcaaaaccaattccaagctaaggacaatgatgttgttattgctagtgttccaaaatcgggcaccacttggttgaaagcccttacctttgctattctccatcgccagtattttccttccttagagaaccacccattacttattttcaatccccatgaacttgtgcctccatttgaatttgtcatttatgatgaaattaatggccaaactcatgacctatccaaaatgcccgagccaagaatttttgggactcatgttccattcacttcattggccaaatcaattaaagagactgactgtaagatcatttatatttgtaggaatctatttgacacctttgtttctacttgggtttttgtcaacaaaattatgccaaagtttttgcctacattacctctagaggaagcttttgaaagatactgtgaagggataattggctttggtccatcttggaaccatatactagattattggaaagagagcattgctaggccgaagaaagttttgttcttgaagtatgaggaccttaaagaaaatgttcattttaatgtgaagaaaatagctgagttcttgggttgtcctttcactaaagaggaagaaaatagtgaagtgattgaaaatataatcaaattatgtagctttgagaagatgaaggaattaaaggtaaataaatctggaacaatgggaaaaggcaggattgttgagaataagtacttctttcgaaaggcagaaataggagattgggtaaattatttctccccttcaatggttgaaaaactatccaaaatcatagaagaaaagttaagtagatcgggtctatcatttagagtgtacgacttcaatagtagtagctagtcaatgatcatcttgagatggttattatatataataagtagctaataaataaccatatgctagtgaataaatcaaaatgtggcacaaaaatgtttttgtggcttttatttcttagaataaggaggtgtaagtcttagacaatatggctacctcggtaattattatttggaatcaacaggatcgcaagttgtatttaagttgtatgattatctatatttattttaattcttttgctaatatgtttcataatttggaagtactacagattaagtgaaaatcatagtcc

SEQ ID NO: 2467 - DNA, 351 bp, Glycine max var. Williams 82
caacaaaagggacaaaaggatatcaaagttacatatatttcgagccccgtgaaggtgaagactagtgcctcgaatttcagggcccttgtgcaagaactcactggccaatactccaatgttgctgaaacctccatgcctatggaagaagaagaaaatggccattccgagagagtgcacaaaactcatcttcttcatgaaagtgaaactcaactatggagggtggatgttgatgagggcaccaatttgatgaaacctcttgagtatagtgagtacctctcaagatccttgatggagccattcaaccaacaacaacaccttcaatacgatttgttgagttttgacatgtcatag

SEQ ID NO: 2468 - DNA, 1323 bp, Glycine max var. Williams 82
atgggtgctgtttgttgtgttgctgccaaagataaaactatacaaagtgcatcacccagtgaaatcttgcatcggaatattcgacattctccaacatggaacttccgctgggatcatcgagggcgtgtagctggtgaagatactgctgtaacttggttttctaacagtattagcgggaatgatggatttgagaacaaaaatgaatcctcgtatgtatcggaggatggaagcccattgcagaattatcaaattcaaaggaataatagattgcaaaaatccccaatctctgaaggaactgctagaaacgtgataaattcatcttctgatcaaactatttcaaggaatatctcctcaaatgtgagcatagaacaggtgaaggagttggcagaatcatcaaccgtatcatgcccatatcccgcaaaacttccacattcattaccttctacttctttgtcagtatctcctctgccatcccaaagtcacccacttccatccagctcaacaccatcaaggtggccctgccattccacaggacagcaactatcgcggcaagtttctgatagccgaatattgggatttaagacttctagcaacttttattcatctgaagagaggccagtgtttccttcatggagcaaagaatctggtacgcactcccatggtgggtctttggataattggtctaggcctggcttttctgagctgacaagcacttccctgaaagaaagatggtcatttgacagtgagtcgtttggttttaattgtgaaaggctggttagatccagtagtcagttttcaaactgttcagttgatttgcaaacttgtggtgtttgctcaaaacttttaactgagaagtcttcctggggcacccaaaagataattgcaagtaatgacctttctgtagtttctgtccttatctgtggacatgtttatcatgctgaatgcttggagagtttgacatctgaagtcaacaagtatgatccaccttgcccagtttgcacttttggtgagaaatatacacttaagttgtctgaaaaagctctgaaagctgaaatggatttgaaggctaaaaataagaaatcaaagaaccgaattgtggaccgtgatattgatgatgattccattgtctatgaacattttagagaaaaagggcgtcatggtaaaggtcctagaatcgattctagttccagtgggagaagatctaatgggaaaccttttctgaggagacacttctcatttggctcaaggagttccaaatccatgctggataatcagccaacccggaagaagggcttcttttgggcaaaatctagcaaggaataa

SEQ ID NO: 2469 - DNA, 420 bp, Glycine max var. Williams 82
atggcacaagttgaactgcgagatgagcatgggaacccagttgaactcacagatgcatatgggaatccggtttggttaacggacgagaaaggcaaaccggtgcacctcaccggtgtggcaaccactgcacacaaatgtttgcaagagaatgacacaccacaagagcttcctcactccaagagctcaagctctagctcttctgaggatgaagagcatggagggaggagcaagaagggactgaaggataaaatagaagagaagttgccaggaggagaagaaggagagggaaaggagcatgcacacaccacaacagttacttctgctactaccacagatagtggtgctaatcaccacccaaccacaaccactgaccatgagaagaagagtataatagacaagattaaagaaaaattccaataa

SEQ ID NO: 2470 - DNA, 420 bp, Glycine max var. Williams 82
atggctgccaccgaggaaccaattctctctaggattgaccgtttggataatatgttgaggcaattggaggtaatcagagggtgcaatccatctccaaagagctcgtgtgcatctactccaacaagtggaagtgatggacacgtgtcatccactgatttctccccaaagagtttagagaagcactgccgtccgattgaattcgtgatgatggagaccgaagtcaaaggaacgatgatagagaggctcaaccaagtggaggatcgaatgctaaagctttgtttgcagctggaggaagagttggtagcaaagaagaaagaggaagagaagaaaatgaatagcccgaagaagggttttaaacagcttgtgaagcaatgtgtgaaagctaggggaaaatatagtactaataataaacaagcatga

SEQ ID NO: 2471 - DNA, 1128 bp, Glycine max var. Williams 82
atgtcttgctccaatctgacaatgttggtgtcctcaaaaccttccctttccgacccctcgaacctctccttccgctctgtcctgaacccttttcagctccctacacaaaacccagcttcatgcaccccttcacgctcctcaagcacccaaattcagtgtggtctgagagaactgagaacccgcattgagtctgtgaagaacacgcagaaaatcacggaggcaatgaagcttgttgctgcagccaaagtgagaagagctcaagaagctgttgtgaacggaagacccttctcagagaccctggttgaagtcctctacaacatcaacgagcagctccaaactgaggacgtagacatccctctcacaaaggttagacctgtcaagaaagttgcacttgttgtgatcaccggcgaccgcggcctctgcggcggtttcaacaacgcaatcataaagaaagccgaggctagaatcagggaattgaaggagcttggcttgcaatttactgtcataagtgttggcaagaagggtaactcttatttcatccgaaggccttatattcctgttgacaagttccttgaaggtggcactcttccaactgctaaggaggctcaggccattgctgatgatgttttctcactgtttgtcagtgaagaggttgacaaggtggagcttctctacaccaagttcgtgtcgcttgtcaaatcggatcccgtgattcacaccttgctcccgctttcgccaaagggagagatttgtgatatcaatggtgtgtgtgttgatgctgctgaggatgagttcttcaggttgactaccaaggaaggaaagttgactgtggagagggatgttgtgaggactaaaaccatcgatttttcgccaattttgcagttcgaacaagacccggttcagatccttgatgcactgttgccactgtatttgaacagccaggtcctgagggcattgcaggagtccttggcgagtgaacttgccgcgagaatgagtgccatgagcaatgccacggataatgctattgaattgaagaagaacttgtccattgtgtacaatagggagcgccaagctaaaatcactggtgaaattctggaaattgtggctggggccaatgccttgcaatag

SEQ ID NO: 2472 - DNA, 1422 bp, Glycine max var. Williams 82
atgatgaataagataacatgtccacatgccccatgcatcccctgctataaaagtgaaactcagcattgtgaactaaacacaccaacacatccattcattgtcttaatgttagcaatgtcttcctctttctccatccatttcttcctcctcctctcaatagcccttttctcagtttgttgcttagcagcatctcaagctcccaccaccaaatcacacccctatatccttcccattaagaaagaccccgcaacaaatttgtactacacttcagttggcattggaactcctaggcacaactttgatttagtcattgatctttctggtgaaaacttatggtacgattgtgacactcattacaactcatcatcctacagacctatagcttgtggctcaaagcaatgccccgaaattggatgtgttggttgcaatggccccttcaaaccaggttgcacaaacaatacatgccctgctaatgtaatcaaccaattagccaaattcatttacagtggtggcttaggtgaggatttcatattcattcgtcaaaacaaagtgtctggtttgctttctagttgtattgacaccgatgcattcccatcattctccgacgatgagttacctctatttggcttacccaataacaccaaaggaatcataggcctttcaaagtcacaacttgcattaccaattcagcttgcatcggcaaataaggttccttcaaagttcagtctttgtttgccttctttaaacaaccaaggtttcactaacttgctcgttagagctggagaagaacatcctcagggaatatccaaatttctcaaaaccactccgctaattgtcaacaacgtttccacaggtgccatatccgtggagggtgttccttcaaaggaatacttcattgatgtgaaagctgttcagattgatggaaatgttgtgaacttaaagccttcccttttagctattgacaacaagggaaatgggggaaccaaactcagcaccatgagtcctttcactgaattacaaacaactgtctacaagactttcattcgagatttcatcaagaaggcttcggacagaagattaaagagggtggcatcagtggcaccatttgaggcatgttatgattcaaccagcattagaaattcctcaactggactagttgtgccaactattgatctagtgctgcgaggtggagtgcagtggactatttatggagccaattcaatggttatggcaaagaaaaatgtagcatgtcttgcaattgttgatggagggacagagcctagaatgtcgttcgttaaagcttcaattgttatcggtggatatcagttggaggacaatcttttggagtttgatgtggcttcctccaaattaagcttcagctcatcgctgttgctccacaatgccacatgttcacgtacttga

SEQ ID NO: 2473 - DNA, 1290 bp, Glycine max var. Williams 82
atgacttcttcatgtaccatccagttctttgttttctctattaccctaattttttcagtttcatacttatcagcatcacatgctccaaactccgaaccacacccctataaacttcccattaagaaagacccagtaaccaatgtgttctacacttcagttggcataggaaatccacgacacaacattgatgtagccattgatcttacaggagaaagcctctggtacgactgtgccattaactacaacacattatcctatattcctgtcagttgtgactcacattcatgccccaccaaaagcactattccatgtgttacttgccatggccctttcaaaccgggttgcacaaacaacacatgtggtacttacaattacaaccccttagctcaagtaacttttccaggggacttggctcaggatttcatattcatttctcaaattcaagtgtctggcattcgttctggctgcacaaatgcacataaattcactagcaatcttgtaggagggttacccaaaggcagcaaaggaatgttaggccttgcaaggtcagaacttgcagtgccaactcagcttgcattgctgaagaaactccctcttaagttttctctatgtttaccttcttctaacaacatcggattcactaacttactcattggacctgagggacatgaacaatctcaggatgtttccaaatatattcaaaccactcctcttgttgtcaaccacttcgacacaggtcctttgtttgaggaagaatactttattgatgtgaaatcaattaagattgatggcaatgttgtgaacttaaagccttccctgctgtccatagataggaagggcaatgggggcacaaaaattagcaccatcactcgttttgctgaattacaaacttttgtctataagccttttgttagaggtttccttaagaaggctgcggaccgaagactaaagagagtggcatcagtggcaccatttgaggcatgtttcgattcgagaagcattggaaattccttcactgggtttgttgtgccaactattgatttggtgctacaagggggagtgcaatggactattcatggagccaattccatggtaatggtaaagaaaaatgtagcatgccttgcatttgttgatggagggacaatggcaacaatgtcgttttttaaagcctcaattgttcttggtgcgcatcagttggaggaaaatcttttggcgtttgatgtggcttcctccaaattaagcttcagctcttcgcttttgctccacaatgtgacatgttcccacctttga

SEQ ID NO: 2474 - DNA, 1212 bp, Glycine max var. Williams 82
atggcttcctcttccctctttctctcactctctctcaccctttgccttgtttcctctctctgctatgctcacaaatcttccttaaccctacctgtgacaaaagacgattcaacccaccaatacctaacaaccctctcttatggcacccctgttgagtctgcaaaattcgtgcttgatctcggaggctcaatcctctgggctgactgtgcatccagaaccaccccatcttccacccttgccccaatcttccaccgttcaattcgctgcctcacggcaaagggtcctgaaattgagacacatagatggctctcgagtctcgcaaatcccatagatcaagatcagccgtgtcaaattcctgcagagaacagcatctcggggaaaagggtcaccgaaggagagcttgtggaagacttagtgattaatcgctctcacgagcttctcttcacttgctcacccactcttctcttgaacggtttagctaccggtgccaaaggcatggtaggtcttgatcgatctcgcacttctttttcgtctcaggtttttcactcacttggaactcagagaaaaatcactctttgtctctcttcctcttctgggattgttcaatttgggaatgtggcgcatgaatcccaacccgggtctgaaattttcagatctcttacttttacaccccttgtcgcgaaccaagaccaaacacagacacacccttccatcaacgttaactccgtcaaaatcaacggcaaaaaggtttctttcgacacccccttgggtgggggtgctcagctgagcacggtggtgccttacaccactctccaaacctcgatctatgcaaacttcgaaagcgcttatttgaaagccgcttcgtctatgagcatgaaaagggtcgatccagtttccccctttgggctctgcttcgaatccaacggcgttggaagctcccaagtggggcccaacgtgccggtcattgatctggtcctgcagagcgagatggtgaagtggagcatacacggaagaaactccatggtgcaggtgaacgacgatgttatgtgcttagggtttgttgatggaggtgagaatccgaggaaccctattgtgattggagggtatcaattggaggatgtgttggtgcagattgattttgatacttccatggtgggattcagtccttcgcttctgacgaagcatgctacttgctctcatttcaaaccctag

SEQ ID NO: 2475 - DNA, 1594 bp, Glycine max var. Williams 82
ttttattacattttattttacttggatccttagttctttagttctccttctcctgcgagaaacagaactttcagaagcggaatcgctcactattgatccgattccaccgtcatcggatctttctgcagccaccgtctatcgcacttcgttgccgtcattggcgccggaattctgaatgttaatgaatttgtgaagtaatgatgagtggaagagctatccaataacatgacatgaactgcaaattcttgtatacttgaaggttaagacagcttaaacaatacaaggatgttttcgttgttttatggactatggaagtacttgttcagcaagatggagcttcatgtactcattctggggattgacaaggctggcaaaacgactttgctggagaagatgaagtcggtgtactcaaatatagaaggcattcctcctgatcgaattattccaacagtgggattgaatattggtcgcattgaagtggcaaatagtaaacttgtgttctgggacctaggaggtcagcctggtcttcgctcaatatgggagaaatattatgaagaggcacatgctgtaatatttgttgttgatgcttcttgtccgtcacgctttgaagatgcgaagtcagcactggaaaaggtgcttcggcacgaggatctgcaaggagcccctcttttgatattagcgaacaagcaggatattcctgaagcagtatcagctgatgagttacctcaatatttggatttaaagaagctggatgaaagagttttcatgtttgaagctgtgtcagcatacgatggaatggggattagggaaagtgcagaatggttggtggaggtgatggagagaagcaagaggactgaaatgttaagagcgagggcaggtgcaatgggtgcaggtccctagaagggtcttacattaaactgaagttatttctcggttcctttatatagctttgtaaatccaaattgaattatacatgattaaaagtcagtgagctgaaaagccgtttcatgagaggctcagtctccactctccagtatctcttagagcaatttttcttctgacatgccttgtaaaagcaatctgtgaaatgatgggctgtgccggagggttttctgcttctgcctccgggcatacttttgtcaaccctaaattgtaattggtacggtttctatttgactgtattaatttactttcctatctgtaacattgtataagcactgctctgccatattgttccaggtacttgcacttggtattcggagcatatatggtatatatgcaaagggacacttgggttgtagccaaaattttatgggagtagtgtgattggggtggatgtacttacgtttgatttccatgcgagtcatgccagaggaaaagtttggtttaactctggaaaaagggcagaaacaacaaacagaactaaactttcttggtaggtcattcaccaatattatttcgcaatgcgtgtcaagtattttgtcttctctcgagaaaaaacgtagttataaaactgatttcttctcaggtctccaaatttaaaccattgtaggtgtttattacatgcttaactacgcccgacggctgactctaa

SEQ ID NO: 2476 - DNA, 927 bp, Glycine max var. Williams 82
atgggcactctagtaggacacgtagctccaggcatgggtttcatgctaatagggctatggcacctcttcaaccacataaagctccatgccctaaacccaacctcctacacatcaccaccatggttcccaacctccaaacacaagtacctggagctcctcctcatcatgttaggctcagcagcctccatctccatggaactcttcatcggccccaaccgccaccagcccttggaccctgacctcaccatcccctccaaccacctccacaacttcgaacactcttccatctccctcgccttcctcctctacgccgccttcgccctcgtcctcgaccgcctcccctcccccgccaaacgtgccctaacacaactcctcggctccatcgccttcgcccagcaactcctcctcttccacctccactcggccgaccaccacggccccgaaggacagtaccacttgctacttcagctccttatcttaatctccctctcaactaccctcttgggaatccccttccccaaaagcttcttagttagcttcgttcgttctctaagcattttctttcagggtttatggcttgtgcttatggggtacatgctttggacgccggggcttatccctaaaggctgcttcatcaacgaagaagaaggccaccaagttgttagatgctccgaccatgattctctccaccgcgccatatcgctggttaacattctcttcagctggttcatcattggtgtcaccgtttttggtgttgcttgttatttgggtttggttaagttttacggtgaaaaagttgactatgttgcgttgagggacgaggaaattagtgacgatgttgagtcgcaaaagagaagcatacttggcaaccccacgagttttattcgtgttggcaaaaactttttgcctcttgacatagaaaggtag

SEQ ID NO: 2477 - DNA, 1485 bp, Glycine max var. Williams 82
atgtttggtgtcattagaagaaaactccggcacctttactcaaggatattgtggctactatggaagcgtcccaagtctaaagttgttatcaaaaggtttagaaaattgaactttaagggtcaccacagagcagaattgcgtaaaaacaaatctacaagtgactcaaatggcctcttagttgagtctcaatctggaaggcctattaggattgctacattcaatgttgcaatgttttcacttgcacctgctgtttcagaatttgatgaatgggttgtctccaatcatgagcatgtatcaaacaagaagaatcttcttgcaaagggtgattttccaaagagtatactaaagcaatctccattgcatgcctctttggacaaggctcagaatctttctgcctccaatattctaccacgttcgaatttgaaggtttctatcaatctccctgacaatgagatttcgttggcaaatagtagattgcttgcttcgatggagagaaaagagggtacttcagatacaatcacgggaaatgtttctggcaggcatcaagttccagcaaggtctcctgtgtgctttcctttcgttatgaattactgtgaggacactgagaggttcacatgcagcagaagcatcatggaagttctgagggagattgatgctgatgtgctggccctgcaggatgtgaaggcagaggaagagaagaacatgaagcctctttctgatttggcagctgccttggggatgaagtatgtgtttgctgaaagttgggctccagaatatggaaatgccatcttatccaaatggcctattaagaagtcgagagttcagaagattgctgatgatgatgatttcaggaatgttttgaaggctacaattgatgtgccctgggcaggagaaataaatttccactctactcaacttgaccacttagatgagagttggagaatgaagcaagtacacgcaataatccgctccaatgaccctcctcacatcttggcaggaggacttaattctctatatggagctgattactcatctgagagatggacagatatttttaagtattatgagaaacttggaaagcctaggccaaggtcagaagtgatgaacttcatgaaatcaaaaggctatgttgatgcaaaggattatgcaggagaatgcgagcccattgtcatcattgccaaaggccaaaatgtgcaggggacatgcaagtatggcacaagagtggattacattttggcatcaccaaactcaccgtacaaatatgtaccagggtcctactcagtcatttcatcaaaaggaacttctgatcaccatatagtgaaagtggacattatgaaagtaaatgcaccagctcagaaaaatgtcattaggcagtgcaggaaactaaagaggaaagtagtgaaaataacgccaccttgttctgcaacaggtgtgagggaatcaaccccacctcccaaaatacttgtgccaaaagaaattgattga

SEQ ID NO: 2478 - DNA, 1545 bp, Glycine max var. Williams 82
atgtccaatatattattgtgtcatgctctttggtttttgctgacaaaagattatgttggaagcaatggcgtccacaagttagaaagaaaacaaatagctgaaagagaaagaaaacaaatagctggaagggatagatcggtttttagaggcaggcgtccacgacctgggttttctgattcattttcaagcactgacttggaagctttagagattgaagagggctctcctaggagtcaagggtctgaaaccccaagttcaagggccagcacttctgattcggagagtcagggatcttttgctggggcacctaataccaataaccaatggcggggtttctttaaactactcaagaaaggatcacaaatgcctttccaaccttttcacccacttaaaaatgttccaaaactgacaagaagaaaaagcaagaggatcagggaggacctcattccttctctgaattctccagctcttcatgcatcttttgacgctgagtttggctgcttcaaatcttcctggaaaaacttcactctcgccgagatccaagctgcaaccaatgactttagccatgaaaatttgattggggagggaggctatgctgaggtttacttgggcaaattggaggatggaaactttgttgccattaaaaggttgacaagagggtgccaagaagaaatgactgcagatttcttgtctgagcttggcattatagtgcacgtggaccacccaaacatagctagattgattggatatggtgttgaaggaggaatgtttcttgttcttcaattgtctccacatggtagcctgtcatccatactttatggacccagagagaaactgaattggaacctcagatataagattgctttggggactgctgagggccttcgctatctgcatgaggagtgtcaaagaaggatcattcacaaagacatcaaagcttctaatattcttctctcagaggattttgagcctcagatatctgattttgggcttgcaaagtggttgcccgaccaatggactcatcacaccgtctccaaagtggaaggcacattcggctaccttcctcctgaattctttatgcatggtatagtagatgaaaagactgatgtctatgcttatggtgtgctattattggagctcattactggtcgacaagctttggatagctcacagaaaagtctggtgatgtgggcaaaacctttgctaactgcaaataacatcaaagagcttgtggatccagttttggctgatgcttatgatgaagagcagatgaaacttgtaaccttaacagcttctctgtgtgtagaccagtcctcaattcaacgaccggatatgagccaggtatttgatatactaagaggggaagaagagagcttaagaatcatggaagaacgatcgaagtcaaaacttcagaggacatactctgaagaactctttgatgcagaagagtacaactcaacaaagtttttgagtgagagggatcgacacatggagactattctaggctgcagtagctctgttacagacgatgaagagaaaatctag

SEQ ID NO: 2479 - DNA, 2640 bp, Glycine max var. Williams 82
atgtttccaatgagggtatgggtagctgtggtattcattatgttagtaactactgtggcggccaagcctcgtcgaattcttttggatacggatgttgatcttgatgatgtatttgctcttctctaccttttgaagctcaacagatcagagtttcaattggagggagtcacaatcaatgcaaatgcttggactaatgtcggacatgctgtgaatcaagtttatgacatactttacatgatggggagagatgacatagcagttggaatgggaggtgagggtggaatactcccagacggtaccattctcccaaatgtgggtggatatctttcaattatagaacaaggaatgacaacgacaggaggctgcagatacagacaggccattccaataggccatagagggatcttggatattgatactatttatggcatccgaaaagctttccttccacaggggataaggaaatatactcccttaggacaaccaactgctcaacaagtgttgattgacaaaatatctgcaggtcctataactttgattgtgataggagtgcaaacaaatatagctatttttctcatgaacaatccacacttgaagaaaaatgtacaacatatttacataatgggcggtgctgtgaggtcaacagacccaactagttgttgccccaaaaatgcatccttttcttgcattcctgggcagtgtggtgaccgtggcaatgtattcacaaattatgaagcgaacccttatgcagagttcaatatatttggtgacccttttgcagcataccaggtgattcattctggtatacctgttacccttgttcctcttgatgcaacaaacacaatccccatcaatgaagaattctttaatgaatttgaaaaaagtcaagacacatatgaagcacaatattgtttcaagtccttgaaaatggctaaaatggctcgtgataagcttgacaaccaattctatacgagttattttatgtgggactctttcgcatctggtgtagcggtctcaagcatgagaaactccaataaaaaaaataaaagggaaaacgaatttgctcatatggagtacatgaacataactgtaattacttcgaacaaaccttatgggatatctgatggctccaacccattttttgatggcctcaaagttcctaaattcaatctaaagaaaggcggggtgcatagtggtcatgttcaacaagggcttagagataaattttgttttgtgaagaatgggaaagggagatgtcaggacggttatacagctgaggtggatggtcctgactcggtgaaggtacttgtcgccactaaagcaaagcctaacagggacgttaggagtaagcttgacaaagaatatttcaaaagcttcttgaatgtgctaaagcaaccacaacatgccgggaggttcaacttcactacacaatttccttactacgaagaagttacttacatgccagattttcaaaacaaaacactgggtaaaccagttgtgtttgacatggacatgagcgtaggagattttcttgctctattttatctccttaaagttgatgttgaagtgataaatcttaaggcaatcatcgtaagcccaactgggtgggcaaatgccgcaacaatagatgttatctatgacttattgcacatgatgggtcgtgacgatatcccagttggtctaggtgatttttttccaatgaatcaatcagatccaatattcccaaccgctggaaactgcaagtatgttaaagccattccccatggaaatggtgggtttttggactctgatactctttatggacttgctcgcgatttgccacgtagtcccagaaggtatacacttgaaaattccatgaagtttgagacttctcagaatactgatcaccttgaactcagacaaccactggctatggaaatttgggagtctataatgcaaacactggaaccagaatctaaaattacagtattaaccaatggacccttaactactttggcaaaggttgtatcaatgaaaaacataagctcaagaattgaggaggtttatgtaatggggggacacatcagcaggaatgtctgtgacaaaggaaatatattttctgttccttccaaccaatatgcagaatttaatatgttcctggatcctttagcagccaagacagtgtttcaatcagaagttaacatcacactcattccactcagtgtccaacagaaagcaagttcattttcacatatgttatgctggttgcgtaggatagaacaaacacctgaaactgtgttttccaagcgtgtgctattaaggctacaacgtctgaagcaaatccaccacagatatcaccatatggacacattcttaggggaaattctaggtgccattgtcctagctgacggcccttcatctctaaaagaaaaatttgagatcaagggcattaaagtgttggccgaaggagacgagtccatcgatggagaaatggtggtggatgaggaacatgggaaattggtgagaattttaagccatgtgaatgccaaggcttatcatgaaaagtattcaaagaggctcggtgactggaaccaatcggctaaggtaggaagctttgaagatcaaataaggaaatggagtcatccacattctttattataa

SEQ ID NO: 2480 - DNA, 1695 bp, Glycine max var. Williams 82
atgttaggcatgtcatcattttcaacgcagtttgtgcaaagtccgaacctacctcctcgttttcatcatcatgttcagtggaattttagccaagatgtttcaaaggttccaagaacacatgtggtctgtagcattaccaaatcacaacttggttacgataaaacattggcatcaagatttcattatgctgccagattttctgtctcacgacaatctgaaacaaaatcaatcgcatataggagaatgacatgtactaatgccaaggaaaatcacaaggatgtggagagtggatatttgcaagagcccttcattcaaccagaggaggttgcttgtaaagaagttggatcagataagagtgtggaaaatggatccattggaatggttttgcttagcacacttgttgccgtttgtggttctttcacatttggaaattgtgtgggctattcatcgcccactcaagcggctataagggaagatctcagtctatctcttgctgagttttccatgtttggttcattagtgaccattggtgctatgcttggggctataaccagcggccggattacagatttcattggccgcaaaggggctatgaggatttcaacgggattttgcattactggatggttagctgtcttcttctcaaagggttcttactcccttgacctgggaagatttttcacagggtacggcattggacttatatcatacgtggttcctgtatatatagcagaaatagcacccaaaaatcttcgaggaggacttgcaacaacaaatcagcttttgattgttactggagcgtcagtctcattcttattaggaagtgtcatacattggagaaaacttgcactagcggggttagtgccttgcatttgcttgctgattggtttgtgctttatccctgagtcccccagatggctggctaaggttggccgtgaaaaagaatttcaactagctttaaggagacttcggggtaaagatgttgatatttctgatgaagctgctgaaattctggactctattgaaactcttcgaagccttcctaagattaagctgttggatttgttccaaagcaaacatgtgcgctctgtagttattggggtcgggttgatggtatgccaacaatttgttggaattaatggcataggattctacacagccgagacttttatagcagctggactttcttcaggaaaagctggtaccatagcatatgcttgtttgcaggttccatttactgtattgggagccattttgatggataagtctggaaggagacctcttatgatggtttccgcaactgggacattcttaggttgctttattgccgctattgctttctttctcaaggaccaaagcttaatgcttgagtgcgcaccgatatttgcagttgctggtgtgttgatctacatagcagcatattcaattggtgtaggaccagttccttgggtgataatgtcagagatctttcccattcatgtgaagggaattgctggaagcttggtggttttggctaattggctaggagcttggatagtttcgtatactttcaactctcttatgagctggagttctcctggtactttgtttttgtatgctggaagttccctcttaactattctgtttgtcacaaaattagtcccagaaaccaaaggaaaaactttggaagagattcaggcttggattagtccatag

SEQ ID NO: 2481 - DNA, 4113 bp, Glycine max var. Williams 82
atgaaccagtaccacatctacgaagccatcggtcgcggcagatactctaccgtttacaaaggcaggaagaagaagacaatcgagtatttcgccatcaaaagcgtcgataaatcacagaaaaccaaggtccttgaagaagtcaggattcttcacacattgggccatgtaaatgtgctgaaattttacgattggtatgaaacttctgctcacctatggttggttttggagtactgtgttggaggggatctgctttccatattacgacaggatagtcaacttcctgaagactcggtttatgattttgcttatgatatagtcaaagctttgcagtttttacattcaaatggaataatctattgtgacctgaaaccatccaatatcctactagatgaaaatggatgtgcaaagctatgtgattttggattggctaggaagttgaaagatatatcaaaagctccttcttcctcgttaccgcgagcaaaacgtggaacaccctcttacatggctccggagctttttgaggacagtggagtccattcttatgcttctgatttctgggcactaggctgtgtactatatgaatgctatgctgggaggccaccctttgtgggaagagaattcacccagcttgtaaaatccatcatttcggatccgactccacctctccctggtaatccaagtcggccttttgtcaatttaattaattccctgttggtaaaagatccagctgaaagaatacagtggcctgagctttgtggacatgccttttggagaaccaaatttactctggtgtctctgcctgctcaacctgcatttgatgatatgatagggctacatgctaaaccatgcttatcagaacgtaatggagataaatcttcccataacaggacccctaccaaatatcgtgaaaaagatgtcaaagggtttttgagaaaggatgagaactctgttttaggatctagaggcattgagacaccaacaagggcaacaccaattggccacagaactcagacaaagggttctggcagaatacatgaggtaaagcaaaaagataattccaatattagcaagggtgtgaatcttttgagactgtcaagaatagcaaaaacaaatctacagagagaaaatgagaaggaaaactatcgacgccccttgcctaataactctgagaatgattctgaagttaaaattgagaacactgacatggaacttgattttaatgagaatgctgaagatgatgcgcatgaagaaactgatggtgccgaacagacaactcctgtgcctgatgagaaaatggtcaatcattttctgaaccagggaaaagcagaggaggttgaaaataatacacaccagttggacaccccatctgttcaccctccagtctcagatgatccaaggtcatttgatcatgaatcaactcctgaccatcctgacatatctgctatttctcccagtgtgagccctcaggtgaagaaacatagaactaaagaagactcaggatctggccttgactctgattcttcgaggttgtctaacaacctttcccaggttctttggcatgcatctgatctctcagtcagacctgtaatgcctagcagaaaagttgataaagtctcagaagtcattccttcactcccttttgaggcattgcaagcatctgattttgtcaagatgcctaaagagcaattggaggcagtccacaaccgaatattatccattttgaatggaaataccagcattggagagaaacagaatgtgattaggtaccttgagatgttgagcagtaatgctgatgcagctaatatcttgaccaatgggccaataatgctcatgcttgtaaaattgcagcgtcaatccaaggcatcagctttgcgtgttcaacttgcttcactgatcggtttgttgattaggcactccacctttgttgatgacagtttggctagttctggaattttaggtgcactgactgatggccttagagacagacaggaaaaagtaaggaggttctccatggctgctttgggtgagttactattttatatatccactcaaaatgcagactgcagggataacaatcaacttgaatctccatcaaaggacaataggaatgcgcatggctggcaggttccaaattcattaatatcacttgtgtcatcaatattgcggaagggagaggatgatataactcaattatatgcattgagaacaattgagaatatttgcagtcaaggaggttcatgggtggggcgtttgtccagtcaagatgtaattagtaatctctgctatatctatagggcctcagggaaacaagagagtatgagactcactgcaggatcatgcttggtgcgcttagttcgttttaatcctcctagcattcagtcggtgatagagaaactctcattcaaggacctatcttctgctcttgtcaagggcagtccacgagagcaacaaatcagcttaaatcttcttaacatggcaatgcttggaagccacatgttcacaaatattggaagataccttgtttcacttgctgaggataaaaatctgatcccaagtcttttgggtcttgttgagcaaggtagtgaagttttaagaggaaaggcactagtccttgtggctctcctctgtaagcatggcaggaggtggcttccacacttcttttgtagccaaaagttactctctgtagtggataggctgggaaaagagaaggatgcttatgtgaggcagtgtttggatgcatttgtgcatattgtggcatccagtattccaggtttacttgatataataacaggggatatccagcaaatgatgggaggaaggcgccatggacacatctctgcccttaccagcagatctgccccaaaacccaacattcatttgtttcctgttgtccttcatcttcttggaacttcaacttttaagcacaaagtagttacaccacaagtcttacggcagttggcgaatctaattaaactcgtggagacatcgtttcagggaagagatgacttccaaataacccttcttcgaattttcgagtctctcacagaggaatctcctgtgattattggcaatcctgacattttcatacgtgaaatcctccctagtctgacagttctgtacaagggtaacaaggacggtgatgccagatttttgtgccttaaaattctttttgatgtgatgatcattcttttgagtgaaccaattgaagaagagcaaagattgacggatctgaaattcgtatccaatacccgttttcttcctctctacccaaccttgattgaagatgaagatcctattcctatctatgcgcagaagcttcttgtcatgctaatggagttcagttttattacaattccagacattctacatctgaagacaatttcacaatgcttcgagttcttgcttggcgatctctcaaatgcaaatgtgaacaatgttaagctgtgtcttgctctggcttctgctcctgagatggagtccaaattactctctcagttaaaggtggttaggaggattggcaactttcttgagtttgtatatgcaaagggtatggaagatttgctggaaccaactcttgggttgtgtaaggcttttctagcacgttcagttagctgcacaaaaggcttcagctacacaacagaactaattctcttaggtgactgtcctcccgagttgagtggtggcgctgtcgatccccaacaatgcataaaagatatagcggactttggaagcaatgtcggtgtcttgctagagttgagtgcctctgcagaaaccagtattgctgatatagcttctgaatgtgttgtcttactgctcaaggcagctcctagagaagccaccactggtatactaaccaatctccccaaggtgactgtgatcctagagagctggagtagaggcattcctcacttgatcatccagcgaatgcttcacgctttaggctatgcttgcaagcaatacttactgcatgcaatgatattatcaatatccaaacctgagatttcaagaactgaagtcatagtttctgaactcaaaaattcaggtgtaccagctttagccaaaacagctgggctggcagccttggaattgcagcggttgcctcgttgcatttga

SEQ ID NO: 2482 - DNA, 1611 bp, Glycine max var. Williams 82
atggaggtttcggtgattggaagctcacaagcgaagctgggcgcgtctgaattggcttctagggaagttggattttgtaatctgaagaacaatttaagggttttgaatgatagagttagttttggtaggaataatatacggtgggagaaggctgggattagtttcactttgagggctcttcagactgaacctgttagagaggagaagaagccttctgggattggaacaagatccaaaacggtagatggtgtaagattatttgtggggcttcccctagatgcagtttcttatgactgcaagtcaataaaccatgctagagcaattgcagctggcctaaaagctttgaagctcttaggagttgaaggtgttgagctccctatttggtggggaattgttgagaaagatgccatgggacaatatgactggtcaggctatcttgctattgctgagatggtccagaaagttggtctcaagctccatgtttctctttgctttcatgggtctaagaaaccaaatatccctctacctaaatgggtatcccaaattggtgaatctcaacccagcattttcttcacagataagtcaggacagcattataaagaatgcttgtccctggcagttgataatcttcctgttcttgatgggaagactccagtccaagtgtaccagagtttctgtgagagcttcaagtcttcattctctccattcatgggctctacgatcatgagcatttccatgggtttaggaccggatggtgagctacgttatccatctcacccccagctgccgagtaatggaaaaactcaaggtgctggggaattccagtgttatgaccaaaacatgctcagctttctcaagcaacatgctgaagcatctggaaatcctctgtgggggcttggtggtcctcatgatgcacctacctatgaccagcccccatacaatggcttcttcaatgatggggcttcttgggagtccacatatggggacttcttcctctcttggtattccaatcagctcatagctcatggagattgcctcctttcattggcatcttcaacttttggtgactctggggtgacaatctatggaaaactcccacttatgcactcttggtatgggactcgatcccatccttcagagctaactgcagggttctataacacagctaacagggatggctatgaaccagttgcacagatgtttgctcggaactcgtgcaaaattatattacccggcatggacctttcggatgcaaaccaaccagaggaaaaccattcaagccctgagttgctacttgcacaagttatggcagcttgcaaaaagtatgaggtgaaggtttcaggtcaaaattcttctgagtctggtgttccaggtggttttgaacaaataaagaagaatctatctggagataatgtattggatttgttcacatatcatagaatgggagcatctttcttttctccagagcattttcctttgttcaccgagtttgtccggagccttaagcaacctgaactgcattcagatgatctaccggccaaggaggaagaaggcgccgaatctgccatggatatgagccatgaatcaagtgtgagcatgcaagcagcctaa

SEQ ID NO: 2483 - DNA, 309 bp, Glycine max var. Williams 82
atggaacgcataacaaaattggcatcacaaaaagctgtggtgatcttcagcaagagctcgtgtgggatgagccatgcaattaagaggctgttctacgagcaaggtgtgggccccgcaatctatgagcttgatgaggacacaagagggaaggaaatggaatgggctctgatgagactcgggtgcaacccttctgtgccagcagtgttcgttggtggcaagtttgtgggttcagccaacacggtcatgacccttcacctcaatggctcactcaagaaaatgctcagagatgctggtgctctatggctttag

SEQ ID NO: 2484 - DNA, 1182 bp, Glycine max var. Williams 82
atggctcggagctccacaagaatgaaatgggtctctatcttcacacttctattcctctcccactcgcccctcacaatctccgcagaagatgggctagtggcgaatggagattttgaggctaccccaagaaacgggttcccaaacgaggcgattgtggagggccccagcgaggtcccaaactggaagtcaaacggcaacgttgagcttgtggaatcggggcaaaaacagggtgggatgatcctcatcgtaccgcagggtagacacgcggtcaggctcggcaacgacgccgagatcagccaggagctgccggttgagaagggttccatttactcgctcacgttttgtgcggctcgcacctgcgcgcagtttgagtccatcaacgtctcggttctgcctgcgtcgcagacgatagacctgcagacactctacaacgtccagggatggaacccttacgcggtttctttcaatgcggatcaggacacttttaggttgctatttaagaatcccggcatggaggatgaccccacttgtggccccatcattgacaacattgctatcaagaagcttttcactcctcttaaacccaaagacaatgcagtgatcaatggggattttgaagagggtccatggatgttcaggaacacttcactgggtgtgttgcttcccacaaatttggatgaagaaacttcatcactgccaggttggatagtcgaatccaaccgtgccgtccgttacattgattccgatcactactctgttccacaaggcaggagagccattgagttgctctcaggaaaggaaggaatcatatctcaaatggttgagaccaaaccagacatgctctacagcttgaccttctcattgggtcatgctgatgataagtgcaaggagcctcttgctgttatggcctttgctggggaccaggctcagaacattcactacactcccaattccaattctaccttccaaactgctaacgtcaatttcactgccaaggctgagaggactagaattgccttctacagcatatactacaacaccagaagtgatgatatgagttctctatgtggacctgtggtggatgatgtcagggtctggttttccggctccaacgggcttcatgggttgggcttaggaaggcttgggcttgtaattttgggtttagttttggttctgatgtaa

SEQ ID NO: 2485 - DNA, 741 bp, Glycine max var. Williams 82
atggcatgttctgtgccttttaacaacaagaatttggatataagtttctttgttttcaagccaactattgtaatcatagatgaccttgttcatggactcaaacacttctccttaaccactgagagccttggttgtgttcaaagctctatatttaggagcatccatggaaatatgatcatatggtatggagcatggcagaggcggtcgagtaaggaaaaagaggagctgacctcaacccttaaatcaatgttaagcaacatatcaagcatggctgtgttaattgaacacagtttccttgaagcatacggtggagaatcaagagatggctcttcaactgcaaaattctccactggggacataatatccttgaactcagcagtcaccactactaatgacctcaatgacctttgctacgcggtcctagccattttaaggtcacgctttgcaaaaatggaaggcataaccgctggcctttgcttcaagggacaaagcaaacccagagtggtgtgcattcatgtctggaagtctctccatttttgttactcttggattctcaactctgaccacagaaattggatgatgccatatcttgaacgcttctctatcaacatgaagtatgatattttccgagtagtctatgttaggggtgacaatgtggttgatcttaactgcatttctactcatcagatgttagaaaatgggaaagaaagtagtaggcaagggcaggttatgcagaactga

SEQ ID NO: 2486 - DNA, 966 bp, Glycine max var. Williams 82
atggccacttccaatggcttcgtcgacggcacttctccggaatccgcattgatctttctcggcagcggttgttcgagcatggttcccaacgtcatgtgcctccttcagccttctgaccctccctgccccgtctgcgtccagtcattgtctatccctcccgaacgaaaccctaattacaggtgcaatacgtctctcttaattgattactgcggcgacgccaacgctggtgatcgtaagtatatattgatcgacgtcggcaagaccttcagggagaccgtgcttaggtggttcgttgcccatcggattcccagagttgattctattattttaactcatgaacatgccgatgcagtccttggattggatgatgtacgtgctgtgcaggcttttagtccaacaaatgatattgatcccacacctatatacttgagtcagcattcaatggatagcatagcagagaagtttccttatttggttcagaaaaagcgtaaggaaggggcagaaatacgaagggtggctcaaattgactggaacattattgctgatgactgcaataaaccttttcttgcatcgggattaaaattcactcctttaccagttatgcatggagaggattacatctgtttgggctttctttttggtgagaaaaacagggtggcttatatatctgatgtttcccggtttcctgctagtacagagtatgtcatctcgaaaagtggagctggacagttggatcttcttatattggattctttgtataggtctgggtcacacaatgttcacctttgttttccacagactctagaaactgtgaagaggttgtgtcctaagcaaacactactaattggcatgactcatgagtttgatcaccataaagacaatgagtttttgatggagtggtccaaaagggaaggaattccggtggagcttgctcatgatggtttgagagtccccataaacttatag

SEQ ID NO: 2487 - DNA, 1410 bp, Glycine max var. Williams 82
atggaaaattttagttcaagttacatttattactgggttctactacccttttttttgttatcacaattctcctttcaacttgcatggtgtggctccatagtaaagttccttcctggattcaagggaccccttccttttgtacttgaaaccgggtatgtgggagtgggtgaatcagaggatgtgcaggcattctactacttcattgagtcagagaacaatcccaagaaagatcctctcatgctttggctcactggtggccctggttgctcagccttatctggacttgtgtttgaaataggaccacttacattcaaatatgaggaatacaatgggagcctgcccaatttggtcttgaggccacactcatggacaaaggttagtagcattatatttgtagacttgcctgtttccacgggcttcacttatgccacaacagagtttgctgctcaacgaagcgactggattctagttcaccaagtccatcagtttcttaggaagtggttgattgatcatccaaatttttcgtcaaatgaagtttacattggtggcgattcatactctggcattcctattccagtgattgttcaagaaatttcacgaggaaatgaaaaagggctccaaccatggataaatctccagggatacctgctgggaaatgcagcaacaactcgaagggaaaaaaactatcaaattcccttcgctcatggaatgggacttatttctgatgaactatatgggtcactgcaaaaaaattgtaaagaagagtacataaatgtagacaccagaaatgtattatgttctagagatatcgagtcattcaatgaggttacatcaggacttaattcagcccatattttggacccgtcatgtgagtggcttgatactgaaacatcttggaggagatctctacttaagaaatatcccagaaagaatttccttaatactcacctcaaattggcacccttaaactgtcggagttatgtatacttcctctgcggttattgggccaatgatgataatgttcgcactgcactgcacatccgtaagggaagtataggaaaatggcatcgttgtaccttcgatatacctaacaagaaggatatctcaagcagctatgagtatcatgtaaatctcagtagaaaaggctaccgttcgctgatatacagtggcgatcatgacatgacaattcctttcttggcaactcaagcatggataagatctttaaactactccattgtggatgagtggaggcaatggcatacaaatggtcaagttgcaggatacacaaggacttactccaatcggatgacatttgcaactgtgaagggaggaggccacacagctccggagtacaagcctgatgaatgctttgccatgttcagtaggtggatatctaacagtgctttgtag

SEQ ID NO: 2488 - DNA, 1872 bp, Glycine max var. Williams 82
gaaactccaattaaaaaccatggatatgcttagaaatggaagagggcattaaaaatggaaaattttagttcaagttacatttattactgggttctactacccttttttttgttatcacaattctcctttcaacttgcatggtgtggctccatagtaaagttccttcctggattcaagggaccccttccttttgtacttgaaaccgggtatgtgggagtgggtgaatcagaggatgtgcaggcattctactacttcattgagtcagagaacaatcccaagaaagatcctctcatgctttggctcactggtggccctggttgctcagccttatctggacttgtgtttgaaataggaccacttacattcaaatatgaggaatacaatgggagcctgcccaatttggtcttgaggccacactcatggacaaaggttagtagcattatatttgtagacttgcctgtttccacgggcttcacttatgccacaacagagtttgctgctcaacgaagcgactggattctagttcaccaagtccatcagtttcttaggaagtggttgattgatcatccaaatttttcgtcaaatgaagtttacattggtggcgattcatactctggcattcctattccagtgattgttcaagaaatttcacgaggaaatgaaaaagggctccaaccatggataaatctccagggatacctgctgggaaatgcagcaacaactcgaagggaaaaaaactatcaaattcccttcgctcatggaatgggacttatttctgatgaactatatgggtcactgcaaaaaaattgtaaagaagagtacataaatgtagacaccagaaatgtattatgttctagagatatcgagtcattcaatgaggttacatcaggacttaattcagcccatattttggacccgtcatgtgagtggcttgatactgaaacatcttggaggagatctctacttaagaaatatcccagaaagaatttccttaatactcacctcaaattggcacccttaaactgtcggagttatgtatacttcctctgcggttattgggccaatgatgataatgttcgcactgcactgcacatccgtaagggaagtataggaaaatggcatcgttgtaccttcgatatacctaacaagaaggatatctcaagcagctatgagtatcatgtaaatctcagtagaaaaggctaccgttcgctgatatacagtggcgatcatgacatgacaattcctttcttggcaactcaagcatggataagatctttaaactactccattgtggatgagtggaggcaatggcatacaaatggtcaagttgcaggatacacaaggacttactccaatcggatgacatttgcaactgtgaagggaggaggccacacagctccggagtacaagcctgatgaatgctttgccatgttcagtaggtggatatctaacagtgctttgtaggaatttccaatgaagtcatcttttctgttgacaaggactaaactttgcatccattgcataacaaagtcacagcctcacggtatattttattcagtaacaaatttgtgtcattatcaactgaaaaaaaaattaatatattctaaaggtagcaagagatagatccatatattgaaagaaaaaccagtcttatcaggtacagctgaataaaaaaaagttgtttaaaatataatacaatgtaaaagtttagatcgtgcacctagataagcattaaaattttctttcaattgcatgaatgtgatacgcatatctttgcggagaccaactttggttatcgatccttttataagtatagaaccagactaaaaacaaagcatctctatgtaaatattttagcagtggtcggaggtg

SEQ ID NO: 2489 - DNA, 1611 bp, Glycine max var. Williams 82
atgcaggcttgtacaacgatgagttctttgcagcaacaacctatttggaccaaagggttaaatttccctgcaaaagggtatggcagcaataacgggtttctacctcaggtgaggttctgcaatattaagccatccaaagcttctcatgttgaagcaagtttagtcactgggaagccgtcatctgtgcctttctctgtgcctgaaattggaggcgacggaagtagcttcctggactatggcttgagtgaagctgatcctgatgttcgtgcaattattgacaaggaaaaggaccgacaatttaaaagtcttgagcttattgcttctgagaattttacatctagagcagtgatggaagcagttgggtcgtgcctcacaaacaagtactcagaaggattgccgggtaaaaggtactatggtggcaatgagtacattgatgagcttgaaatcctatgtcaacaaagggcactggctgcatttcatgtagatgaaaacaaatggggtgttaatgttcaaactttatctggttcccctgctaattttgcagtatacactgcagttcttaaaccacatgatcggataatgggtttggacttgcctcacggaggacatttgtctcatggattcatgacacccaaaaaacgtgtatcagccacatcaatttattttgaatctatgccttatcgacttgatgaatcaacaggtcttattgattatgatatgctggagaaaactgctactctgtttcgtccaaaactcattgttgctggtgctagtgcttatcctcgggacattgactaccctcgtatgagaaaactaattacttcttatatgcatgggaagattgcagatgaagtaggtgcttttcttatgatggatatggctcatataagtgggcttgttgctgcatctgtactttctaatccctttgagtattgtgatattgtgaccaccacaacccacaagtctttacgaggtccaagaggtggtatgatattcttcaagaaagatactgtgcatggggttgatttggagcctgccattaacaatgctgtttttcctggtctacaggggggtcctcataaccacacaattggaggactagcagtttgcttgaagtatgctcagtctccagaatttaaaaattatcaaaatcaggtggttgctaactgtagagctcttgctaagcgattaattgagcatggatataaactggtttctggtggtagtgacaatcacctggttcttgtcgatctaaggccatctggtcttgatggtgctcgggtggagaaaattcttgacttggcttctataaccctcaacaaaaattcagtgcctggtgataagagtgccctagttccaggaggcattcgcattggggcaccagcaatgacaacaagaggacttggtgagaaagaattttcactcattgctgatttcattcatgagggtgtgcaaataagtcttgaagccaaaagtttggtctcaggaacgaagctccaagattttttgaagtttgtaacatcttctgaatttcctttgggagagaaggtatcagagttgcgtaggaaagttgaagctcttactactcagtatccaatacccggagtctaa

SEQ ID NO: 2490 - DNA, 357 bp, Glycine max var. Williams 82
atggctgaggagttcacggaatctgaggttgtctttcccgaccaccgcgccgtccacgactgggtagtagagatggcgccgcagccgcagcggaaggagagggagaattgtcgacggacggcggcgaattcgatgccggtgagcataccggagagggaggggcggcggcggtggggctcccccgaggaggaggcggaggaggaggagatgacgccgccgcacgagatcgtgaagagaagggtggccgcaaaaatggcgttttcggtgtgcacggggaatgggagaacgttgaagggacgcgatttgagtcaggtcaggaattcgatcctcaggttaactgggtttctggaagcatga

SEQ ID NO: 2491 - DNA, 561 bp, Glycine max var. Williams 82
atggagaagaaaaaagggaagaagacaacaggaaagaaagagcaccacttgtggaaaagtagagattctgctcagtctggccaaaaggcacttgctcttgttaggactgtttataaactccctaatgagaaagaggctgtttatggggcattagacaaatggacagcttgggaaacagagttcccagtgattgcagtgtctaaggctttaaaaatcttaaggaaaaggggtcactgggttcgtgcaattcaagtagctaagtggatgataagcaaaggccaaggagcaacgatgggaacatatgacacccttcttctggcatttgatatggacaagagggtagatgtggcagaatcgtcgtggaatatgatcatacatgcccacatacgctctgtatttgcagacatggaggagttgcgggtaaaacctgatgaagatacggtcaggagagtggcaagagcctttagagaactaggtgaagaagagaagtggaaactggttataaaacgatatgggcttaaatggaagtacattcactttaatggtgaacgggtgagttag

SEQ ID NO: 2492 - DNA, 561 bp, Glycine max var. Williams 82; identical to SEQ ID NO: 2491

SEQ ID NO: 2493 - DNA, 1479 bp, Glycine max var. Williams 82
gttcaaaacacacacacacacacacacacacacttgtctaaaggagtgtaagcaagcttctttgatgattttattaagtttagcaccaaagaataagttttgggagtgcagttgttaaactgaagtgatactgataaacggcatggcaaagtttttatggtaggtcttcttcaatgaaaaggaatgattgaggtttgttgaagtgcagggagtagagggtacatatcccttccactttgtcaaaaaacacatctccccaaatttgaaaagcatgatggccatgacatgtgaaagctcaattgtttcccctcttttcctgtcacgaatatgtcaggctaagacagacccaacaagagcctttctgttggagaataaattctcaacaattacagtaaccgcctcgccaagacaagttgtatccgctgcacggttgtgcaatccaaatttggccacaaaggtggtagtcccatggagaagaaaaaagggaagaagacaacaggaaagaaagagcaccacttgtggaaaagtagagattctgctcagtctggccaaaaggcacttgctcttgttaggactgtttataaactccctaatgagaaagaggctgtttatggggcattagacaaatggacagcttgggaaacagagttcccagtgattgcagtgtctaaggctttaaaaatcttaaggaaaaggggtcactgggttcgtgcaattcaagtagctaagtggatgataagcaaaggccaaggagcaacgatgggaacatatgacacccttcttctggcatttgatatggacaagagggtagatgtggcagaatcgtcgtggaatatgatcatacatgcccacatacgctctgtctcaaaaagattgttttctaggatgatctcgttataggatcatcataatatgctggataagattatagaggtatttgcagacatggaggagttgcgggtaaaacctgatgaagatacggtcaggagagtggcaagagcctttagagaactaggtgaagaagagaagtggaaactggttataaaacgatatgggcttaaatggaagtacattcactttaatggtgaacgggtgagttagaacagaagcatgggaagataatgaatcaacaaattgaaatgggtaaataagtacatgtcaatgataacaccactagatcttagtatctgggatctgctgtttcgaagcaatttatcttgcgttctactcctgctgcattagtcgctcaccaatttgattcattgtcctgcatccaggtccaacatagctactgatcaatcagaggtactacattgaaggattgggctgcaccctaaattgaaaaactacaatgttgtaatgttagatactcacataggcatgtatttcagagcaaaatttgttaatatataagatttgatgtctacagtcgaaacttgttttctaagttctgcctgtactaattatgcgtttagggat

SEQ ID NO: 2494 - DNA, 1539 bp, Glycine max var. Williams 82
atggccgacgtcgtttccaagtccccaaccccaaccagcaacctcatcagccccaacaagaaggaaacatcgaaccttttactgggtcgtttcgagattgggaagctcctcgggcatggaaccttcgccaaggtgtactacgcgcgtaacatcaaaaccggcgaaggcgtggccatcaaggtaatcgacaaggagaagatcctcaaaggaggtttggtggcgcacatcaagcgtgagatctctatcctgcgccgtgttcgccaccctaacatcgttcagctcttcgaagtcatggccaccaagagcaagatctatttcgtaatggaatacgttcgcggcggcgagcttttcaacaaggtcgccaagggaaggctcaaagaagaggtcgcgagaaagtactttcagcaattaatctctgctgtgggattctgccacgccagaggggtgtaccacagagatctcaagcctgaaaatttgttgcttgatgagaatggcaatctcaaagtctctgattttggattgagtgcggtgtctgatcaaatccgacaggatggtcttttccacactttttgtgggacacctgcgtatgttgctcctgaggttttggcgaggaaagggtacgatggtgctaaggtggatctttggtcttgtggggtggtgttgtttgtgttgatggcggggtatttgccctttcatgaccagaatgtgatggcaatgtataagaagatttatagaggggagtttcggtgtccgaggtggttttctcctgatttgtccaggcttctcacaaggcttcttgataccaagcctgaaacccggattgcgattcctgaaattatggagaataagtggttcaagaaagggtttaagcagatcaagttttatgtggaggatgataggctttgcaatgtggtggatgatgatggccttatggacaatgatgatgacactgcttcgattgtttctgttgcttcgttttcggattactcggtttccgagtctgattctgagattgagactaggaggaggatcaatgctcccttgcctagacctcctagtttgaatgcctttgacattatatcgttctcgccgggctttaatctttcggggttgtttgaggagaaagaggatgagacaaggtttgtgactgctgcaccggttaacaggatcatttccaagctggaggagattgctcagttggttaggttttcggtgaggaagaaggattgcagggtgagtttggagggtaccagagagggggttagagggcctttgactattgctgctgagatatttgagttgacaccttctttggttgtggtggaggtgaagaaaaaaggaggggatagagccgagtatgagaggttttgtaacgatgagttaaagcctggattgcagaatttgatggtggaggagtctgctacttcttcagagttgtctacacctattcaaccttccctactacgtggcctttctgaacctgtgccggatatttcttctgatattgaaaccccgctctgtataccttctgatgattga

SEQ ID NO: 2495 - DNA, 510 bp, Glycine max var. Williams 82
atggcaaaaactacaatcatcatccttgcctccaccctttgcttcttatccttcctaggctccgcttatgcccgagaccgcttcatggtggagggcaccgtttactgtgacacgtgtcgcgtccaattcctcaccaagttgtctgagttccttgaaggagctaccgtgcgtgtggtgtgttcacaagttgataatgcgaagaacgtgacattcagcaaagaggcagtgacagatgcatcagggtcatacaaagtggaggtggacggagaccacgaagaagacacgtgtgaggttaccctcttgaagagtccaagagcagactgctccgaggttgatcaagagtctcaccttcagcaagctgcaaggatcagcatcaccaaaaacaatggaattgtgtccccaattcgccaggccaaccctcttggtttcctcaagaaggatcgtctccctggctgcttggacctcctcaaggagcttggaatcaatgaagatggcaccctcatcgcttga

SEQ ID NO: 2496 - DNA, 1137 bp, Glycine max var. Williams 82
atgaggtcaatttgtgaagagcgatggattgcaattgttggttttgtggtagttttttcttcagcaaccatattggcagcatgcccttacaaatcaatcttcagcttcggtgattcatttgcagacactggcaacttgtattttagctcccacccaccttcccatcactgctttttccctccctacggtcaaaccttctttcaccgggtcaccggacgctgctccgatggccgcctcataatcgatttcatcgctgagtcactgggacttccactgctgaaaccatatttgggaatgaagaagaagaatgttgttgggggagcaaattttgctgttattggagccacggcgttagacttaagcttctttgaagagaggggcatttctatccctacccattattctttgacagttcaattgaattggttcaaggaactgcttccttctctctgcaattcttccgcagactgccatgaagtagttggaaactcattatttcttatgggtgaaattggaggaaatgatttcaactatcttttatttcaacaaaggagcatagcagaggttaaaacatttgtgccgtatgtgatcaaggcaataacttcagctgtcaacgagttgattggtttaggggctcgcacgctcatagttcctgggaatataccattgggatgtagtataacgtatttaacaatctatgaaaccatggataagaaccaatatgaccaatatgggtgcttgaagtggttaaataagttcgccgaatattacaaccaaaagctccaaagtgaattacataggcttcagggacttcactctcatgctaatatcatttatgctgattattacaatgccatattgtcattatatcgtgatcccacaatgtttggttttactaatcttaaaacctgttgtggaatgggaggtccatataattacaacgcatcagcagattgtggggatccaggagtgaatgcttgtgatgatccttctaagcatattggatgggatggtgttcacctgactgaggctgcatatagaataattgctcaaggtttaataaaaggaccatattgtctcccccgatttaataccttgtgcttgataaacactagttatggccatttcaatagctaa

SEQ ID NO: 2497 - DNA, 240 bp, Glycine max var. Williams 82
atgtgttgttgctctgaagactgtgagtgcaggcctcttgggtttttgttgggcctgccttttgccttcttgtctctcctcatctcccttgtgggtgtggttgtttggatagttgggttgcttttgacatgcatatgcccatgttgtctttgtgtgaccatcatagttgagtttgctctggcgctgatcaaggctccgatagtggttatggagtggttcatctccaagattccatgttag

SEQ ID NO: 2498 - DNA, 711 bp, Glycine max var. Williams 82
tagcacctaactacgtgtttctgtatgcttgttttattttgttttttcttcttaacccattttactaatacttatagtattctccgtcaatgctctctagtttatattgtaagtatttggcttttcctaagttaaaagcttcaagagatagtaagcaatatctggaaaagaagatcaaattggcaaccattaaatcaaaccatgtgttgttgctctgaagactgtgagtgcaggcctcttgggtttttgttgggcctgccttttgccttcttgtctctcctcatctcccttgtgggtgtggttgtttggatagttgggttgcttttgacatgcatatgcccatgttgtctttgtgtgaccatcatagttgagtttgctctggcgctgatcaaggctccgatagtggttatggagtggttcatctccaagattccatgttagatatttgtatttttaaagtggtagatgcgaattttggtggattcttttgtgaattgccttcttagttgattcatgtatttgattaaattatgtccaaatgaatgtaaggaatttttcatttccccaatgggaaaaaaaattatatttcttctgtgtcattgtattttgacaatcacgatcgatgagattttaaagtaattactatacaaattagaagaaaataatacatccattaacctttacaattttataaatatcatacataaatat

SEQ ID NO: 2499 - DNA, 1527 bp, Glycine max var. Williams 82
atggctaatgtttcagagacaactttagagaacacaccaacatgggctgtggcaacagtttgcttcataatgatagttatctccatttttattgagcatttgctccatatattggccaggtatttcaaaaggaaaaggaggaaatccctcactgaggctcttgaaaagattaaaacagaattgatgcttttgggtttcacatctctgctgctaacggtgagcgaaaaatcaattgcaaatatttgcattccaaagggtgtaggtgaaactcttattccctgcgcaagcatagcttttgacgatgctgaggaagaaacaaaatgtgcagagcagggaaaagtatcattgttgtcgagggaaggtgtcagagagctgcaatacttcatctttcatctggctgtgtgccatgttgtttcctgcattctcacctttggtcttggaatggcgaagatgaggcgttgggagtcttgggaaggagaaactaaaacattggaatatcagtttgcatatgatccacggaggtttcagctcactcgtcagacaccatttggaaagcggcatcttaactattggagtaacaattctgtaatgtattggcctgtctgtcttgttagacaattttatagatctgtccccaaggttgattacttcactcttagacatggattcatcatggcccatttttcagaagaaagtaactttgatttccaaaaatatatagaacgggctctggagaatgattttggagttgtcgtgggattaagctggtggatttggatcttctctgtactttacatattcttcaatgcaaatgcattctacagccatttctggctgccttttattccgctaatggtgcttttattggtgggaacaaagctacaaagcataataacagatatgtgtttggatagtcatgacaaatcccatatgatcaaaggaactttgcttgtgaggcccagtgaccactttttctggtttggatggcccaagctgctgcttcatctcattagcttcatattgtttcagaattcctttcaactagcatttttcacatggacttcgatccgattcggcatcagatcatgctttcatgaagaaattgagaatatcatcataagggtagctatggttgtttcagtacaaattctttgtggctatgtaacactaccactttatgctttggtaactcagatgggtacctcgatgagaaaagttgtgtttacagagaatgtgattagaggaatccaaatttggcaggataaggccaagaagaatatggctcttaggaatccatattcacaaggcacaagcttagacacttcgctttcacttgaaacttcactagaggcttcgccttctttcaggcttggtgcatcgctctccaattttatggatcgtccattagatgttaataagcacatgaatgttaatattacacaaggagaaatagtgagtgaacaacaagaatccgagaatcaggcatcaaatctaagttcatttcaaggatttaacctgcaactttga

SEQ ID NO: 2500 - DNA, 417 bp, Glycine max var. Williams 82
atggacggaagttggagtgagggaaaaaggagcatgagttacaaggaggaggatgagtacgaagaagaggaagaggaggaggtgagtgagtatggagatgatggtaagaaaaagagggtggtgagtaataagagagggtccaaagctggaggctcagtgccaccttcatgtcaagttgatggttgcaacgctgatctaagtgaagctaagccctaccataggcgtcacaaggtttgtgagtaccatgccaaggctcctgctgtagtcattggagatcagcaccaacggttttgccaacaatgtagtaggtttcatgagctatcagaattcgatgactcaaaaaggagttgcagaagacgtttggctggacataatgagaggcgtcgcaaaaatgcatctgagtatcacggactttga

SEQ ID NO: 2501 - DNA, 4341 bp, Glycine max var. Williams 82
atgaatttaagacagcgacccgtcgccgcgcgcggcggcgccaccaacctgccgcggccgcctccgctgaactccgtcttcaacattatccccgtgcatgacctcttcacggaccatccgtcgctccggtacccggaggtgcgcgccgccgcggcggctcttcgcaccgtcggcgacctcccgaagcaccagttcatgcggtgggaaccggagatggaccttctggactggctccggttactcttcggcttccaactggacaacgcgcggaaccagagggagcacctggttctccacctcgcgaactcgcagatgcgcctcgagccgccgccggtgatcgtcgacgcgctcgacgccggcgtgctgcggcggttccggcgaaagctcctccacaactactccgcgtggtgctcgttcctcggcctgaagtcgaacgtgcttctctcgcgccgccgcgacccaacggatcttcggcgcgagttgctgtacgtgtcgctttatcttctggtttggggagaggccggtaaccttcgtttcactcccgagtgtctttgttatatttatcatttcatggcgaaggagcttaatcatgttatagatgaacacggtgatcctgatactggtcgtccttatatgcctacggtttctggtgaattagggtttttgaagtctgtgattatgcctatttataatactattaaggttgaggttgatagtagcagaaatggaaaggctccgcactctgcgtggagaaattatgatgacattaatgagtatttctggagtaggaggtgtttgaagagactcgggtggcctttgaattttgaatgtaattttttcggtaccacgccgaaggagaagagggtggggaagacggggtttgtggagcagaggtcgttttggaatgtttataagagttttgataggctctgggtgatgctgattttgttctttcaggctgccattattgttgcttgggagggtaccacttatccatgggaggcgttggagaaaagggatgtgcaggtcaagatgttgactgtgtttatcacttggagtgctctgaggtttcttcaatcggtgcttgatgccgggactcagtatagcttggttactagagagaccaggtggcttggagtgaggatggcgctgaagagcatggctgccataatgtggactgttttgttttcggtcttttatggaatgatttggattgagaagggttctaggccaatctggtctgatgcggccaatcagaggatttatacatttcttaaagttgtccttttctttcttatcccggagctgttggcgttggtgctgttcgtggtgccatggttgcggaatgtcattgaggaatcagactggaaaatagtatacttgttgacatggtggtttcatacccggatttttgtgggtcggggtgtgagacaagcgctaatagataatgtaaagtatactgttttctgggtagcagtattagcttcgaagttttcattcagttatttatttcagatcgagcctctagttgctccaacaaaggctcttttgaatcttaagaacattcgttataaatggcacgagtttttcaacaacaccaacagggtagcagttgtcttgctatgggtacctgttgtgctggtatacttaatggatttgcagatatggtattcaattttctctgccttttatggcgcggcaattggtttgttctcgcatttgggtgaaattcggaatgtgacacaactcagacttagatttcagttctttgccagtgcaatgcagttcaatctgatgccagaggagaagctgctaagtcagcaagctacactgttaaagaagcttcgtgatgccatccacaggttgaaactgcgatatggacttggtcagcccttcaataagattgaatcaagccaagtggatgctaccaggtttgccttaatatggaatgagattatgataactttcagggaggaagatatcatcagcgatcgagaacttgagctcttgaaactgccgccaaattgctggaatattagggttattcgatggccgtgttcccttctctgtaatgagctgctgcttgctgtcagtcaggccaaagagctggaaaatgagtctgactggtcactttggttgaaaatatgcaagaatgagtatcgccggtgtgctgtcattgaagcttatgatagtgttaaatatttgtttcccaaggttcttaaagctgaaaaagaagagtattccattatgactaatatattcggggcagacaagaatccccgtgcggacgagatattgtatttgatgcaaaacaacgaggcacttcgagtggcgtatgttgatgaggtttctttagggagggaggggactgaatattactccgttcttgtgaagtatgatcagcagttgcagagtgaggttgagatttatcggatcaggttgcctggtcctttaaaacttggagaagggaaaccggaaaatcagaatcatgccataatctttacacggggtgatgcagtccagaccattgatatgaatcaagacaattattttgaggaggctctcaaaatgcggaatctgttggaggagttcaatgcatactatggtattaagaaaccaaccattttgggggtccgagaaaatatcttcacaggatctgtttcctcacttgcatggttcatgtcagctcaagacacaagttttgtgacactgggtcagcgtgttctggcaaaccctttgaaagtacgaatgcactatggtcatccggacgtgtttgacagattctggttcttgggtcggggtggagtcagcaaggcctccagagtgatcaatatcagcgaagatatttttgccggtttcaattgtaccctgcgaggtggcaatgtgacacatcacgaatatatacaggtaggcaaaggaagagatgttggtttgaatcagatatccatgtttgaggccaaggttgctagtgggaatggtgagcaggtcctgagcagagatgtgtaccggctaggccatagattagacttctttcgcatgctttcagtgttctacacaaccataggattttactttaactccatggttattgtactgatggtttatgccttcctttggggccgcctttatatggctctcagtggtattgaacatgcagccttgaaaaatgctaccaacaataaagcccttggtgcagtcctaaatcagcagtttgctatccaggttggtatcttcactgcgctcccaatgattttcgaaaactctcttgagcatgggttccttccagctctttgggacttcttgacaatgcagttgcagcttgcatcactattttacacattctctttgggaactcgcacacatttctttggtcggactatacttcatggtggtgccaagtaccgagcaacaggtcgtggtttcgttgtggcacacaagagttttgctgagaactatcgactatatgctcgaagccattttgcgaagggtattgaacttgggattattttaattgtgtatgctgctcatagtcctttggctagggatacttttgtgtacatagctatgacaatctcaagttggtttcttgtagtttcatggataatgtctccttttgtcttcaatccctctgggtttgattggttgaagactgtatatgactttgaagattttataaattggatatggtatcctggtggtcccttcaaaaaggcagaacatagctgggaaacatggtggtatgaggagcaagaccatttaaaaacaaccggtatatgggggaagctgttggaaatcattttaaaccttcgattcttcttctttcagtatggcattgtttatcagctgggtattgcaggtggaaataatagtatagctgtttacttgctgtcttggatagtcatggttgtgattgttgccatttatatcatcatggcatatgcccgggataaatttgctacaaaggagcacttatattatcgattagttcagcttcttgtgattgtaatcacagttcttgtacttttcctcctactggagttcgcccatttaaaatttattgatcttctgtcaagcttcttggcattcgttccaacaggatggggaatgatttcaatcgccctggtgcttaggccttttctgcagacaactaaagtgtgggaaactgttgtttccttggctcgtctatatgatttgctgtttggggttattgttatggctccaatggcaattgtatcatggttacctggatttcaatcaatgcaaactaggattctctttaatgaagctttcagcaggggtctccagatatctcgaatagttagtggcaagaagtctgtttaa

SEQ ID NO: 2502 - DNA, 390 bp, Glycine max var. Williams 82
atggcactgtcccatgaagatgaaagtccaatacaccccaggtctattgttgttttggatgatatcttttgcatttttatgggatctctagcaaacatagctgagcttagacatcattatgggctcgcaagacaagcaacagaagccatgattgtgattgaagcctataaggccctaagagatcgcgctccctacccacctgaccaagttgttaaacatcttgatggaaaattcgcattcatcatctttgatgccaagacatatactctttttaaagccagggatcgtgaaggaagtgtgaaatttcaatggggaatggcaagagatggatccttagtctgttctgatgaccctacaatcatcagagagggatgtggaaacatcatatag

SEQ ID NO: 2503 - DNA, 1439 bp, Glycine max var. Williams 82
ttgtatcttggttacgtattattacacgtatatccccacggaatctgaaaccatcctgtgaggttgccacgtgcataatctccaatgtcactatttgtaagtttgtgaattttttaatggttccatcacaaaatagttgaacctaagtcctatggaagtctataattaaaccagctttgaggatactatagcacaagctgaagagccattgaatttgaactaaccaaactaataagcaaaaatgttggcggtgtttgcaaaagccattggaaaaccaccggaggaactgaggcttccggcaatggggtccaataattcaagaccccagaagaaattgtacagaaatttcaatctttgtggccggattctgcggtttacaaccttccacatgggaattttatggcactgtcccatgaagatgaaagtccaatacaccccaggtctattgttgttttggatgatatcttttgcatttttatgggatctctagcaaacatagctgagcttagacatcattatgggctcgcaagacaagcaacagaagccatgattgtgattgaagcctataaggccctaagagatcgcgctccctacccacctgaccaagttgttaaacatcttgatggaaaattcgcattcatcatctttgatgccaagacatatactctttttaaagccagggatcgtgaaggaagtgtgaaatttcaatggggaatggcaagagatggatccttagtctgttctgatgaccctacaatcatcagagagggatgtggaaacatcatatagttaaaataaaaattcatgtcccaatgttacatcttatctgagtattgtgtcctgacatcttccaacacaacgtttcttaaagcaattcatctagttatctgctctcacaaacataaggttgagatcatcacaatatttaaacacaaacaacacataggggagtgagttatcacattcctaaacatgtaaagataaacgaaaacacacacatacatataatataagtataacaagctcaacttaccacaattcacatcattttaccactcattgcataacgtcactgataactgtaaaatttaagtttaattgataattaattttaactaagaatgattagaattcctttactttagtgttgtttttaatgaaataataatgaatttaatatcatgtgaatttttaactagcaggattcagaagtaaattacaagtgctttggaagaaaatcgatgcaaaaacttaaagaaaaagccttaaagaaaaaagtaaaaaagggacagcttgcttagcgcacaagttaggctcagcgcacctcctcggtttgctggcaagctcaagcttagcgcaaaaaaaaacccacgaagaaacttaaaggcacacttagtgcgaaatcccacgctaaacgcgtgatcgcctcgctaatctca

SEQ ID NO: 2504 - DNA, 756 bp, Glycine max var. Williams 82
atgttgggaattttcaagcagaagttagttaatgcacccaaggagctgaacagtccagcttctttgaattcatgcactaagcctaagctaagtcatgaagtcctgaaggatttcatgtcctgcaattcctccaatgctttctccatgtgctttgggagtgatgctttgctagcctattccccttcaaacaagccctccattcatcataggttgtttagtggtttggataacatatactgtgtcttcctgggtggcctgcacaaccttagcatgctcaacaagcagtatgggctatcaaaaggaacaaatgaggccaggtttatcattgaagcgtatcgaactcttcgcgacaggggtccatatccagttgatcaagtcctcaaagaacttgaaggcagtttcggatttgtgatatatgacaacaaggatggaacagtttttgttgcatctggttctaatggccatattgggctctactggggaattgcagcggatggttcggttacaatttctgaaaatctggagcttataaaagcaagctgtgctaaatcatttgcaccatttcctactgggtgtatgtttcatagtgagcacggtctcatgaactttgaacatccaacacagaagatgaaagcaatgcctcggattgacagcgagggagttatgtgcggggccaacttcaatgttgactctcagtcaaagatccaggtgatgccacgtgttggaagtgaagctaattgggcaacttggggctaa

SEQ ID NO: 2505 - DNA, 762 bp, Glycine max var. Williams 82
atgggttgctgcgtcagtagtaccaacagatctcattcttcaccctcaagcaagcctattgaccgaccaagatctaccgcgaaaggttcagaaaacagagcaccgccaccggaggaagaaacggtgaaggaagtgttgtctgaaacacccaaatggaagccaaaattcgaagcggagaagccaacagagagcgatgctgagaacgagaaggagaagctgttcgtcaaacccgatgagatctctgaggtttctgaagtttgcagtgtaagtgagagcctgtccacactcgccgaagaagaagcacgtcaaagggtcaacagatctccggcaaaggtgcgcaaagcacgctccttttccggcgagttcggctgccggagggaaatgacggcggggaagtctccggcgaggaggccggagcagtctccgggaagaaggaatattgggtcggtgagagttgttcaaatggccaatggtggaaccgggagccagcctcgccggcgagactccggcgagaattccggccgccgatccaggtcgccgggcacccgcaccgacagcgtgtcaactagatccatcgtgggtcggagcccgtcgaagaggaggacgcctatgaatcaatcaccagctcgggtcagaagctgcgcggcggagagcggtggccggaaaatggagaattcgagcatggagggtaaatggccttcatcagctaatgagtcactagaaaacccacttgtgtcgttggaatgcttcatatttctctag

SEQ ID NO: 2506 - DNA, 1526 bp, Glycine max var. Williams 82
tggagagatcttacagtaataaatgcctttgattgacctctgcaaagcttcacacttcctttttctaactaccatttcctccttttgtgcatcttctctcgtgtcctctccatcttaaaccactactactttatcactacactacaacactgcaacactctctctaatggaacaaaccttcctctttctctttccccccacacattagcaacctacgaccactctgcttcacaattccaaaatgggttgctgcgtcagtagtaccaacagatctcattcttcaccctcaagcaagcctattgaccgaccaagatctaccgcgaaaggttcagaaaacagagcaccgccaccggaggaagaaacggtgaaggaagtgttgtctgaaacacccaaatggaagccaaaattcgaagcggagaagccaacagagagcgatgctgagaacgagaaggagaagctgttcgtcaaacccgatgagatctctgaggtttctgaagtttgcagtgtaagtgagagcctgtccacactcgccgaagaagaagcacgtcaaagggtcaacagatctccggcaaaggtgcgcaaagcacgctccttttccggcgagttcggctgccggagggaaatgacggcggggaagtctccggcgaggaggccggagcagtctccgggaagaaggaatattgggtcggtgagagttgttcaaatggccaatggtggaaccgggagccagcctcgccggcgagactccggcgagaattccggccgccgatccaggtcgccgggcacccgcaccgacagcgtgtcaactagatccatcgtgggtcggagcccgtcgaagaggaggacgcctatgaatcaatcaccagctcgggtcagaagctgcgcggcggagagcggtggccggaaaatggagaattcgagcatggagggtaaatggccttcatcagctaatgagtcactagaaaacccacttgtgtcgttggaatgcttcatatttctctagagtaggtgaaattagggttaaagttaaagtagttattactacttgtcagaggtattattagtaactcgtagtattaatttctgtactttctttgtttaattaagtagtgtctgatgactgatggtaagcactaagcacttgaattgggtgtaaatagttgaagtcaatggtcaattgaattgtaggagtcagttattattggagggaaagggtggttggaccctacttctacttgcattgcaacatggccttttggatagttgaatacgtaaatggttaaaagaaaaaattgacctctgttttacctgcagtgttgtagcagtgctcttttcttttttctccccctgtagcctgtgggtagattttgcttcttctacttcacctattggcaggtttggaaagattgcgtttctgccatatgtgattcagtctttaccaaaatattcaccttcgcttttttgaaagtgaaaggtgaactacatacaaagatgaatgccaatacaaagcatgaaatttattcact

SEQ ID NO: 2507 - DNA, 777 bp, Glycine max var. Williams 82
atgctttcttggaaagttctcctcgtctccgccgccgtcttgttcgcggcgttaggcctcagagtctctcttccagtcgccgccaccaacctccctcttctttggagtttcttcctcttgtgtttcaagcctccttacctcttcgttgttctcaacgccatcatcatctccatcgtcgcttcttcacggtttcatcactcatcaaaccctcaatctccggagccaactcctccacgtgttgaatccatgcccgctcccaccgttccagaaccaccgcttttccaagtaaaagccgttctcgaagtggagaagaaagtaatcgaagaagatgttgtggcactaaagagaaaagactcgacggagattccatcgccggaggagaagccactggtgtctgctaggttcactcaccggaaattccttaaatccagttcagaaggtgggagagcgttgagagtggtggctaaggcaaaacgggacgagacgttggagagcacgtggaaggccataacggagggtcgatcaatgccattgagcaggcacatgaagaagtccgacatgtggcacaaccgcaacgtgaccccacaaccccaagagacattcaacgatgcactgagtgtgtcgtccgggaggctgcggaaagaaccctcgctgagtcaagacgagttgaatcgtcgcgtcgaagccttcatacaaaagttcaaccaagagatgaggctgcaaagacaacaatccttagaacagtacatgcagatgattaaccgcggtgccgcttaa

SEQ ID NO: 2508 - DNA, 1731 bp, Glycine max var. Williams 82
atgtcgagtatcactttcttccaccgtctctctagtgctttccgtgacaaccagtcgcatcttaagcttgtactgctctgcaccgccgtaagtggtggtggcctttgggcttatggtgagagtgttgcacctgaagaggcagttacggagaagaagaaggtggtggtgctgggaactggttgggcggccacaagttttatgaagaatttgaacaatccaaaatatgagattcaagtagtttcgcctcgtaattactttgcattcacccctttgctgcctagcgttacgtgcgggacagtcgaagcgcgcagcattgttgaaccagttcgcaatatttttaagcagaaaaaggtggacgtacaattcagtgaagcagaatgtttcaagattgatgcagaaaataggaaagtttactgtcgatctagtgtgaacaataatttggatgggaaagaagaatttgttgtggattatgactacctaatagtggcggtgggcgctaatgtcaatacgtttaatactccaggagtgacggagaattgccattttttgaaggaagttgaagatgctcaaaagattagaagaacagttattgactgctttgaaagagcaaatttgcctgatgttagtgaagatgagaagaagagaattcttcattttgctattgttggaggtggacctactggagtggagtttgcagcctcacttcatgattttgtcaatgaggatttggtccgtttatatcctggaattaaagatttagttaaaattacacttttggaggcgggcaatcatatcttgggcatgtttgacaagagaatcactgcttttgctgaagacaagtttcgaagagatgggattgatgtgaaaacaggatccatggttgttaaggtatctgagaaagaaatttccactaaagaactgaaaaatggagagattaagacaattccgtatggaatggctgtctggtcaactggtattggcactcgtccatttattaaagattttatggcacaaattggtcaggctagcaggcgtgccctagctacagacgaatggttgagagttgaggggtgcaacaatgtctacgcgctcggtgactgtgccacaataaaccagcgaaaagtcatggaagatattgtggcgatctttaagaaggctgacaaagacaattctggaacacttacggtcatacaatttcaagaggtcatgaaagatatctgtgaaagataccctcaggttgagctatatctgaagaataaacagatgggcaacattgctgatttattgaaggaagccaagggagatgataaaaaagaatcaattgagctgaatattgaagaactcaaaactgcactttccaaagtggattctcaaatgaaatttcttcctgctacagcccaggttgcatctcagcaaggcacttacctggccaagtgttttaaccggatggaagagtgtgaaaaaaatccagagggtcctctcaggttcaggggagaaggtcaccatcggttcaaaccctttaggtacaagcatttaggtcaatttgctcctttgggaggagagcagacagctgcccagcttcctggagattgggtttcaattggccatagcagtcaatggctgtggtattctgtctatgcaagtaagcaagtaagctggcgtacaagagcgttagtagtttcagactggacaagacgttttatttttggaagggactcaagtagcatctga

SEQ ID NO: 2509 - DNA, 423 bp, Glycine max var. Williams 82
atgatttcactacgaccctataacacatgtcttgaaacaacaacgtttctcttcaacccttcaaagcttggaatctctagacaaacccaaacatgcatgatagcacaaaggaaagcaacaccacgtagaatagaagtcaaatgcagtggtgcagaaaataagggtgagagaacgtttttgacactggaggaagctggtttggttgagatatcaggcttgagcacacatgaacgctttctatgccgtttaacgatatcgtcgttgaacttgctaagagtgatatcggagcaagaagggtgtccaattgaggagctcaatgctgccaagatatgtgattggttcctcaaagataagctcaaaagagaacagaacttaggctctgcggttcttcaatgggatgataattccgactacaaattttaa

SEQ ID NO: 2510 - DNA, 609 bp, Glycine max var. Williams 82
atggttaccaaggtttacattgtttattattctacgtatggacacattgagaagctagctagagagatagaaaaaggtgctgcttccgtggagggagtagaagcaaaactgtggcaggtacctgaaacactgtctgaagaagtccttgtgaagaagggagcacctccaaagagtgatgatgttcctattattaaaccccgtgagcttgccgatgccgatggctttctgttcggttttccaacaacatttggaaccatggcttctcaattcaaagcatttttagaaggcactatagggctgtggcatacacaggcactagcaggaaaacctgcagggttcttctctagcactagttctcaaggaggtggacaagaagagaccccgttgacctctgtcactcagcttgttcaccatggaatgatttttgttccggttgggtacacatttggagatggcatgtatgagatggagaaggtcaaaggtgggtccccttatggctcaggaactgttgtcggggatggctcaaggcaacctagtgacttggaattggctcaagcttttcatcagggtaaatactttgcagccattgcaaaaaagctcaagggatag

SEQ ID NO: 2511 - DNA, 507 bp, Glycine max var. Williams 82
atgtctatgccaccgcacagatctttacaggccatctttcttgtcttgtttgttgttgttcttcttcctttctcagtctcagtggcagcttcatattcttctattcatgagcttctccgaagccatggcctaccagcagggctgtttccagagggtgtaaagtcatacaatttggaccaaaggggtcgtttggaggtaaacttggatggtccttgcatgaccaagtatgaaacaagagttttgtttgaaactgtggttagagcaaaccttagttttggtcagctcaaggggttggagggtctgtctcaggaagagcttttcctatggttaccagtgaaggatatcattgtgaatgatccatcttcaggccttattctcattgacattggtcttgcacataaacagctctctttgtctctctttgaagatcccccagtttgtagatcccaaggtctttcacttaatattggtggaaggaaaagcattggatttcaagaccagagatga

SEQ ID NO: 2512 - DNA, 627 bp, Glycine max var. Williams 82
atggagtatgaagatgaagattggctttgtgtcactatggatgagttttctcttgctactgaaaatggttgtaacaggaagaggaactttgatgatgacacgaaagagtacaaatcaaagaaccttgagactgaaaggaggaggagggagaagctcagtagcaggcttttgatgctgcggtctatagtacctataatcacaaatatgaataaagcaatgattgttgaagatgctatcacctacattgagaagctgcaagacaaggttcagagtctcagccaagagcttcaccaaatggaagcaacttcagaggaaacagcagagacaaaaatagttgaaattgatgctgcggaagatatgaagaattgggggatacaggaagaggtcatagtggaagaaataaacgagaataaactctgggttaagatcattgttgagaagaaaaggggaagattcagcagattgatggaggccctcaataattttggcattgaactcattgacaccaatctcacaaccacaaaaggagcatttctgattacaagcttcataaagggcaagaacggtgaaagacttgaaattcatcaaaccaagaatttattgcaagatatcatcaatgacatatag

SEQ ID NO: 2513 - DNA, 2895 bp, Glycine max var. Williams 82
atgttcgccggaggaattttccggtacggttctcccactactctgttattcctctgtctcgttgcttccaccctctcagatgaacttcaactactcatgaagttcaagtcctctatacaaagttccaacgctaatgttttcagttcatggacacaagcaaattctccctgccaattcaccgggattgtatgcaactccaaaggctttgtttcagaaatcaaccttgcggagcaacaactaaagggtactgttccttttgattcactttgcgagcttcaatcgcttgagaagatatctttggggtccaacgtctacttgcatggcagcatcagtgaggatttgaggaagtgcaccaacttgaagcagctggacttgggtaataattcattcactggtgaagttcctgatctgtcaagtttgcacaagttggagttgttgagtttaaactccagtggaatttctggggcgtttccatggaaatcattggaaaatctaactagtctcgagtttctgagtcttggagataacctgttggagaaaactcctttccctttggaggtcttaaagcttgaaaatttgtattggctttacctcacgaattgcagcatcactgggaatattcctttggggattgggaatttaactcggcttcagaatcttgagctttctgacaaccatttgtctggtgagattccacctgatattgtgaagcttcagaggctgtggcagcttgagttgtatgataactatttgagtgggaaaatcgctgttggatttggcaaccttactagtcttgttaactttgatgcttcttataatcagcttgaaggcgatctttctgagctaaggtccttgacaaaacttgcatcccttcatctttttgggaacaagttctctggagaaattccaaaagagattggagatctcaagaatctcacagaactttctctttatggtaacaatttcactggccctcttcctcaaaagcttggctcgtgggttggcatgcagtaccttgatgtttcagacaattctttttctggtcctataccacctcacctatgcaagcacaaccaaatcgatgaactagcactgttgaacaacagcttcagtggaactataccagaaacatatgcaaactgcacatctttggctcgatttcgcctgagcaggaattcactttctggtgttgttccttcaggcatatggggcttggcaaatttgaaactatttgatcttgcaatgaaccagtttgaaggtccagtgacaactgatattgccaaagcaaaatctctggctcaactgctgttatcttacaataagttctcaggtgagttgccattggaaatctcagaagcttcttcactggtgtcaattcaactaagttcaaatcaattttctggtcacattccagaaaccattggcaagttgaagaaactaactagtctaactttgaatgggaacaatctttctggtattgtaccagattccattggttcttgtacttctcttaatgagataaaccttgctggtaactctctttctggggctataccagctagcgttggttctcttccaaccctcaattcattgaacttgtcctcaaacaggctttctggtgaaattccatctagtctatcatctctcagacttagccttcttgacttatcaaacaaccagttgtttggttccataccagaaccactggctatttcagccttcagagatgggttcacgggaaaccctggtttatgcagcaaggctttaaaaggtttcagaccatgttcaatggaatctagcagctctaagcgattcagaaacctattagtctgtttcattgctgttgtaatggttctgcttggagcatgtttcctcttcacaaaactaaggcagaacaagtttgagaagcaactgaagactacttcatggaatgtcaagcagtaccatgtgctaagattcaatgagaatgaaatagttgatgggatcaaggctgagaatttgattggaaaaggaggatccgggaatgtttatagggttgtgcttaaaagtggggcagaatttgcagtgaaacatatatggacttcaaatctaagtgagaggggaagttgtaggagcacctcatctatgctaagaaggagttcaaggtcacctgaatttgatgcagaagtggccactcttagctcaataaggcatgtgaatgtggtgaagctctattgtagcatcacaagtgaagatagcagtttgcttgtttatgagtttttaccaaatgggagcttgtgggacaggttacacacgtgtaagaataagtctgagatggggtgggaggttaggtatgacattgctttgggtgctgctagaggattggagtacctgcaccatgggtgtgatagacctgttatacatagggatgtcaaatccagtaacatattgctggatgaggaatggaagccaaggattgctgattttggccttgcaaagattcttcagggaggagcaggcaattggaccaatgtcattgctggaacagttggatacatgcctcctgagtatgcctacacttgtagggtgacagagaagagtgatgtttacagctttggggtagtgctgatggagttggtaacggggaagaggcctatggagccagagtttggagagaatcatgatattgtgtattgggtatgcaacaatattaggagcagagaagatgctcttgaattggtggatcctaccattgcaaagcatgtcaaagaggatgccatgaaggtgttgaaaatcgcaacactgtgcaccgggaaaattccagcttcaagaccctcaatgagaatgttggttcaaatgctggaagaggcagatccatttaccacaaccaaaatgattgtgaccattgatgcttaa

SEQ ID NO: 2514 - DNA, 1389 bp, Glycine max var. Williams 82
atgaaaaactcacaagagaagaaacatgtcgcagtgtttgttttcccctttggaagccaccctgttcccctcttaaaccttgtgctcaagctagttcatgccactcccaataacttgaaattctcattcctaggcactgaacactccaacaaacctcttctctcaaaaccccacatcccagacaccatcaagttctatagtataagcgatggagtcccagagggtcatgtcccaggtggccacccagttgagagagtaaacttttttcttgaggctggtcctgagaacttgcaaaagggtatagacatggcagtggcagagactaaagagagtgtcacttgcatcatcgctgatgcttttgtcacaccttctctccttgtggctcaacacttgaacgttccatgcgttctagtttggcctcctttgtcatgttctctctctgcacattttcacaccgacttaatacgccagaaatatgataacaacagtgacaaaaacacccctttggatttcattcctgggttgtcaaagatgcgagttgaagacttgccagaagatgtgatcaacagtactgacagcgaagaggagacactgttttcaaagacactagcttcattgggaagtgtcttgccacaagctgaggcagtggttgtgaatttctttgaggaactagatccaccgttgttggttcatgacatgaggtcaaagttgaagagttttctctacgttggttttctgactctttcagtgcctctaccacccttgcctccatcagacacagatgcaacagggtgcttgtcatggctggatcacaagcagaagcagaataatggtgttgggtcagtggcatatgttagctttgggacagtggtgaccccacctcctcatgagattgtggcagtggctgaagcattggaagcaagtggtgttccctttctttggtctctcaaggagcatctgaagggtgttctgccaagagggtttcttgagagaacaagtgagagtgggaaagttgtggcttgggccccacagactcaggttttgggacatggttctgtgggtgtgtttgtgacacactgcgggtgtaactcggtgtttgagagcatgtccaatggggtgcctatgatatgcaggcctttctttggggatcatgggttgactggaaggatggttgaggatgtttgggagattggtgtgagagtggaaggtggagtgttcaccaaagatgggttggtgaaatgcttgaggctggttctggtggaggaagaggggaaaaagatgaaggaaaatgcaatcaaggtgaaaaagacagttgtggatgcagcaggaccacaagggaaagcagcacaagatttcaacactttgctggaagtggtttctagatcttaa

SEQ ID NO: 2515 - DNA, 2198 bp, Glycine max var. Williams 82
ttcggtaaccctaggtgcagtgcgcgcacgaggcccttcttctcggcgcattttagcataagaattcagaattctattacactgtttcttttactcttcctttttggtagcttcacacaattccgaattcccacagagagagagagagagagagagaattatgggaagcaactttctctctccgccagctaagcgctccgcactcgacccgaatccgtttcctccaaacggaccttcaaagcgctccaggcaatccaagcctccgccgccgctctccgtgccgcccggccacgtagccttccgcctcctctgcaacgcctcccgaatcggcggcgttatcggcaagtctggctccgtcatcaaaactctccagcaatccaccggcgccaagatccgaatcgaggacgcgccgcaggagtcgccggaccgagtcatcctggtgattgccgacgccgcactcagctgcaaggttctgctgagaaacgaagaagtcgttgaggtgtcgaaggcgcaggaggcgctgctgaaggtgttcgataggatcctcgaagtggcagcggagatggaaggagtcgacgttggggacagggtaatgtcttgccggctggtggcggactcggcgcaggctggctccgtcatcggcaagggcgggaaggtggtggagaggatcaagaaggaaaccggatgtaaaattagggtattaactgatgatttgccactttgtgcctccgcttccgatgaaatgatcgagatagaaggcagagtgtcatctgtaaagaaggcacttgttgcggtctcccaacggcttcaagattgtccctctgttaatagaataaagatgatgggaaacaaaccttatgaaatagttcagtatgaaactttagatgcacttcctcgtgagattttaactgcagctccacgtgggactttaactgtagtaccacatgagactgtagatcatcttttgcttaggagctctgcactttctactttatccagttcctctaacagctatgccaccagagttcattcactgtcagcagaagttaatagagtctcatccttggaaccaaaagcacttcagcaggaagtctccttcagaatactttgttcaaatgatagagttggaggagttattggaaagggaggcaatattgttagagctcttcagagtgagacaggggctacaataagtattggtcctttggtagctgagtgcgaggatcgattaattactattgctgcttcagagaatcctgagtcaagatattcaccagcacaaaaggctgctgtgcttgttttctccaggtccattgaggttggttttgagaaggagctagactctggattaaataaggggtcaactgttactgtgcgtcttgtagttccatcaagccaagttggttgtttgataggaaaaggtggagtaatagtatcagaaattcgaaaggcaactggggccaacataagaataattgggactgatcaggtgccaaaatgcgcatcagataatgatcaagtcgtacagatatcaggagagttttcaagtgtgcaagatgccttgtataatgctactggtagactgcgagataatctttttgtcagcacacagaatagtgctggaacaaggagcctttcttctctacgagttgataccagtccctatgggatacagcaggattttgttcctcatggaagccaactgcctgcaaccacttctcactgtctgagtagacatacttttgctcagggcattgatcatcttggtctttctagaaatttagatcatccttcgtcaccagggttatggactagaaatttagaccgtacttcttcacctttgttatggactagaaatttagactgtccttcttcgccagggttatggactagaaatttagaccgtccctcttcgccggggttatggactagaaaattagatcgtccttcttcaccggggttatggacgcagccaacagtggctgggataaattcaagaagcattaatgattttagtttgggattgacatctcgaaaaggcggcttagaacttgtgaggttgttgatttgcaaaacaaattaaacttgttgtaatccaaattgcaaatcttgttttcttgttatctcaaattttaagattttaataatattaacagctatttatggtgtgatgtaatggatgttgatgtctgcggtat

SEQ ID NO: 2516 - DNA, 378 bp, Glycine max var. Williams 82
atggcctcaagcaaattattcatcacagctttccttcttgctctgaccttctcaagcatgagcatgagcctagcagctcgccatcttatgcaaacaagtactgcaccaaatttgccgggtattccaagtttgccttcaccaacattgccacctttgccttcacttccaacactgcctcaggccaatgttccacctttgcctactatcccaacacttccacaacctaacctaccatctttgccaaccactttgcctccacttcccagcagcatccctaccattccaacactcccacagctcaacattcctccattgccctcaattccaaccactatgccctccatcccattcctctccccaccaccttccactccttaa

SEQ ID NO: 2517 - DNA, 486 bp, Glycine max var. Williams 82
atggaagcaactaatgttcatcctccccgcatttctgaatttggaacgctggatcaatctcttggatttcgcattgaagataccaattgtttaaatttatcatacatacaaaaacatgcttatttttactctaaaatatggtgcttcattgtcttttggcagcctgaaaggtgtgaatccagtggatcaaaagataaatcaaatcaaaagacattaagacggcttgctcaaaattgtgaggctgccaggaaaagtcgactgaggaaaaaggcatatcagcaacaattagaaagcagtaggtttaaactgacccaacttgagcaggagctccagcgagcacgccaacaggtttggttttgtacttatatttattgtttccgttcaaaatttgatacctatccagctatccttttgacccaacttatgtatttcttcgaagaagcctatcaaaataggttaataagaatcataagttatttgttataa

SEQ ID NO: 2518 - DNA, 2310 bp, Glycine max var. Williams 82
atggattttatggaagtttcaatcttgcatcatgcggggatcgtgcttattgggctatggattctctctgcattcaactggtgtcacacggttgcttattttgtggctttgatctatctttttctggttcatgaacgttatgtcacgaggttgcggaagaagttgcagtttgaggagaggaagcaagctaatcaaagaagggtgctttcagattctgaaacagtccggtggttgaaccatgcagttgaaaacatatggccaatatgtatggaaaacattgtctctcagaagatattattccctatcataccgtggttcttagagaagtacaaaccttggactgctaaagaagctgtcgttcagcacctatacatgggaagaaacccacctttgatcactgaagttagggttcttcgccagagtgatgatgatcacttggttctggagttaggaatgaattttctcacagctgatgatatgagtgcaatacttgctgtgaaactaagaaaaagattgggctttggaatgtgggcaaaactgcacatcacgggaatgcatgttgaagggaaggtcttagttggggtgaagtttctcccaacatggccttttattggccgtttgcgtgtatgctttgttgaacctccatattttcaaatgactgtcaaacctatgtttactcatgggcttgatgtgactgaacttccaggcattgctgggtggctagataagctgctgtctattgcttttgaacagacccttgttgagcccaacatgctggttgttgatgttgagaaatttgtttcaccacaacaagagtcttggttcaaagtgaatgagaaggagcctgttgcttatgcaaaagtggaagttattgaagcatctgagatgaagccatctgatctaaatggattagcggatccttatgtgaaaggtcaaatgggtgtatacagattcaggacaaagatacaaaggaaaacacttactccaaaatggcacgaggaatttaaagttcccatcataacatgggagtctgataacgtgctggttattgcagttcgtgacaaggaccatttctatgatgatatccttggggactgtaccgtgaacatcaatgaatttagggatgggcaaagacatgatatgtggctgtcacttaagaacatgaaaatggggaggttgcgtttggcaataactattcttgaagataatggaaagggagttgatactactacacgtgaccaggaaacaatggactttgaagaacgaaaaatctcctttgaagcaaatgagactactgataatagttccttctcacctgttccacctgaaaaatctgagaagttggcagataactatgagcctatagacatcgacgggcaaaaagagacaggagtttgggttcatcacccaggaagtgaagtttcccaaaggtgggagcctaggaaagggaagagtcggcgccttgatacagaaattcatggggagcctaatgattcagttggcagtggtaattcaactgtatcaggatccttgaacaatgacagcagcagtcctgataataatcctgaagaaaagcatcgaatgagaacggttaggaagggccttcacaagattggttcagtattccaccggagtaaaagaagggagggtttttcaggttctgttgatgaggagattctgtctccacatgataacattaggtcagagaatgctaaggggatgattgctgtgaagtttgtcatggacgagaacatttccggctttcaaactggtaaggttcaggcagaagggggatcaacagaagggagtggtcctgagagccctgccagtgccaagggaaatgtgaaggatatggcgaagaatatttttaaacatgcagaaaaatcggctcgtggcttgaggcacgttctttcttgtaaatcaaggaaattgaaatttaaaggtgagtctccaacagttccagaaagagaacatgaatctgactcttctgacgaggaatctattgcagctcaatctcccatagatgtaataagaactccagttggttctcatgctgtggtctcaggtagcaatggttcccctggttctggggtgaacgtggttcaaatagttccatcaaacactaatttggacaatgaagccacagctaaaatcacgaatgaaaaagatgaccctgaaaatgcatgctcccctgacaggtctagccaagaagttgttaaatctgctgaagtggagcatgataaagaggaaatgggggcacagataaaagagattctatcggtttgtcctactgaagaaagtttcaagtag

SEQ ID NO: 2519 - DNA, 1167 bp, Glycine max var. Williams 82
atgtctcttaaactttgctatcgctcaatccaaggacgaggatattgcagactttcagggaaagtaaaccttgaaacaatcatgagcatcggaacaacactactttcaacaccaccacattactgtttccactccaacactcaaaccacattcctcagcaccgttactccaattcaaaacctctctatccgcaataacaatttcagagtcctctgtttctcttcggacccgtcgcagttgccgccggtggtggtggtggggtccgccaacgccgacatctacgtcgaggtagaccggctcccgggcgagggcgagaccctggcggcgaggtccgggcagacgattgccggcggcaagggcgccaaccaggccacgtgctccgccaagctcgcgtacccgacctacttcgtcgggcaggtcggggacgacgcttacgggagactcgtcacggcgggcctccgcggtggcggggttcgcctcgataatctcgccgtggtggcttcggcggcaacgggtcatgcagttgtgatgctccagtccaacggccagaactccatcgtctacattgggggtgccaacttgagctgctggcctagttccctgccacgtcagcatttggacctcgttgcccaagctggcatcgttttgctgcagagggagattcctgatgctgtcaatgctcaagtcgcacaggctgccaaaaatgctggggtgccagtagtgttggatgctggaggcatggatgggccacttccgccacaattaataaattttgttgatattttgagtcctaatgaaactgaacttgcacgccttacgggaatgccaacagaaagttttgaagagattcaacaggctgctttgaaatgccatgaaatgggagctaagcaagttcttgtgaaacttggacacaaaggatctgccctttttgtagaaggagaaaaaacaattcagcagcctgccatacttgctaaaacagttgttgatacaactggtgctggtgatacttttactgctgcttttgccgtggccttggttgagggcaagtccaaaaaggaatgcctcagatttgccgctgctgcagcttgtctctgtgttcaagtgaagggagcctctcccagcatgcctgataggaaatctgttttggatcttcttaattgtcaatga

SEQ ID NO: 2520 - DNA, 1308 bp, Glycine max var. Williams 82
atggcttctgtgcctcaaccaaaaatctcccttctaaccttattcttcttctcttccttcaccatcattgcgcatgcaattgttcctcaaaacgaaaccttcaaatttgagaactcaggtgaacttggaccctacatcgttgagtacggtgcagattacagaatgataagcatcttcaactctccattccaagttggtttctacaacaccaccccaaatgccttcactctagctttgcgtgtagggctccaacgctcggagcagctatttcgttgggtttgggaggccaacagggccaacccagttggagaaaatgccactttttcacttggcactgatgggaaccttgtgttggcagatgctgatggcagaattgcatggcaaactaacactgccaacaagggtgttgtggccttcaggcttctttcaaatggtaacatggtccttcttgatgcacaaggcgggttcgtttggcagagttttgatcaccccacagatacccttttggtcggtcaatatcttagagcaaaagggccatccaagttggttagtaggctctcagagaaggaaaatgttgatgggccttatagtttggtcttggagcctaaagggttagccttgtactacaagagcaagaattctcctaagccaattctctattggttttcttctgattggttcaccattcaacgagggtccttggaaaatgtcaccttcacatctgatccagaaacttttgaacttggatttgattaccatgtggccaattcttcatctggtggcaatagaatccttggcaggccagtgaacaatagcaccataacatatctcaggcttggaattgatggcaacattaggttctacacttacttccttgatgtgcgtgatggtgtatggcaagtgacctacactctatttgatagagattctgatgagagtgagtgccaattgcctgagagatgtgggaaatttgggttgtgtgaagataaccaatgtgtggcttgtccattggaaaatggactacttggttggagcaacaattgcactgccaaggctgtgacatcatgcaaggctagtgatttccactactacaaaattgaaggagttgagcattacatgagcaaatacactacaggggatagagtgagtgagagtacttgtggaaacaaatgcaccaaggattgcaagtgtgtgggttatttctaccacaaggagaattcaaggtgttgggtagcttatgatcttcaaacccttactagaggggccaattcctcacatgtggggtatattaaggtgcctaataagtaa

SEQ ID NO: 2521 - DNA, 2012 bp, Glycine max var. Williams 82
cccaccgagacactcataacattgaaaatatatttccctatactgtagtacgaatttgatcttatccaactctagatcattcttcataatatttgagttgaaaaccttgaccaaagttctaaattttttctatatatagcagaggctactcacccacatagcacaacatatccattttatttacaacaacaatggcttctgtgcctcaaccaaaaatctcccttctaaccttattcttcttctcttccttcaccatcattgcgcatgcaattgttcctcaaaacgaaaccttcaaatttgagaactcaggtgaacttggaccctacatcgttgagtacggtgcagattacagaatgataagcatcttcaactctccattccaagttggtttctacaacaccaccccaaatgccttcactctagctttgcgtgtagggctccaacgctcggagcagctatttcgttgggtttgggaggccaacagggccaacccagttggagaaaatgccactttttcacttggcactgatgggaaccttgtgttggcagatgctgatggcagaattgcatggcaaactaacactgccaacaagggtgttgtggccttcaggcttctttcaaatggtaacatggtccttcttgatgcacaaggcgggttcgtttggcagagttttgatcaccccacagatacccttttggtcggtcaatatcttagagcaaaagggccatccaagttggttagtaggctctcagagaaggaaaatgttgatgggccttatagtttggtcttggagcctaaagggttagccttgtactacaagagcaagaattctcctaagccaattctctattggttttcttctgattggttcaccattcaacgagggtccttggaaaatgtcaccttcacatctgatccagaaacttttgaacttggatttgattaccatgtggccaattcttcatctggtggcaatagaatccttggcaggccagtgaacaatagcaccataacatatctcaggcttggaattgatggcaacattaggttctacacttacttccttgatgtgcgtgatggtgtatggcaagtgacctacactctatttgatagagattctgatgagagtgagtgccaattgcctgagagatgtgggaaatttgggttgtgtgaagataaccaatgtgtggcttgtccattggaaaatggactacttggttggagcaacaattgcactgccaaggctgtgacatcatgcaaggctagtgatttccactactacaaaattgaaggagttgagcattacatgagcaaatacactacaggggatagagtgagtgagagtacttgtggaaacaaatgcaccaaggattgcaagtgtgtgggttatttctaccacaaggagaattcaaggtgttgggtagcttatgatcttcaaacccttactagaggggccaattcctcacatgtggggtatattaaggtgcctaataagtaaaatattaaaaccttgatattgcggttttatacagttttacttcaattaattcctaatactagtttaagttgaaataaagttatggtatgattctgtcctccgtgaagagaaggacatggatgtacaataaagaagtttgtaataaagttttgattggtttggcttaaagtacgattcatgtttttctcttcctgcttccttagcaaattgattaacttggtaaggcatagcttaaaattaattctttataatttgtttcatgtagttcaaatgaactctattcgaataatctttcatggtttcaactttattatctgtgtttgtaatgcttgagtggtgaaggaaaattatgtacaaatagcagatgattgaaggcagaatgatggtttcacagagaaggaacaatttcattatcaatattgctaagattacgaccggagcatagaatgacaatttcagaacggaactaatagagcaacaccataaacagaaaagaaaaatagaaatggccat

SEQ ID NO: 2522 - DNA, 792 bp, Glycine max var. Williams 82
atggctaccttctccaaggaacgcgagaactttgtatacgttgccaagttagctgaacaagctgaacgctatgatgaaatggtggatgccatgaagaaggtggcgaagctggacgttgagttgagtgtggaagagaggaacctgttctctgttgggtacaagaatgtggtggggtcacggagagcttcatggagaatcttgtcatcgatagagcagaaagaggattccaaagggaatgagttgcatgttaagcatatcagggattacaggaacaaggtggagttggagctgtccaacatttgcagtgacattatgataattttagatgagcatcttattccatccactaatattgcggagtccacagtgttttattataagatgaaaggagactattaccggtatttggcagaatttaaagctggcaatgaaaagaaagaggtggcagatcagtcacttaaagcatatcagacagcttctaccactgctgagagtgaactacaacctacacatcctattcgtttgggtctggctctaaatttctcagtgttttattatgagatattaaattcacctgaaagggcctgccatcttgcaaagcaagcctttgatgatgctgtctcggagctggataccctgaatgaggattcttacaaggacagtaccttgattatgcagctgttgagggataaccttactttatggacttctgatatccccgaagagggtgaggacctaaaaatggaaagcgcagccagggttgatcaaggagaagatgagttaggccgctaa

SEQ ID NO: 2523 - DNA, 1276 bp, Glycine max var. Williams 82
accgcatctacctttcacttcacttgtggttcctcactctctctctctccacaccacactgaggagggagacagtggaaggaaggaacactcaaatcactgaaccagccatggctaccttctccaaggaacgcgagaactttgtatacgttgccaagttagctgaacaagctgaacgctatgatgaaatggtggatgccatgaagaaggtggcgaagctggacgttgagttgagtgtggaagagaggaacctgttctctgttgggtacaagaatgtggtggggtcacggagagcttcatggagaatcttgtcatcgatagagcagaaagaggattccaaagggaatgagttgcatgttaagcatatcagggattacaggaacaaggtggagttggagctgtccaacatttgcagtgacattatgataattttagatgagcatcttattccatccactaatattgcggagtccacagtgttttattataagatgaaaggagactattaccggtatttggcagaatttaaagctggcaatgaaaagaaagaggtggcagatcagtcacttaaagcatatcagacagcttctaccactgctgagagtgaactacaacctacacatcctattcgtttgggtctggctctaaatttctcagtgttttattatgagatattaaattcacctgaaagggcctgccatcttgcaaagcaagcctttgatgatgctgtctcggagctggataccctgaatgaggattcttacaaggacagtaccttgattatgcagctgttgagggataaccttactttatggacttctgatatccccgaagagggtgaggacctaaaaatggaaagcgcagccagggttgatcaaggagaagatgagttaggccgctaacccatcattctgtcatatgtctaagatttgatgcattaatttttctcaatcatattttctccattgtagtgaagcctctatctgaatggtgcactgcacctcatcaactttgagtcattcttatttttgagtgatggcctatttgagtcatctacttcatttttatgctattgttgagtagttttattcatgtgtttgtgacacaaaaacaccattggtttgcaatgcataatttccctatttgtatcctgttatggttaagatctgttcttgggttggcctttcaagaactgatcacatgtgagccactgtaatattgcaatatttagacttttgttaagtctcattttattaagacagacaaattaggttaat

SEQ ID NO: 2524 - DNA, 2139 bp, Glycine max var. Williams 82
atgagaagaacaatgtcaaaggtatcatcagcatgcttcattttctttgcttttgtagttgtagcagcacttcatgttgaatgccgttctcttcggcctagtgtttctgatggagttgatgcaattcaacctcaagagtcttatctacaactcaataaagaccaaagggttgttgttgagtcttcttctgatgatgatgagcatttctgtaagcaaatgtacgggttcttgccatgttccaataacatacttggccatctcttcctcattttggtttatgagtacttgttgttccatggagaatcatatttggctgctgggggtgagcaaatcttcaagattcttggccctggtgtttttggtgctagtgcctttgatattcttggtgctcttcctgagtcattaattcttgttgttactggactttccagcgataaggagagtgcacaagagtatgcttccactggcgttggtttgttggctggatcatccattatgcttctgacagtagtgtggggaacttgtgttatcattggcaagcaaaagttgaaaaatgaccctgactcttttggcacaaattcgtcaaatggaggaataaaagaatcactaactggttatggtatcactatggatgtagagactagaaagatggcaagaatcatggttttctcagttataccactcctcataatgcagattcccaatttgttcaacttctcttctacaccacgcaatgtgaccttgatggtttctcttacagttgctgttgcttttcttatctcatacttcatttaccaggtctttaaacctcagatagagaaaacaagactggagtatattaaacatgatgacttaatattaagaatttttcaacgtgttgaaaaacaaactctgcaaaagatcctcaccgacgatgggactcccaatgtagctgcaataagtgggttgtatcatgaaattagtcaaagtgggggcaaggatttgttagcttctgaagtgaaagagctgttgtttgggaacaaattaaatgacacaaatatcaaagaggaacaaataactgacatgttaaaagtttttgaccgaaatggtgaccaaattataaccaaggaagagtttgtcactggcttaacagaatacattaaccaatcaaagcatgctctggatagacaatacctccccaaagaatctctcaacaaaatgtatcagacttttatcaagccatggattgaacacgtgagaaaacaacgcgaattgaagggacatcttatatctgaagtcttgaagcatgctcagaatgatatggttggcaggctgcgccaagatgatggcagacctgacaaaactgctatcagaaggttgtttgaggaaattgatgtcaacagggataaccacatttcaagatctgaattggaaaaaatagtcaaggacatacattttggcaaggtcgtagaaactgaggaggcagttacaaaacttgttcaagatcttgatctcaacagagacaatgaaattagcgagaccgagtttgttgaaggttttacaaaatggatggactcgaattccagccaagctgctaactcaaaatcttcgtctcacgaaattcatcaaacctgggaagatgttgaaaaggtgatggaagagaatcaaaccaaaggagcatctgcatggttgacagctatagcatatgtggtgttgggagttactatactggctcttcttgcagaacccttaatagcaagtgtccaaaaattctctgaagaagcaggaatttcatcatttttcatctcattcattttagtccccctggctacaaattttagagaagcaacctcagcaatcaaagaagctagccataaaaagagcagcaatacttctcagacaatgtatgagatttatggagcagtgttcatgaacaacattcttggctttgtggtgatctctatacttatatatatgcgtgagatcacttgggaattctcagctgatgtgctagttgtggcaatagtttgtgctgtaatgggccttactgctagttttcgacccacgtttcctctttggacatctttccctgcatacctcatgtacctaatagcattgcttttggtctttgtcctcaaagatgttctcaattatgtttaa

SEQ ID NO: 2525 - DNA, 213 bp, Glycine max var. Williams 82
atggaaaagaaaaatagaatattgagaagaatgggtagttttgagtgggacaggtgtgaggatccaacagcaaggtatcagtgcatatggtccattgatgcaggttattcgggcatgggtatggatgcatgtatttcatccatttacacgagtacactacacccagacaaatacaaaaataacaatgataaattattgtttttctttttataa

SEQ ID NO: 2526 - DNA, 564 bp, Glycine max var. Williams 82
atggagatcaagagtggagagaggaggcaagtgtcaattgagaaggtgaggagagacaacacagttgaagtagaagatgaagaagaggaggatgaaagtgtggttggtggtgagggtggtcttgcagaagatgaaaggaagaaaattggtggaggaagtgggagaagagggtcaagtggagtttctccaccttcttgtcaggcagagatatgtggtgctgatttgactgttgcaaagaggtaccatcgccgtcataaggtgtgtgagcttcattccaaggctccttctgtgatggttgcaggactgaggcagaggttttgccagcaatgtagcaggttccatgagctggcagagtttgatgaagctaaaagaagctgccggagacgcttggccagacacaacgagcggcgccggaaaagcaacgctgaaacttgcaatgaaggatgcagtggcagcaaagggcagcaccctgcagaaacccactgcagaaatactgatgactggggaagaattcagatgaacattgcaaagaattctggctacaagttcttccatatcagatga

SEQ ID NO: 2527 - DNA, 1672 bp, Glycine max var. Williams 82
ctgcgtatcagaaatcacatcaaacaaacaaaagagaaaaaaatcctcctcttccaaattgtaactccttgagcaccattagatgagcatttagttaccacaaaggaacctagagtttatttgacagcactatcgctttcaacacaccattcatgcaaaatcaatccccactccccacttactctaagaattgatatttaaactttgctttatttgcttatcattacaagacaaaaaaatccccatgcattacttctcccaccctatgctaaccaaagcacacaactaattaacaaaatggagcctgtggtccacacctcttcccccttctttctccacctttttggctccctataaactccctctttcactcacaatgctccaaaagacaaggctctaactgttttcttgctccagcactttcttcttcttcatcatcattgtcagaccactcacaatggagatcaagagtggagagaggaggcaagtgtcaattgagaaggtgaggagagacaacacagttgaagtagaagatgaagaagaggaggatgaaagtgtggttggtggtgagggtggtcttgcagaagatgaaaggaagaaaattggtggaggaagtgggagaagagggtcaagtggagtttctccaccttcttgtcaggcagagatatgtggtgctgatttgactgttgcaaagaggtaccatcgccgtcataaggtgtgtgagcttcattccaaggctccttctgtgatggttgcaggactgaggcagaggttttgccagcaatgtagcaggttccatgagctggcagagtttgatgaagctaaaagaagctgccggagacgcttggccagacacaacgagcggcgccggaaaagcaacgctgaaacttgcaatgaaggatgcagtggcagcaaagggcagcaccctgcagaaacccactgcagaaatactgatgactggggaagaattcagatgaacattgcaaagaattctggctacaagttcttccatatcagatgaatccaatgtgttcatcagcatgctccctctcttctgtcaatgaatcttcacagtttacatgccaaggcatataataaaggccccttttttatgttacgagaataagcatctaaaccagaatgaaaaactcccaacatctaaaggaggtgtcgtatgtataatactagttcatttcccttaagctctatattctatttacttagtcagtttcttctgtttctgtgtgccttggaatataagtattctgttgtgccacccttaatatggtgtacccctattcccccttgattagaataaaatccattgcttctttgactaaattcacgtatctctttcaattatttctatatctcatgcatgcttttttttatcagcaaaagcaaaatattagtggttagttttttgttagtaagaatattcgaacccacaacctctttcgtcttcttttttcccttcaccactaggtcaaccttattacctcttcgtgcatgttatgttaataagcctcatagattcatttgagactttaaaagcatacatgtttttcatatccgtttcttaggatgcattcttttcactttgccttgaatatctccacaacatagatgtaagctttatttgcatcacctgcaaataaaatgatacccggcc

SEQ ID NO: 2528 - DNA, 474 bp, Glycine max var. Williams 82
atgcaaaaagtatctttccttctctctcaaatgctttccataaccatggaagaagaacaagaaccaaagctgatccatggctccaaggccatgcgcatgcacactcctactcccaatcctaacccttcccaaacaatcatgagattggcctcacttgcgatcagcttcaacgtgcggttgaaatcatcccacatgcctcttcacatgcaggaacatgctctgcgccacactagatcacttttcctccttcaccaccctccttctccaaagccatccaacactctcattgctagagctctcaaaaaggagtttgactcgaagtatggattggcgtggcactgcgtgatagggaatagtttcgggtcgtttgtgagtcacacaggtggaggcttcatctacttctcaattgactcactttctgttcttctcttcaaaaccgaggttcacttggtcacgcaaccacctcctacttaa

SEQ ID NO: 2529 - DNA, 225 bp, Glycine max var. Williams 82
atggagaagaaatcaatagctgggttgtgcttcctcttccttgttctctttgttgctcaagttgtggtgcaaactgaggcaaagacttgcgagaacctggctgatacatacaggggtccatgcttcaccactggcagctgcgatgatcactgcaagaacaaagagcacttgctcagaggcagatgcagggacgattttcgctgttggtgcaccaaaaactgttaa

SEQ ID NO: 2530 - DNA, 1599 bp, Glycine max var. Williams 82
atgaaaatgctgctgaggcagccaagtgttgtgatggcactgctttgttgtgttcattttcatgtccaatgttgtgatgaagttgaagaaggaatcatcagatctcacttccctcaaggattcctcttcggaacgagtacttcctcttaccaaattgaaggagcaccatttgaagatggtagcggtacaagcaactgggatgttttttgtcatacaccaggaaagataaacaatgatgagaatggtgacattgcagatgatcattatcatcgctatttggaagacattgagttgatgtcgtctcttggggtaaatgtatatcgattctctatctcatggacgaggattctaccaagagggatatacgggaacatcaatccaagtgggataatgttctacaacaagattatagacaatctgctgcttagagggattgagccatttgtgacaattcatcatcatgacatgccacaagaactagaagaaatatatggtggttggattagtcccctaatacagagagattttgttcattttgctgaaatttgttttaagagcttcggagacagggttaagtattggactaccatcaatgagccaaaccaattttcagactttgcttatatgagaggaatatatccccctggtcgctgttccccaccttttggaaattgtaaaactggtaactctgatgttgagcctctcattgccttgcacaatatgttactgtcacatgccaaggctgttgacttataccgcaagcactttcaggcaaagcaaggtggaaccatcggcattgttgcagactccctcatgtttgaaccacttagagatgaagaatgtgatagacaagctgcgagtagggccttgacttttgagctagcccgggtcttagatcccctggttttcggtgagtacccagctgaaatgcgctcaatccttggtagtaagttgccagtgttctctcctaaggagaagagtctcataaaaggcagcctagacttcattggcatcaatcactatggaactctctatgccaaagactgcaccctctctacttgttctcttggagcagatcatccaataagaggttttgtagaaacaactgcaacaagaaatggtgttccaattggtgaaccgacaggaatagcacagttttttgttgttccaaggggcgtggagaagcttgcagactacattaaaatgagataccataatatacccatgtatattacagaaaatggatactctccaccgccgaagccggatgtgacaatacatgattcactacaggatttcaaacgaatagattatcataaagcctaccttgcagctttgcttagatccataagaaaaggtgctgatgtaaggggatatatgatatggtcattgatggataactttgaatgggcaagtggctatgacataagatttgggctttattatgtggatagacagactcttgaacggattcccaaactttctgttcaatggttttctagtttcctcaacaacactagccacaccaacaaacaagacctgagtgagcaatatgttagaagcaaagatgtgatgactgctggtttcgaagttatttga

SEQ ID NO: 2531 - DNA, 558 bp, Glycine max var. Williams 82
atggcttcaaagcttttactcatcactgtcttcgtttttgatttgattgcttttggacttgccgtggctgctgagcagagaagaagcaccgctagtgttgtgacggacaatgaaaagaattataattactgtgtctataactctgatatagcaactggctatggtgttggagcatttttgtttctcttggttagtcaagtcctgataatggtggcaagtcgatgcttctgttgcgggaagcctcttaaccctggaggctcaagggcctgtgcagttgttcttttcataatctgctgggtgtttttcatcatagctgaggtgtgcttgttggctggatcagtggaaaatgcctatcacaccaagtacaggaccatcttcggggagaatcctccgtcttgcgaaacagttaggaagggagtctttgctgccggtgctgcttttgttttcttcactgccataatctctgaattctactatatcaactactcaagggcaagggaaagcttccaaccttatgctggcggcgagactggtgtcggtatgggaacctacaaatga

SEQ ID NO: 2532 - DNA, 804 bp, Glycine max var. Williams 82
atggcagcaacattgatggcagcaacaagttctggcactcttaaagcaactcctttcctaggccaaggcaagggtgccaatgccaatgctcttagggatgttgtttccatgggaactgggaagtacaccatgggcaatgatttgtggtatggaccagacagagtgaaatacttgggacccttttcagctcagaccccttcatacttgaaaggagaattcccaggggattatggatgggacactgctggcttatctgctgacccggaagcatttgccaagaacagggctcttgaggttatccatgggagatgggccatgcttggagcactaggatgcatcaccccagaggtgctagagaagtggttgagagtggacttcaaggagccagtgtggttcaaagctggagcccaaatattctcagaaggtgggcttgactatttggggaacccaaaccttgtccatgcacaaagcatcctggcagtgctgggcttccaagttatcctaatgggccttgttgaagggtaccgcatcaatgggcttgatggggtgggagagggcaatgacctctaccctgggggccagtactttgacccactgggccttgctgatgacccagtcacttttgctgagctcaaagtcaaggagatcaagaatggaaggctggccatgttctctatgtttggattctttgttcaagctattgtcactggaaaaggcccattggagaacctcttggaccaccttgacaaccctgtggctaacaatgcttgggtctatgccactaagtttgccccaggatcttaa

SEQ ID NO: 2533 - DNA, 1569 bp, Glycine max var. Williams 82
atggagttagttctaaacagcacaacaattggagttggagttgtttctctgatcctcctcttgtacttgtttttgcgtggtggttcatggaagagtggggaagagggtcctccaacagttgcaggtgcatggccaataattggtcacctcccattgttgcttggttcaaagacacctcataaaacattgggtgacttggctgacaagtatggacccatattctcgatcaagattggtgccaaaaacgcagtggttgttagcaactgggaaatggctaaagaatgctacaccacaaacgacatcgccgtttcctccctccccgatcttatctccgctaacctcttgtgctacaaccgatccatgatagtcgtagcaccctacggtccctattggcgccaacttcgaaagattttaatgtctgagttcctatctccttcccgagtagagcaactacaccatgttcgcgtctctgaagttcaaagttccatcacggagctcttccgtgattggcgtagcaataagaatgtccagtctggctttgccactgtggagttgaagcaatggttctctcttcttgtcttcaacatgattctgcggatggtctgtgggaagcgctatttcagcgcttctacttcggatgatgagaaggcaaacagatgcgttaaggctgtggatgagttcgtgcgtctcgccgccaccttcaccgtgggagatgccattccttatcttagatggtttgactttggtggctatgagaatgatatgagagaaactgggaaggaattggacgagattattggcgagtggttagatgagcatcgacaaaaaagaaaaatgggtgagaacgttcaagacctcatgagcgtgttgctttccttgcttgaaggaaaaactattgagggcatgaatgttgatattgtcatcaaatcctttgtattgacagtaattcaagcaggaactgaggcaagcattactactcttatatgggcaacaagtttgatattgaataatcctagtgtactagaaaaacttaaagcagaactagacatccaagttggaaaagagagatacatatgtgagtctgatttaagtaagttaacatatcttcaagctgtagtcaaagaaactttaagattgtaccctccagctcctctctcaagacctcgtgagtttgaagaggattgcactataggtggctacactgtcaaaaagggaactcgtctaattacaaatctttccaagatccacacagatcataacgtttggtcaaatccattagagtttaaaccagaaaggttccttacgactgataaagatatagacatgaagggtcaacattttcagctattaccatttggaggtggtaggaggatttgtcctggaataaacttaggccttcaaacagttcgtttgacacttgctagttttttgcattcctttgaaatcttaaatccatcaactgagcctcttgatatgactgaagtctttagagcaaccaacactaaagccactccacttgagattcttattaaaccacgcctatctcctagttgttatgaaagtatctaa

SEQ ID NO: 2534 - DNA, 702 bp, Glycine max var. Williams 82
atggctcctctcacaaacttgcatggagcagtctccaagaccttaattccgatcacatgtcaccttccaaatgcacacaaaagcataacaaagagaggacaagtgattggatttcttggaagcaaaacacaccaaaaggatgcatcagagtgtgcagttcaggccacaagaagagcagcagcattaggccttgccactgtagtgcttacttggaaattcaatgacaagatttcattggctaaagataatggtttctggtatgaagatcaccctcttcctggaccaactgtcactaacaatattgcaaatgcgaaaacggggacacgttcttttcttaagagggggatttacatagcaaacattggagtgaaaggaagtgtgtttaggataaagaaatatgcctttgatcttctggcaatggcggatttgatagcagaagacacactcaactatgtgaggaagtacctaaggctcaagtccaccttcatgtactatgattttgacaagattatccctgccattccagtggatgataagcagcaactaactgatatggctaacaaattgtttgataattttgaaaggcttgaagaagcttcaaggaagaaaagtctacctgaaacaaaatcatgctatcaggaaactgaagttatgcttaaagaggtcatggaccggatggatataatgtacaaaacaatttga

SEQ ID NO: 2535 - DNA, 642 bp, Glycine max var. Williams 82
atggcttccacagtgttctcatatccttctcctcttcatcttaaaacctatccacacaaaacatcatcaaacccttcagagttttccattcacatccaacccaaaaagcacttttccattagatgcacatctttggactccattcctgaggctgagtttccaactccagatccttcctcaagcacagtgaacagtgcagagtcctttcccattgagaagagaaggaggtcagagatagtgagagagagaagaggagaaaaactagtgcagccagagccaccaaactttgaaataggttggaagaggaccaaagagatcaacctagagaggccaatagggcatgtcatagctgatttcttggagaagctggagaccctcatggagaaggagtttggatcaacagaacttctggctaaggttggggagattgtggccgagagggcaagagaggaggctgagattctcatggatgaagggaaagtggaagagagaatggtgactgaattgtttagagtgttgaagttgatggagatggacttggcaatggttaaggctgctgtgaaggaggagactttgggtgagaggcttgagctggccaaggcaaggtgcaggcaagccatacttgttgcttattccttttga

SEQ ID NO: 2536 - DNA, 1020 bp, Glycine max var. Williams 82
atggctcagttattgtcaccagtatgcatggaggctctgaaaatccacaatccatcattgaatctttgttcaagaagctcatggcggatgctggtgaagggtgcaagtccttgcacctttctgacacacagtggtagtaagcgaagagggtttggcaaagtaagagttactgctgaagactcagtttctccctctgagaccattgcagatgactattatgaagttcttggactgcttccagatgcgacaccagagcagatcaagaaggcatactacaattgcatgaaatcttgccacccggatttgagtggaaatgatcctgagaccacaaatttctgcatgttcatcaatgaagtctacacggtgctcagcgatcccgtccaacgcatgatttatgatgaaattcatggctactctttaacttcaatcaatcctttcttggatgattcaagcccaagggatcatgcctttgttgatgaattcagctgcataggctgcaaaaattgtgccaatgtagcccctggtgtgtttgcaattgaggaagactttggaagagccagagcatacaaccaatgtggggaccctgaattagttcaacaggcgattgacagttgccctgttagctgcattcattggacatcttctgcacagctatcattactggaagatgagatgcgccgtgtagaaagagtcaatgttgccctaatggtatcaggaatgggaacagcatcaattgatgttttcagaatggcaagttccagatgggaaaagaggcagtcaaaagtcttggcaaaagcaaaattgagaatgatgagggaagaaggttctgataagaaaaattcgtactgggacaatctttggggcaaacagaaagactatcaaagttcagatgaggaagttgaagaaagagcaaaaagagctgcttcagcggcacgaagatggagggaatactcaagtagaggtgttgataagcctcccacatttaaacttccagaggcaagccttggcaaggacaagtga

SEQ ID NO: 2537 - DNA, 1110 bp, Glycine max var. Williams 82
atgagtttcttgttaccattaccaaccctcttgttgtgtctctttgttgtgttaatttattccctccaatcaaaggccgatgaatttgatttcgatgagtccttgttcaatgcaaaaaacgcttccagtggcagaaaacttgcaggaagatgcaacttgttccgtgggaaatgggtttatgacccttcataccctctctatgacccttctacatgtcccttcatagatccacaattcaactgccaaaagtacggtagaccagacaaacagtatcagaaatatagatggcaacccttctcttgtcctttacctaggttcaacgcatttgatttcctggctaagtataggggcaagaagattatgtttgttggtgactccttgagtttgaaccagttcaactctctggcttgtatgattcactcttgggtgcctaacactagaaccagtttcataaagcaagatgctctctccaaaatcacatttgaggactatggccttcagttatttctataccgcacagcatacttggtagatcttgaccgtgagaacgtcggaaccgttctgaagattgactctataaagagtggtgacgcttggagaggcatggacgtgctagttttcaacacgtggcactggtggacccacaccgggagttcacagccgtgggactatattcaagagggtaacaagttgtacaaagacatgaaccgtttgattttattctacaaaggtttgacaacttgggctagatgggttaacatcaacgtgaatccagctcaaagcaaagtcttctttttaggaatttcccctgtgcattatgaggggaaagattggaatcaaccagcaaaatcctgtatgagtgagacaaaaccattctttggattgaagtaccctgcagggacaccaatggcattggtgatagtgaacaaggttttgagtaggataaagaagccagtgcatttcctagatgtgactacactctcacagtacaggaaagatgcacatccagaaggctacagtggggttatgccaactgattgcagccattggtgtcttccaggactgccagatacatggaatgtgcttctgcatgcggctctatttgactga

SEQ ID NO: 2538 - DNA, 1932 bp, Glycine max var. Williams 82
atggcgtctgaacaattggctcgcagagagaacaccaccaccgagaaggagattcacgttgagaaacacagggttcccaagatggccacccacttcgagcaccttgcggagcaagctaaagaatctgacatcaccgctgggaaggatactccgcagggtagcatagaagccttgcaagctggagagagggtcaaagatcatgcaggaaaagccatgggagatattggtggacgtgggaaagccagagagactcacgagctgggtgcacactttgaatccctggctgacaaagtaactgaccatgcagcagccaatgtagttggaaacaaagagagtcaaagagaagctcgtggtggtgttcgtgatgttgggaagttcgaaatgagaactgaagggggagaaaaaggaaacaaggatagaccagaactgaaaacacgaaccagagaggtaataggaagaacggagaaagaaagaggaagagaaagtggaggacaagtagtggcagagaaaggaagagaaacagaaactgcaaggggaagggttggtgctgaaaatgaaggtgcaagaacaaccgctgttataacttgcacgttggaaaaaggtggtggtactcagaaaccaataagagaagaagagagagagagtgaaagtgaaagatcagcgtgggaacagatttccaactacagtgatcaagccacacaaggtgtgaaggaaaagtacgagagagcaaagcaagcagcaagcgagacactgaacaccacaacacaaaccgcacaagagaaaagcgcacaggcaaagaatcttgcagcacaagcaaaggacgcaacgttagagaagggtcagcaaggctatgctgtgacaaaggacaccatttcaagtgcagcgaaaaccgcttcggagaaaactgcgccagtggcagagaaggccaaagactacactcttcaggctgcggagaaggccaagagtgcgggtggcacaacggcgagttacgtcggagagaaagcggtgcaggccaaggatgtcgccgtggagagtgggaagagtgcggctgggtatgctgccaaggtggctgctgatttgagggacaaggccaccgcggtggggtgggccgcggcccatttttcggcggaaaagacggtggaagggaccaaggccgccgcccatgttgtcgagggagcggccgggtatgccggacataaggccgcggagcttgcttcgatgtcggccggtgctgttaaagggctggctgcttctgctggtgagactgctaaggaatacaccgcaaagaagaaagaggaggcacagcgggaattggaggccaaaaaaccatctcaacctcaggaagctgaagagaggccatcagaaggaattggcgaaactgtgaggcagtatgcacaaaaaccaaagccaagtgaaagaaaccctcagaaggagggaaccggaagcatcgtgtttacagcaataggcgaaacagtaagcagtgccggtgagaaggtaaagaaaccgtttaaaaacactatgggaggagaaagtgaaggaggaggagggaaagaagaggggaagagtgtcattggtaaaagtttgaccagcattggtgagaagctgggtgatgcaaaacagagagaggagctgttagacaacgtcactggcaacatcaccgagggaggaggcgaggtgttgggagcagtaggtgaaaccgttgctgagattggacagaacatgatgaagccagcggagatagttcaggaacgcgctcacgttcgacaagcgggtggggtcttggatgccattggtgaaaccattgctgagattgctgaaacgactcgagtcatggtttctggagaggacgagagagtgctgaggcagagcgtggtgttggagactcgcgtaactggtcgtgccaagcatgaagaagggtcgcacggtgcttga

SEQ ID NO: 2539 - DNA, 2327 bp, Glycine max var. Williams 82
ttcccttctcctttttaatcacacttccattcccatgcacaccccacacacatcctactaaaaaacattgcccttgttctttcaaagttaccaaacacaagtacacaacacaacagcaacatatggcgtctgaacaattggctcgcagagagaacaccaccaccgagaaggagattcacgttgagaaacacagggttcccaagatggccacccacttcgagcaccttgcggagcaagctaaagaatctgacatcaccgctgggaaggatactccgcagggtagcatagaagccttgcaagctggagagagggtcaaagatcatgcaggaaaagccatgggagatattggtggacgtgggaaagccagagagactcacgagctgggtgcacactttgaatccctggctgacaaagtaactgaccatgcagcagccaatgtagttggaaacaaagagagtcaaagagaagctcgtggtggtgttcgtgatgttgggaagttcgaaatgagaactgaagggggagaaaaaggaaacaaggatagaccagaactgaaaacacgaaccagagaggtaataggaagaacggagaaagaaagaggaagagaaagtggaggacaagtagtggcagagaaaggaagagaaacagaaactgcaaggggaagggttggtgctgaaaatgaaggtgcaagaacaaccgctgttataacttgcacgttggaaaaaggtggtggtactcagaaaccaataagagaagaagagagagagagtgaaagtgaaagatcagcgtgggaacagatttccaactacagtgatcaagccacacaaggtgtgaaggaaaagtacgagagagcaaagcaagcagcaagcgagacactgaacaccacaacacaaaccgcacaagagaaaagcgcacaggcaaagaatcttgcagcacaagcaaaggacgcaacgttagagaagggtcagcaaggctatgctgtgacaaaggacaccatttcaagtgcagcgaaaaccgcttcggagaaaactgcgccagtggcagagaaggccaaagactacactcttcaggctgcggagaaggccaagagtgcgggtggcacaacggcgagttacgtcggagagaaagcggtgcaggccaaggatgtcgccgtggagagtgggaagagtgcggctgggtatgctgccaaggtggctgctgatttgagggacaaggccaccgcggtggggtgggccgcggcccatttttcggcggaaaagacggtggaagggaccaaggccgccgcccatgttgtcgagggagcggccgggtatgccggacataaggccgcggagcttgcttcgatgtcggccggtgctgttaaagggctggctgcttctgctggtgagactgctaaggaatacaccgcaaagaagaaagaggaggcacagcgggaattggaggccaaaaaaccatctcaacctcaggaagctgaagagaggccatcagaaggaattggcgaaactgtgaggcagtatgcacaaaaaccaaagccaagtgaaagaaaccctcagaaggagggaaccggaagcatcgtgtttacagcaataggcgaaacagtaagcagtgccggtgagaaggtaaagaaaccgtttaaaaacactatgggaggagaaagtgaaggaggaggagggaaagaagaggggaagagtgtcattggtaaaagtttgaccagcattggtgagaagctgggtgatgcaaaacagagagaggagctgttagacaacgtcactggcaacatcaccgagggaggaggcgaggtgttgggagcagtaggtgaaaccgttgctgagattggacagaacatgatgaagccagcggagatagttcaggaacgcgctcacgttcgacaagcgggtggggtcttggatgccattggtgaaaccattgctgagattgctgaaacgactcgagtcatggtttctggagaggacgagagagtgctgaggcagagcgtggtgttggagactcgcgtaactggtcgtgccaagcatgaagaagggtcgcacggtgcttgagtctcttgagtgaacgctgtgttttttaaggtttatttctgttaatgtcatgtttagtctgtgtcaagtttcatgtttcgggtttgttgactttgttctatggaattgtaaccaataagaatctccttttttgagattatggaaaatagcaaaattgtgtttatgcctgtataatagtacgcaatgtgtgctttcatgtgatcgctgcatggaagcaaatatttaatttttgatgcactgtatgatcgctacaatattatctatcgagttatg

SEQ ID NO: 2540 - DNA, 936 bp, Glycine max var. Williams 82
atgacgcaattacctccaaagatcccaaacatgtcaccaagttggccagatttctcttcacaccaccagaagatgcaattgccacctcttaaatccggtagcaacaacaattatcagcacaaccagaacccttcttgggtagatgagtttcttgacttctcctcggcccggcggggcgctcaccggaggtcggtgagcgattccatcacctacttggattcaccaatgaagtgtggagagaataacaacaacaatgagaacgagtttgacaagtttgatgatgaacaattcatgtccatgttcacggatgaagtagtgctctctggggtccccttgcttccaccaaccatcttgtcctcctctaacccttcaagcccttctgatcagaacttcttcaatgatgagaaggagaagaaggaggagcaccaccaccaccaattgaaaaatgaagcagatgaggttgaaagccaatgcaaacaggaaattatgcagcttccaaatgacaccaatacttgttcttccaacgagagaattactgaccccaagagagtcaaaagaatcttggctaatagacaatctgcacaaagatcgcgagtgaggaagctgcaatacatatcagagcttgagagaagtgtaacttcattacaggccgaagtttcagtgctgtctccaagggttgcatttttagatcatcaacgattgcttctaaatgtcgacaacagtgctctcaagcaacgaatcgctgcccttgctcaagacaagatctttaaagatgctcatcaagaggcactgaagagggagatagagagactaaggcaagtttatcaccaacaaagcctcaagaagatggaaaatgctgcaggatcaccattaccatcaccaaagcctatatgcgatgctcaaacagaaaaggaagcaacacttctcaacgcttga

SEQ ID NO: 2541 - DNA, 525 bp, Glycine max var. Williams 82
atgcatcaagcaattccctatagatcatggcgccatctccataaccccaccacccacttcaccccactcccattaattactcattcccacaacgatgatgataagaagaccaagaatattattgttaacaacaataatactattaatattcattcttcttcagttcttgtttcaccaaaagagaaggaggggatgaaaatggtgctcaacatggtttctgagaacgccgttatagtgattgcgagaagagggtgttgcatgagccacgtggtgaagcgtttgcttcttggtcttggtgttaaccctgcggtttatgaggtagaggagaaagatgaagagggtgttgccacgcaactggaagcaacaattcgtagtgatgatgggaacacacaacaggggaaggtgcagtttcctacggtttttatagggggtaagttgtttggaggattggataggatcatggctactcatatctctggggaattggttcctatcctcaaaaaagctggggctttatggctatga

SEQ ID NO: 2542 - DNA, 897 bp, Glycine max var. Williams 82
atggcctctttttggaaccaactctcattctttttgctcttggtgcttgttatctccccccaaattcaagccagagaaggcaagctcttcagcttgttctcccatttcagaaccatctataatgtcaaagaccctcttgacaaaacaaatgctgaatctccagcactaccaccaggaccaacaccaaaaccagcctcagcaccagaactagaaccagaatcagcaccaacaccagcaccttcagctgaacaagaaattgggtcaacaataccatctgggccagcacctgagcctgaattttttgacagtggagagggttatggcctctatggtagaggctcttatagccaataccctcccaccaaggagactcctaccaccaccacgacctttcaaaatgagcttctcaatgaagacttcaatgatgagagctacaaaactggctaccccaaaaccaatctctacaacaacaacaatgaggagtacaaaaacaatgacaacactaaggaagagtacaggaacagttacattggtggctactccgacgacttcaataggtactccaacaacaacaacaacaacaacaacggcaaggaaaattacaacaacaactacaatggcaaggaaaattactacaacaacaacgacaactatatcagcaatggctatgaagagaagagagaaggaatgagtgacacgaggttcttggagaatggcaagtactactatcatgtgaatagtgttaaagagaattataaccttaatgggtacgaatcagggagagggagcgctaatgaaaacgaaggtaattactatgagaaaagtcagtatccaaatgagtttgacaccatggaagagtacgagaagcagcaggaagaacaaggctacactccttga

SEQ ID NO: 2543 - DNA, 1615 bp, Glycine max var. Williams 82
ataaccttaattcttaaacttgggctgcttcggatagtgtgcagtgacaacacatcctagaagtgaagcggaatacgaatgagcataaacatggtatcatcggttccttggacaaagtccttcttcccgttgtggttctggaacaaaacccgcgttctactcacacaccattaccgttaccatcaccgtcattcgccactctctgacacagacatgaccgaagaaggggttgttgtctcgttgcaggaatggcagggttggggcaccacctccccactccccaccatggtttcccaaatcgttgaggatttgaaggttctggaagaagatttggatgcccacatgaattttggaggcaatggtggaaaattacaggggaattttagagtacaagaagataagaagcaccgtgccacgtatcaggctttgggtgattcagaaaagaagctccagttttattcggctagacagattgcttgtcgcatactaggtagcaggggttacctttgtcaaaagtgttggcttcccatggaggattgtatgtgttcaaaagtcacatcctgttcgctctaccctggaatcagattttggctgtatatgcatccaaaggatttcttgagacagaacaacactggaaagattttgtggcaggtgtttggggttgatgcggcgactttgtgcctttttggtattcctgaacatgaggaaatcatgtggaattcccttaaaatggcaggaaaaagtaacgtgtggtgcctttatcccaacaagaatgcagttttaaagtcagttcaaaatgtgtttggtgaggaatcagttgcaagggatgaagttgcaccgtccaagcagttaaaagtagatacaacccagcattttattttgattgatgggacatggagcaattcagcagcaatgtttaggcgccttcaggataaagcaaagtcagtttggggagatgaggacctttcctgtatatccctaaatcctggtgcttctgctatgcataaacttaggccacagccatcttgggatcgtacatgtacagcggcagcagctgctggtctgctctcagagctccagcttcttccacagtttagctctgttgaattggaaaaacaggcagaagcagtagaacatgctttaacagtcctattagatgccctcacaaatagacgtcttcgcatgggaagatccataacacgaaaaatgaggcataccaacatccaataaaaatctaaccaagtttattctgacaacttatacagtaagcatattggaatttttggaaatggagaaagaaattctcaaccatgtacatagactctttgagaaatgatggcttttggttatgtggtcaggattttccaactccttcacatattaacctttgataaaggttttaaggcttaaatttcagtctggagtatgagttatagattctactttccatttacaacattggatggaagtgaattttttttgtttttttttctgttgaaaagatagaattgtacttctaatttaattcagtagtccatggtttgaatctatcattatatccttggaagataaaatggagaagaatggaacataatggtttgaatccattattatt

SEQ ID NO: 2544 - DNA, 936 bp, Glycine max var. Williams 82
atggaaaacatccagcacagtcacgtggaagttaagggactaaagctccatgttgctgagattggaagtggtcaaaaggcactggttttcttacatggattcccagaaatatggtatacatggaggcaccagatgattgctgcagcaaatgctggctaccgggctattgcctttgatttcagaggctatggactttctgagcatcctgcggagccagaaaaagcaaacttacttgaccttgttgatgatgtcgtgggtctgttggattcattaagcattaccaaggctgtgcttgttggtaaggactttggtgcctttccagcgtatattgttgccgctctccatccagacaaagtagattcagtcataatgttaggtgttccattcatgcttccaggtccctctgctattcagaacctcccaaaaggctcctacgttattaagtggcaggagcctgggagggcagaagcagattttggccgctttgatgttaagtcagttataaggaacatctacacactcttctctggaagtgagataccaatagcaggtgataatcaggaaatcatggatttgtatgacccaactactcccctgccaccatggttctctgaggaagacctggcaacctatgcatcactatacgaaaaatctggcttcagatttgcattgcaggttccatacaggactcttggagtggatagtggcataagtgatcctaaaatcacagttccggcactgctgatcatgggtgagaaagactatgtcttcaagtgttttggaatggaggactacatccgaagtggcgcagtgaaacattttgtgccagacttggaaatcatatatattccagaaggaagccattttgtgcatgaacaatttcctgagaaggtgaaccagctcatcattgaattccttaacaaacaaagcatttga

SEQ ID NO: 2545 - DNA, 510 bp, Glycine max var. Williams 82
atggcctccccaacactaataacccccaaatcagtcaaatcactctcacccatcaagcccaaagccaccaccaccaccaccaccatcgccgccactctcacaccatccaccaccacccaccctcgccgccgggaattgttgtccatcatcaccaccacatggttgctccctctgagcccggcactggcatcctcggacgaggaatacgtgaaggagacagaggaagtgatcaacaaagtgaggacgacaatcgtgatggacaagaatgaccccaacgtggcaaccgcggtagcggagttaagagaaacctcgaactcctgggtggcaaagtacaggagggagaaagcgcttcttggacgcgcttcctttagggacatatattccgcgctcaacgctgtgtcgggacactacattagcttcggaccaaccgctcccattcccgccaaacgaagggcaaggatcttggaggaggtcgacactgctgaaaaggcgcttctaaggggaagatga

SEQ ID NO: 2546 - DNA, 1410 bp, Glycine max var. Williams 82
atggctcaagtgaagatcttagagcaaagtgaagttggtccaccaccatgctcacttccctcaaccacccttcccctcactttcttcgatattccatggttctactgccaccccatccaacgcatcttcttctatgactttccccaccccacacaccactttctccaaacagcacttcccattctcaaacactctctttccctaaccctccaacacttcttccccttctcctccaatctcatcgttcctccacagcaaccccatctctctcacatacgctaccttgatggagactctctctccttcaccgttgcagagtccaccgcagacttcaccctcctcacatcagattcaccacaagacgttccaaattggcaccctcttgttcccgcgtttcctaccccacgtgttgaccaagatggcgcacgtgtgttccctcttatggccattcaggttacaattttcccaaagtctggcttcaccatatgtctcaccttcaaccaccttgccagcgacggcaagtcacttcaccatttcatcaagttctgggcctctctttgcaaagcaaaaggaaacatggcttcccttcaaacctctttgtctcttccttctcatgagagggacaaagttaaagatccaaaggggcttaagctcatttactttcaagaacttgaacatcctgagtccagaaacatggagtttgcggggctcgtgagagaagtctcctctaacaaggttcgcttcacagttgcattgagtcgtgaacaagttgagaaatttaagaaatgggtctctcttaaatgcgccagctacacttctgatgagacattgcacatatcaacctttgtggtgacatgctccttaatttgggtttgcatgattaggttagaggagagcaaaggcaattatgttgcacaagattatgctgaattctgccacttggtgtttcttgcagattgtcgtggtcgtcctgagttttcattaccttcaacgtactttgggaattgtctaaccacttgttttgtggctatgaagaggagtgagatagtgggagaaaatgggatcattggggtggcaaaggctattgaaaggcaaattagagatttgaagagtgatgctttgagaaatgctgaaaggttgatgtcatattatagagagttagggaaaccaggaaaatctgtgttggtagttgcggggtcaccaaaattgggtgtgtatcatactgattttggatggggtaagcctaagaaatctgaagcagcgcatattgaatcgtcaggatcaatttctctttctgattgtagagatgaaaacggaggaattgaggttggattggcacttgaaaggattcagacgaataattttttcaacatcttagaagagcaactcaataatattaataaattctaa

SEQ ID NO: 2547 - DNA, 975 bp, Glycine max var. Williams 82
atgggaagagcaccttgttgtgacaagaatggcctcaaaaaaggtccatggacttccgaggaggatctcttgctcaccaactacattcaaactcatggacctggaaattggagaaccatccccaagaatgccggtctacaaagatgtggcaagagttgtcgccttagatggactaattaccttagacccgatatcaagagaggaaggttctcatttgaagaagaggaggccatcattcagcttcacagtgtcttgggaaacaagtggtcggctatagcagctaggttgccggggagaaccgacaacgaaataaagaactattggaacacgcacgttaggaagaggttgcttcgaacgggaatagacccagttacacacgctccacgcctcgatcttcttgacatctcctcgattctaaggtcagcaattggcaacgttaatccatcgattctgaatctgcaaggcctattgggtgcccaagcgttgatgaacccagagtttttgaagctcgctgccactgccacacttttatctctaaagaataatgagaacccatcaaacttagtttcacaagtacaacaacaattcaatagtgctgggaattgtctagtacaaaaccaagttgctgctccaaatgatccgtttcagacaccaactcacgtgaacaatggcttatcatcaagttcccccgagaattcaattctttcccatcttggggagaataataattaccagctgaatgctcaacaaattaaccaagttgatttgcttctggaccatgaattggaacattacttaaactgtgtaaaccaaaacattggctatgaatcagttacacctttgtcgaccccaaccccattgaattcatcatccacgtatgtgaatagcagcacggaggaagagagggacacctattgcagcgatatattcaagttagaaattccagagagtcttgacattagtgatttcttgtaa

SEQ ID NO: 2548 - DNA, 1389 bp, Glycine max var. Williams 82
atggtagttcttagagaacacaaacttgtagaaaaatttcaggttggtccagcagtgagaacaatcaccactcttcccctcacattccttgatttgcctttagcaggtcctatttatgtgagacgccaattcttctatcacttcccccactccacactccatttctgtgaaaccatacttccttgtctcaaaacctctctctctcaaacccttcaacacttcttccctctcgctggaaacctcctctgtccaccaccaccccacaaacccttcattcactgcaccggtgatgactttgtcaccttaaccatcattgagtccgaagcagatttcaaaaatctctcatccaaccgccccaaaagcctcaaagatttggatcacttggttcccaagttaacatgctcaaacacacaccatgacacgttcattttcccattggtagcattgcaagccacagttttccccaaccatggcctttgcatcgcgatcacgtattgccacgtgatggatgatagttgttgcagccatttcatgaagtcttggtcctccatttgtcgaagtggtggagttgactttactcttgtggagaagtcaacaccttgcttcgatagggaagtgttgaaggaccccaaaggactcgaagctatcttcttaagagattactttgaagagaggtcaacttggaaggttggtaaaacttctgaggtttccaatggaaatagtgaagattatgtcaaagcaacgattgtttttggaagagaagatgtcgaggggctgagaagatgggtgctaaatcagtggaagagaagtaaggaattcaacacaccacaatatatatcaaaatttgtggtgacgtgtgcttttgtgtgggctagtttggttaaaacaagatgcagaaatgatgaagaagaagatgtcaaagaggagttctttcgtttcgctgcagattgcagagatcgccttgagcatcctgtgccaaaaacttactttggaaactgcttaactctctgttatgcaatgcttaagagagaagacctcaagggagagagtggttttgtgaatgcggtcaaggtcattgaaagggcagtggctgatatgaaaagtgaactcttcaaagatgcagaaaattggagggaatcttttacgaagatgtttgtgttgggaagcactttgatagttacagggtcaccaaaattcactgtttatgagactgattttggatttggaaggcctaccaaagtggaaatggcacattcctttaagggtatgtctctggccgaaactggggataatgaaggaggacttgagattggcttggtgtgcacaagtacagaatatgaatatttaatttccctcattgaacaaggacttcaaatttcaaagtcttaa

SEQ ID NO: 2549 - DNA, 1914 bp, Glycine max var. Williams 82
aacagtaatcaaaaagtgtggtttgaaatttaaatcgatgccatatcaatgtgaagatcgaagagtcacagtcaccatgacggcagattcaacgccgctaagaacactagtatgaacacaaaacatgaaaaagttgaattcagattttgttatatggtaatctcatcgacataaagggaaacacaggtatttgacaaagtcatttgaagcttatctatttttgtgtgcgtgccacaccggatgctgctttttgtttttggtcacagtgattacgcaactcaagtttccacctttgacttatatagctgtccagtttccacaccacgcgattgaataattaatatttgaagattctgcttctccaacttcctttcagcgcttctggggtaccttgtggtaatctaccaagacatatatataaacttgattgcaaagaagcatccacggcaggcatggtcaacagtgaggtttctacacgtcttgagggaaaatatgctgcaattgtggtgtgctggcttcttggcaatggatgtcttttctcgtggaacagtatgctgacaatagaagattactacggttacttgtttccgaaataccacccctctagggtgcttactcttgtatatcagccattcgcagttggaacacttgcgatactggcatataatgaggccaaactcaatactcgactaaggaatctgtttggatatatactttttttcataagcactttgttggtgttaattttgaattcagcaacatctggtaaaggaggacttggaactttcatcggtatatgtgcacttagtggtgcttttggagttgcagatgctcatgttcaaggtggaatggtgggagacctctcctacatgaaaccagaattcattcaatctttccttgctggtttggcagcatccggtgtattaacctctgctttgaggttggttacaaaagcagcatttgagaattctaaggacggtctccgcaaaggagccattctgttctttgccatatcaacattctttgagcttctttgtgttgttctctatgcatttattttccctaaaataccaattgtgaagtactaccgttcaaaggcagcatcagaaggatccaaaactgtttcagctgaccttgcagctggtggcatccggacattacctggaacagagaaggaatatacgaaagatccagagaggaagggaaacaagcaattgttattagaaaatattgactatgcacttgacacgttcctaatttatatgctaacactgtctattttccctggattcctcttagaagatactggatcacatagtttaggcacctggtatgctcttgttttaattgctatgtataatgtgtgggatctgattggaagatacattccactcttgaaatgcttgaagttggagtcccgaaagttgatcactataacaattcttagccgtttcttacttgttccagcattttatttcactgctaagtatggtgaccaagggtggatgatagtgttaacgtccttcttggggctatccaatggttaccttactgtctgtgttctaacatctgcacccaaaggttacaagggtccagaacaaaatgccttgggaaacctattggtgttgtttcttcttggaggtatttttgcaggggtgacacttgactggctgtggttaataggtaaaggatggtgagatctcattaaggccagattagaggaatagttgtgaggttcattccttgtaaaacattgataagtgtttatagtttatagcatgttctttttctacttttaagctaatgaattcgttactttctctgtttggttcgtcataaactcttaatgtaacatttgatatttatcatagagagcccaggaaattcaacatctgataaaatgacattcccttt

SEQ ID NO: 2550 - DNA, 759 bp, Glycine max var. Williams 82
atgagaaacgtttcaaagaataggttcttaacctgtttccgtcctgtggttgacatagatgacatgctcgagcctaaagctgctgttgttgatgattctgctagttgtcgttttgcatgtatcccggttgcagacaaacatgacgccaaaaattcaacgaccaaagccacgctttctgaccaagatatgttagcacagaattggattgtcgtgcctcgtcctcaaaaacgaacgttttctaagataattaaagccgatttgtttttattgaatacaagagcacgcaataaaaatcttgatggccaaggttgttttgggtcaaagcgtgattattcggcatacacagaaagttcatcaaccggtgatgagaagaaacaagcttttgtgggcaccaacattcagaaaatcaagcccccagaatggtcttcgtcgatttcatcttcaaattcgcccgaatcaaagaacgagtcccctaaagaccaagtagagaagcaaaagaagtttcggtgcttaggaatatactgggttcttgtaagcttagtggttacggtcttttggggtaaggtcaatgttactatctggacatcattattgttatgttttttctctatttggaacggaatctgttgctggaaaaaagaggttctcaagttgcggaacgcagaatccaaagcacacaagaatagccgtagggaccgtaatggaaggagtggtcgaaacaaaggaacgttcgtaatgggcattgaatcttttacgtga

SEQ ID NO: 2551 - DNA, 390 bp, Glycine max var. Williams 82
atgaacaaggttggttttgtttttcttctagtaataactcaaatcattctgcttcaagccatggcactagagtctgaggctccaatgccaggactcaaccctttggaggttaaaattcaaagagaagttaaggtaagtgatcaaaagagagacaaagttgtagttcaaccagttgctgggtctagagggtcgtcatcatcacatgaagagggtgagtctaaagcagaagaagctgaggctccaagtattagaaagctaggaaaacatcattccgcagacaagtcagtggcaggtggaagtgtgatcttaggtggccttgttactgtcacttttgctgctgtcttttgctacattcgggttacaaggaaaagggataatagtgatcactga

SEQ ID NO: 2552 - DNA, 1722 bp, Glycine max var. Williams 82
atggggacaaaaatcacgcttcagtttcaagaaaggtataatttacagcatgggatttcaaggaggtatggagctatatgtgtggagagagcgaggaaaccaagaacaacacattgcttcttcaaatcggattgtggccacctcaagaaagaacgaggtgttagagtgacgttaaaagccgaaactgctgaatctaaggaacagattcatacaagttataaagacccaatgcttgcaagttatgtaccagtatacgtgatgctcccattgggagtcgttacaaatgacaatgtcttacaagacagtgcgggactaaagaaccaactcaaggagctacatgcagcaggggttgatggggttatggttgatgtctggtggggtatagtagaatctaaaggacctcaacagtatgattggtctgcttataggaccttgtttaaattggttcaagattgcaaaatgaagttacaacctataatgtcattccaccaatgtgggggaaatgtgggagattctgttttcattccacttcctaaatgggtacttgaaattggagaattagacccaaatatcttttacaccaacaacaaaggtatcaggaataaggaatgtatatccctcggtgtagacaaccaacctctgtttcatggacgaactcccattgagctatacaccgactacatgaggagcttcagagaaaatatgaaagattttcttgaatctgagctcatgatagacattgaagtagggcttggacctgcaggagaacttagatatccttcttacacacaaaatcaggggtgggtattccctggtattggacaatttcaatgctatgacaaatatcttaaagatgatttcaaagaggctgcaacaagggaaggtcatcctgaatgggagctgccagataatgttggagaattgaatgatgcacctgaatctacaaaatttttcaagtcaaggggaacttatctaacaaagaaagggaaattttttctaacatggtattccaacaaattattgatccatggtgatgagatcttggataaagctaacagtgtattcctaggttgcaaagtgaagttagcagcaaaaattgcgggaatccactggttgtataaatcaaagagccatgcagcagagcttacttcaggatattacaacttgaatcgtagagatggatatagacccatagcaaggatgctttcccgtcacaaagctgttttaaattttacatgtcttgagatgagaaaccatgagcaaccaattgaagcccgaagtggagcccaagaacttgtccagcaggtccttagtggatgctggatggaaaaactagaagttgcaggggaaaatgcacttgcaagatatgacagtgaagcttacaaccaaatccttttaaacgctagaccaaatggtattagcaaatggggccctccaaaactaaaaatgtatagcatggcatacctccgcttgtcagatgaattactacaacaaacaaactttgatatattcaaagcctttgtgagaaagatgcatgctaatctggattattgtcccgagccagagaggtattatcattttagggtacctatggagctgtcaaagccaaggattccactggaggttcttcttgaagcaaccaaaccagtgaagccttatgcatggtacaaggaaataaatatgagccttagtgatgttattgtttttcttgattatatatag

SEQ ID NO: 2553 - DNA, 429 bp, Glycine max var. Williams 82
atgtgttacgtggggaaagcaacaaagatcttcatcttcattgtgacggtgctcgttgttctgggtctagttttgggattaggactccttcgccgccaccaccacaacacttcaaataaatgctccgatgagtcttgcattattccttcaccagcaaccacatttccgaaccccaatttcaatacaccaaccccaccttcccccattgacaacaaccccacaaccccacaaactcctcctcagcttccaaatccaaatccaattcctcctcctcctcctcctaattccgataacccatctttgccaccgcctccgccgccggaggaaacgacccctccgaatcctcctagtgtggcggcgccacctatgaacacaccaacaccagggtcggcgcaggtgaccccaggtcctgtgcatgctatggcctag

SEQ ID NO: 2554 - DNA, 699 bp, Glycine max var. Williams 82
atgttaacagcaggtgagtacagcaaccacagctggccgctgcagccagaaacaagcctgaccgagctgaacttgcccagagtgctctgcattctctcttccatgttagagaagctggtggctcgcaatgaaaagctcgttgatatcctgagccagcagctagatggactgaactgtggctcagtaagacttgggaacagcttgaatacatttcatggcgtaagagcaccaagcataagcatacctaagtacttggagaggatatacaagtacactaattgtagcccctcgtgttttgtggttggctatgtgtatatagacaggttaacacataggcaccctgattctcttgtcacttccttgaatgtgcacagattgctagttaccagtgtcatggtggcttccaagatgcttgatgatgaacattacaacaacgccgtatatgctcgagtaggaggagtaagcaatactgaattgaacaagcttgagttagagttactctttctgttggattttagagttatggtaagctctcgggtatttgagagctactgttttcacttagaaaaagagatggttatcaatggcacaggcatgaagattgaaagggcattaacaccaaaggctatggatgacttagagactgaaatatccgttgaagataaacaaagcccttccccacctcaaattgtagactaa

SEQ ID NO: 2555 - DNA, 1187 bp, Glycine max var. Williams 82
gattctaaactttcaatcgcaatcttaaaacttagtctgtggtagagtcacacgtcagcaatacagtgagtggttcctccaaactagataacaagcacagttgcagttaacacctgcttagtctttaaccactcaaataccacagccatgagcatatgcaagcattaactccctctggtgaaaccaccaagatggcgtaaatgttaacagcaggtgagtacagcaaccacagctggccgctgcagccagaaacaagcctgaccgagctgaacttgcccagagtgctctgcattctctcttccatgttagagaagctggtggctcgcaatgaaaagctcgttgatatcctgagccagcagctagatggactgaactgtggctcagtaagacttgggaacagcttgaatacatttcatggcgtaagagcaccaagcataagcatacctaagtacttggagaggatatacaagtacactaattgtagcccctcgtgttttgtggttggctatgtgtatatagacaggttaacacataggcaccctgattctcttgtcacttccttgaatgtgcacagattgctagttaccagtgtcatggtggcttccaagatgcttgatgatgaacattacaacaacgccgtatatgctcgagtaggaggagtaagcaatactgaattgaacaagcttgagttagagttactctttctgttggattttagagttatggtaagctctcgggtatttgagagctactgttttcacttagaaaaagagatggttatcaatggcacaggcatgaagattgaaagggcattaacaccaaaggctatggatgacttagagactgaaatatccgttgaagataaacaaagcccttccccacctcaaattgtagactaacacgatcagtggttggttctggtcaatttttgggtcccatgcccctccttagtccttcccttgctcttcacggcgtggtaataattggatcattcatgggccagtttcgtttcttgtatttcacgtcaatgtcaaagcttgtgatattgccttttgcctcctgcaaaaataaagtacgaggctgagttattatatgattcacacgaactgtattaatttggctttgatgacaaaatacagttatattagtttttcttcccttatttagtttttttgaaagaaagttca

SEQ ID NO: 2556 - DNA, 981 bp, Glycine max var. Williams 82
atgaaaatgggaagcaacttgaggtttttgagtctttgcctcttggcattgattgcatcaactcatgcccaacttcagcttggtttttatgcccagagctgcccaaaagctgagaaaatcattttgaaatttgttcatgagcatatccacaatgctccatcactagcagctgcattgataagaatgcatttccatgattgttttgtaaggggatgtgatggatcagtccttctgaactcaacaaccaatcaggctgagaagaatgctcctccaaatctcacagtaagaggctttgacttcattgacagaataaagagccttgttgaagctgaatgccctggtgtggtctcttgtgctgatatcctcactttggctgccagagacactattgtagccacaggtggaccctattggaaagttccaacaggtcgaagggatggggtcatctctaacttggtggaagccagaaataacattcctgctccatttgacaacatcactacgctacagacactctttgccaaccaaggacttgatttgaaggacttggtcctgctctctggtgctcacacaattggtatcgctcattgttcatcattatcaaaccgcttgttcaatttcactggcaagggtgatcaagacccttcactagacagtgaatatgctgcaaatctgaaagccttcaagtgcaaggacctcagtaaattgaacaccacaaaaattgagatggaccctggaagtcgcaagacatttgatcttagctactatagtcacgttattaagagaaggggtctatttgaatcagatgctgcattgttgactaactcagttacaaagtctcaaatcatccaattgcttgaagggacagttgaaaatttctctgctgagtttgcaacctccatagagaaaatgggaagaattaatgtgaagacagggacagagggagagatcaggaagcattgtgcattcgtaaatagctaa

SEQ ID NO: 2557 - DNA, 975 bp, Glycine max var. Williams 82
atgggaagcaacttgaggtttttgagtctttgcctcttggcattgattgcatcaactcatgctcaacttcagcttggtttttatgctaacagttgcccaaaagcagagcaaattgttttgaaatttgttcatgaccatatccacaatgctccatcactagcagctgcattaataagaatgcactttcatgactgttttgtaaggggatgtgatgcatcagtccttctgaactcaacaaccaatcaggctgagaagaatgctcctccaaatctcacagtaagaggctttgacttcattgacagaataaagagccttgttgaagctgaatgccctggtgtggtctcttgtgctgatatcctcactttggctgccagagacactattgtagccacaggtggacctttttggaaagttccaactggtcgaagggatggggtcgtctctaacttgacggaagccagaaataacattcctgctccatcttccaactttaccaccctacaaacactctttgctaaccaaggacttgatttgaaggacttggtcctgctctctggtgctcacacaattggtatcgctcattgctcatcattatcaaaccggttgttcaatttcactggcaagggtgatcaagacccgtcactagatagtgaatatgctgcaaatttgaaagcattcaagtgcacagacctcaacaagttgaacaccacaaaaattgagatggaccctggaagtcgcaagacatttgatcttagctactatagtcacgttattaagagaaggggtctatttgagtcagatgctgcattattgactaactcagttacaaaggcacaaatcatccaattgcttgaagggtcagttgaaaatttctttgctgagtttgcaacctccatcgagaaaatgggaagaattaatgtgaagacagggacagaaggagagatcaggaagcattgtgcatttataaatagctaa

SEQ ID NO: 2558 - DNA, 1197 bp, Glycine max var. Williams 82
atggagtggactagaggcttcattataggacgtggctcatcggccaccgtttacaccgtcacctcctctcactcctccaccgtcgcggccgtcaagtcggcagagctaacactatcaaattcagagcagctgcagagagaacagaggattctgtcttgtctgttttctcctcacatagttacctacaaaggctgtaacattacagaggacaagaacaacaccctttggttcaacctcttcatggagtacatgccctttggcactctctcacaggaaattcaccggcgcggtggtggccgcctcagcgagccagccaccgtgcactacacgcgacaagtcctgcagggcttagagtacttgcacaataatggtgttgtgcattgcgatattaaaggtggcaacattttgattggtgaagatggggccaagattggggactttggatgtgccaagtttgcgaatgattcctcggcggtgatcggtggcacgcctatgttcatggctccggaggtggcgcgtggggaggagcagggttaccctgctgatgtgtgggcacttgggtgcactgtgcttgaaatggccactgggtttgcaccatggcctaatgtggaagaccctgtgacagtgttgtaccatgttgcatattccgatgatgttcctgagattccttgttttctgtctgaggaagcaaaggatttcttggggaagtgttttaggaggaatcctaaggagaggtggagttgcagtcagcttctgaagcatccatttcttggggaattcagttccaatgataaggaaattcaagaatctaattcatgttctccaacaagtattcttgagcagcgcttttggaattctgtggaagaggcagaggcagagtgtgtctctgtctctggcaatgtggttcagattaaaagttttgaggattctcccatggacagggtcagaagtcttgctttgagctcaggggatccattttgggaactggatgatgaaaattggatcacaacaagaggcagtgaagcaggggcttcgagttgtgatgggttgaatttggatgttaatagtagaattagtggttatttatgtgatgattattataaatgtagggatgttagtgttgtagttgataatttcaattttgagagaggcaattctgagatgcttctccctttaaaattggaattttttttataa

SEQ ID NO: 2559 - DNA, 2247 bp, Glycine max var. Williams 82
atggccaaccaaggacatgacctccctctctatgaaaaaatatgggtcaagcgaaaatttcaaagagtgatagacacattgatcttagtcctccttctcctgcttcttagttaccgacttttctcatccaacaactttactttcccgtggttccttgctttcatatgtgaatcttggtttacattcacttggattgtgattctcaacaccaagtggagtcctgcagtaaccataacccacccaaatcgtctcctgctacgggtacctgagtctgagtttccaccagttgacttgctcgtgacaacagcagaccatgtacttgaaccaccaatcatcacagtcaacactgtcttatctcttctagcacttgattatcctactaacaagctagcttgctatgtttctgatgatggttgttcccctcttactttctatgcccttgtggaagcttccaaattcgctaagttttgggtacctttctgtaagaagaactgtgtacaagtgagagcacccttcagatacttctctgacattgccactaacaaaagtgaagactcacttgaattcaaacaagaatggttacaaatgaaggatatgtatgacaatctttgccaaaaaattgaagaggtgacgggcaaaacaattccattccaacttgatggagaatttgctgttttctcaaatacagaccaaagaaatcatccaaccataattaaggttatattggagaacatgggtgatcttttagatgggttgcctcacttaatctatatatccagagagaagaggccacagtatcatcacaattacaaagctggagctatgaatgtcttgacaagagtctctgggttgatgaccaatgctccctttatattgaacgtagactgtgacatgtttgtgaacaatccaaagattgttctacacgctttgtgcattttgatggattcacaaagaggaaaagaagttgcttttgttcagtgtttccaacaattctacgatggaataaaagatgacccttttgggaatcagtggatgattacatttaagaacattataatgggaatggcaggacttcaaggacctttctatgggggaacaaatgctttccatagaagaaatgctatttatggcctttatcctgatgaaattgaaagcgagagaaaaggaaaattagaaggaaagatattaatagagaaatttggaagttcaaaggagtttatcaaatcatcagctcaagctttgggagggagtgcattttctgctaatgatattactactttcaactttattgaggcagcaacacaagtttccaattgtgaatatgaatatgacacttgctggggtaaacagatggggtggttgtatggctcaatctcagaagatgtgccaactgggttgaatattcaaagaaaaggttggagatcagagtgttgtacaccagatccaattgccttcacaggatgtgctcccggaggaatactctctacaatgttacaacaaaagagatgggcttcaggcctcactgtagtcttctttggaaagcattctccaattacgggcatgctctttggtaagacccagttcagggcaggcttgtcttttttttggcttaccaactggggcttgcgtggcctatttctagtttgctatattgctctactagcattttgcattattaccaacaccaatatctttcctaagggactaggcctttggattccaattgctctttttgtgatttacaacgtacatactctattagagtaccttacaattgggttgtcaatacgacattggtggaataatcagagaatgtgcataattagaaccacgactgcatcgtttcttggatttttgagtgctatgcttaagctatcggggatatcggattctgtctttgaaataacagacaagaaaccctcaacttctggtgctgatggaaacaatgcagatgctggaaggttcacattcgaggagtccccagtttttgtgataggcacgaccattttgttggtgcatatgacagcaatgttgatcaagtttttggggttgcaacctactcatagtgggaatgggtgtggacttggggagtccatctctagtatgtatgtgatagtgtgttactggccatatttgaaagggctgtttgctagaggaaaatatgggattcccctatccactatttgcaaatcagcagtgttagcattagtgtttgtgcacttttgtagaagtaacgttatcagttga

SEQ ID NO: 2560 - DNA, 1275 bp, Glycine max var. Williams 82
atgtcaacttgtatgagcaagaaaatacaaggccaaagcctttctatagaagaagagaacatgctggtggtgcagaagcagggaatcgtgaccattttgggctctaaccacgatgctccgacaacttctcttcgacgcactttatccgcagacatgtcttccaagacatggctttctcaaaacggcttctctctcatgaaaaaaacctcttcctctgaagaactctcttactcatcactcacaaaatccactatttctgactcatcctcgtctgatgaagataactgcgaagaagcgaaacaagaccagttccaaatttggaacacaattcaaaaggagcagcagcatgaggacaacaaaccaggacaggttgatgtgtggagttcaattttggtccaaaaagccaacgaggaaaccttaaaactaagcacaactccttatgttcacccacttgtgagaaggtcaaagagttgtttgagtgaaaaaagtttagagatctgcacggagagtcttggatccgaaactggctcagatgggttctcttcttactcaccctctgagacagaagaaaaagaagaagaaaaagaggaagagagtatgcaaattacacacgaggaggattttcaagtgccaaaacaaaactatgctgagaaaaagtccttgcctcgttctttccctcctccacttccttcactccacatgcgttcacaccgtgacaatggaaggttgttcctacaagctgtgtctgttccttcacagaacaacttttgtgctcaacgagaaaacggtcgacttgtcctcacttttgctgacgtggaggtagctgaagaagaagaagagtttgatgaggcagaggaatttgagagtgtgatagaggaagcaaaaacacccatgttaaggttgttatctagtgggtttgggttagcattaatgatgaataagccaattgggttattaggtactgatgctaacgttaagagtccaaaatggtcagagaagttcaacgatgtggtcaattttaaggatgttgatacggtacaacatagtcatccactgccaccgaggccaaggcagcatggtagtattcataaaaaggctttcaatgcttatgaatactattggaggaccaagcctacgacaaaagttgctcctgcttctaacacgtttacctttcaacacaacaacaattactcttccttggagaacaatttgaagagttgcaaggattctaggaggtcttttctgatctgggaaccgtattgcattgccacctga

SEQ ID NO: 2561 - DNA, 1212 bp, Glycine max var. Williams 82
atggatgaaattgaaatccctgctcatttcctctgccccatttccctccaactcatgagggaccctgtcacggtttgcacaggaatcacttatgatagagagaacatagagagatggttattttcatgcaagaacaacacatgccccgttactaagcagtgtctattaaaccatgatctcaccccaaaccacactctacggaggttgatccaatcttggtgcaccctcaacgcctctctaggagttgaacgcattccaactccaaagtcaccaatagacagaactcagattgtgaaactcctcacagaagcaaaaaggttccctgagaagcaactcaagtgcctcacaaggcttcgatccattgcctttgaaggccaaaggaacaaaacatgtttagagtctgcaggagtaatagaattcttggtctcaacaatgaagaacaacaacacacaagaagactcaactgttctcagtgaagcagctattgaagtcttgttccacctcaatctttccgaggctcgggttaaagctctgattaacaacgaggaatttcattttattgagtcattgtttcatgttttaagacttggaaactaccaatctagagcctttgctacaatgctgcttagatcagcatttgaggtagctgatccaatccaattgatcagtgtcaaaactgcactgttcgtggaaatcatgcgcgttctgcgcgatcagatttcgcagcaggcttcaaaggctgcattgaagctcattgtggagctctttccgtggggaagaaacaggatcaaaggggttgagggtggtgctgttttggtcctcgttgagttacttcttggtgcctcggaaagaagaacgtgtgaactcattttgatagctttggatcagctttgtgggtgtgcagaagggcgtgcagagttgttgaaccatggagcaggagtggccattgtgtccaagaaaattctaagggtctctcatgtggcaagtgacagaggggttagaattttagcctctatttgtaggtattccgccaatgctagagtgcttcatgaaatgttgcaggttggggcagtgtccaagttgtgcttggtgcttcaagtgaattgcagtttaaagactaaggagagggcaaaggaaatactccaattgcattctgtggtttggaagaattctccatgtattcctgtacctttgttatcttcctatccatga

SEQ ID NO: 2562 - DNA, 324 bp, Glycine max var. Williams 82
atgagtaatgaaagagcaaggagtcctaggttggaatttgatctgatgttgtcccccccacgaactgcaaactcatccgagttatcgacttcagaatcatcattatgtttgtattcatcatcggatcctgactcatgcgtatcttccgagactaatgatgaagagattagatccatggttctcgtaggttgtctgcgatgcctcatgtacgttttgttttcaaaggatgatccaaatcctaaatgccccaagtgcaagagtactgtgttgcttgatttcctgaatgacaacaagcaaaaaaacaccaacaaaacaaccacctag

SEQ ID NO: 2563 - DNA, 2308 bp, Glycine max var. Williams 82
ttgatatttgcacatttaactttttttatacatatctaaatattaaaatgttttgatttatatgcaattcctgtataggaaacccataatgtgtgtgtataaaggttgtgcatgggaaagataaaattatttcccaagttttattgcagaagaactcaaatggaaagcactatcttagaatggaaaaatggaactagaaaaaggggtccactagtgaacaaaagtaggaaggaataatatctatttctcaggtcaccgcacattaagattaagttgggttttctattggctctatccaagattccatgggattaatagcctcccctccagctctcagatataaataccagtttcagcatgctttccactgaagagaagtgtgtataagagaaacaagacaagcacaacaagcattctgaaattctctatttgttagtatcaggactagtaacaaattaaccttgaaaataaagcttcacctagtttcatcttccgtaggttgaaaagtgatcaagagaatacacgtcatcaggtaattacacaactggtcttcagaactgggaattaagttgctagtttttatatgttggggtgcttataagtggtttttgtaggtggaaatgtaccatcatcaccaacaccaaggaaaaaacattcattcttcttccagaatgccaatcccctctgagaggcacatgttccttcaagcaggaaatggttctggtgattctggacttgtgctttcaactgatgctaagcctagattgaaatggacaccagatcttcatgcaaggtttatagaagcagtcaaccagttagggggagctgacaaggcaactccaaaaacagtaatgaaactaatgggaattcctgggcttaccttgtatcatctaaagagccatcttcagaagtatagattgagcaagaatctgcatggacaaagcaacaacgtgacacacaaaatcacaacaagtgcaacaactggggagagactttctgaaaccaatggtactcacatgaacaaattaagccttggaccacaggctaacaaagatttgcatataagtgaggcactgcagatgcagattgaggtgcagagaaggctcaatgaacaacttgaggtacaaagacacttgcagcttaggatagaggcccaaggaaaataccttcagtctgtgttggagaaagctcaggaaactcttggcagacaaaatttgggaatagtaggacttgaagctgcaaaagttcaactttcagagctggtatccaaagtctcatcacagtgcttcaactcagcattcacagagctgaaggatttgcaaggattttgccctcagcaaccacaaaccaacccgccaaacgactgctcaatggacagttgcatcacctcctgtgacagatcacaaaaggagcaagagattcaaaatggcttaagacacttcagcagccatatgttcatggagcaaaaggaagccaaagaagctcccaacaaccttaggaaccctgaaatcaagtggtatgatgatgggaaaaagaacaccttccttgccccattgagcaagaatgaagagagaagaaactatgctgctgaatgcagtcctagcaacttatccatgtccattggacttgaaagagaaacagaaaatggaagcagcatgtatcccgagagactaatcacagaaagcccatcagatggtagaatcaagccacaaacaatgaaaccagtggatgaaaaagtttctcaagattataggttgccaacttcttactttgcagcagcaagattggacctaaacactcatggagacaatgaagttttgtaaacaattggacttgaatagattcagttggagctgagaaaacattaaagaaaacagttatgcttcttcaaaatttgattcagcataagaggaggataataggaacagtgtgttgttagttactagttactgcaatacaatttcagctgctctttctttcaacccaacaaatgaccagatataggtcatttttagccaaatgaaataagctgcaacaacaagatcagtgataaatatttgtaagcaatcattacaaaggagatagtccagcaacataaggttttattctagtttattcaaaattcatgacatcatgtaacatgcattaattattcttgagaccaacttctattcgaattagaaattgaaatgacactaatatataaaatggcgttagttttactctaaacatcacaactctgcatgtatattgcaatcataggttatttaaaattcagaaagtgttcatgttattcacatgtatacgt

SEQ ID NO: 2564 - DNA, 1371 bp, Glycine max var. Williams 82
atgagtacgctgcttccaacctcaacaagagtacatgatacagagaaccaaaatgcttctcaacaacaccgaagagatgcaggcactctctttgtcctcaaatctaaaggttcatggattcactgtggttaccacttgacaacttcaattgtgtctccatcactgctaagtcttccttatgctttaacctttctcggatggaaagctggaatattttgcttggtcattggagctttcgtaagcttctattcattcaacttgatgtccctggttcttgagcaccatgcttatttgggtaatcgccacctgctgtatagagacatggctcgtgacattttaggtccacgttggggtcgctattttgtggggccaattcaatttgcagtttgctataataatgaagttctttgtgctcttctggggggacaatgcatgaaggcaatttacctgttatcaaatccaaatggaaatatgaagctttatgagtttgtagtgatatttgggtgcttcatgctgatgttggctcaaatgccatctttccactcattgagacatattaatctggtgtcttcggtcatgtgcttatcttatagtgcctgtgctactgcagcttccatatatattggaaactcatcaaatgcgccagaaaaggattattctctgaaaggcgatacgacaaatcgcttatttggaatctttaatgccattcccatcattgccacaacttatggtagcggaataattccagaaattcaggcaacattagcacccccagtaaaagggaagatgctcaaaagtctctgtgtttgttttgttgtagttctcttcagtttttttactgtagccatttctggctattgggcatttggaaatcaagctgaaggcctcatttttagcagctttgtagataataacaagcctttggctcctaagtggcttatttatatgcccaacatttgcacaatagcccaactaacagctaatggtgtggagtacttgcagcctacaaatgtaatactagagcaaatatttggagacccagaaatccctgagttttctcctcgcaatgtaattccaagattgatttctcggtcattagctgttattacagcaactattatagcagcaatgcttcctttttttggggacatgaactcgcttataggagcatttggttatatgccacttgacttcattttgccaatgattttcttcaatatgacatttaagccatccaagcgaagctccattttctggttgaatgttattattgtcattgctttctccgcactggcagctatggcaacaatttcaacagttaggcaaatagttcttgatgccaaaacttatcaattattcgcagatttataa

SEQ ID NO: 2565 - DNA, 1707 bp, Glycine max var. Williams 82
atgaatcactcatacgcgaatcaatcggctcaagaagttaatatagttacagaggacacaagaagatctgcaaattataaacccaacatttggaaatacgattttctgcagtcacttgacagtaaatatgatgaggaagaatttgttatgcagttgaacaagcgggtgacggaagtaaagggtctttttgttcaagaggcaagcgttttgcaaaaactagagttggctgattggatccaaaagctaggccttgccaactactttcaaaaggatatcaacgagtttctcgaatctatacttgtctatgtcaaaaacagcaacattaatcctagcatagaacatagtttacatgtatctgcactatgcttcaggcttttaagacaacatggatatccagttttgcctgatactttaagcaactttttagatgaaaaaggtaaagtgataaggaaaagctcatatgtttgctatggtaaagatgttgtggagcttcttgaggcctcacatttgagcttagaaggagaaaagatcttggatgaggccaaaaattgtgccataaattctctcaagtttggtttctctcccagttccatcaacatcaaccgacactccaatctggttgttgaaaaaatggtccatgccttggagcttccatcccattggagagtacagtggtttgaggtcaaatggcacgtggagcaatacaaacagcagaaaaatgtggatccaattttacttgaattgactaaattaaatttcaatatgattcaggccaaacttcaaatcgaggtcaaggatttatccaggtggtgggagaatcttggcataaaaaaagagttgagctttgcaaggaataggttggttgaaagcttcatgtgtgcagcaggagttgcttttgagccaaagtataaagccgtcagaaaatggctcactaaagttattatttttgtactaataatcgatgatgtttatgacatacacgcctcatttgaagagttgaagccgttcacattggcatttgagagatgggacgacaaagaacttgaagaacttccacaatacatgaaaatttgcgtccacgcacttaaagatgtcacaaatgaaattgcttatgaaattggtggagaaaataactttcactcggtgttaccttatctaaagaaagcgtggatagacttttgcaaagcattatacgtggaagcaaagtggtacaacaagggatacattccatcgttggaagagtatttaagcaatgcttggatttcatcttcgggaccagtgattcttctcctttcatattttgctacaatgaatcaagcaatggatatagacgattttctacacacatatgaagatttggtctacaatgtatctctcataattagattgtgcaatgatttagggaccacagcggctgaaagagaaaagggtgatgttgcttcgtcgatcctatgctacatgaatcaaaaggatgcttcagaggaaaaagcaagaaagcacatccaagacatgatacacaaagcatggaaaaagataaatggacattattgctccaatagagttgcttcagtggagccatttcttactcaagctataaatgcagctcgtgtggcccataccctttatcaaaatggcgatggctttggtatccaagaccgagatatcaagaaacatatcttatcactggttgttgaaccccttagatag

SEQ ID NO: 2566 - DNA, 948 bp, Glycine max var. Williams 82
atgttgtcacaaatggacatggaggagcttgtctcatgtaacaacaacgatgccaccaacatagccaaaggcaagcgcacaaagcggcgcttgaggcctttgtctccttgtgccgtcgttcctaccaccaccaccatcaccactgtcactgccgctaccacccccatcatgacatctagctgttcaagtgcttcttgtggcggtggttcttcttcatccacaacctttgaggaggaagaggaagacatggctaattgtttgattctcctagcacaaggaaaagtaggaggggaccctcctcatcgtcacaaggacttatatggtagtgatgttaagacagagaagctgggtagcaccaaagtcgatcatttctatgtttatgagtgcaaaacatgcaaccgaacattcccttcttttcaagcactaggtggccacagggcaagtcacaagaagcccaaggtggaggagaaaaagtcgtcatcaccaccactgtcgttgccgccgccgccaccaccaccaccaccgtcttcgtcgtcactatttaattttgaagaagcaaaacaaagtcatcacatgaagaatattattagcccttctgtttcccttcaattagggtgtggcaataataacaaggttggtttaaatttccatggcaacaaatccaagattcacgagtgttccatctgtgggtcagaattcacatcagggcaagcattgggtggtcacatgaggaggcatagagcatctaccaataataacaatattgttcagacaacaacaacaacttctaatggtgctgttgatgttaagcctcggaatgttctagagttggatcttaacctcccggcgccggaagacgatctccgggactccaaatttcagtttccggcgactcagaattctatgatgcggtcggctgctccggctttggtgggatgccattattag

SEQ ID NO: 2567 - DNA, 501 bp, Glycine max var. Williams 82
atgtccaaggaacaaccacttcctctggagtcaggaccataccattataaaaagccagttcaacccacccacaacacaaagtcaaggagacaaaacaaactaaacatgaatcccattggtttctctcttctctccctggtttctctagcacttgtctcaattgtcacagcccaagaaagagcccctcatgggcttgtttacgagaaccctgaagccttttcaccatcagcatataacttcttgcacccgaatgaacgaaagcccgagaccaaagacccttgtgctgcatccaaatgctcaccaatgcctttagcagcacaagtggaagctactgaaattcatgaaagcaaagcctcaacacctcaaggaagtaagaaacaattggtagctggtggcgtagctggcattatctttggtgttgcttttgttgtgcttttagctatgggggtctaccatgtaagggtcactggccgagccaaagccaatggtgctgttgcttga

SEQ ID NO: 2568 - DNA, 1170 bp, Glycine max var. Williams 82
atgacaaagaaattacgtttgggttgttcttttcagggggaggaggatggaaagaaagtgaataactttctggaaatggataggggggaaggagtgaatgatggtttttctggacctggaccaaatgattcacttattcctggtcttattgatgatgtagccttgaattgtcttgcttgggttagtggatctgattatgccgtgctatcgtgtattaataaaaggttcaataaactgatcaatagtgggtatctatatgggttgaggaaacaattgggggctgtggagcatttggtgtatatggtttgtgatccaagaggatgggtggcctttgaccccaagataaacaggtggatttctttacctaagataccttgtgatgagtgctttaatcatgcagacaaggagtccttggccgtgggctgcgaactgttggtcttcggtcgagaattgatggagtttgccatttggaagtatagcatgatttgtcgtggttgggtgaagtgccaggagatgaaccaaccccgttgtttgtttggatctagtagtcttggttcgattgctattgttgctgggggaagtgataagtatggaaatgttctaaaatcagctgagttgtatgactcttcaacaggtatgtgggaacttttaccaaacatgcacgcaccgcgtagattgtgttctggtttttttatggatggcaaattctacgtgattggtggaatgtcgagtacaactgtttcattaagttgtggagaggagtatgatctcaagacaaggagttggcggaaaatagaggggatgtatccatatgttaacgtgggtgttcaggcacctccacttgtggctgttgtggataatcagctatatgcagttgagcatctaactaacatggtgaagaaatatgacaaggaaaggaacacctggaatgaattggggaggcttccagtccgagcagattcttctaatggttgggggttggctttcaaggcttgtggagagcaacttttggttgtgggtggacaaaggggtccagaaggtgaagctattgtgctgagttcatggtgtcctaagtcagggatcagcaatggcaccatagattggcaggtacttggcgtgaaggagcatgtcggggtgttcgtgtataattgtgctgttatgggttgttga

SEQ ID NO: 2569 - DNA, 738 bp, Glycine max var. Williams 82
atggtgatgatgatgaagaaacaccttctcttctcactttcacttctcctaatggttctcttcacttcagctcaaaccaccccagcaccatcaccttcctcagccccaacagacatcatcagaatcctcaaaaaagccggaggattcaccacccttatccgtctcctcaccacaacacaagtctcaacccaaatcaacgcccagcttttgaactcaaacaacggattaacagtgtttgcaccaaacgacaatgccttccaaagcctcaaacccggcttcctcaactccctcaacgatcaacagaagaatgaacttatccaattccacgtgctaccaacatttgtttcaatctcaaacttcgacactcttagcaacccggttagaacgcaagccggtgatgaccctgataggttggcattgaacataacaagctcagggaaccaagtgaacttgacaacaggtgttgttaacaccacagttggtggaagtgtttactccgatcaccagctcgcgatttatcaagtggacaaggttcttcttccgagggatttcttcgttcctaagcctcctccaccagcaccttcacctgctaaggctaaggcttcttctgcaaagaaatctacggagggtccttctgctgcggataatgactctgctgctatcagcttgaaacacatgaatagaatgtgggtgatgacccttgcagtggctactattgcagcagtgttttcgttgtga

SEQ ID NO: 2570 - DNA, 513 bp, Glycine max var. Williams 82
atgactaaagaagacgctggtattgatgccattactcctgaagaaggcaaagccaataatattattgaggcgtatgagtcacctagattccaaaagtttgtgacacattgcagctcacatgttactcaaacatgcagtggaaatgatccattaaataatcaggaggccagtagaatgaatagtccatttgggttgtctttttgcctttttgattctatggagaagtgcttggcagaccataaagcctcacttaaagatccccaagataacaacaacctagcttcaatgtcgtctcttcctggctcaatccaaaatcagccactcctcattgagactgtaaaattcagaaccgtcttgaaaacctgttcccatgtcagtgcacaatattgtttcactaatcctaacgttgctacatcggctttagcggattgtctcatgccatctctcaatcaatgtgtttatcctggttctatcttattaccacccccgccaccacccccgccacttatttag

SEQ ID NO: 2571 - DNA, 1428 bp, Glycine max var. Williams 82
atgggttgctttcgttgcaccggcaaatcaagcaaaaaaaccaacaacattaatcacgccgagaagcacactcctgctgataaggtcaaagttaattcgaatttgaatggtaaaaaagaagataataatcctaagcctgatcagctatctctggacgtgaagtatttgaatttaaaagaggtttccaatgaaggaaaagttaatggttaccgggcacagacatttacttttgctgagcttgcagctgcaacagggaatttcaggttagattgctttctgggtgaaggagggtttggcaaggtttataaggggcgcatagacaaaataaatcaggttgtagcaataaagcaactagaccctcatgggcttcaaggaattagagaatttgttgttgaagtgttgacattgagtttggcagaccaccctaatttggtcaagttaattggtttttgtgctgagggagagcagaggctattggtttatgagtacatgtcattgggatctttggagaatcgtttgcacgatcttccgcgtggtagaaaaccgattgattggaattcaagaatgaaaatagcagctggtgcagctagaggtttagagtatttgcataataaaatgaaacctcctgtcatataccgggatctgaaatgctccaatattctgttaggcgaaggatatcattcgaagttatctgattttggcttggcaaaagtaggaccaagtggtgataaaacccatgtttcgacaagagttatgggaacatatggatattgtgccccagactatgcaatgacgggtcaattgacgttcaagtctgatatttatagctttggagttgttcttttggagatcatcacaggcaggaaggcgatcgacaatacaaagcctgctaaagaacaaaatctagtttcatgggcaaagtctttattcaaaaaccgtaaaagattctgtgagatggttgacccattgcttgaaggtcagtatccaatgagaggtttgtaccaagctcttgctattgctgccatgtgtgttcaagaacagcctagtatgcggcctgaaacaaccgatgtggttacagctctagattaccttgcatcccagaaatacgatccccaaattcatccagtacaaaactgtagaaaaggtttatcttttccaagagaaagaagcagtggccatagacgtactgttagtaatgattctgatccaagagcaagaagcgatggtcatagacgaactgtttgtaatggttctgagacaagagcaagaagcaattgtcataaacgaactgttagtattagtaatggtcatagtagtagttctgagacagaaagctctagaaaaggtctatcttctccaagggtgagaagtgatggtcacagacattttgttagcaatggttctgagacagacagttctggagattag

SEQ ID NO: 2572 - DNA, 1059 bp, Glycine max var. Williams 82
atggcggaatcatccactagttctcctgtttcagttgattccattcccagagacaatgataagttctggaaagggtcatttactgtcgccggaatcatggttactctcgtcacctatggtctcttgcaggaaaagatcatgagagtgccgtatgggacagaaaaggagtatttcaagcattcactgtttcttgttttctgcaaccgcatcacaacatctgctgtttctgctggttctttgctggcaagtaaaaaagtgttggacccggtagctcccatttataagtactgccttatctcggtttcaaacatactaactacaacttgccagtatgaggccctcaaatatgttagttttcctgttcagacccttgcaaaatgtgcaaaaatgataccagttatggtctggggtgccctcattatgcagaagagataccagggacctgactatttgttggcttttttagttacccttggctgctcagcatttatcctatatccggcaggaacagacatgagtccttacagtagaggaagggaaaatacagtttggggcattctcctaatggttggctatcttgggtttgatggatttacaagcacattccaagataagttgtttagaggctatgacatggagatacataatcagatattttacacaacattgtgctcttgtgttcttagcctgacaggtcttatcttacaaggacatttaataccagctatagaatttgtttatcaccatcatgattgtttctttgacatagcattgctttcgactgttgccacaattagtcaattttttatttcatacacaattcgcaccttcggtgctctgacatttgcaaccataatgaccacaagacagttggtgagcattatgctgtcatgtgtgtggtttgcccatcctcttagctgggaacagtggattggagctgtcattgtctttggctccctttatggaaaaagcttctcgaggaaaatgcctcagaagacaaccccctctatagcacttgttcaaaatggggatccaaataatttgaaggacaatctgtga

SEQ ID NO: 2573 - DNA, 795 bp, Glycine max var. Williams 82
atggttcaacaggaagtgcgtaaaggtccttggacagaacaggaagacttcaaattggtgtcctttgttggattgtttggagaccgtagatgggactttatagctaaggtatcaggtttgaatagaacaggtaagagttgcagattaaggtgggttaattacctacatcctggcctcaagcgtggaaagatgaccccccaggaagaacgccttgtcttggaacttcactcaaaatggggaaataggtggtcaagaattgctcgcaagttaccagggcgcactgacaatgagatcaagaattactggaggactctgatgaggaaaaaggctcaggagaaaaagcgaggagaagctgcatcgtcatcaccaacaccctctagcgttgattcctcaatatcctcaaacaaccatgcagtggatccacatgcttccaagaaggcaggagaagagagcttttatgacacaggaggtgataatggtgtgatagccgcaacccaagatcagggtcaaaaaggtgatcaacaagggttgttctctatggatgatatatggaaggatattgacaatatgtcagaagagaacaacactactcttcagccagtgtcagtgtatgatgggcacagtgaagagggttgcaacttctcttgcccaccacaagtgccttctccatcatcatgggaatattcttcgtctgaccctctatgggtgatggatgaggaaagtttgttttgccctttgagtgaagaaccatatttttcctgctatgcacagggcaccgtttttttaaccggctaa

SEQ ID NO: 2574 - DNA, 2322 bp, Glycine max var. Williams 82
atgggaaaggacttggtttcttctgaccagaccactgttcaaattcaggacaataatccaggatgcatgtggggcatgcttcaaattcttgattaccatcgttggcgcgtaaaaaaggtgtttcctcacaaaaggagaaaacatgccacatataagagaaaacccattttgtatgaccaacatgaagaccaacaacatggagttacagaagcagaatccctccttgtcgggcaacatagcgaaaaattgcatgctgcaggcagaagttctcccaagaatcgcaaaaaggaaccatgcactgagaaaaaggttaacaacgaaaactccaaaggcggtagaaccatggactactcaaggaaaaaccaagccagtaatgagtatgcacttcatctggagaaagatggcaagacaacagaagatgaccttaaccataagcctatggaaacaaacaagcataacagaaacatttccaataaatttgagaaacatactgatgttttcgagttacttagagtggagaaggatttattactcaaatttcttcgagacacagactttggtgggaaaaaagtccaacaagcatcccacatcaatgcaagattgacaaaatctgggtcatttcctttagcctcaacttcacagatgagaaacataagctctaggtccttaaaacacaagcaaaacgaaatttgggcccttccaaagggagaaaagttgcatgctggtactcaagaatcaaacatgtcagtgtccagttctgtgaaagataattcttatgagaatccaatgcctttagcgagtgatcttggtgtggatagtaccatgaaacaaaaagcattcttttctttaaggccttctcagggatcaaatcacaaaggttggaatcaagcggttcttcatcatttcaaagttataaaacagaagataaaacatgctcttgtggaattcagaaaaagcggttgccaagctacttctgctgaagcaattcaccatagggattcacctgaatatagcatgaacaaaaatgaggaagagatctcacaaagcttagaagatggtgtggttcaacaattcaaaagaagtaaaagctcaaatgaaactagagcttctgattatgattccaacaagcatgatgctcgcctcatgcgaagaacatcctctctgaatgaatcgttggatagatatactcagttgtttgagaaaagcttcagcgaagacactaagtggcaaagctcaaagtctaaaagcttaaaattgacaaacgaggataagatccacaagaatgggcacactcctaggttttcaagaagcaatttgtctatgcctaatctcgagactttaggcttcattctacaagatgcactttttgatacaaatgatatagggaataaagtggaagcttataatcgtgttcatagaaaatcagtgagtcttcctttgaagatagacaggtcacttgatcattttaaagaggctgaaattgtggaaacagtagaagggagtgagagagatgtaaatcccaatcttttatcagataagattatggagaaaattgatgaagaagttacctgtgaccagaaggaggacatgaatgagccagcggtgggagatggaagttttcccgaagaaaaagaggaaatgagtaatatgactacctatcttcgcaaggaggtgatggcaactcttgaaactagctttgaggacactaaaaccagccatgaaggtacaaaattgaattcactaagatctacattggacgaattagagactgatctatcatattcatctgacagaaatgctagtgtgacagctgaagacacagacaacacttccgatttcaaatatgtgaaaaatattcttgaattttcgggctacttgagaaatgagcacactcagatgccatacacagtagaccagccgctaaagccctccatattcaaagatttggatgcaactttgcgccatgaaattgaaccctctgaagaagagacaatcaaccaccagcttctttttaacttagttaacgaggtgctgcttgaaatatatggaaggtctccaacttacttcccaagaccattctcattcaacccccgcctccattcaatgcctaaagggaactatcttctgaatgaagtatggaatagtgttaattcatacctgaacttgaaacctgagctagatcagacactagacgatgttgtcggtcgtgatttggcaaaaggaaaaggctggatgatccttcaagaggaagaggagtatgtagcacttgaattagaggaaatgatcatggatgagttgttagatgaatttatcttctcatga

SEQ ID NO: 2575 - DNA, 6996 bp, Glycine max var. Williams 82
atggatccagaaagatcagtagaggatcaattctccaagctgcatccttccatgccagtaaacaccagaattggaatagtgggtgctggtccaagtggcttatcagttgcttatgcactggtcagacttggttataataatatcactgtcttggagaagcatcatacagttggtggcatgtgtgaatcagttgaaattgaaggaaaaatatatgatctaggtggccaagttttggctgcaagcagtgctcctgtcatctttcacttggcaaaagagacaggctgtacactagaagaaatgaactcccacaagcttgctgttattgacagctcctctggaaaataccaagatgttaaagttgctgatgattatgtatctgttatgtcactaacattgcaaatccaagaaaaggtgaagaattctggtcgttttggggttcatgctctcagtgaagttgcttcagacttagctccagattatcttgagcgtcatggacttaaatctgttcctaaatctgtggcttatggttatactgcttcaggatatggatttattcaagacatgccttatgcttacattcatgaatttaccagaacttccatggctggaaaaattcgacgattcaaaggtggatatacaagtctttggcagaggattgctgaatcaattccaataaaacttcactatagcactgaggtgttggcaatcaggcggaactctgacactgtcactgttaatgtcaagggctcaaatgaaatcgaaactatggaatttgataagatcataatctctggtaactttccattaaaatatggaagaacttatagatcggcgccttcaacttgcttagagaatgaaacagaagtaatggatgcaagtgagcttgaaaaggatttattcagcaaagtagaaacaaatgactactacacaacagttttaaagatcaaagggctggaacgtatgccggttggattttattattttagtgaatatatggaagatcccagcacaattggaaatccagttgccatgcagaaattttatgctgacagtaacatattcttgttctggtcctatggaaactctgctgatattaagggaccaactgtcactgagcttgcaatcaaatcaatagaatccatggggggagaagttcagaatatcattcttcaacgtcgctttaagtattttcctcatgttagcagtcaagatatgagaaacggattctatgaaaagttggagtcagagcttcaaggctcgaggaatacttattatgttggtgggcttatggcatttgagcttacagagagaaattcatcttatgccatggctttgatctgcaagaactttgcaaatagcagtgatttgccagtgtttccttacactaagagtttgtttcccttgcaaactgatatccagaaaaaggagcctaaagaactagttgaattgcctggagtgcaatttcccaatttgcctgctttgaatagctatttaaagcactggggaactcatccaatcactcaaaacagaactctttatacttggctaaatgaaggagggactgtggttggcaagaggacatatggagaacaacatttaaatgcttcttgcattgcacataagctcttaacaagccaaaagccggttatcaagcctggtgacagggttctcctagtctatgttcctggcctagattttgttgatgccttctttggatgtctaagagctaaagttttaccagtcccagttcttcccccagaccccatgcagagaggtggacaagcacttcttaaaattgagaacattgccaagtcatgcggcatagtggcaattttatcaacggcatcttaccacacagcagtacgtgccggtctagtgaaaagcttgatctcattaactgggaaaaatggtaaatacacagctcaatggccaaaacttccgtggctgcacaccgatacttgggtcaataactcaagaaattcggctgtggaagatgtagatgatcaatgtgaaccccagcctggtgatgtatgtttcttgcagtttacctcaggttcaactggtgatgctaaaggagtcatgataacacatggagggctcgttcacaatgtgaagttgatgagaagtagatacaagagcacctcaaggacagtgctagtgagttggcttcctcaatatcatgacatggggctgattggaggactttttacagctcttgttagtggtggatctgctgtactgttttcaccattgacatttattaagaagccactcttatggcttgaaaccatcagcaagtatcaagcaactcacagtgccggacccaactttgcttttgagttggtggttcgaaggttagagtccgagaaagacaagcttcagagtttagacctttcatccatgattttccttatggttgctgctgagccagtgaggatgaagaccttgaaaagatttcttgatctaaccactccttttggcttatctcaaaaggtgatggctccaggatatggcttagcagaaaattgtgtgtttgtgagttgtgcatttggagaaggatgtcctattcttgttgattggcaaggaagagtttgttgtggatatattcacccaggcgattcagacgttgacattataatagttgatccagagagtggtgaagagcttgaggaagatggaagggaaggagaaatctggataagtagtccaagtgctggaataggatactggggaaaggaagaactgagtcagaaaacttttagaaataagcttcagaaccatcctggacgcaactacacaagaactggagacttgggaagaattatagatgggaagctattcatcactgggagaatcaaggatcttatcattgtggctggaagaaacatctactcagcagatgttgaaaagacggttgagagttcatctgaatttcttcgtccgggatgctgtgcagtcattggtgtccctgaggagattttatcagcaaaggggatttccctgccagatggatcagaccaagttggcttggttgtggttgctgaagtaagggatggtaaaacagttagcaaagatgtgattgagcatattcagacacgtgtggttgaagaacatggagttagtgttgcttctgtcaagttgatcaagccaagaaccatcagcaaaacaacatcaggaaaaatcaagagatttgagtgtctcaaacagttttcagatgaaacactgaacctggttccacaacctattttgacaaagaaatcactgttgaggtcatttactacaggaacatgcagagaaggaagaacacctcgggcacatttggtgagaagtagttctcctctacctattccaagaatcagcaacaaggaaattgtggaacacttgaaaaggattatttctgaccagtctggaatcccggtcaacaatatctcagtcacagacaacatgtcaacctatggaattgattcaattggagtggtcaaagcaactcaaaaactcacagatttcctgggagtgccagttgcggctatagatgttttcactgcatcatgcattcaagaattggctaacttctctgagaatcttctactcaagtctcaacctcaactcatgagcaattcaccacatgctccagaagctgaaattgattttactgaagtggttgtggatgtatccaagtctcgccaatggggtatccgtttacttcaactcctagcacttgtttatatttctatcatgctggtcactcctgcttatctatccatcactgcttttcaaagtttcataccaaatgccagtgaatcggtatatggaatgccttggtcaagctatttgatttctttgactttggcaccactttcttggatcctttgcatagtttccacttgcctttgcatttccttttttgggaattctttcttgaggccaaactatgcccttacacctgaaatatccatttattcaatggattttgttaagtggtgggcgctctataaaactcaggaaatttcttcaaaagttttggcaacacacctcagaggaacagtgtttctgaaatactggtttgagatgctcggtgcaagaattggatccttagttttgcttgacacagtggacatcaccgacccatctctggtttcaattggagatgaagttgccattgcagaaggggttttggttcaaagccatgaggtgaagaatggaattctaagtttccttcctattagaataggtaaaaattcttcaattggaccttattctattattcaaaaaggaagtatcatcaaagaaggatctgaagtacaacccctgcaaaaggttgaaggaggccaacatgtactcaaacctgctaagcataataacgttaaagagaatgccctgttgcttgtttctaccagcaaaatacagtccaatgccatgtaccattttctggggatctatctcactggctttctcagctcccttgcttcagctattgcttacatcttgtacataaggctcttccagatacctgcatcattccaacacttctcatttctttgtgtatgcggtgccttccactggatcccatttaccgttgttgcatatgccaccatgttttctgatgtcccatcaaatcccattgcctttaccatttcatttaccagcgcatatctgcttcatggcctcatactcacctctctcacttgtgctttgacacgtttgctaaaattcaaccaaaatcaaacccatttcaaaacctggcttagacatcaattgaccatttcctgccaccatagatttgcaaagcttctctcaggaacagaagccttctgcttatatttacgccttttgggtgcaaaaattggcaaacactgttccattagagccatcaacccagtttctaaccctgagttaatgtcaataggcgatggtgtccatcttggtgatttcagcaagataatcaccggttttcactattccaatggatatgcttgtggaaaagtagaggttcaggataattcagttgtggggagtcaaagcctaatcctcccaggttctgttgtagaaaagaatgtcattctaggtgcactttcagttgctccaatgaattctatcctccatgagggtagcgtgtatatcggatctcaaacccgagttgcaaccagaaactcttcgtatcatttagatgaaaggatagaggagatggacatggagtacaaaaaagtagttgcaaacatggctgcaaatttagccgtcactactattaatgtcaaagcaagatatttccaccgcattggtgttagtggaaagggacacttgaaaatctatgacaaacttgatggcaatattccactacacaagattttttaccctggaaaaagctaccctatcatgttaagacacagtaatagcttgagtgctgatgatgatgcaaggattgatgcacgtggtgcagctttgaggattctttctgatgaatcaccagattctaataacctgcagcatgcttccctcattgacctgacactaaaaactggcaacgcattttatgctcgcactcttgctgattttgcaacctggcttgtgtgtggacttccagcgagggaggaacttgttaagcgcaccccacatgttcgtgatgcagtgtggaattcccttagacatgcaaactcatacgctgaattgcactactattcaaacatttgcaggcttatgcgcttcactgatggacaagaaatgtacgtgaagtttaagctaagacctattgacacaagcattagtgaggacacaggtaaggttgtaccaactgggattcttccaccagaaacgggtgcaattcctagggatgaaaaggacacacgtcctttgcttttccttgctcaagattttcaacgccgtgtgaattctcctggtggagtttgttatgtgtttcaattgcaactccgagcagtgccagaagatgaagccgcacgtgacattgcactggactgcaccaaaccatgggatgaaaatgagttcccttacattgatgttggagaggtaaacatcaatgagaatctctctacggaagaatcagataggcttgaatttaacccttatctcaaaagccatgagttggatgtgatccctgctacttccaacacccaaagtgcttcaattgatcatggccgttcattgatctatgagatttgccagcacgttcgtaacagacagccactcccagaatcttggaggaacctcgtagagcaatctaacgttaaggtagacttgtcttgctgtcccgtggcagcagcattgcccaaaaaggagacgacaaagaaagttacaacaaccttaaccttgacaagaacctggtaccagacattctcagcacttttcactcaaccgttgctgcaaactgttttgccttacacggtgatgggtttagcagtttttgctcctttgaactttcttgttaaccttaagaacgttgagaaactccaagtgcaatggttctttcctttgttttgggttgtctcgggtgtcatggctgcactggcatgtgttgtgaccaaatgggttctcgtgggaagaaaaaaagagggtgaaaccgtgcccttatggagcaaaagggtaatcatggatagcacgtggcaagcgattagaaccttggttggggattatttcatggacatggcaagtgggtcgtttttgtttgtgatgtggatgaagttgatgggtgcggacatagacatggatggtggtggggcctacgtggacagcaccggggctatgttgaaccctgaaatggtgacgattgagagagggggttgtgtgggaagagaggcattgctatttggacacatatatgaaggtgatgaaggtggaatggtgaagtttgggggaatcaaaattggtgaagatgggtttgtgggaagtagagctgtggtcatgcctggtgtgcatgtggagaatgaggccaatctttctgctttgtctctcgccatgaaaggagaaacagttaggtcaagataa

SEQ ID NO: 2576 - DNA, 7060 bp, Glycine max var. Williams 82
tcaagattgacaagcaagtgctatacacctctcatatctaaggtttcaggatttgaaatcagagatggatccagaaagatcagtagaggatcaattctccaagctgcatccttccatgccagtaaacaccagaattggaatagtgggtgctggtccaagtggcttatcagttgcttatgcactggtcagacttggttataataatatcactgtcttggagaagcatcatacagttggtggcatgtgtgaatcagttgaaattgaaggaaaaatatatgatctaggtggccaagttttggctgcaagcagtgctcctgtcatctttcacttggcaaaagagacaggctgtacactagaagaaatgaactcccacaagcttgctgttattgacagctcctctggaaaataccaagatgttaaagttgctgatgattatgtatctgttatgtcactaacattgcaaatccaagaaaaggtgaagaattctggtcgttttggggttcatgctctcagtgaagttgcttcagacttagctccagattatcttgagcgtcatggacttaaatctgttcctaaatctgtggcttatggttatactgcttcaggatatggatttattcaagacatgccttatgcttacattcatgaatttaccagaacttccatggctggaaaaattcgacgattcaaaggtggatatacaagtctttggcagaggattgctgaatcaattccaataaaacttcactatagcactgaggtgttggcaatcaggcggaactctgacactgtcactgttaatgtcaagggctcaaatgaaatcgaaactatggaatttgataagatcataatctctggtaactttccattaaaatatggaagaacttatagatcggcgccttcaacttgcttagagaatgaaacagaagtaatggatgcaagtgagcttgaaaaggatttattcagcaaagtagaaacaaatgactactacacaacagttttaaagatcaaagggctggaacgtatgccggttggattttattattttagtgaatatatggaagatcccagcacaattggaaatccagttgccatgcagaaattttatgctgacagtaacatattcttgttctggtcctatggaaactctgctgatattaagggaccaactgtcactgagcttgcaatcaaatcaatagaatccatggggggagaagttcagaatatcattcttcaacgtcgctttaagtattttcctcatgttagcagtcaagatatgagaaacggattctatgaaaagttggagtcagagcttcaaggctcgaggaatacttattatgttggtgggcttatggcatttgagcttacagagagaaattcatcttatgccatggctttgatctgcaagaactttgcaaatagcagtgatttgccagtgtttccttacactaagagtttgtttcccttgcaaactgatatccagaaaaaggagcctaaagaactagttgaattgcctggagtgcaatttcccaatttgcctgctttgaatagctatttaaagcactggggaactcatccaatcactcaaaacagaactctttatacttggctaaatgaaggagggactgtggttggcaagaggacatatggagaacaacatttaaatgcttcttgcattgcacataagctcttaacaagccaaaagccggttatcaagcctggtgacagggttctcctagtctatgttcctggcctagattttgttgatgccttctttggatgtctaagagctaaagttttaccagtcccagttcttcccccagaccccatgcagagaggtggacaagcacttcttaaaattgagaacattgccaagtcatgcggcatagtggcaattttatcaacggcatcttaccacacagcagtacgtgccggtctagtgaaaagcttgatctcattaactgggaaaaatggtaaatacacagctcaatggccaaaacttccgtggctgcacaccgatacttgggtcaataactcaagaaattcggctgtggaagatgtagatgatcaatgtgaaccccagcctggtgatgtatgtttcttgcagtttacctcaggttcaactggtgatgctaaaggagtcatgataacacatggagggctcgttcacaatgtgaagttgatgagaagtagatacaagagcacctcaaggacagtgctagtgagttggcttcctcaatatcatgacatggggctgattggaggactttttacagctcttgttagtggtggatctgctgtactgttttcaccattgacatttattaagaagccactcttatggcttgaaaccatcagcaagtatcaagcaactcacagtgccggacccaactttgcttttgagttggtggttcgaaggttagagtccgagaaagacaagcttcagagtttagacctttcatccatgattttccttatggttgctgctgagccagtgaggatgaagaccttgaaaagatttcttgatctaaccactccttttggcttatctcaaaaggtgatggctccaggatatggcttagcagaaaattgtgtgtttgtgagttgtgcatttggagaaggatgtcctattcttgttgattggcaaggaagagtttgttgtggatatattcacccaggcgattcagacgttgacattataatagttgatccagagagtggtgaagagcttgaggaagatggaagggaaggagaaatctggataagtagtccaagtgctggaataggatactggggaaaggaagaactgagtcagaaaacttttagaaataagcttcagaaccatcctggacgcaactacacaagaactggagacttgggaagaattatagatgggaagctattcatcactgggagaatcaaggatcttatcattgtggctggaagaaacatctactcagcagatgttgaaaagacggttgagagttcatctgaatttcttcgtccgggatgctgtgcagtcattggtgtccctgaggagattttatcagcaaaggggatttccctgccagatggatcagaccaagttggcttggttgtggttgctgaagtaagggatggtaaaacagttagcaaagatgtgattgagcatattcagacacgtgtggttgaagaacatggagttagtgttgcttctgtcaagttgatcaagccaagaaccatcagcaaaacaacatcaggaaaaatcaagagatttgagtgtctcaaacagttttcagatgaaacactgaacctggttccacaacctattttgacaaagaaatcactgttgaggtcatttactacaggaacatgcagagaaggaagaacacctcgggcacatttggtgagaagtagttctcctctacctattccaagaatcagcaacaaggaaattgtggaacacttgaaaaggattatttctgaccagtctggaatcccggtcaacaatatctcagtcacagacaacatgtcaacctatggaattgattcaattggagtggtcaaagcaactcaaaaactcacagatttcctgggagtgccagttgcggctatagatgttttcactgcatcatgcattcaagaattggctaacttctctgagaatcttctactcaagtctcaacctcaactcatgagcaattcaccacatgctccagaagctgaaattgattttactgaagtggttgtggatgtatccaagtctcgccaatggggtatccgtttacttcaactcctagcacttgtttatatttctatcatgctggtcactcctgcttatctatccatcactgcttttcaaagtttcataccaaatgccagtgaatcggtatatggaatgccttggtcaagctatttgatttctttgactttggcaccactttcttggatcctttgcatagtttccacttgcctttgcatttccttttttgggaattctttcttgaggccaaactatgcccttacacctgaaatatccatttattcaatggattttgttaagtggtgggcgctctataaaactcaggaaatttcttcaaaagttttggcaacacacctcagaggaacagtgtttctgaaatactggtttgagatgctcggtgcaagaattggatccttagttttgcttgacacagtggacatcaccgacccatctctggtttcaattggagatgaagttgccattgcagaaggggttttggttcaaagccatgaggtgaagaatggaattctaagtttccttcctattagaataggtaaaaattcttcaattggaccttattctattattcaaaaaggaagtatcatcaaagaaggatctgaagtacaacccctgcaaaaggttgaaggaggccaacatgtactcaaacctgctaagcataataacgttaaagagaatgccctgttgcttgtttctaccagcaaaatacagtccaatgccatgtaccattttctggggatctatctcactggctttctcagctcccttgcttcagctattgcttacatcttgtacataaggctcttccagatacctgcatcattccaacacttctcatttctttgtgtatgcggtgccttccactggatcccatttaccgttgttgcatatgccaccatgttttctgatgtcccatcaaatcccattgcctttaccatttcatttaccagcgcatatctgcttcatggcctcatactcacctctctcacttgtgctttgacacgtttgctaaaattcaaccaaaatcaaacccatttcaaaacctggcttagacatcaattgaccatttcctgccaccatagatttgcaaagcttctctcaggaacagaagccttctgcttatatttacgccttttgggtgcaaaaattggcaaacactgttccattagagccatcaacccagtttctaaccctgagttaatgtcaataggcgatggtgtccatcttggtgatttcagcaagataatcaccggttttcactattccaatggatatgcttgtggaaaagtagaggttcaggataattcagttgtggggagtcaaagcctaatcctcccaggttctgttgtagaaaagaatgtcattctaggtgcactttcagttgctccaatgaattctatcctccatgagggtagcgtgtatatcggatctcaaacccgagttgcaaccagaaactcttcgtatcatttagatgaaaggatagaggagatggacatggagtacaaaaaagtagttgcaaacatggctgcaaatttagccgtcactactattaatgtcaaagcaagatatttccaccgcattggtgttagtggaaagggacacttgaaaatctatgacaaacttgatggcaatattccactacacaagattttttaccctggaaaaagctaccctatcatgttaagacacagtaatagcttgagtgctgatgatgatgcaaggattgatgcacgtggtgcagctttgaggattctttctgatgaatcaccagattctaataacctgcagcatgcttccctcattgacctgacactaaaaactggcaacgcattttatgctcgcactcttgctgattttgcaacctggcttgtgtgtggacttccagcgagggaggaacttgttaagcgcaccccacatgttcgtgatgcagtgtggaattcccttagacatgcaaactcatacgctgaattgcactactattcaaacatttgcaggcttatgcgcttcactgatggacaagaaatgtacgtgaagtttaagctaagacctattgacacaagcattagtgaggacacaggtaaggttgtaccaactgggattcttccaccagaaacgggtgcaattcctagggatgaaaaggacacacgtcctttgcttttccttgctcaagattttcaacgccgtgtgaattctcctggtggagtttgttatgtgtttcaattgcaactccgagcagtgccagaagatgaagccgcacgtgacattgcactggactgcaccaaaccatgggatgaaaatgagttcccttacattgatgttggagaggtaaacatcaatgagaatctctctacggaagaatcagataggcttgaatttaacccttatctcaaaagccatgagttggatgtgatccctgctacttccaacacccaaagtgcttcaattgatcatggccgttcattgatctatgagatttgccagcacgttcgtaacagacagccactcccagaatcttggaggaacctcgtagagcaatctaacgttaaggtagacttgtcttgctgtcccgtggcagcagcattgcccaaaaaggagacgacaaagaaagttacaacaaccttaaccttgacaagaacctggtaccagacattctcagcacttttcactcaaccgttgctgcaaactgttttgccttacacggtgatgggtttagcagtttttgctcctttgaactttcttgttaaccttaagaacgttgagaaactccaagtgcaatggttctttcctttgttttgggttgtctcgggtgtcatggctgcactggcatgtgttgtgaccaaatgggttctcgtgggaagaaaaaaagagggtgaaaccgtgcccttatggagcaaaagggtaatcatggatagcacgtggcaagcgattagaaccttggttggggattatttcatggacatggcaagtgggtcgtttttgtttgtgatgtggatgaagttgatgggtgcggacatagacatggatggtggtggggcctacgtggacagcaccggggctatgttgaaccctgaaatggtgacgattgagagagggggttgtgtgggaagagaggcattgctatttggacacatatatgaaggtgatgaaggtggaatggtgaagtttgggggaatcaaaattggtgaagatgggtttgtgggaagtagagctgtggtcatgcctggtgtgcatgtggagaatgaggccaatctttctgctttgtctctcgccatgaaaggagaaacagttaggtcaagataa

SEQ ID NO: 2577 - DNA, 387 bp, Glycine max var. Williams 82
atgatcctaacgccaacgccacgtgtcagagctcttcctctccttctgctcagtaactgcatggacatcactgtgccaaccttgaatggatggcttctaggctacccggtggtctatctgtttggcaaggagcatatttctgatgccatttataatcttgcaaccaaatatcttcatattttttatgccatttatccatgctttacgaatagtactctcaagaaagggactcaagcagaaaagctgttaagcatgagagggagcaatgaacaatgggcagaggcttttctggctcgcatgcaagcaaagtgggaaaggtgtgcaagtgcttggaagtcgttaaagatggaggttattgagtgtcatcctcaagctatcgtgttataa

SEQ ID NO: 2578 - DNA, 825 bp, Glycine max var. Williams 82
atgataggaaagaaattcttatgcgttgttgtagcggtggcctttgttatgataacaaaggtgccccaaaatgtgagtgctcaaaactgtggttgtgctgaagggttatgttgcagccaacatgggtattgtggtaacggtgaggagtactgcggcacagggtgcaagcagggtccttgttattcgagcacaccaagtactaacaatgttaatgtggctgacattgtcacaccacaattcttcagtggcataattgatcaggctgactctggctgtgctggcaagaacttttactcacgagatgcttttcttaatgctctcaattcctataatgactttggtagacttggttcccaggatgactccaagcgcgagattgcagctgcttttgcccatttcacacatgaaactggacatttttgccacattgaagagattaatggtgcatcgcaggactactgcgacgagaatacgatttcacagtatccgtgcctttctaacagaggctactatgggcgtggtccgattcaactaacatggaacttcaactatggacctgctggacagagcaacgattttgatggattgaacgctcctgaaacagtgggcaatgatcctgtgatttctttcaagacagcactgtggtactggatgcaacacgtgcgccctgtcatcaaccaaggctttggtgcaaccatcagagccattaacggtcaacttgaatgtgatggtgccaacccttccacagttcaggctcgcgttaattactacactgactactgtagacaattcggtgttgccaccggtgataatcttacttgctaa

SEQ ID NO: 2579 - DNA, 2601 bp, Glycine max var. Williams 82
atgttttcagttccaggggtgtcgggaatcctgaacagaggaggagggcataagataaaagggacagtggtgttgatgaggaagaatgtgttggacttcaacagcgtggctgatcttactaaaggaaatgttgggggactcataggcaccggcctcaacgttgttggctcaacacttgataacctcactgctttcttgggccgaagtgtcgccctacagctcattagtgctaccaaacctcttgcaaatggaaaaggaaaagttggaaaggatacgttcttggaagggattattgtgtcgttaccaactttgggagcaggggagtctgcattcaatattcagtttgaatgggacgaaagcatgggaatccccggtgcgttttacataaagaactacatgcaagttgagttttacctcaagagtttgactcttgaagacgttccaaaccaaggaaccattcgctttgtttgcaactcatgggtttataacactaaactttacaaaagcgtgcgcattttctttgccaaccatacatatgttccaagtgagacaccagcagcacttgtggggtacagagaagaagaattgaagaatttaagaggagatggaaaaggagagcgcaaagaacatgataggatctatgattatgatgtctacaatgatttgggcaatccagatcacggtgaaaattttgctcgcccaattcttggagggtctagcactcatccctaccctcgtaggggaagaactggtcgatatccaacaaggaaagatcagaattctgagaagccaggcgaagtttatgttccaagagatgaaaattttggtcacttgaagtcctcggattttcttgcatatggaataaaatctttatctcaatatgtcttaccggcgttcgaatctgttttcgatttgaacttcacgccaaatgagtttgatagcttccaagatgtgcgtgacctccacgaaggtggaattaagcttcctacagaagtaattagcacaattatgcccttaccggtggtcaaagaactctttcgtacagatggtgaacaagtcctcaagtttccaccacctcatgtcattcaagtgagtaagtctgcatggatgaccgatgaagaatttgcaagagagatggttgcgggtgtaaatccatgcgtaattcgtggtcttcaagagtttcctccaaaaagcaatctggatcctacaatctatggtgagcaaaccagtaagataacagcagatgcccttgatctagatggatacacagtggacgaggcactagcaagtcggaggttatttatgttagattaccatgatgtattcatgccatatataaggcggataaatcagacatatgccaaggcttatgcgacaaggactatcctttttctgagagaaaatggaaccttaaagccagtggccatcgaattaagtttgccacatcctgctggggacctgtcaggtgctgtcagtcaagtcatcttacctgcaaaagaaggtgttgaaagtacaatttggctactggccaaagcttatgtggtcgtaaatgactcttgctatcatcaactcatgagccattggttaaatactcatgcggtgattgagccattcatcatagcaacaaaccgacaccttagtgctcttcacccaatttataagcttctaactcctcactaccgtgacaccatgaacatcaacgcacttgctaggcaatctctcattaatgctgatggcataatagagaaatcttttttgccctcaaagcattccgttgagatgtcttcagcggtttataagaattgggttttcactgatcaagcactacctgcagatcttatcaagagaggagtggcaattaaggatccatctgccccacatggacttcgacttctgatagaggactacccttatgctgttgatgggctagagatatgggctgcaattaagacatgggtccaagaatatgtgtccttgtactatgcaagagatgatgatgtcaaacctgattctgaactccaacagtggtggaaagaagctgtagagaaaggtcatggtgatctgaaagacaagccatggtggcctaagttgcaaacaattgaagagcttgttgaaatttgcaccattatcatatggactgcttcagccctccatgcagccgttaactttggtcaatatccatatggaggtttcattctgaatcgcccaacttcttctagaaggttgcttcctgagaaaggcaccccagaatatgaagaaatggtgaaaagtcatcaaaaggcttatttgagaactattacatcaaagtttcaaactctagttgacctttcagtgatagagatcttgtcaaggcatgcttctgatgaggtctaccttggccaaagggacaacccacattggacctctgactcaaaagcattacaagcctttcaaaaatttggaaacaagctcaaagaaattgaggaaaaacttgcaaggaagaacaatgatcaaagtctctccaatcgacttgggccggttcaactgccatacactttgctccatcctaacagtgaggaagggttgacttgcagggggattcctaatagcatctctatctaa

SEQ ID NO: 2580 - DNA, 1801 bp, Glycine max var. Williams 82
ttgaatcctacatttccaaatgtgtatcctgtaccctccatttgtgtttgaaaatatcaaatactcttctccaatcctagcacctttcttttggtgccaattactcccagagcgatacctcctcttcacccgtaacaacaacttcttctcccacaagttcacctttttcacagtagtctagcgacctcctcctcacaagtcacaacaccatagaacatcctccccctcttccttcctttgcgcgtccctattgaagcaaaacggtttcttttctccaatgggtgcttcgggaaggtggtttaagtcacttcttccttttagaaagacctcaactgatcaagagaagggtggtgacaacaagagtaagaagaagcggaagctatggagggcatcttcagaagggtccatgaagaatgttggtggtggtggtgctgctgctgcatctgattcttcccttacttatgcggtggctgtgatggttcccaaagatttcaagctcatcaagcaggaatgggctgccatccgcattcaggcggtgtttcgagccttcttggctagacgagctttgagggccttgagggcagtagtaaggctacaagctatttttagaggccggctagtcaggaagcaagcagctgttactctgaggtgcatgcaggctcttgttcgagttcaagcacgtgtgagggcaaggaatgtgaggaattctcctgaagggaaagctgtgcagaaattactggatgagcatcacaaccacgctgatccttttaatctaattgagcaaggatggtgtgacattcctggaactatggatgaagttaaagcaaagctacgaatgaggcaagaaggagccatcaagagggatagagcaatggcatactctctctccactcagtcaagactgtgtgctagtccaaacccaaaagccactaaggcattgactcctgtcaagcataacaacccaagcaacaagagcttaggatatagcttgttggaacgctggatggaggccaagccatgggagagtccaatctctaggaagagtgaagaccttgttcctgcttttcaatcaagaaggaatggtatgacaactaggatttcagttaagcctattataaccagtcaatcgacttcaccatcttcggccatgagctctgagtacatgtgtgatgataatagccctgtgtcaacatcttatacctctggatctctatccttgccatccaccaacactgttttggtggaagcaacagaggaaagagatgttcatcagccaagctacatgaatttgacagaatcaactaaggctaaacttaaagcctgcaggagttcttcacagaattcaaagagacttgtaatggaggacacagtgtctcacaatcacagcacaacaacaggccttatgaatggagatactagaagcagttttgattctgatccttcagttaacttgtggaaggattcttgtgcgacacctctaagggcaagttatcaaaaacgacaaattaggatatgagtttctgtaacagtggcagatgtgttgtttactttcaatgagttcaacagcttgttgtccgtagtcaagaccttgacaaattaggatgagtttctgtaacagtggcagatgtgcaagttaggatagagggctaattggctgtgtagataacataagtggttttgttttattttgtgtgaagaatgaaatagcaaactagtacactacttcaatctgtatggtgctttgtacactaatatatggtttatgtatgaattatctaactcgagtagaaatcgagctttt

SEQ ID NO: 2581 - DNA, 2006 bp, Glycine max var. Williams 82
aaatactcttctccaatcctagcacctttcttttggtgccaattactcccagagcgatacctcctcttcacccgtaacaacaacttcttctcccacaagttcacctttttcacagtagtctagcgacctcctcctcacaagtcacaacaccatagaacatcctccccctcttccttcctttgcgcgtccctattgaagaacatgagccgtggcgttgtgaagagggtgtgaggggaagaaggtggcgcgggacaaggaggagccgttgtgagagctaccatggcaggttggatggtttccgaaggagagaggtgttagggttgagaaaggaggtattaattcattaacggtggtttagctagtgatagggtcaaattggagcgtgcgtgggaaataaacaaagaaaaagtgcttcacagcagaagctacctctcctcttactcgctccgtttgctcagcaaaacggtttcttttctccaatgggtgcttcgggaaggtggtttaagtcacttcttccttttagaaagacctcaactgatcaagagaagggtggtgacaacaagagtaagaagaagcggaagctatggagggcatcttcagaagggtccatgaagaatgttggtggtggtggtgctgctgctgcatctgattcttcccttacttatgcggtggctgtgatggttcccaaagatttcaagctcatcaagcaggaatgggctgccatccgcattcaggcggtgtttcgagccttcttggctagacgagctttgagggccttgagggcagtagtaaggctacaagctatttttagaggccggctagtcaggaagcaagcagctgttactctgaggtgcatgcaggctcttgttcgagttcaagcacgtgtgagggcaaggaatgtgaggaattctcctgaagggaaagctgtgcagaaattactggatgagcatcacaaccacgctgatccttttaatctaattgagcaaggatggtgtgacattcctggaactatggatgaagttaaagcaaagctacgaatgaggcaagaaggagccatcaagagggatagagcaatggcatactctctctccactcagtcaagactgtgtgctagtccaaacccaaaagccactaaggcattgactcctgtcaagcataacaacccaagcaacaagagcttaggatatagcttgttggaacgctggatggaggccaagccatgggagagtccaatctctaggaagagtgaagaccttgttcctgcttttcaatcaagaaggaatggtatgacaactaggatttcagttaagcctattataaccagtcaatcgacttcaccatcttcggccatgagctctgagtacatgtgtgatgataatagccctgtgtcaacatcttatacctctggatctctatccttgccatccaccaacactgttttggtggaagcaacagaggaaagagatgttcatcagccaagctacatgaatttgacagaatcaactaaggctaaacttaaagcctgcaggagttcttcacagaattcaaagagacttgtaatggaggacacagtgtctcacaatcacagcacaacaacaggccttatgaatggagatactagaagcagttttgattctgatccttcagttaacttgtggaaggattcttgtgcgacacctctaagggcaagttatcaaaaacgacaaattaggatatgagtttctgtaacagtggcagatgtgttgtttactttcaatgagttcaacagcttgttgtccgtagtcaagaccttgacaaattaggatgagtttctgtaacagtggcagatgtgcaagttaggatagagggctaattggctgtgtagataacataagtggttttgttttattttgtgtgaagaatgaaatagcaaactagtacactacttcaatctgtatggtgctttgtacactaatatatggtttatgtatgaattatctaactcgagtagaaatcgagctttttat

SEQ ID NO: 2582 - DNA, 387 bp, Glycine max var. Williams 82
atgaaagcaacattctgtttttttctgctagctctactaatagtgagttgggaatctgcagtagtagtagcaaggaggcccttcccttcaaccgatggaatgtgccatccaggccccaaagcggcaccaggaccagggcccgtgtcttcaccatctaatactgtagagtcagaaaagggtttaatggaagaagcatactcatatagagtgagcaaaatagggtcaagtccaccaagttgtgagcacaagtgttatggttgcactccatgtgaagcgattcaagtgccgagcaccagcagctggcgcagtcatttggggttgcagtacacaaattatgagcccgagagttggaaatgcaagtgtggtccttccctctatagcccgtga

SEQ ID NO: 2583 - DNA, 1725 bp, Glycine max var. Williams 82
atggccatatctccaattttgttgttggctatcttatctctcatttatggcaatggtgttcttcccattgaagctacccatcatgtttacagaaatcttcagactctatcttctgattcctctgatcaaccttatagaactgcttaccatttccaacctcgcaaaaattggataaatgaccctaatggaccaatgaggtacaaaggactttaccatctgttctatcaatacaatccaaaaggtgccgtatggggcaatattgtctgggcccactcaatatcaaatgatcttgtgaattggactccactggatcatgccatctacccttctcaaccgtctgatataaacggttgttggtcaggctcagccacaatactccctcggggcaagccagccattttatacacaggaattaaccctaataagcaccaagttcaaaacttagccatacccaaaaacatgtctgacccattacttagggaatgggttaagtcacccaaaaatccactaatggcaccaactatttctaacaatatcaattcaagctcatttagggaccctaccactgcttggctaggaaaagatggatactggagggtgctgattggaagcaaaatacacactaggggtatggcaattttgtacaagagcaaaaactttgttaattgggttcaagccaaacaacccctacattcagctgaaggcactggaatgtgggagtgccctgatttctatccagtgctggataataagggcccatcaactattggtcttgacacatctgtgaatggtgataatgttaggcatgtgcttaaggttagtttggatgatacaaaacatgatcattatttgattgggacttatgacattgccaaggatatcttcactccggataacggatttgaggatagccaaactgtcttaagatatgactatggaaaatattatgcctcaaaaacgatttttgaagatggaaaaaacagaagggtcttattgggttgggttaacgaatcctcaagtgttccggatgatatcaagaaaggatgggctggaatccataccattccaagggccatctggcttcataaatctgggaaacagttggtgcaatggccggtggtggaacttgaaagcttgcgtgtgaaccctgtccactggcccaccaaagtggtcaaaggtggtgaaatgcttcaagttactggtgtcactgcggcacaggctgacgttgaaatttcatttgaagtgaatgagtttggaaaggccgaagtattggacaaatgggtggatccccaaattctgtgtagtagaaagggggcagccgtaaagggtggtttgggaccctttggcttgctagtttttgcttctcgtggcttacaagagtacacggcagtgttctttagaatattcagataccaaaataaaaatttggttctcatgtgtagcgaccaaagcagatcctctttgaataaagataacgatatgaccacctatgggacttttgtggacatggaccctcttcatgagaagctgtcgctaagaactttgattgatcgctcagtagtggagagttttggaggagagggaatggcttgcatcacagccagagtatatcccacaatagcaattaataaaaaggcacaactatatgttttcaataatggaactgccgctgtcaagatcacaagattgagtgcttggagcatgaagaaggcaaaaatcaactga

SEQ ID NO: 2584 - DNA, 2292 bp, Glycine max var. Williams 82
atggaattgcagcttattttcctgctaattaagctacattttgttatatgtattcctcagcttcatgaatatgctgccacgtatctgcaccattcgagaatcagcagccattcaagtattgcattcccaccatcagaatcaccttctggagttcccgatagtattgcacttccaccttccaaggcatcttctagcattcccagaagtattgcactctcaccttccaaatcattccccaaaatgaaatggacgcacagttctatggactatccaatatcacaccataagcatcaccattccagaataaagtccatcaaccaagttcctgcaccaacctatccaatccaccctcatactcgtcaaggttctccagtcttcaaatcacaacatccatcctcttcacctatgagctggaatttaaatgcagcagcaccagcacctgcaccatcaacaacagctctaccacaccacttgaatgtgccctctccttcacctagaatttcaccttcaggttcatcattgaagaagaaaaagactccaccaccagcatatactttggttctaccatctccaccgcctaacaaagattgtatgtcggtgacttgctctgaacccttgacatatacacctcctggatcagcttgtggttgtgtatggccacttcaagttaaacttcgcatcagcattgcaatatacaagttttttcctttggtttccaagcttgccaaagaaattgcagctactgttttgctgaaccgtaatcaagtacgcattgtgggagctgatgcaactagccagcagctagagaaaaccactattctcataaacttggtacctcaaggagtgatgtttgatgatacaacggcatttttaatatataagaaattctggcagagagagattctcaatgatgcttctgcctttggggactatgaagtgctctatgttcattatccaggccttccaccatctccaccttcaaatgttcatggtatagatgttgaaccataccctggtcgcggcaacaatggaacaatagtgaaacctttgggagtagatatctcagggaagaaaaaagaagggggtggtggaagaatggttattatgatcgtgctgtcatcttttactgcctttgttctattcattggagtagcctggctttgtctcttgaaatgtgactcctgcactctcgaacctgaacaaattccagatgtcaaaattcaatcctcttcaaagcgatcagggactgccagtgctaggtcattgacttatgggagcatgccaggttctagatcaatgtccttcagttcaggaacaataatatacacaggatcagctaaaatatttactttgaatgaaatagagaaagcaacaaataacttcaattcttcaagaatattaggagaaggtggcttcggtcttgtttataaaggtgacctagatgatggcagggatgtggcagtgaagattctcaaaagagaggaccagcatggtgaccgtgaattctttgtagaagctgagatgcttagtcgcttgcaccatagaaatttagttaaattgataggtttatgcacagagaaacagactcgctgcttagtctacgagctcgtccctaatggcagcgtggaatcccacttacatggtgctgacaaggaaaccgaaccacttgattgggatgcacggatgaagattgcacttggtgcagctaggggattggcttatctgcatgaagattgtaatccatgtgtcatacatagggacttcaaatccagcaacattttattggaacacgattttacacccaaagtttcagattttggattggctagaacagcactgaacgagggaaacaagcacatctcaacacatgttattggaacatttggctatgtagctcctgaatatgcaatgactggtcatctccttgtgaaaagtgatgtttacagctatggagttgtactccttgagctcctaagtggaagaaagcctgtggatttgtcacagccagcaggtcaagaaaaccttgttgcttgggctcgtccacttcttacaagtaaggagggtttgcagaagatcatagactcagttataaagccctgtgtttctgtcgatagcatggtaaaagttgcagcaattgcatccatgtgtgtgcaaccagaagtcactcaacgtcctttcatgggtgaagttgttcaggcgttgaagctggtatgcagtgagtttgaggaaacaagttatgtaagaccaaaaagttttcgagttccaggtgggagagtgggcttttcagagtaa

SEQ ID NO: 2585 - DNA, 834 bp, Glycine max var. Williams 82
atggctgggattgtggtgatttttgacttcgactcgacaatcatcgagtgtgatagtgataattgggttcttgacgagtttggtttaacagaaaagttctatcagcttcttcctaacatgctttggaaccctctgatggataagatgatgaatgaacttcattcacaaggaaaaaccattgaagacattgtacaagttctgaacaggactccaatgcatcctcgcattgtcccagccattaaggcagcatattcccttgggtgtgagctgaagattgtgagcgacgcaaatattttcttcattgaaacaattttgaagcatcatggggtgtggaattgtttctcggaggtcactgcaaaccccagttatgttaacgaagaagggaggctcagaatttccccctaccatgattatctaaaatgttctcatggatgcaatctctgtccaccaaacatgtgcaagggaatgatcacagagagaatccaaaattcggttgatgctgcaggaaagaagttcatctatcttggagatggaagtggagacttttgcccaagtttgaagctcaaagatagggattatttgatgccaagaaagaatttcccattgtgtgatttagtatctgagaactctaagcacataaaggcagaggtgcatgcttggagggatggggaagagctttatgatgttctgctccattttatcgacaaagctattggtgaaggaaacaagaatatcattagttctactccaatagtatcagttgattgcaagttggggtcaatttcaattgaggctcataaacctttacctaaagcaatcccagttcctcaataa

SEQ ID NO: 2586 - DNA, 1144 bp, Glycine max var. Williams 82
ttcttagcctataaatacacctgtctattagtcttatgatcacattcacatacattaactcatttaggcatattcacaagattagttctaatggctgggattgtggtgatttttgacttcgactcgacaatcatcgagtgtgatagtgataattgggttcttgacgagtttggtttaacagaaaagttctatcagcttcttcctaacatgctttggaaccctctgatggataagatgatgaatgaacttcattcacaaggaaaaaccattgaagacattgtacaagttctgaacaggactccaatgcatcctcgcattgtcccagccattaaggcagcatattcccttgggtgtgagctgaagattgtgagcgacgcaaatattttcttcattgaaacaattttgaagcatcatggggtgtggaattgtttctcggaggtcactgcaaaccccagttatgttaacgaagaagggaggctcagaatttccccctaccatgattatctaaaatgttctcatggatgcaatctctgtccaccaaacatgtgcaagggaatgatcacagagagaatccaaaattcggttgatgctgcaggaaagaagttcatctatcttggagatggaagtggagacttttgcccaagtttgaagctcaaagatagggattatttgatgccaagaaagaatttcccattgtgtgatttagtatctgagaactctaagcacataaaggcagaggtgcatgcttggagggatggggaagagctttatgatgttctgctccattttatcgacaaagctattggtgaaggaaacaagaatatcattagttctactccaatagtatcagttgattgcaagttggggtcaatttcaattgaggctcataaacctttacctaaagcaatcccagttcctcaataaaactaaaattgcagaggatgaaggatcgatcgatttcaaagtgattacatttcttgtggcttgtcttctatgtattgctactttgtttttgctgttgttgcttttgcagaaagtgtatgagtatgaggctttggcctggttattattattgatagtaataataaaaatataatgaataaaagagaagctaaaagccttcactgttgggactcaactaatc

SEQ ID NO: 2587 - DNA, 546 bp, Glycine max var. Williams 82
atggaaggaaaaagtaggaagaagaatgtaatagtgggaccatggggaggcaacggtggaaatagctgggatgatggaatcttcacaggggtgagagaaatcaaacttgtttatggccattgcatagactcaattcaggtggtttatgataggaatggcaagcctttcacagctgaaaaacatggaggagttggaggtaacaaaacagctgagattaagctgcaattcccagatgagttcttggtcagtgtgagcggccactactgtccagttgttcgcggaggcacccccgtgattcggtcattgacattcaagagcaaccacagaacctttggaccatatggagttgaagaagggactctattcactttttcgatagatggaggctgtgttgtgggttttaaggggcgaggtgattggtatttggatgcaattgctttcactttgtgtaatacacgatcaaagtcgctgtttcagaaagtgcagaggagcttgctgtggttaacaaccactgctccaaaatctacatcctccaaggatggctag

SEQ ID NO: 2588 - DNA, 1944 bp, Glycine max var. Williams 82
atgttctcctcaaccagatgcgctttcctgagcaactcggggttaggtgggtgcagcagcttgtgtgatgctgcgcagaaaaagcgttcaactcgtttgagggtggtgagtatgaccccaagcagcagcagcagcagcaggtccggtgatagaaacggcagcgttgtgatggagacgccgttgaaagaattgaaaaaggaatccacggtggctgacgtggacgataacgccatctccgccggcggccctcaagatgtctacggcgaggatagggctacggaggatcactttgttaccccttggagtgtttctgttgccagtggttatacactattgcgagatccccatttcaacaaagggttggccttcactgaagatgagagggatgcccactacttgcgtggtcttcttcccccatcagttattcctcaagaaactcaggtgaagaaaatgatccagcacgtacgccagtatcaagttcctttgcagaagtacatggcaatgatggatcttcaggagagaaatgaacggttattttacaaacttcttattgatcatgttgaagagttacttccagttgtatatactccaactgttggtgaagcttgccagaaatatggcagcatctttatgcatcctcagggtctttatataagtttgaaagagaagggaaagatccgtgaagtactaaggaattggcctgagaagaacattcaagtcatagttgtaactgatggagaacggatcctgggtcttggggatcttggttgtcaggggatgggaataccagtgggaaaactttctttatatacagcacttggaggagtccgcccttcagcttgtttacccattacaattgatgtgggcacaaacaatgagaagctgctgaatgatgaattatatattgggctaaagcaaagacgagcaactgggcaggaatatgctgaacttatgcacgaatttatgacagcagtcaagcaaacttatggggaaaaggtcctaattcagtttgaagactttgcaaaccacaatgcttttaatctgcttgagaaatatagatctacacatctggtctttaatgatgatattcagggaacagcatccgtggttcttgctggactagttgcatctctgaagttggttgggggtaacttagctgatcacagattcttattccttggtgctggagaggctggcactggcatagcagaactcatagcacttgaaacatcaaaacagacaaatgctccactggaggaagtgcgcaagaatatttggctggtggactcaaagggattgattgtcagttctcgcaaagattcgctccaacattttaagaagccctgggctcatgagcatgaacctgttaaaaatcttctagatgctgttaataaaattaagccaacagtgttgattggaacatcgggacaaggaagaacttttactaaagaagtgattgaggcaatggcttctattaacaagagacctattattctttctctttccaaccctacgtcacagtcagaatgcactgctgaagaagcttacaagtggagccagggacgtgccatttttgcaagtgggagtccatttccccctgttgagtacgagggcaaagtgtttgtgcctggccaggccaataatgcatacatattccctggatttggtctcggtttaataatgtctgggaccattcgagtgcatgatgacctgcttctggctgcctctgaggctttggctgcacaagtgagccaagagaactttgataagggactcatatacccaccattcaccaacatcagaaagatttcagcacacatagctgccaatgttgctgctaaggcttatgaacttggcttggccactcgccttcctcaacctaaagatttagtgaagtttgcagagagctgtatgtataccccagcctacagaagctaccgatga

SEQ ID NO: 2589 - DNA, 585 bp, Glycine max var. Williams 82
atgtcactcctccaactccaactcacttctcatgcattacgctctgtctcttcccataacttcagacccctctattcatctaagcgtgtcagctatgtaagaaccaaaattagagctgttggcacagtccctgatgagaaggactctgattcagacatcaccactgaccccgatgagccaccttatgtcggcctcgtatttgttagttctgtattgctaccagatggaacaccagatatgcactttcgttctgcttgtggaggccagaggcttaggaagataatgctcgattccaatgttgacctctatggaccctatgccagacctttgttaaattgtggaggaggtggaacttgtggcacatgtatggtggaggttcttgaaggcaaggagcttctaaaccctcgcactgataaagagaaaaaaatactaaagaagaaaccaaagaattggagattagcatgtcaaacaactgttggtaaaccagattccagaggagcggttgtgattcaacaactaccagagtggaaaggacacgaatggaaatatgcaaagcctggagagtcggactgggagtcggagtaa

SEQ ID NO: 2590 - DNA, 2289 bp, Glycine max var. Williams 82
atgggcgccgacatgtccaacaataataatcctcctcccacttctcacgccaaagacttgtttgcttctccagctctctctctcagcctcgctggcatttttcgccatgctggggtggccgcggctgatgaggctgccacttctgtggaggagggcgaagaagggagtggaggagctgctgagaggttagaggagattagcagcgagaactccggccccacgagatccagatcagaggatgacttcgaaggaggagaagctgaacctgaagatgatgacgatgcccatggagacaacaagaacaagaagacgaagaagaagaggaagaaatatcacaggcacactgctgaccagatcagagaaatggaagcgcttttcaaagagtcaccacatcctgatgaaaagcagaggcaacaactaagcaagcaattaggccttgccccaaggcaagtcaagttttggttccaaaatcgtcgaacccaaatcaaggcaatacaagagcgtcatgaaaattctttgttgaagtcagaaatagagaaactaaaggagaaaaataagagcttacgagagaccataaacaaagcttgttgccccaactgtggcgtgcccaccacaagcagagatggtgtcatgccaactgaagaacaacaactacgtattgaaaatgccaaactcaaagctgaggtagagaaactccgagcagctttagggaaatacgcaccagggtcaacgtccccttcatgttcttctggccatgaccaagagaatagaagctctttggatttttacactggaatttttggacttgataagtcaaggataatggacatagtaaaccaagcaatggaggagctcattaagatggctaccgtgggggaaccattatggcttcgtagcttcgagactggtcgcgaaattcttaactatgatgaatatgttaaggagtttgcagttgaaaattcaagcagtagtggaaagccaaagagatccattgaagcctcaagagacactgcagttgtttttgtggatctccctagtcttgtccaaagttttctagacgtgaatcagtggaaggaaatgtttccgtgtttgatatctaaggcggcaactgttgatgttatatgcaatggagagggtcttagcaggaatggtgcagtgcaactgatgtttgctgagcttcaaatgctgactcctatggttcccacaagagaagtctattttgttcgtttctgcaagcagttgagtgctgaacagtgggcaatcgttgatgtatccatagacaaagtagaagacaacattgacgcgtccctcgtgaaatgcagaaaacgcccttctggttgcattattgaggacaagtccaatggccattgcaaagtaatatgggtggagcactcggaatgccagaagagtgcagtccattcaatgtatcgcaccattgtgaacagtggcctagcttttggggccaggcattggattgcgactcttcaacttcaatgtgaacgtctagttttcttcatggcaacaaatgttcccatgaaggattcaaccggtgttgccaccttggccgggagaaaaagcattctgaagttggcacaaagaatgacatggagtttctgccatgcaattggcgcgtcaagcatccacgcatggactaaggttacaagtaaaactggagaagacataaggataagttctagaaagaacttgaacgatcctggtgaacctcttgggttgatattgtgcgctgtttgttctgtatggttgcctgtctcacctaatgttctgtttgatttcttgagggatgaaaatcgccgaactgaatgggacatcatgtcaagtggtgggacagtgcagtctattgcaaatttagccaaaggacaagaccgaggcaatgccgtagccattcaaacaattaaattgaaagaaaacagtgtgtggatactgcaagatagctgcacaaacctttatgagtcaatggtggcatatgcttgtgtggacattactggcattcagtctgtgatgacaggatgtgattctagcaatcttgccatactgccctcaggattctccattattcctgatggtcttgagtcaaggccattggtgattagttcaaggcaggaagaaaaaaatactgagggaggatctttgtttacaatggcattccagattcttaccaatgcttctcccacagccaagttaacattggaatctgtggactcggtcaacactcttgtatcttgtacattgagaaatatcagaacaagtttacaatgtgaagatggttag

SEQ ID NO: 2591 - DNA, 420 bp, Glycine max var. Williams 82
atggcttctctggcaagcttagctgttgttcaaccatctactgtcaagggccttgctggaactaagctctctttcaagccctctcgccagagcttcagacccaagaatttcaggagtggtgccgttgtagcaaagtacggtgacaagagtgtgtactttgatttggaggatctaggcaacactactggtcagtgggacttgtacggctccgatgcaccttcaccctacaaccctcttcagagcaagttcttcgagacattcgccgctccattcacaaagaggggattgttactaaagtttttgatcctgggaggtggttccaccctggcatacttgagtgccacagcgtcaggtgacattctaccaatcaagaagggcccacaacttccaccaaagccaggtccccgtggcaagatctaa

SEQ ID NO: 2592 - DNA, 606 bp, Glycine max var. Williams 82
atgcgattctcaaaagcttccttctacactcttcttctccgcaaacctcataaccatcaccatcaaaactacgtcgttttatcgcggcgtcgcgtagtgaccttggcagtgggtgtgttgatcttgctgagtgctctctacattttctggccatcgggtcctgatctgaagatcgtggggctgaaactgaggcgcataaaggtgcaccctgtgccgccaatcaccatagacatctccatgcttctcacgctgagggtgcacaacgttgacgtctacttcatggacttcggagcggttaacgtcgccgtcgcctacagggggaagatgctgggccacgtgacgtccaggcgcatgcacgtgagggccagggggtcttcctacgtggatgctgacgtggaatttgctggcatcagcgtgctaccggagcttgtgttgctgctggaggacgtggccagaggtatcgtaccctttgataccattagccatgctaagggccaattgggccttctcttctttcacttccccatcaaggcaaaactatcgtgtgaggttgtggtcagtataataaaccagaccattgttcgtcaacattgtctccacgagtga

SEQ ID NO: 2593 - DNA, 423 bp, Glycine max var. Williams 82
atggcatcccataggcaaagctatgaagctggtcaaactaagggccgaactgaggaaaagacgaaccagacgatgggcaatattggagagaaggctcaagctgcaaaggagaagacccaggaaatggcccaagctgcaaaggagaagacccaacaaacagcccaagctgccaaggacaagacttgcgacacttcccaagcggcaaaggagaagacccaacagaatacaggagctgctcaacaaaagacctcagagatgggccagtccacgaaggaatcggcccagtcagggaaggacaacacccaagggttcctgcagcagacaggggagaaggtgaagggcgcagcccaaggtgctacagaggctgtgaagcaaacccttggcttgggcgagcatgatcaagacaaccgcagaaattactaa

SEQ ID NO: 2594 - DNA, 990 bp, Glycine max var. Williams 82
atgttggatgtgatgtctttgagttaccccttccaaacattgttattaggttgttgtgtaactactcctagtcgtagatacttgagcaagacaaggcggtgcctagttcaagccacacccccatcttcagttattctgaatgcagatggaagtggcaaattttctgagaagcttcatgtcccaaaccttgattcagggaggggtgctccttttgtcattcagggaagtgctgttggtataattggaggagtgtctgtggatgccactctcaaatttttgagaaaacttgtggagtttagttcacaagatggagttaattccaccccttttgtactgtgttctgatcctctcttgagtaaggagcttctgtcctatgaaaggagttattttgtttctagcactagtaaagcagaaaatttgaagcttgattcttctccaatcgtgcaaactcttagaaataagagggtttttcttgagaattcagggactagttgcatagttatgccctgtaatgtgtcacattcttggtatgaacaagtgtcggagggatgttctgttcctgtttttcacatggccgagtgcgttgccaaggagctcaaggaagctaagctaaagccacttgaagccggtagtcctttgcggattggagtgcttgcaacaaatgcaactctagcagctggtttttataaggagaagcttcagaatgaaggatttgacgttgtactgcctgatagagcaacaatggagcatacagtaatacctgcaattgaagctttgaacagaaaggacatggaaggggcatgcaatctattgagaattgcacttcaagttcttttggtgagagcagcaaattttattatcctggcttctgatgatatgcgggacctcttgcccccagatgatcctcttatcaagaaatgtattgatccaatggatgcattagccagatcaactatcaaatgggtaaaatcctctgggcaaaatacatga

SEQ ID NO: 2595 - DNA, 1119 bp, Glycine max var. Williams 82
atgagcacccaccaaattagtctcaaattaagtaagaaaatggaggagaaaatattaatgagagtgatagtaattaccgtattcctatttataggtgcagcaactgcagaagatgcagcagctgaggcgtatgagtctcctaaattaaaaaagttgataacagattgcactgggcatgttggtgaaacatgcagtactactactagtagtagtggaagtgaagcattaatgcagaagcaggatgggttggctctttgccttttggattctatggagagatgcttgctagaccatcaaacaaatgttggaactcttggagacctaattacacttccaccctttccaccaagacctccagtagatcctaacataattccatttccaagacctccaaacatagttccatttataaaacgtcgtcgctccaaattagataaccatcaaacagatgctggaactcttggaaaagtaattccacttccaccgattcgaccaggaccgccattaaaaataattccatttccaggaactaacatagttccatttccaagacctccaaacatagttccatttccaagacgtcgtcgctccaaattagataaccatcaaacagatgctggaactcttggagacctaattatacttccaccctttccaccaagacctccagtagatcctaacataattccatttccaagacctccaaacatagttccattttcacctcgtggtcgtcgctccaaattagataaccatcaaacagatgctggaactcttggaagagtaattccacttccaccgattcgaccaggaccgccattaaaaataattccatttccaggaactaacatagttccatttccaaaaccttacattcctcattcatacaatacaattacgaaccttcttggcgcacgacgtgatcaagttcaagatttgccactcctcattcagactacacaattacgaaccgtcttgggaatctgtagtcatgtcactgcacgaacttgtctcactgctccaaatgttgctacatcagatttagaggcttgtctcactccttccatgaatcaatgcgtctatcctcctggagctgaatctggtagcccgccaatataa

SEQ ID NO: 2596 - DNA, 1552 bp, Glycine max var. Williams 82
acatgagcacccaccaaattagtctcaaattaagtaagaaaatggaggagaaaatattaatgagagtgatagtaattaccgtattcctatttataggtgcagcaactgcagaagatgcagcagctgaggcgtatgagtctcctaaattaaaaaagttgataacagattgcactgggcatgttggtgaaacatgcagtactactactagtagtagtggaagtgaagcattaatgcagaagcaggatgggttggctctttgccttttggattctatggagagatgcttgctagaccatcaaacaaatgttggaactcttggagacctaattacacttccaccctttccaccaagacctccagtagatcctaacataattccatttccaagacctccaaacatagttccatttataaaacgtcgtcgctccaaattagataaccatcaaacagatgctggaactcttggaaaagtaattccacttccaccgattcgaccaggaccgccattaaaaataattccatttccaggaactaacatagttccatttccaagacctccaaacatagttccatttccaagacgtcgtcgctccaaattagataaccatcaaacagatgctggaactcttggagacctaattatacttccaccctttccaccaagacctccagtagatcctaacataattccatttccaagacctccaaacatagttccattttcacctcgtggtcgtcgctccaaattagataaccatcaaacagatgctggaactcttggaagagtaattccacttccaccgattcgaccaggaccgccattaaaaataattccatttccaggaactaacatagttccatttccaaaaccttacattcctcattcatacaatacaattacgaaccttcttggcgcacgacgtgatcaagttcaagatttgccactcctcattcagactacacaattacgaaccgtcttgggaatctgtagtcatgtcactgcacgaacttgtctcactgctccaaatgttgctacatcagatttagaggcttgtctcactccttccatgaatcaatgcgtctatcctcctggagctgaatctggtagcccgccaatataattagggcatacaggaaaatatgttggaagaataaatggacatgtcaactagatttaagcaagctagcttgttttatgatgaaggattttgtatcccttcaaaattccaatagctgcatcactggcatgcataaataaatagctgaatgttacgaacgatatggtgttcctactaaataaatagtcataaaaaaggcttatttctatttttcttggatttctatttgcacgcacgcatattcaatttaggatcgaaacctaaagttgcgttctgctgcgtttgttacccaacatgtttaaacttcttaaatattattagttttttaaaacaaaattgagtatagctagcttttaacaatatagttttttaacatcatattattgttctacgctgcctattattgggaatccaattccgtgttgaaccccccc

SEQ ID NO: 2597 - DNA, 1134 bp, Glycine max var. Williams 82
atgcaacgcagtgaaagcatgcgactaaaggagaagaaggtgaaggatttgatggttgacaagaagaggctagtggaggtgccgtacatggcgtccctggcccacacaatgactacactggtggcgaacaaggttgtggcggtgccggtggctgcgccgccggggcaatggatcggagccggagggtccatgatcgttgagtctgataagcaaaccggaaccgtacggaagcactacatagggatggtgactatgcttgacattgtggtccacattgctggtgataaccacttgagtggtgacgatgatgatatcaccaaagaccttgatcaaaggatgtctggccctgtctcctccatcattggccactcctttgaaggccttagcttgtggactctcaatcctaataccagcctgttggattgtatggaagtgttgagcaaaggggtgcatcgtgctatggtaccggttgatgggcaggcagagaacgtggctgcagctggggtggaacttgtagagtcagcttggagctaccaaatgctgactcagatggatgtgcttaggttcttgcatgatcgtgctggtgaaggtgatggtgaactgcagagcattctgtcacgttctgttcaagatttgttggctgtcactgaacagatttatgccatcactgaccgcacaaaactcgtggatgccattaagtgcttaaaggctgctatgttaaatgctgttcctattgttagagcctctgatgttgatcaagatgatcacaagcagcacataaatggcagatgcaggaagcttatcggtacattttcttcaactgatttgaggggatgccacatagccacgctgaaatcatggttgggaataagtgcactagcattcactgaagatgttgcatcgagtcctttgtacacagaatcagaatcggacacccagattaatagaagggagcttgtgacttgctttgccgaatcacccttgtctgaggttattgaaaaggcagtgactaggcatgttcatcgagtttggatggtggatcatcagggtttgctcgttggggttgtttcacttacagatgtaattagagttataagacattctctgctatcatctgattcagatgatctgtaa

SEQ ID NO: 2598 - DNA, 378 bp, Glycine max var. Williams 82
atgtttggcagtacaaaggcatcatcgctgccagtgtcgtcgcgttcagaggaaggaggccttcgcagacgtctttcttcgctgtctctgaagatccaagacagcccaacatggtcattttccagatccaagtccctctcatccatgggtgactatgtaaggacatgctgggcctggatcctctccaggaagctcatctttgccacagatctcgaaatgaacgaccagaaaactaagctccttggctcccccaacaggggcacttggagccatgttttctataagctgcgctctgagatcagaaggttcatctctacttctgatcacgccactcttcccaaaacctaccacagatccaccgtggaaatcattacgtaa

SEQ ID NO: 2599 - DNA, 2013 bp, Glycine max var. Williams 82
atgagcggagctgttcttgttgctgtggctgctgctatcggcaacttgctgcaaggatgggataatgccaccattgcaggatctattttgtacataaagagggagtttaatttacaaagtgaacccacaatagaaggtctaattgtggccatgtcacttattggagccactgtcgttacgacatgctctggacccttatcagacttgctaggccggcgtcctatgttgatcatctcctctatcctttattttgttggttctctggtcatgctatggtctccaaatgtttatattctcctctttgcaaggcttttagatggattaggcattggtttggcggtcaccttggtacctctttacatatccgagacagctccacctgagattaggggattactaaatactcttccgcagttcactggttctgctggaatgttcttttcctactgtatggtctttgctatatcactcaccaaggccccaaactggagactcatgttaggtgttctttcaattccctctctcatttattttgcactcacactattcttcttgcctgaatctccaagatggcttgtcagcaaaggccggatgctagaggccaagaaggttttgcaacgacttcgcggcagacaagatgtcgctggtgagatggctttactagttgagggtcttggagttggggccaatgaattcagtgatgcagagcagatcaaattgtatgggacagcagaaggtcaatcctggattgccaaacctgtcactggacaaagttccattggccttgtatctcggaagggaagcatggcaaatcaaagtgctctagtggaccctctagtgaagctctttggtagtgtccatgagaagctcccagaaacaggaagcacacttttcccacactttggaagcatgtttagtgttgggggaaatcaacctaggaatgaagattgggatgaagaaagcattgccagagagggagatgattatgtatctgatgctgctgacaccgacgattctgatgacaatttgcagagtccattgatctcacgtcaagcaacaagtgcggaaagggacatgcctgctcctgcccagggaagcatgaggcaaggtagtcttttgcaaggagaacctgctggaaactcagggattggtggtggatggcagctagcatggaaatggtctgaaacagaaggtgttttcaagagaatatatttgcaccaagaaggtggtcctggatctagacgtgggtccatcatttcacttccaggctgtgatgcgccgacactaacagatggtgagattgtccaggctgccgctctagtgagtcaatcagccctttacaacaaggagcttatgcatcagcagccagttggaccagccatgattcatccatcccaaacagctgcaaaagggccgagttggagtgaccttttagagcctggagtgaagcatgcactgattgtgggggtggggattcaaattcttcaacagttctctggtataaatgtggtgctctactatacacctcaaattcttgagcaggcaggtgttggttatcttctttcaaacctgggcctcggttctacttctgcgtcttttcttatcagcagcgtgacaaccttgttgatgttaccctgtatagctgtggccatgaggctcatggatatatctggcagaagtgttattgtctacttctgttgtttcgtcatgggctttgggccaattcctaatatcctttgttcagagatcttccctactcgagttcgtggtctatgcatagctatatgtgctcttacattttggatatgtgacatcatagtcacctactcgctcccagttatgcttaattctgtgggccttggtggtgtctttggtatgtatgcggttgtgtgcatcatagcttgggtgtttgtcttcttaaaagttccagaaaccaagggcatgccactggaagttatcattgagttcttctctgtcggggcaaagcaagctcaagttgccaataatacctga

SEQ ID NO: 2600 - DNA, 2202 bp, Glycine max var. Williams 82
atggggtgtggcagctccaagctggaggatctaccagcagtggccctttgcagggagcggtgtggtttccttgacgaagcaattcaccagcgctacgcactggccgcagctcacatggcctacatcaactccctcaaggcaattggtcactccttacaccttttcattcagcaagacatggatgctcctccctctccctctccctccccctccccttctccccctcacaaaccctccaaacacgcctcttcttctcactccgactccgccggctcccacctccacttccactccgactccgactccgaccacctcccctccctccaccattcccctgatccatcctctcctctgcctcaccatcttcatatgaattacatgaagaataaagccgctccttcaattgtctacgagcagaggcctctgagtccccaaaccatgtacttgggagagtcctcctcttcctcctccttttacccttaccagtatcccccttacccctacccctacgatccctattcggccgtaggttcttcctcgccgcagctccatgccgtttccaagcctcccccgcctcctccctctcctcctcgctcctccacctgggactttctcaacttcttcgataacagcgacgacaagtactatccccaaactcattaccctgccacggccacccccagccgcgattccagggaggttcgagaggaggaggggatccccgatttggaagatgaggattaccaccacgaagttgtcaagcaggtccatggggatcagaagctcgtccagccaactatgcacgaacccccagcctcctcccgccaccacgacgaagatgacgatgatgacgatgatgatgatgatgatgatgatgaggtagaatatgaggtgcacgtggtagataagaaagtggttgatggagataataatgatgggaacaaggccaaggagcacgccgcattccgtacccggagacctggttcccggaatccacttgaggttgctaaagagattcagattctatttcagagggcttccgattctggtgcccaaatcgccaagattcttgaggtcggcaagcttccccacaatcgaaagcacgcagcttatcaagcttcttccaagatgttacaagttgttgctccctctttgtcccttgtctcctcccaaccttctacttccaaagatgctgaatccgcctccgctgctaacatggattttaatgttgatctaacaaccggggcacgcaatctttcctctacgcttcagaagctccttctttgggagaagaaactctttaatgaagttaaggcggaggaaaagatgcgggtcatgcacgataggaagtgtcacaggttgaagcgtttggatgataggggttctgattttcataaagtcgattcgactcgaactttgattaggaatctgtccacaaaaattagaatggcaattcaagtgttgaccagaatgtggaaatccatgcttgaatgtcatcatgatcagtgtgaagcaattagagaagccagaatactgggttccattggatccaggaagaagagcggtgatagtcatctccaggcaaccaagcagctcgaacaagagcttatcaattggacattccaattctctggctggataagtgctcaaaaaggttatgttagagcattgaataattggctgttgaaatgtctcctgtatgaacctgaagaaacaccagatggcatagtccccttttcccctggtaggattggggccccgcaaatatttgtaatatgtaatcagtggtcccaagctttggatagaatatctgaaaaggaagttgttgattccatgcatgtatttaccatgagtgtgcttcagatatgggaacaagataagctagaaatgcataggcaggtgatgaagaacaaggatcttgagagaaaagtgagaaatatggatagagatgaccagaagctgcagaagcaaattcaagcattagagcgaaaggtggttctggtatctggagaaggcaaaggtctctcagtttctgagaatatcatatatcagagtgacaaaagcagtagtctacaggctagcttgcagcgcatttttgaggccatggagagatttactgatgaatctgtgagagcttatgaggagttgctacaacggagcgaagaagaaagtgctgcccgaaatcatgagagagtttcatag

SEQ ID NO: 2601 - DNA, 831 bp, Glycine max var. Williams 82
atggctgcacaagctcttgtatcatcatcatctcttaccttctcagccgaggctacaagacaaagtcttggaccaagatcactccaatctccatttggcttctcaagaaaagcctcctttcttgttaaggcagctgctactccccctgtcaagcaaggatcagacagacctttgtggtttgcatcaaagcaaagtctttcctacttggatggcagccttccgggtgactatggatttgaccctctgggactttcggaccctgaaggaacaggagggttcattgagccgaaatggctagcatatggtgagataatcaatggtcgttatgcaatgttgggtgcagttggtgcaatagcacctgaaattctaggcaaggctggtctgatccctcaggagacagcactcccatggttcagaaccggtgtgttcccacctgcaggaacctacaactactgggcagactcctacacactgttcgtgtttgagatggcactgatgggatttgcagagcacagaagattccaagactgggccaaaccaggctctatgggcaaacaatacttcctaggactagagaagggtcttggaggttctggtgagccagcttacccaggaggacctttcttcaacccacttggctttggtaaggatgagaagtccttgaaggatttgaagctcaaggaagtgaagaatggaaggttggctatgttggcaatcttgggttactttgttcaagctcttgtcacaggtgttggcccataccaaaacctcctagatcatttggctgaccccgtgcacaacaacatcttgaccagtctcaagttccactaa

SEQ ID NO: 2602 - DNA, 930 bp, Glycine max var. Williams 82
atgggtagtaacagcagaggaaaggatggtgaaggcacttctggagttaaaaaggatgagtacgaacaagacatcaaatttctgccacctgaagtgctttatggcaatactaatggattcactgatccattggtggttcagttacctccacatggccctggaccatatgagccaccacctcctttgctcatacaaccccagtatatccatgaggggaaagaaagaaatttgatcaaagcaataagaaataagcttcctatcaaggtccctgtggctgccatgcaaatgcaaagaccagcagcggtagcgcaatccctgccacaaaatggatatgtagaatctgtgattcatgaaaggctgaaaagtgtgaggataacatggaaccatgcagccacggatgttgctattgcaggatcatgggataactggaagaccacggagcccctgatgagagtagatcaaaattttgtcattgttaaaacactcccgataggtatctatcattaccgtttcattgtagatggctacttgacacatgctccagagttcccatcggcttctgatgattcaggttatggctacaatatattggatttgcaggattatatcccagaaatagttgcaaacttctccgattttgaagatcctccatcaccaccatcgagttatgataacacatacttaaatgaagaggagttcagcaagcccccgccagaattaccacctcaactaccagtggcaataagacatgaggcttcttcatccgcaagtggtagtcgttttgtccctaggcccacgcatttggaactgaatcatctatacatccacaaaactgataggggtcaatttgtggcactacgatcaacttacaagtttcaacacaaatatattactacggaactgtacaagtccttacgcagggaaagatga

SEQ ID NO: 2603 - DNA, 1371 bp, Glycine max var. Williams 82
ataaaaccctgtatacttgcttgttcagttgctttaaggcagggaaaagtggtatcctcagagagagaaagagagtgagaggctcatcaaatattaaaataaagcaaaaaaaaaactaatttttttttgctataacaacaatgccactcaacctagagtcatttccttgtttgctttcaaggctgagcatggatatctactctactctctttctgttctgactgctgaagtttttgtatggtattttgttctgaggatagtagtgattgcgatcaaaatctgggtttcttccactttcagttatgggtagtaacagcagaggaaaggatggtgaaggcacttctggagttaaaaaggatgagtacgaacaagacatcaaatttctgccacctgaagtgctttatggcaatactaatggattcactgatccattggtggttcagttacctccacatggccctggaccatatgagccaccacctcctttgctcatacaaccccaggtccctgtggctgccatgcaaatgcaaagaccagcagcggtagcgcaatccctgccacaaaatggatatgtagaatctgtgattcatgaaaggctgaaaagtgtgaggataacatggaaccatgcagccacggatgttgctattgcaggatcatgggataactggaagaccacggagcccctgatgagagtagatcaaaattttgtcattgttaaaacactcccgataggtatctatcattaccgtttcattgtagatggctacttgacacatgctccagagttcccatcggcttctgatgattcaggttatggctacaatatattggatttgcaggattatatcccagaaatagttgcaaacttctccgattttgaagatcctccatcaccaccatcgagttatgataacacatacttaaatgaagaggagttcagcaagcccccgccagaattaccacctcaactaccagtggcaataagacatgaggcttcttcatccgcaagtggtagtcgttttgtccctaggcccacgcatttggaactgaatcatctatacatccacaaaactgataggggtcaatttgtggcactacgatcaacttacaagtttcaacacaaatatattactacggaactgtacaagtccttacgcagggaaagatgatgaagcattaagatttttgtctgctattgaacttgcctcgtctaagctgcccttatgagaacacttgttaaggtcattaatttaatgtgtagaaaattgattggaataggtaaatgaaaaattgctttccatgtaaaaaacttaagggaatgttattttattctggcagtccgcagtcaatatatacaatacatttcatact

SEQ ID NO: 2604 - DNA, 1332 bp, Glycine max var. Williams 82
atggaggatggggtccatctggaagccaatcgaaagctggcattgattcataaacccacaagacacaagacagaacacagagcacacttgtccattctccaaaacaaaatgaagagcctcctcttctctctcttcctcttcctcttcttagcctcctccgccgtcgccaccgtccccgcccacaacatcacccgcatgctggccgcacaccccggcttctccaccttcaaccactacctctccgtcacccacctggccgaagagatcaaccgccgccagaccatcaccgtcctggccctcgacaatgccgccatgtcctccctcctcgacaagcacctctccctccccaccatcaaaaacgtcctctccctccacatcctcgtcgactacttcggcgccaaaaagctccaccagatcaacaacagcaccaccctcgtctcctccatgttccaggccaccggctccgcctccggcaccgccggctacgtcaacatcaccaacctcaaggccggcaaggtcggcttcgccgccgaagacaacgacggctccctccactccttctacgtcaaatccgtcaaggaaatgccctactacatctccgtcctccaaatcagcgccgccattagctccgccgacgccgaggcacccaccgccgccccctccgccatcgacctgatctccattatgtccaaacaaggctgcaaggccttcgcggaccttctaagaggctccaaggcccttccatctttcaaggaaaacgttgacggcggcttaacggttttctgccccaccgacagcgccgtcagcggtttcgcgccaaagtacaagaacctgaccgaagctcagaaggtttcacttctgttgtaccacgcgactcccgtgtacgagtcactgcagatgctcaagtccagcaacggaataatgaacactctggccacagagggagccaacaagtacgacttcacggtgcagagtgaaggggaagacgtcagcctcaagaccaaagtcaacacagccagcatagtggggacattgatagatcaggatccattcgtggcatataagataaacagggtattgatgcccagagagctcttcaaggccagcgacgcggcggatgcacctgcccagtcgccaaagcccgccaagaagaagaacaagaacaagaacaacagccatgcggcggatgcaccggcggacggaccatccgacgacgacgctgattcggaagatcagaaggctgcggatgaagacagcaatggagtaagcggattgcacgtgagattcttcatggtcttcttcagtttaattatggcttttttggctctatga

SEQ ID NO: 2605 - DNA, 546 bp, Glycine max var. Williams 82
atggccactgttgaggttgtgtcagcaaaggtttccctcccagaggacacaaaagaggcatcattgaaggctgatgagaagaagaacacagaagaagttgttgagactccaacaccaacaccagaaaatgtcgtcactgagcaaacaaaggaggaaagtactgaggccccacaacctgcagcttcagaagacaagccctcggttgaagttgtgtctggaactgtcacagaagagccaacagttgagaagacagaagaggaaactttgaagcaagaagctcctgaggaaacaaaagaaaatgatgatcctactgaggttaagacaccagaagctgcagaagcagtgacagaaacacagaaagaaactgaggctgaagctaaggaagaggctaacacagaagccccggcagagaaaagcgaggaggagaaagaagggccagctgaaaagaaagatgaggaagtgattgcagaagcagaagcagaagctgagaagagcgaggaggtcacagtcacagacacagaggctccaactgagaagactgagtaa

SEQ ID NO: 2606 - DNA, 948 bp, Glycine max var. Williams 82
atctaaagcttttagttttctatatcactctcaactctgcttcttttcaatcagttacattttctttggtattccaatggccactgttgaggttgtgtcagcaaaggtttccctcccagaggacacaaaagaggcatcattgaaggctgatgagaagaagaacacagaagaagttgttgagactccaacaccaacaccagaaaatgtcgtcactgagcaaacaaaggaggaaagtactgaggccccacaacctgcagcttcagaagacaagccctcggttgaagttgtgtctggaactgtcacagaagagccaacagttgagaagacagaagaggaaactttgaagcaagaagctcctgaggaaacaaaagaaaatgatgatcctactgaggttaagacaccagaagctgcagaagcagtgacagaaacacagaaagaaactgaggctgaagctaaggaagaggctaacacagaagccccggcagagaaaagcgaggaggagaaagaagggccagctgaaaagaaagatgaggaagtgattgcagaagcagaagcagaagctgagaagagcgaggaggtcacagtcacagacacagaggctccaactgagaagactgagtaaagaaagtgaagaggggaaatgtgcagtttatgtgactgttttagttgcatcatgccataatgtcttgttgctccatgttttttcttttctttgtttagtgatctaataaaatgtctagctaggaatgagtgatgacccacttaagtttacgaatgccaaccatcagtacaaggaccacatggcatgtactctttcgatctgtttatgtactgtgagctctgatccaatgaatagaagtatattatggtccttattgtgtgattctgcatgtagggtaactttctttgttcaaataaatatgtagattatttatatgatttgttcac

SEQ ID NO: 2607 - DNA, 798 bp, Glycine max var. Williams 82
atggccacctctgctattcagcaatcagcattcactggtcaaactgctctgaagcagctcaatgagttcgtccgcaagaccggtggcgccggcaaaggtcgcactaacatgcgccgcaccgtcaagagtgctcctcagagcatttggtatggccctgaccgtcccaagtacttgggtccattctcggagcagattccatcatacctgaccggagaattccctggtgactacggatgggacactgctggattatcagctgacccggaaaccttcgccaggaaccgggagctggaggtgattcacagcagatgggcaatgcttggtgcccttggctgcaccttcccagagatccttgagaagaatggtgtcaaattcggcgaggccgtgtggttcaaggccggtgcacagatcttctcagagggaggccttgactacttgggcaacccaaacctgatccatgctcagagcatccttgctatctgggctgttcaggttgtgctcatggggtttgttgaaggttacagagttggtggaggaccacttggtgaaggacttgacccaatctaccctggtggtgcttttgaccctcttggtctggctgatgaccctgatgcattcgctgagttgaaggtcaaggaactcaagaacggtcgcttggctatgttctccatgtttggtttctttgttcaggctattgtcactggcaagggccctattcagaacctttacgaccacgttgctgatcctgttgccaacaatgcttgggcttatgccactaactttgtccctggacaatga

SEQ ID NO: 2608 - DNA, 120 bp, Glycine max var. Williams 82
atggtatgcttcagtggatgtatttcagtgacttccttgctgtctttcctagaggtgtatataattacttgtatttttttgaaccagtcagagcagtgtgaaagattttcaattttgtaa

SEQ ID NO: 2609 - DNA, 1074 bp, Glycine max var. Williams 82
atgtctgcctttgttggaaagtacgcagatgagcttatcaagaatgccaagtacatagccacacctgggaagggcatcttggcagcagatgagagcactggcaccattgggaagcgcctatcgagcattaacgttgagaacattgaggccaaccgccaagctcttcgcgagcttctcttcaccgctccagatgccctccaatacctctctggtgtcatcctctttgaggaaactctttaccagaaaacctccgatgggaagccttttgttgaggtccttcaagagaacaatgtcatcccaggcatcaaagtggacaagggtgttgttgagttggctggcacaaatggtgaaaccaccactcagggattcgactctctcggagctcggtgccaacagtactacaaggctggtgcacgcttcgccaagtggcgtgcagtcctcaaaattggcccaactgagccctctgagctttccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccaccagaggtgattgctgagtacacagttcaagcactccgcaggactgtcccagctgcggtgccaggggttgtgtttctgtctggtgggcaaagtgaagaagaagctaccctcaacctgaatgcaatgaacaagttggaggtgttgaagccatggactctctcattctcattcgggcgagcactgcaacaaagcacactcaagacatggggtggaaagaaggagaatgtcgccaaagctcaagaggcatttctggcaagatgcaaggccaattctgatgctactctgggaaagtatgttggtggaagcggaagtggcttgacttctgagagtttgtatgtcaagaactacaagtattaa

SEQ ID NO: 2610 - DNA, 1691 bp, Glycine max var. Williams 82
aatatatattattgaaacggaggatgaggtgccacttgggcaagggaaggatcactcgttgctttatccaagagtgataaccttcgttaggctaatcactggacacgtggttcctttgcatgggttgggtagataccacttggtatattcctttgagatttttatctatatagctttggtctggctgaactcctttttcgtgctgttgtctgttatctgtttcccgccatatatccaataagctttaaccatgtctgcctttgttggaaagtacgcagatgagcttatcaagaatgccaagtacatagccacacctgggaagggcatcttggcagcagatgagagcactggcaccattgggaagcgcctatcgagcattaacgttgagaacattgaggccaaccgccaagctcttcgcgagcttctcttcaccgctccagatgccctccaatacctctctggtgtcatcctctttgaggaaactctttaccagaaaacctccgatgggaagccttttgttgaggtccttcaagagaacaatgtcatcccaggcatcaaagtggacaagggtgttgttgagttggctggcacaaatggtgaaaccaccactcagggattcgactctctcggagctcggtgccaacagtactacaaggctggtgcacgcttcgccaagtggcgtgcagtcctcaaaattggcccaactgagccctctgagctttccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccaccagaggtgattgctgagtacacagttcaagcactccgcaggactgtcccagctgcggtgccaggggttgtgtttctgtctggtgggcaaagtgaagaagaagctaccctcaacctgaatgcaatgaacaagttggaggtgttgaagccatggactctctcattctcattcgggcgagcactgcaacaaagcacactcaagacatggggtggaaagaaggagaatgtcgccaaagctcaagaggcatttctggcaagatgcaaggccaattctgatgctactctgggaaagtatgttggtggaagcggaagtggcttgacttctgagagtttgtatgtcaagaactacaagtattaaacttctaaagagtgtgtttgtttctccttttgaaaacgtcaatccatgcttttggttcagtcacgttgaggtctataagaaagtatgacaatggagaaacaagcatactctaaatggacttggggactgattcggggtggtctggcatatgtatgatacagcctaagaagcatttgcttctgattaacatgcttatttttgggttacatatttttacaaatatcagttattatgttataggagccaattttaatgtcaaatggtgatggtgcgtaccactaaaaaataattgttggagtgaggctggtatatattgtcagaaacagtaatattatactttataaaatgtgcaattacttaacacagg

SEQ ID NO: 2611 - DNA, 1020 bp, Glycine max var. Williams 82
atgaattctaggtgcttccttgttcatccgcaacaagagtatagcatggttccattttcttcaaattctgccacagaagatagagtggctagtgctcgaaacaggcctccacgtgtcacccctccttcctttatggttcggatggccatgagaatatctagagcaagatggtttacctttttgagaagagtttttcattaccaaaatggatcaaggtccaaccttggctccaaccctttcaattctagcacttggatgatgctggagtttattgccttgattctccaaataacaattacaacgttcactttggccatttccaagagggagagacctatttggccgatgaggatttggatttctggatatgatattggctgtgttcttaatctgcttctactttatggacgctaccgtcaaatttatctaactcaaggagattctctcagtctttctgatatggaacagcagagaaacaatgaagaaaccaggatgtcacacttgatgaataaatgccggacttcacttgagcttttcttcgccatatggtttgtgatgggaaatgtttgggtttttgactcacgttttggatcttttcatcatgctccaaagctccatgtgctctgcatcattctccttgcttggaatgcaatgtgctactctttccctttcctactgtttgtgttgttatgctgctgtgtgccactaattagcaccctcctcggctacaacatgaacatggcctcttccaataaaggagcttctgatgatcaaatttcacaacttccaagttggagacataaagaagccggtgtcaagttagagcttggcaatggctctgaaggcagtaaaaaattgatcaatgaagacccagaatgctgtatctgcttagccaagtacaaagacaaagaggaagttagacaattgccctgttcccatatgttccacctaaaatgtgtggatcaatggctaaaaattacatcatgttgccctctttgcaaacaaggattagagaggtag

SEQ ID NO: 2612 - DNA, 2508 bp, Glycine max var. Williams 82
atggggtggttgtttgttgtgtgttggcatttgttgctgtttcatttttcattctcccattccttatgccacactcatgacagttttgccttgcttcacttcaaggcctcctttccttttaatacaacttactattataatgcttatgaatgccctgttactaacctgaagacaacaacatgggaaaatggaacagattgctgctcttggcttggagtcacctgccaccccatctccggtcacgtgaccggcctcgacctcagctgcagtgggctttatggtgaaatccatcccaacagtaccctttttcatctttctcatctccaatcactcaacctcgctaacaatgacttctatccatctcccttgtcatctctcttctgtggatttgtgagcctcacgcacctaaacttgtctaatacttactttagaggtgaaattccttcccaaatctcacacctttccaaattacaatcacttgatctctctcttccacttaattctcaatttctattaaagtggagagaaagcacttggaagaggctgctccaaaatgcaacagttttaagggagcttgtgttgaatcgcacagatttgtcatcaacttcaatgaggccactcaatttgtcttcctctttgatcactctaagtcttagaggaactgggttaaagggaacgttggcagatggaattctctgtttgccaaatctgcaacacttgtatctatcagataattttgaccttcatggccaacttccgaacttgagttgtagcacaacttctgtcagtgtcttacagatctcatctaatgaattccaaggcccaatccctccttctttctctaaccttgtacatcttactttcctggatctctcatttaacaaactcaacggttcaatcccacccttactcttagcccttccacgtcttacttttctgtatctccgtgataattatctcactggtcaaatcccaaatgtctttcaccagtcaaacatatttgaagtattggatttgactcataacaatatccagggtgagctgccatcaacactttcaaatcttcaacatctcatttacttggatctttcatttaacagattagagggacctctgcccaacaaaataacagggttttcaaacctaacttggttagtgttcaataacaacttactgaatgggaccattccttcttggtgtttctctttgccatcgttgatgtatttatatctaaataataatcagttcacagggcatatacctgcaatctcatcatattctttgcagtctctaattttgtgctacaacaagctacaaggtctttatctttcgcagttaagtcaattatcactcaactttgaatcaagggccaattatagtttctccagcttactgcaactggacttgtcttctatgagcttaacagaatttccaaaattatcaggaaaagtcccaattttgaaaatcctgtatctgtccaataacaaattgaagggaagagtgcccacttggttgcacaaaatggattctttatctgctttgagtctatcccataacatgttgacaacaccaatggaccaattctcaaggaactaccaactcacaatcctggatctaagtttcaacttactcactggcagcatctcttcctcaatttgcaatgcaagttcaatggagtctctcttcttgcctcacaacaagttaacaggcattattccacaatgcctcgtgaacttaccatatcttcaagttttggatcttcaaatgaacaaactttatggcactttgccaagtactttttcaaggaacaacaggctaagtacgctgaatctcaatgataaccaattagaaggtatattgccagaatctttgtccaactgcacactactggaggttttaaatcttggcaacaatcaaatagaggatacgtttccccattggcttcaaaaactaccatatttgaaagtattggttttgcgggccaacaagtttcacggtctcattgccagttttaagaccaaccatggatttccaagtttaattgtttttgatatctcatccaacgacttcagcggcccaataccaaaaaagatcattcaagatgaagaggatagcagttcacagcaatacatgcgaacgcaagttagtcttggagcattcgattcaactgtgactgtaacaatgaaaggcatgagtatgctacttacaaaaattccaacagactttgtaagcattgatttatcaggaaacaaatttgaaggagagattccaaatgttattggggagcttcatgcactcaaagggctcaacctttcccataacagactcagtggtcttattccccaatccatgggaaatttgacaaacttggaatcattggatctctcttctaatatgctgaatgtggccataggatatggatgtggaatggtatttggagtgggcatgggatgctttgtgttgttaacaggaaagcctcaatggattgtgagaaagtttggtccttaa

SEQ ID NO: 2613 - DNA, 366 bp, Glycine max var. Williams 82
atggggtgcctccacctccaaccttcactgcttccttttcctttgcatgcaaaattcaaaccgcagttacatcatatgaggcacaccaccaaactattttggcttactactcaccaacctccacgtggccagcacttaccttcagcaagtccactaagtaccaaggcacttccacatttagtggttgttgccccagcccaatccggtgacttgtccaccttgctcccaataagtgcagtgcttctatcggcatacttcatagcaaattttgtcgtgccaggtttctttaccaactctttcggatatgataagtcatcaaacgaagagcagaaggttgacgatgtaaatgcaatagaagatgaatag

SEQ ID NO: 2614 - DNA, 1089 bp, Glycine max var. Williams 82
atgggtaaaagagctttccttattgtccatgccttcttcgtcttattcagctttggttcctcaaaggctgaaatggtttctgccgtttatgtgtttggagactcacttgttgatgtgggcaacaacaattacttgactctttccattgctaaggcaaatcatcgtcactatggtgttgattttcctacacacaaaccaacagggagatttagcaacggcaagaatgctgcagattttgttgctgagaaattgggttttccaacttcaccaccttacctgtcccttataacatcaaaggccaacaaaaacaatgcatccttcatggatggtgttagctttgcctctgcaggtgctggaatatttgatggtacagacgaacgttatagacaatcaataccgttgagaaaacaaatggactactactcaattgtgcatgaggaaatgactcgagaagtaagaggagcagctggtctacagaagcatctctcaaaatcaatattcgttgtggtgattggcagcaatgatatatttggatactttgaatcatcggatcttcgtaagaaaagcaccccacaacagtatgtggattccatggctttctcactaaaagtgcaactacagcgattatacgatcatggtgctcgcaaatttgagattgcgggagttgggacacttggatgctgccctgatttcaggctgaagaacaaaacggaatgctttatagaagccaattacatggcggtaaaatataatgaaggccttcagtccatgttgaaggaatggcaatcggagaatggaggcataatctactcctattttgacacttttgctgccatcaacgaccttattcagactccagcttcctacggatttagtgaggtaaaaggtgcctgttgtggactgggtgagctgaatgctagagctccctgcctgccattgtcaaacctttgtcctaacagacaagatcacatcttctttgaccaattccaccctacggaggcagctgctcgtttatttgttaataaactttttgatggcccttcaacttacacctctcccattaatatgagacagctagtagctgcctag

SEQ ID NO: 2615 - DNA, 345 bp, Glycine max var. Williams 82
atggttgaagtgggtatttatcagatccctacgagcactttcgacccatttgcggaggcaaaagaaacagatgctcccggggcaaaagagtatgtgcatatccgcatacaacagaggaatgggaagaagagtctgaccacagtgcaagggctgaagaaagagttcagctacgagaagatcctcaaagacctcaagaaagagttctgctgcaatggcaatgttgtgcatgacaaggagcttggcaagattatccaactccagggtgatcagcgcaagaacgtttctcacttcctcattcatgctcgccttgttaggaaggaccagatcaagattcatggtttttaa

SEQ ID NO: 2616 - DNA, 2459 bp, Glycine max var. Williams 82
caaaatccaaaacccaaagcaaattggaatggcatgtgaagggaagcatagtagcatggtgctaagtttcaagatttgcataagatttttccctttcacacaaataggatagtttggtgagcagacatgacatcagaggaagcctagatttggtgctcagcttctctgttggattgagtgtggcccacttgttacctactgttgtgccactacatcttttgcagcatctggattttgctgtagggtatgtgtgttgctcatcctccggtaatctttgcacattaagtctctcgtcggttcaaaatgaggcgtgaaacctgttgcttctttgggtagaggattcaggagtctagctaccttggatcaccacaaagatgtgtgtttcgaagtcttgagtaagaggagtacttaacttgaatcctgtacttgagtgggaatgtcttggttctaccagctgaagaacttgtggggatgatattgattgactcggtgcaaccaattatgtcatccaacagttctttgaatatggaattgtcaaagaagacgtcatttttgggtttgaaacgatgggttttgattgggataggtgtcggtgcatttatagtgctgattttgtgtatattatcgatatgggcgatgtttcggagaaagtctaggagatctctggacaagtattctgtatcccaaataccaaatttctcaaaagatatcgatgttgacaaggttggggtgcagagttctcatgttcaaccagaaaatgtggttattcctgttcatgacaaggcaagtgacaagaattcagataatgtatcagttcatttgggaaatagcaaatctggtgatcctgataatatcagtcagtgcagctcaatttatcatcatgagagaggattgagttcaatgtccgccgaagaaggaagctctgggaatgttaagaagcaatctacgttgtcacatggagggctggccactgcctctcctttagttggcttgccagaattttctcatcttgggtggggccactggtttacacttagagatctggaaatggcaaccaatcatttctcaagcgagaacatcattggcgagggtggatatgggattgtttacaggggcagactggttaatggaaccgaggtggcagtgaagaagcttcttaacaacttgggccaagctgagaaagaattcagggttgaagtggaggctataggccatgttagacataagcatcttgtacgccttcttggatattgtgtagaaggagttcacaggctgcttgtgtatgaatatgtgaacaatggtaacttagaacaatggttacatggagacatgcatcaatatggaacacttacctgggaggcccgcatgaaagttatacttggcactgccaaagcgcttgcttatttacatgaagcaatagaaccaaaagttattcaccgggatataaagtctagcaacatattgattgatgatgaattcaatgcaaaggtttctgattttggtttggccaaacttttggattcaggcgaaagtcacataaccactagagtaatgggaacgtttggttatgtggcaccagaatatgctaacagcggtttgttaaatgagaagagtgacatttacagctttggtgtcctcttgctggaagcagttactggaagggaccctgtagactatgcgcgtcctgctaatgaggttaatctagttgaatggctcaaaacgatggtggggacacggagagctgaagaagtagtggactcaagccttcaagttaaaccaccactgcgtgctttgaagcgcactcttttggttgcacttaggtgcatagatcctgatgctgacaagaggcccaaaatgagtcaagttgtgaggatgcttgaagctgacgaatatccacttcgagaggatagaaggaaaagaaagagtggcactgccagcatggaaattgaaaccgtgaaggatatttctggtccatctgatgctgaaaagatgggaatttctgaaagccacgttgaagaataggattgacaaccccatgacttagcctgcaagtacaattcccgttatacacacgttatatatatagtaacttatctataccatattgaaatatctccaactttgtgaccttaagaaaattttgtttcatctgaggatagaatcagatcagagtgagcttttgttttgttttgtttttgtttttaattgaatggttgccattgaagatatgatacactagctagccttgcaaagagggtagaatcagtatgggtggtgtgagtattagtgttgtacagatgctttggggcctatccttcttacatgattgttgattttctttcttaacttccttgactttattatatcctcgcttagtcacacgctgctggagagtggcgatagtaaaaacgaatattttgcttcaatttccatgtcaagtgacaatatattttccaagc

SEQ ID NO: 2617 - DNA, 186 bp, Glycine max var. Williams 82
atggaagagaagaagaagagcaagttgtggttgaagaaggtgtcttggccgtttcgctggaaacgactggatcttcaaacaaccatcatcgacaccgtcgttttcaagatactctacgcggctgaggctgtagtccttgtctccaccctctgtttcttctacctttgctgtggctgccacttctga

SEQ ID NO: 2618 - DNA, 981 bp, Glycine max var. Williams 82
atgaaggttcccaagttttcaagtgttgcacacagactaataatggatgtggccaagttacataactctgatgatgatgatgacaagaaagaagaagaagttgtgcttcctgggtttagattccatccaacagatgaagaacttgtggggttttatctgagacgaaaggtggagaagaagcctctgagaattgaactcatcaaacagattgacatctacaaatatgatccatgggatcttccaaaagtgagttcagttggggagaaggaatggtacttcttttgcataagagggagaaaatacaggaacagcataaggcctaatagagtgacaggttctggattttggaaagccacagggattgacaagcctatatactgtgttagagaaccccaagaatgcattggtctaaagaaatcattggtctactatcgtggaagtgctggtaaaggtaccaaaactgattggatgatgcacgagtttcgcctcccacccaatggaaaaactagcaataatccacaagctaatgatgccaatgatgttcaagaagctgaagtgtggacgctatgccgaatattcaaacgagtcccaacttacaagaagtacacaccaaatttgaaagactcggcagcaccaatcactgagccaaatcaccccacaaactcttcaagttccaaaacatgcagcttagaatctgacaactgcaagccatacttgactttcacaaactcatcatcaccacaactcattctacaaaatgaaaggaaaccagttattaatggacatgttgacgttgaacgtaaccacttatttctaggtcaattaggcaatgtagctcaggctccaagtttttggaatcatcatcagaataataatgtggaatttgctaatgagaattgggatgatctcacatctgtggttcagtttgctattgatccatccagggtttctgatcatagtaaggaattcaatagattttaa

SEQ ID NO: 2619 - DNA, 1332 bp, Glycine max var. Williams 82
atgctgaggagcgtgttagggttcatgatccgtttcttcttccgatccttcaccaaagcgatgggcttcttcttcgcgtgcttcaggatcagagacaatcgccgcacaaacacatcgcaattgattacctcctccactcaatccaccggtgttgtggtatctcgaaatcgctcgtcttctttattatctgaagaagagagagatgattctgcgaggattgatggtgttgggtttgagggagatttccaggggcttaaggatgaggctatgtttcttaaagcttgtgggaccttagcaggaacacctgctgaaattcgtaaagcatctgagaagttgaaatcacttgctcctgataaagattcagacccttcaagatttcattcttggcttcctaacacgtctgtggagaaactgcagctggatgtccaaccatttgatccaccaactcccataaatctttgccaaaaattgggaaatagcatggattcatttgagcacacaccaagcagccgtatctccaaagcacaagatactgaagatgactctgttgactatatggaaaaaaattggtcagggaaccttcatacggcggataggtctgaaaggaatgcagctttggtttcacctttgctagccacatatactcagagaaagaacaagtctgttcgttttgaaagtgaaactgacttggcaacctatggaagctcatcagatgattggcatatgaaggaaaacaagtcaccaaatagccaaagtgcatataaaccatctccttatcctaccccgttgaagttatttgacgagatgcaaacaccaggaactgtgtaccctgcatcattagaagagttacgtacgggtaaggctcaagttcggtcccagtttgtctatccaactaacaaaccaggtgataatgtcttctggtgcaaaatactcgaggagagagattttaaccttgaagaagattcaagtgagctgagtgatttggttgagaaagctcaaaatgaaactcctaccccagaaaaagggtccaagaaattttcaaaagaaaatgacgatgaggtcaaatcaaatttgtctgctagaataagtcctgtgtcaaccatcaaggagcattcgcctatgccatttaagtggtggtatgacaatggcatcccgaattcaacaactaagtacaaggaggaccagaaagtaaaatggcatgcaaccccatttgaagagaggctggataaggcactgtctgagaattttatatctcaaaggaagcttgtttgtgggaaaccagtggaatttgatgagattgaagaaagtgatactacattatctcagctatag

SEQ ID NO: 2620 - DNA, 648 bp, Glycine max var. Williams 82
atggcagtgaaagtatacggtccccactgtgcttccaccaagcgggtgctggtttgtctggttgagaaggaagtcgaatttgaggttgtccctgttgatgtcactaagggggagcagaaggatcctgagtacctcaaactacagccatttggagttgttcctgtcatcaaagatggagattataccttatatgaatctcgtgctataatgaggtattatgcagaaaaatacagatctcaaggggttgagttgctgggaaaaacaatagaagagaggggtctagtggagcaatggctagaagttgaagcacacaactttcatccacaagcctacaacttgtgtcttcatggtttgtttggttcactatttggtgtgactccagatcccaaggtgattgaggagagtgaagcaaagctggtacaagtgttgaacatctatgaggagaggctctcaaagactaagtatttggctggggatttcttcagcattgctgatattagccaccttccatttcttgattatgttgtgaacaatatggggaaaaagtatttgttagaggagaggaagcatgtgggtgcctggtgggatgacattagcagtagaccatcatggaacaaggttctccagctctacagagctccaatctag

SEQ ID NO: 2621 - DNA, 1081 bp, Glycine max var. Williams 82
ggcaagcactatatataagtgttgtgttgccactaactaagcaataatataactatataagcggttcttccatttgactcttgttctgaacgacttttcaagagaatcaaaccatggcagtgaaagtatacggtccccactgtgcttccaccaagcgggtgctggtttgtctggttgagaaggaagtcgaatttgaggttgtccctgttgatgtcactaagggggagcagaaggatcctgagtacctcaaactacagccatttggagttgttcctgtcatcaaagatggagattataccttatatgaatctcgtgctataatgaggtattatgcagaaaaatacagatctcaaggggttgagttgctgggaaaaacaatagaagagaggggtctagtggagcaatggctagaagttgaagcacacaactttcatccacaagcctacaacttgtgtcttcatggtttgtttggttcactatttggtgtgactccagatcccaaggtgattgaggagagtgaagcaaagctggtacaagtgttgaacatctatgaggagaggctctcaaagactaagtatttggctggggatttcttcagcattgctgatattagccaccttccatttcttgattatgttgtgaacaatatggggaaaaagtatttgttagaggagaggaagcatgtgggtgcctggtgggatgacattagcagtagaccatcatggaacaaggttctccagctctacagagctccaatctagttgctaaatgagtttcagggaaactgctattagtgtatcatctttgaatatgttagtcaagaataaatgtacttttagcagattccaatgaaaggaagaaagtgggtagtgttcaacttaatggaatgtgttgaatttctgctttctttcattttcagttgtttgcttgtgtttaatttggatattccttgtggtcatgctcttaactttcccgttgtttaccctctatttttcttttgctactgaataaaagttatatatatatatatatatatatatatatatatatatatatatatatatatatatatatatatata

SEQ ID NO: 2622 - DNA, 1203 bp, Glycine max var. Williams 82
atgtctggtgttcttctttgggtgagttgtggacccaaagagaacatcaactccttggtgagtttttcatgcaggagtagtagtggtggtgaaagaacacaaaagagattttctggaatcagttttgctagtggtacttctgctttttcaagtgcagtggcagctactgagacttcaagatcttcagaggagagggtctatgaagtggttctgaagcaagcagctttggtaaaagaacacaaaaggggtacaaaaatagctttggatttggacaaagatgttgaggctgatttcaacaatgtggatctgttgaatgcggcttatgatcggtgtggtgaagtttgtgctgagtatgccaagacattttacttaggcacacaattgatgactgcagagcgccgaaaagcaatttgggcaatttatgtgtggtgcagaagaactgatgagctagtggatggcccaaatgcttcacacatcacccctggggccttggacaggtgggagcaacgattgagtgatgtttttgaaggtcgaccctatgatatgtatgatgctgccctctcacatactgtctcaaagtacccggttgatattcagcccttcaaggacatgatcgaagggatgagggtggacctgagaaagtcaagatacaataactttgatgagctctacctttactgctactatgttgctgggacagtaggccttatgagtgtcccagtaatggggatagcaccagaatcaaatgcttcatcagagagcatttataatgctgcattggctctaggcattgcaaatcaacttaccaacatacttagagatgttggagaagatgctagaagaggaagagtatatctcccacaagatgaattggcacaagctggcctttcagatgatgacattttccgcggaagagttacagacaaatggcggaaattcatgaagggacaaataaagagggcgaggatgttttttgatgaggcagagagaggggttgcagagctcaactcagctagcaggtggcctgtgtgggcatcattgttgttgtataggcaaatattagattccattgaagccaatgattataataacttcacaaaaagggcatatgtaggaaaagtaaagaaactcttgtcactacctactgcctatggtttttcacttctaggccctcagaagtttaccaaaatggttaggaggtaa

SEQ ID NO: 2623 - DNA, 1557 bp, Glycine max var. Williams 82
tctaatgtgacagccacacaaacaaaaacaaacctcatcatagttttgctaacacaagtatacactcattctcaaaaggttttcatccaatttctttccctctcttttcattggtgtgcactttcacttgtggagctgcatcaactgcagtggaaattgtgctttgttcttgagatgtctggtgttcttctttgggtgagttgtggacccaaagagaacatcaactccttggtgagtttttcatgcaggagtagtagtggtggtgaaagaacacaaaagagattttctggaatcagttttgctagtggtacttctgctttttcaagtgcagtggcagctactgagacttcaagatcttcagaggagagggtctatgaagtggttctgaagcaagcagctttggtaaaagaacacaaaaggggtacaaaaatagctttggatttggacaaagatgttgaggctgatttcaacaatgtggatctgttgaatgcggcttatgatcggtgtggtgaagtttgtgctgagtatgccaagacattttacttaggcacacaattgatgactgcagagcgccgaaaagcaatttgggcaatttatgtgtggtgcagaagaactgatgagctagtggatggcccaaatgcttcacacatcacccctggggccttggacaggtgggagcaacgattgagtgatgtttttgaaggtcgaccctatgatatgtatgatgctgccctctcacatactgtctcaaagtacccggttgatattcagcccttcaaggacatgatcgaagggatgagggtggacctgagaaagtcaagatacaataactttgatgagctctacctttactgctactatgttgctgggacagtaggccttatgagtgtcccagtaatggggatagcaccagaatcaaatgcttcatcagagagcatttataatgctgcattggctctaggcattgcaaatcaacttaccaacatacttagagatgttggagaagatgctagaagaggaagagtatatctcccacaagatgaattggcacaagctggcctttcagatgatgacattttccgcggaagagttacagacaaatggcggaaattcatgaagggacaaataaagagggcgaggatgttttttgatgaggcagagagaggggttgcagagctcaactcagctagcaggtggcctgtgtgggcatcattgttgttgtataggcaaatattagattccattgaagccaatgattataataacttcacaaaaagggcatatgtaggaaaagtaaagaaactcttgtcactacctactgcctatggtttttcacttctaggccctcagaagtttaccaaaatggttaggaggtaactgttatacaatgtgtgatacttttgagttacaactgtatacatctcaagttaccagcatgtgttgaagagcaacccattcatttaatgagtttgcaagcatagtaatcagttttaaaatgtgtaaaaaaagaaggaaaaatgtgttaatccatttgtatattataaatttcagaggtca

SEQ ID NO: 2624 - DNA, 153 bp, Glycine max var. Williams 82
atggtggtctttctttgcaaggaagaatatggtgtgctcttgggcaatgactgggctgcaactcatgaatttggccacaacttttgtatctcaaatgaaggtgacgatgacgatgatgataatggcgtcattgatgtggccccagcggcatag

SEQ ID NO: 2625 - DNA, 1092 bp, Glycine max var. Williams 82
atggttgtgagaaaaagcatggggcgggcaaagtcactgcttttgctgctcatggtgcttatattttcctttgccacttataatttggtagctatgatcatgaaccttaagacagatgggtcggaatcttttaatagaaaaattatgaggtcaggaaagactaattcaaagtttcatgttgccttgacggcaaccgattctccttacagtcaatggcaatgtcggattatgtactattggtataagaaagtgaaggacatgcctggatcagacatgggcaagctcacacgtattttgcattctggaaggccagaccagctgatggatgagattcctacttttgtggttcatccacttcctaggggcttggataagggttatgttgtcctaaatagaccatgggcttttgttcagtggctggagaaagcagatattgaggaagaatatattctgatggcagaacctgaccacatatttgtaaatcctttgcctaatttggctcatggaaccctgcccgcagcatttccatttttctatatgaactcatatgagaatgtagacataatcaggaaattctatcctgaggaaaagggtcctgttactgatgttgaaccaattggcaattctcctgtaatcattaagaagtctttgatggaggaaatagctccaacatgggtaaatatttcattgagaatgaaaaatgatccagagactgatgaaacttttggatgggtgcttgaaatgtatgcttatgctgtgacatctgcattgcatggtgtagagcataatcttcgaaaagactttatgcttcagccaccttgggacgaaaatgttgagaataagtttatcatccactatacatatggatgtgactataatatgaagggggaactgacatatgggaagattggagaatggcgttttgacaagagatatcatcttttgggtcctccacccaaaaacctccccttaccgcctccaggagttcctgaaacggtggtgcagctagtaaaaatggtcaatgaggctactgcaaacatacctgaatgggattcaataaataacagccgagggaaagatgataaaccataa

SEQ ID NO: 2626 - DNA, 1317 bp, Glycine max var. Williams 82
atggcttcattatgccggcggttatccgccgccgcaccggccggtcacttccgattccatcggcccgccgggatttgcgcggttcgatacggttattccgtccggcggccaatgcggttggttgcggcggggaccaccgtgggcggcggcgcgtgggtgacatccgatgacgtcggagggagggaggagaaggtggggccctgctcctacgccgtggaggatcggagggtggcggaagatggcggaagcgatgcggtggtaggaagtaggaaccgggtggtggaagtggcggcggcggcggttgcaacggtggtgctgggtgttgggaaccgggttctgtataagttggctttggttccgttgaagcactaccctttcttccttgctcaacttgccactttcggatatgtaatagtgtactttgcgattttgtatattcgacaccatgcgggcattgttactgatgagatgttagatgctccaaaggctccatttatagttgttggtctattggaggctctcgctgctgccactggaatggccgcaggagcaattctctctggagcttcgattccaattttatctcagacttttctagtgtggcaaatactcctgtcaattatttttcttgggagaagatataaagtcaaccaattacttggatgctttcttgtaaccattggtgtagttgttactgtagcaagtggagctggtgctgggaatttattaaaggaaggtggtatgttttggagtcttttgatgatagtttcatttttcctccaagcggctgataccgtgctgaaggaaattatctttttggattcatcccgaaaattgaagggaggttgttgtatggacctttttgttgtcaattcgtacggatctgctttccaagcactattcgtgtgccttcttctccccttcttgtcaaaattatggggcattcccttcagtcaactaccaaactaccttaaagatggtgcagcctgcttcctaaattttggtacattatcaagtggatgtgatggtgcccctctgcttcctctgctgtttattattgtaaacataggtttcaatattgcattgcttcatctcctcaagatctcttcagctgttgtatcttgtcttgcttccacattttcagtcccaatatccatctacgtgttcaccatgccattgccataccttggtgttgcctcctctcttccaacaggctttatggcaggggccattatcctcattttgggcttactcatttatgcttggaccccttcaaatggttcctcgggtgcttccttctcaacttcctccacctag

SEQ ID NO: 2627 - DNA, 1717 bp, Glycine max var. Williams 82
ttttacgtgttgcacggtatttcgtttttgttaggctttggtttagggtccagccaagccaaacccaacattatgctaccctcaaattgttaactttccatttctgcaataatattcacattatggaatgaacttcagggctaagaggttgttgagaagatggttgggaaccctgcactccatgtttcatcattgccaacttattttttttcatctctgattatcctaccaagaaatccttcaagttccatccctcttccaattcgacgccagacacaaatcaacaggataagagttacatctgctgattcaggtcatggccaaaggccatcatcatcttcttcagaagcaaagaaaccactttcagctttgtcaaacattccgtgggccatttggaggcaaacattgcggccattaagtgattttgggttcaatggtaggagcatctgggaaggtggggttggactgtttctagtgtctggtactgtcctatttgttcttagcttggcctggttgaggggcttccaaatcagatccaaattccggaagtacacagtggtgttggagtttgctgaagcttgtggcataagcaaaggaacgcctgtgagaatcagaggggccactgttggcaatgtcattggtgtgaatccttccttgaaaagtattgaagcagttgttgaggtgggtgatgataaaacagttataccgcgaaattcattgatcaaggttaaccagtcaggtcttcttatggaaacaaaaattgaaatcactcctcgtgagccaattccaacaccttctgttggccctcttcaccaagactgtactaaggaaggtcttattgtgtgcgatcgcgaaaagatcaatagtgaccaaggaacaagtttggatacattgattggaatttacatccgccttggtcgtgacatagagaaaattggtatcatcaatagctatacaatggctcaacgagtattttccattattgaagaagcgaaaccacttcttacacagatcaaagccatggctgaagatgttcaacctttgctggctgaagtccgtgattgtggcgtgctgaaggaagttgagaatttaacccaaaaccttatccaagcttctgatgatttgagaagggtacattcatccgtcatgacccctgagaacactgaactgtttcagaagtccataaacacaattagttttaccttgaagaactttgagaatattagcaaggatattgtgggttttactggggacgagactacaaaaaggagtttgaaattacttttacagaatctcagcaggcatttgtgaagtccaatataaagataggaagtagaaaatgacaggtaatagtattgtaaacaatgtttacatcagctgcaaagcagtgcaggtgtgttattgactgatggaattaatttctttgtggatgacctttttttcctgataaagttatccactcatctgtgttggatggactggtttttaatggttgacactctaggacctcagagagaaaaaaagtttctggtcataggctcatagcattcaaagtgtaatactataggaggttatgaacggattatatttgtagagttttctatagtttttgtttgtttttctttcccgcaatttggttctaatataaactggcaaatggaaataaccattgtgatttccaacactataatttgtgtcctcgtttgttaccttaaaa

SEQ ID NO: 2628 - DNA, 3087 bp, Glycine max var. Williams 82
atggtgttcattaagctttcattaattcgtctaattctctgctcactcttaagcctccattactcccatcttttcacattttcttcttttgcctttgctgccatcactgctaatgaagttgcagaaaaccaagagatggaagcaagtgaaagtgctctacttgagtggagagagagtcttgacaaccaaagccaagcttctctgtcttcatggaccagtggtgtcagtccttgcaggtggaaaggaatcgtttgtgacgaatccatctctgtgaccgctataaatgttacaaatcttgggctacaaggtactcttcacactctcaacttctcatcctttcccaagctgctaactctggatattagtcacaacagttttagtggaactattcctcagcaaattgctaacttgtccagtgtttctcaattgataatgagtgctaataattttagtggtccaatccccatttccatgatgaagttggctagcttgtcaattctaaacttggaatacaataaactttctggctctattcctgaggagattggagaattccagaacttgaagagtctaatacttcaatggaatcaactttctggtaccattcctccaacaattggaaggttgtccaaccttgttagagttgacttaacagagaactcaatctctggtacaatccccacttcaattacaaacttgacaaatttagaactccttcagttctcaaacaatagactttctggctccattccatcctccataggagacttggtcaatttgactgtttttgaaatcgatgataatagaatttcaggttcaattccttccaatattggaaacttgacaaagctggtcagtatggtcattgccattaacatgatttctggatcaattcctacctccatcggaaacttggtcaatctacagttctttgtcctttatgagaacaatatctccggagttattccttccacctttggaaatttgacaaacctcgaggttttcagtgtctttaataacaaacttgaaggcagattaacaccagcattgaataacattaccaatttaaatatctttcgaccagccatcaatagtttcactggccccttgccacaacaaatttgccttggtgggctacttgaaagttttactgctgaaagtaattatttcacgggtccagttccaaaaagcctgaaaaattgttcccgtctttacagactcaaactaaatgaaaaccagttgaccggaaatatatcagatgtttttggtgtatatccagagttggactacgttgatctgagtagcaataacttttatggccacatttcaccaaactgggcaaagtgtcctaatctcacaagccttaagatgtccaacaacaatttatctggtggtatacccccagaactcggccaggcacccaacttacgagtactagtcttgtcttcaaatcatctaacaggaaaatttccaaaagaacttgggaacttgaccgctttgttggagttatcaataggcgacaatgaactttctggcaacattcctgccgaaatagcagcctggtccggcattacacgtctcgagcttgcagcaaataatttaggtggcccggttccaaaacaggtgggagagttgcgcaagttactttacttgaacttgagcaagaatgaattcacagaaagcattccatcagaatttagccaattgcaatctcttcaagatctcgatcttagttgtaatttgctaaatggagaaataccagcagcacttgcgagtatgcaaagattggaaacactaaacctctcacacaacaatctctcaggagccattcctgattttcagaatagcttgttaaatgttgacatatctaacaaccaattggagggctcaattcctagcattccagcctttcttaatgcttcatttgatgcattgaaaaataataaaggcctgtgtggaaaagcctccagtttggtgccttgccacaccccacctcatgataaaatgaaaagaaatgtcatcatgctggcattactcctttctttcggcgctctatttctattattattggtggttggaatttctttatgtatttactaccgaagagcaacaaaggccaaaaaggaggaggataaagaagaaaaaagtcaggatcattattccctttggatttatgatggaaaaatagagtataaagatatcattgaagccacagaggggtttgatgacaaatatctcgttggagaaggaggaactgcatctgtttataaggcaaaattacccgcaggacagattgttgctgtgaaaaaacttcatgctgcacccaacgaggaaacacccgattcaaaagctttttcaactgaggttaaagccttggccgaaatcaagcaccgtaacattgtgaagtcactaggatattgtttacatccacgtttttcctttttgatttatgagttcctagagggtggtagcttggataaagtactaaccgatgatacgcgtgcaacaatgtttgattgggaaaggagggtgaaggttgttaaaggtgtggcaagtgctttgtaccatatgcatcatggttgctttcctcctattgttcaccgtgacatatcaagtaagaatgttcttatagatttggattatgaagcccacatctctgacttcggaacagctaaaattctgaatcctgattcacaaaatataaccgcgtttgcaggcacatatgggtattctgcaccagagcttgcttatactatggaagtgaatgagaaatgtgatgtcttcagttttggagtgctttgtttggaaataataatgggaaagcatccaggggatctcatttcttcattgttttcatcatctgcgtctaatttgctattaatggatgtgttggaccagcgactacctcatccagtgaagccaattgttgaacaagtgatcttgattgcaaaattaacatttgcttgcttaagtgagaatccacgctttcgcccaagtatggaacaagtgcataacgagtttgtgatgccaaaatcatcttctttggatccactccccatgatcacacttggtcaactatctaaataa

SEQ ID NO: 2629 - DNA, 507 bp, Glycine max var. Williams 82
  misc_feature (1)..(205): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgttcatcattagcatttgaaggcgaaaccagtgatcaattggtggtaactggagaaggaatcgatgctgttttcttaaccaaccggatgagaaagaagttcagttatgcaacgttattaagtgtggaagaagtgaaagaagaaaaagatgagggtggccaagatggaggagaagaggaagatgaaaccgagacaaatgaaaactatcctccaccttgtcccatgtgtggcacctatcattctcctatgtaccatcacgtagtttatgatccataccctaatagctgctccatcctctga

SEQ ID NO: 2630 - DNA, 387 bp, Glycine max var. Williams 82
atgggtttgaaaatggcaatactgatcctaggcctgctggccatgttccttttggtctcctcagaggtggcatccacgaattcaaaagaggtgacaaatggagttgaagatgccaaatatcctggtggaggctatggtgggggttacccaggcaatggcggtggtggctatcctggccgtggtggtggctaccctggtcgtggtggtggctatccaggtcgcggtggtggttaccctggtcgtggtggcggctatccaggccgtggaggagggtattgtcgctatggctgttgcggtggccggacatacaatggaggttgtagaaggtgctgctactacgccggtgaagctgttgctgcacaaactcaggataagactcacaattga

SEQ ID NO: 2631 - DNA, 678 bp, Glycine max var. Williams 82
atccttcatttccaaacatatctcatttatagtttactattgaaagatgggtttgaaaatggcaatactgatcctaggcctgctggccatgttccttttggtctcctcagaggtggcatccacgaattcaaaagaggtgacaaatggagttgaagatgccaaatatcctggtggaggctatggtgggggttacccaggcaatggcggtggtggctatcctggccgtggtggtggctaccctggtcgtggtggtggctatccaggtcgcggtggtggttaccctggtcgtggtggcggctatccaggccgtggaggagggtattgtcgctatggctgttgcggtggccggacatacaatggaggttgtagaaggtgctgctactacgccggtgaagctgttgctgcacaaactcaggataagactcacaattgagacaatgcagttctacgtaatgcttaagatgtttcatgaataaaatctcgtgtcacgagaggcatggattccccgtgatctttcttaccactagatctatttcgaatgtagaaatagtgtataatgtgtaatacgcctttaatttgtacgtgcatgtgtgatcagtttaagagcaaattaaagtgatgaacatcatctattgtagaaattctaatttgtcttaaatatcgtgatttttatttcta

SEQ ID NO: 2632 - DNA, 396 bp, Glycine max var. Williams 82
atgggtttgaagatggcgttactgatcctaggcctttccctcatgctccttttggtctcctctgaggtggcatccacgaatacaaaagaggaggcaaatggagtggatgatgccaaatatcccggtggaagctatggagggggttacccaggtcatggcggtggcggttatcctggccatggcggtggcggttatcctggccatggcggtggtggtggctatcctggtcatggtggtggccaccctggtcatggtggcggctaccctggccgtggtggtggatactgtaggcatggctgttgcggtggccggacatacaacggaggttgcagaaggtgctgctataacgctggcgaagctgttgctgcacaaactcaagataagactcacgattaa

SEQ ID NO: 2633 - DNA, 444 bp, Glycine max var. Williams 82
atgggttcaaagatggctatactgatcctaggcctgttggccatgctccttttgatctcctcagaagtggcagccaggaatttaaaagaggcaggtgaggctgttcaagagacaaatgaagtggctgatgccaaattagttgctgcaggtgaggctgttcaagagacaaatgaagtggctgataccaaattagttggtgcaggtgaggctgttcaagagacaaatgaagtggctgataccaaattagttggtgcaggtggggttgttaaacagagaaataaagtgggttatggcaaattagttggtgttggtggttatgattatgggaattggaatggtggccaacgctctccatatggaacgggagctatttgcatgagaggctgttgttttccatcctcgttgggaggttgcctaagttgctgcccgcatgaatggcagtaa

SEQ ID NO: 2634 - DNA, 978 bp, Glycine max var. Williams 82
atgattgggtatgtcttcaatacgaaagctccaatggcttcttactacttcctcttgcttgttctcgtcggtgcaactacagcttctggggctgaactatgtgcagacttttactcatgcacctgcccaaacttgttgcctatagtgaagaaaggagtggccaaagccattcagaaagaaccacgcatgggcgcttccttactccgattgcatttccatgactgctttgtaaacggttgtgatgcatctatactgttggatgatacaagcaacttcattggggagcaaacagcagcagctaacaaccaatcagctagagggttcaacgtgattaatgatattaaggccagtgtggagaaagaatgccccagagtagtgtcatgtgctgatattcttgctttgtcagctagagattctgtagtttatttaggaggaccttcttgggaagtggggttggggagaagagattctactacagcaagcagaagtgatgctaataatagcattcctgggcctttcctcagtctaactgctctgataaacaattttgctaatcaaggcctctcagttacagatttggtggctctttcaggggcacatacaattggcctggctgaatgcaaaaatttccgagcacacatctacaatgattccaacgttgatccctcttaccgaaagttcctgcagagcaagtgccccagaagtggaaatgataaaacactcgaaccccttgaccaccaaactccaatccattttgataatctatactttcagaatttggtgagtaagaaggcccttctccattccgatcaggagctgttcaatggcagttctactgacaatctggtaagaaaatatgctaccaatgctgctgcattctttgaagactttgccaagggcatgctcaaaatgagcaacatcaagcctcttacaggaagccagggccagatcagaatcaattgtgggaaagtcaattaa

SEQ ID NO: 2635 - DNA, 627 bp, Glycine max var. Williams 82
atggaggccagtgctccagaattgccaatggaagtggcacatgggttccccatgatcagtgttgtagaggatagcttctgtgtgacttacccaacagaaataactgtgaagaagaattaccgtggattcttcttaaaccaacgatacgaggtgttagatgttaacggtgatctcttgcttcaagttgatggctcaagccttgacgtgcgcaagaagagggtcatgcgtgatgctgccggttcccctatacttacaatgcgtgagaaagttaagctgataacactgcggcatcggtggatggttcatagaggcaaaagctcggaggagaaggatctgatttttggggttcaacgatcccaccctcttgacatgaaaccgcggcttgatgtgttcatggccaccaacatcaatgaagatatcagcagctttcaacttgttgggagccacagtgacaagtcctgcaaagtttacaaaggagacaccatgattgcagaggtaattggtgtatatccaaggagcaacttcagcaattggacagaaagttttaaggtcaaaatgaatgcaggggtggattatgctttcattgttgcgttgcttgtaatactcaccgtaaatgattacatataa

SEQ ID NO: 2636 - DNA, 276 bp, Glycine max var. Williams 82
atgaggatgagaatgagaattaggatgatgatgacgatgatcatgagtataaagacatggaagaagaaagttaagaagaaaatagtgctgaatacacgaggagtcaaactcatcatcgtagagcctgcaaaagggagaatgcaacaagttccacttccacccatgattggaggtcttcttcttgaagattatgaatttgatcacaaatgtatatttagacaaaggctgattcagcactcatatacagaaattggaaaatcaaaaaccagtttttaa

SEQ ID NO: 2637 - DNA, 1401 bp, Glycine max var. Williams 82
atgtgtgtctccctctcgtataaatacactaccatcttccatttcctcttcaaatccaattcaccaaacatggttgatctagattggcaaacaaagatggttcactccaacatgcctccaaagtcccccaaactctctctcccggataataacattccaatcccccttcgccagaacgacatcaccgcagcgtcgtctccaatctgcgctgcctacgacaactacctccgcctccctgagctcagagccctctgggcctccaacgacttccctaattgggccaacgagcccatcttaaagcccaccttacacgccctcgaaatcaccttccgcttactcgcaaccgttttatccgacccgaggccgtacataaacaagcgcgagtggacccggcgggtggagtctctcgccacggcccaaattcagatcatagctatgctgtgtgaagacgaagaagaaaaccccgagacacgtggcacgacgccaccggtgagtgacattaacggcttcatcgctcaaagcagaagctacagcgaggagagcctgctcccgcgcctcgccacgtggcacaaatccaaggacgtggcgcggagaatcctcgattcggtagagtaccagatgatgaggtgcacgtacaccttaggtttaggagaggcgaatctcgcgggtaagaagatattcctttacgacgccgtttgcaggccgagcgagattcactcgttggagacgacgccgtttgattacgtggggaactgcgagaacaagacgctgcacgcgacgcagcagatcgcggagtgttggacgcgcgcggtgaggaagctgctggagagagtggcggagtcggtggagagaaaaacgttggagaaggcggcgagggagtgtcacgcggtggagcggatctggaagttgttaacggaggttgaggacgtgcacgtgatgatggatccggaggatttcttgaggttgaagaaggagttgggaatgatgagaaattgcggggaaatggtggcgttttgcttcaggtcgagggagctcgtggaggtggcgaggatgtgtagggatctgaggcagaaggtgccggagatattggaggtggaggtggaccccacgggtgggcccgggatgatggaggcggcgatgaaggtttactcggagaaagagaaaaggaacgggttcgagaaggttcatgttttgcaggggatgcaggcgattgaggtggcgatgaagaggttcttctacgcctataagcaggttgtggcggttatgatggggagctccgaggccgataatgggttcactcagatattccttgaacccacttatttccctagcttagatgctgccaagacctttctcgcttattattgggaaaataataatcaaaatgtggttccctgctag

SEQ ID NO: 2638 - DNA, 624 bp, Glycine max var. Williams 82
atgttggttactgaggacaagtctcatgtcgttgttgccatagacaatgatggctgttgtcaccggagctctgccggcggcgagggtttcgccgacgccggcgaacggtcagatgaggagcaaaggtcctctcatgattctggcaccgagattgtgggagtgtgtgagaaggagagaggatcagagtgttctgtggaggtggatctggttcctgaggttaaggtgcatttggccaatgtggagagggattgtaggatttgccatctcagcatggatatgaccaaccatgaatctgggacttccattgaattgggatgctcttgcaaggatgatttggctgctgctcacaagcagtgtgctgaggtttggttcaagatcaagggaaacaaaacttgtgaaatctgtggatcggttgcacgcaatgtagctggagctattgaaattcaaatgacagaacagtggaatgaggcaaatgatgcttccacggccccaccatctggaccagcaccacccacagaaactcgaaatttctggcagggtcaccgttttttgaatttcctgctagcctgtatggtctttgcctttgtcatatcctggctttttcactttaatgtgccctcttga

SEQ ID NO: 2639 - DNA, 2211 bp, Glycine max var. Williams 82
atggtgtctttaaggccatgccttcttttcattcttctctgtattgccatgattaatcttgcgcattccaataatgatcggaaggcctacattgtctacatgggtgatcatcccaagggcatggactccacttccataccttctcttcatacggtcatggctcaagaagtccttggcggcgattataaaccagaagctgtacttcacagctacaagaactttaatgcattcgtcatgaagttaactgaagaggaggcagaaagaatggcagaaatggacaacgttttctctgttttcccaaacaccaagtaccatcttcacacaacaagatcgtgggacttcataggctttccccagaatgttaatagagcaactacagagagtgacataattgtcggagtacttgacacaggaatttggccggagtctgagagcttcagtgacaggggatttggtcctccaccaagcaaatggaaaggatcatgtcataactttacctgcaacaacaaaataattggcgcgaagtactataatattttacaaaactttaccgaagatgatatgatatctcctagagatacaaatggtcatggatcacactgtgcatccacagttgctggaaactcagttaactctgtaagtctatttggcttggcctcagggacatcccgtggaggagttccatctgccagaattgctgtgtacaaaatatgttggaacaaaggttgtcaagtaatcgacatgcttgcagcatttgatgaagctattgatgatggcgttgacatcatttctgcttcactcgagtcacctagtatacagcactttccgtatttcaaatcagtattcgatgtagcaagtttctatgcaatgagaaaaggtatcttaacgtcacaagctgcgggtaattcgggtccgtctctttacaccatgtcatatcatgcaccatggttactttctgtggctgctaccacttttgacagaaagattgttaccaaggtgcagttgggcaatggggttgtttatgagggggtttcgattaacacatttgatcttgagaaaaaattgtatccactgatttacgctggagatgtacctaacattgctggtggacataacagctcaacatccaggtattgcatagaagactctctggatgcagattcagtgaagggaaagattgttttgtgtgaaagaattcatgggactgaaaacgtggggtttttgtctggggcagctggtgttatatttggactgatttaccctcaagatttgcccgaagcatatgccctgcctgagttgctgattactcagtgggatcaaagactcatacattcatacataacttcaatcagaaatgcaaccgctacaatatttaagagcgaagaaataaacgacgggctaatccctttcgtaccttcattctcatcaagaggtccaaatccaataactgtaaatactctaaagcctgatatcactgccccgggagttgaagttatagctgcatggtctccactcaacccactttcaagtgtcaaaggtgacaaaagaactatacagtataatgtaatctctggcacttcaatggcctgtcctcatgttactgcagcagctgtatatataaaatcattttaccccaactggactcctgctatgatcaagtctgcgttgatgaccacagctactccaatgagtcctacccttaatcctgaagctgaatttgcatatggagcggggctaattaatcctgttaaggccgttaatcctggtttagtatatgatattagcgaagcagattatataaagttcttgtgtggagagggttatacagataaagaacttgaagtattcagtcttaatcatagtagttgcaaaggacaagataacaagagagcggtatatgaactaaatctcccatcgtttgctctttttgtaaacggctcagattttactcgtgcttaccctagaacggttacaaatgtgggatcagtaacatctacttataaagccaaagtaattgctccatctttgttaaatattcaagtgaaacccagcactctttccttcacttctatagggcagaaaaagtcattttgcgtcacaattgaagggataactaatgtagaaatagtctctgcttctttgatttgggatgatggcagtcatcaagttagaagtccaattgtagtgtacggggtgttaccaaatagttga

SEQ ID NO: 2640 - DNA, 2581 bp, Glycine max var. Williams 82
gaagaaggatagaaagaaattaaaaaatataaatagagaaaataataaatggaataaataataatatatccttataattagttacccttttggatttttgtaatattcacgagccgatctgtaagtgggtggttcatttttccaccataaatactctttctttctgctaggcattttgttctcataggagtggcaaatatggtgtctttaaggccatgccttcttttcattcttctctgtattgccatgattaatcttgcgcattccaataatgatcggaaggcctacattgtctacatgggtgatcatcccaagggcatggactccacttccataccttctcttcatacggtcatggctcaagaagtccttggcggcgattataaaccagaagctgtacttcacagctacaagaactttaatgcattcgtcatgaagttaactgaagaggaggcagaaagaatggcagaaatggacaacgttttctctgttttcccaaacaccaagtaccatcttcacacaacaagatcgtgggacttcataggctttccccagaatgttaatagagcaactacagagagtgacataattgtcggagtacttgacacaggaatttggccggagtctgagagcttcagtgacaggggatttggtcctccaccaagcaaatggaaaggatcatgtcataactttacctgcaacaacaaaataattggcgcgaagtactataatattttacaaaactttaccgaagatgatatgatatctcctagagatacaaatggtcatggatcacactgtgcatccacagttgctggaaactcagttaactctgtaagtctatttggcttggcctcagggacatcccgtggaggagttccatctgccagaattgctgtgtacaaaatatgttggaacaaaggttgtcaagtaatcgacatgcttgcagcatttgatgaagctattgatgatggcgttgacatcatttctgcttcactcgagtcacctagtatacagcactttccgtatttcaaatcagtattcgatgtagcaagtttctatgcaatgagaaaaggtatcttaacgtcacaagctgcgggtaattcgggtccgtctctttacaccatgtcatatcatgcaccatggttactttctgtggctgctaccacttttgacagaaagattgttaccaaggtgcagttgggcaatggggttgtttatgagggggtttcgattaacacatttgatcttgagaaaaaattgtatccactgatttacgctggagatgtacctaacattgctggtggacataacagctcaacatccaggtattgcatagaagactctctggatgcagattcagtgaagggaaagattgttttgtgtgaaagaattcatgggactgaaaacgtggggtttttgtctggggcagctggtgttatatttggactgatttaccctcaagatttgcccgaagcatatgccctgcctgagttgctgattactcagtgggatcaaagactcatacattcatacataacttcaatcagaaatgcaaccgctacaatatttaagagcgaagaaataaacgacgggctaatccctttcgtaccttcattctcatcaagaggtccaaatccaataactgtaaatactctaaagcctgatatcactgccccgggagttgaagttatagctgcatggtctccactcaacccactttcaagtgtcaaaggtgacaaaagaactatacagtataatgtaatctctggcacttcaatggcctgtcctcatgttactgcagcagctgtatatataaaatcattttaccccaactggactcctgctatgatcaagtctgcgttgatgaccacagctactccaatgagtcctacccttaatcctgaagctgaatttgcatatggagcggggctaattaatcctgttaaggccgttaatcctggtttagtatatgatattagcgaagcagattatataaagttcttgtgtggagagggttatacagataaagaacttgaagtattcagtcttaatcatagtagttgcaaaggacaagataacaagagagcggtatatgaactaaatctcccatcgtttgctctttttgtaaacggctcagattttactcgtgcttaccctagaacggttacaaatgtgggatcagtaacatctacttataaagccaaagtaattgctccatctttgttaaatattcaagtgaaacccagcactctttccttcacttctatagggcagaaaaagtcattttgcgtcacaattgaagggataactaatgtagaaatagtctctgcttctttgatttgggatgatggcagtcatcaagttagaagtccaattgtagtgtacggggtgttaccaaatagttgattgatatatcaagtgcgttaaacaagatatataaaataaatgaaaatgaaagttgagtgatgtttgtaagtctacgaagaaatgaatgcagataagctcataccatgaccctttttaatttctcttatgaataataatattattaaatttgattggtgcattgttgcatgcc

SEQ ID NO: 2641 - DNA, 783 bp, Glycine max var. Williams 82
atggctttggttaacctttcttacatcggcattgtgacccttataacccttctggcttccaccgaggccagggtcccgggcgtgtacagcggcggcgcgtgggagaccgcgcacgccacgttctacggcggcagcgacgcgtcggggacaatgggcggcgcgtgcgggtacgggaacctgtacagccaggggtacggcgtgaacacggcggcgctgagcacggcgctgttcaacaacgggctgagctgcggtgcctgcttcgagataaagtgcgcgaacgaccccagctggtgccacgctggcagcccctccatattcgtaaccgccacaaacttctgccccccaaactacgcccttccgaacgacaatggagggtggtgcaatcctccccggccccacttcgacctggccatgcccatgttcctcaaaatcgctcagtaccgcgccggcatcgtccccgtctcttaccgcagggtgccttgccgtaagcagggagggatgaggttcacgatcaacggcttccgttacttcaacctggttttgatcaccaacgtcgcgggcgcaggggatatcgtgaggacgagcgtgaaagggtcaaagactgggtggatgagcatgagccgcaactggggtcagaactggcagtcaaacgctgttctggttggtcagtcactctccttcagggtcacagccagtgaccgacgcacctccacctcctggaacattgtacccgccaattggcaatttggtcaaacattcaccgccaaaaatttcagagtctaa

SEQ ID NO: 2642 - DNA, 819 bp, Glycine max var. Williams 82
atggcatcatttccaatcccacagctcctaccatctcacaccaaccactccttaacttgtttcagtagtaacactaacactctgccgttgtcatcctcactgttgcgccgtcgccggactctcgactctctccgatgctcggcgtcgtcggagaagcagccccacgacgacgcgctggagctccctctcttccctctccctttggtcctcttccccggtgcgatcctccccctccagatcttcgagttccgctaccgcatcatgatgcacacgctcctccataccgacctccgcttcggcgtcatctacaacgacgccgtctcgggcaccgccgaggtcggctgcgtgggcgaggtcgtcaaacacgagcgcctcgtcgacgacaggttcttcttagtgtgcaaggggcaggagcggttccgcgtgaacgacgtcgtgcggacgaagccgtacctggtggggcgggtgacgtggctggaagacaggccgtccgagattaatgtcggaggcgatgacgtggaggggctggcgcgtgaggtggaagggtacatgaaggacgtgataaggttgtcgaataggttgggagggaagaagggggagaataaggagattgggaacttgcgacggaatctttttccgacgccgttttcgttctttgtcggaagcacgttcgagggtgctccgagggagcaacaagcgcttctggagttggaggacactgccaccaggttgaagagggaaaaggacacgttgaagaacacgcttaattacctcactgctgcttctgctgttaaagatgcctttccttcttcctcttaa

SEQ ID NO: 2643 - DNA, 501 bp, Glycine max var. Williams 82
atggcctcatccagtggaacatcgagcatgtccaatattcttcttcagagctctagctctgaggaggatttgcagcttctaatggaacaaagaaaaaagaagagaaagcaatcgaatcgcgaatccgcgagaagatcaaggatgcgaaagcagaagcacttggatgatctcattgcacaagtggaccacctcaagaaacaaaagagcctaaccctcatgaaagtggacatcaccacaaaacactatctcgaggttaaggctgaaaattccattctctgggcccagaagactgaactcacccaaagccttcaatcactcaatgatatcatcgatctcatcaacaccaccaacggggtctaccacacggattgctatgatatcaataatcataataatcataacaattattacaataataacaataatttcatgaatcccatgcacatggcatatcttaaccaaccaattgtggccactgcagacaacatgtttctgtggtga

SEQ ID NO: 2644 - DNA, 774 bp, Glycine max var. Williams 82
atggagttgcaagatttgccagaaggatgcattgcaaaaatactgtcatacaccactcctgtggatgtatgcaggctctccttagtttccaaagcctttcgttctgcagctgaatcagacactgtgtgggattgttttctcctttccgatttcacctctatcattcctatttcctctacctctaagaaggatctctatttcactctctcagaccatcccaccatcatccaccagggtagaaaaagtgttcaattggacaaaaggaccggaaagaagtgttgcatgctttccgctagaaatctgaccattatatggggtgatactgttcaacattgggagtggacaagcctgccagagtccaggttccaagaagttgctatgcttcaggctgtgtgctggtttgacattagtgggagcataaatactcttaccttgtcctcaaatactcattatgcaacttttcttgtgttcaagatgatcaatgccagtggatttcactaccatcctacagtgttatcagtaggtgttttaggaggcaatagcaatactaaatatgtttgtttggatcccaacttaaaaggcaatcatcgcttacaagaattacaatttcctaaagtgagaagtgatgggtggttggagattgagatgggagagttcttcaattctggccaagaagaaaaacaggtgcaaatgaaagtcatggagacaacaagtcatatctggaagtgtggtttcattcttgaaggaatagaaattaggcctaaacatgtctga

SEQ ID NO: 2645 - DNA, 234 bp, Glycine max var. Williams 82
atgatttctgctttgggtctcacagggaagtcaagtagcggaaatcaggaagtgtggttggttgtgaaagcgcagtggctatcttatttaaatgatttggtgatctctaccctgaatttagaattcttggattgttcttttgcttctacttttcgatggtctagtatgagagcatttcttaaattacttctccgttgtttcgtcttgggtctcgtgatgtgggatggctgttga

SEQ ID NO: 2646 - DNA, 1497 bp, Glycine max var. Williams 82
atgagcctaatgttgtcaataaaattgcttttgtggttcctgtttttgtcatggtgccactttgccatcccatgtgaggccaaccaacaaggggaatatctctataagtttattcaaacaaagagggctcagaaacgctcttatggagaagcttcttctatggctacaaatcttggtggtgatgaacatttttcgaaggtttatgttgttaaggaacaatccgggttgatggaaggtgacaaagtgaaggctttgccgggacaaccatctcaaggggtggattttgatcaatatgctggctatgttacggtcgatgccaaggcagggagagcactgttctactactttgtggagtcacctcacaatgcttccaacaggccccttgttctatggctaaatggagggcctggttgctcttcctttgggtatggagccatgcaagaactgggaccttttagagtcaacagtgatggaaaaacactttacagaaatcaatatgcatggaacaatgtggcaaacgtgattttcctagagtctccagcaggagttggcttttcatattcaaacacttcgtctgactacacaaaaactggtgacaagagcacagccatggactcttatacttttcttctaaactggctcgagagatttccacagtacaaaactcgagacttgttcatcactggagaaagctatgctggacattatgtccctcagctagctgacactattctcacttataataagcttacaaatcacacagtgatcaacctgaaagggattgcggttgggaatggctggatagatgataatatgtgtggaaagggaatgtatgaatatttctggacacatgctctgaactctgatgaaacccatgagggaattcaaaggtattgtgactttgaaagcggtaacttaacaggtgaatgcagcaaatatcaaagtagaggggatactgagattggatccattgacatttatgacatatatgcccccccttgtgattcagctgcaaaaaaacctggttccagtcctgccactaactatgacagcaattttgacccttgttctgacgattataccaattcctacttaaatctcgcggaagtgcaagaggctctacatgctaaagcctcagtatggtatccttgcagaggggtgggatggacagatagcccagcaacaattctaccaactataaataggttaatatcaagtggcataaacacctggatatatagtggcgatacagatgggcgtgttcccataacatcatctaggtattcagtaaatgccttgaaacttccagtggagacaacatggcgtccatggtattctagcaatgaggttggaggatacttggttgggtacaaagggctcacactaatcactgtaagaggagctgggcacatggttccaagttaccaaccgcagagagccctaaccatgatctcatttttcctacttggagaacttcctcctgaattcacctcttag

SEQ ID NO: 2647 - DNA, 1227 bp, Glycine max var. Williams 82
atggagagagcagagtcatcgattgaacaaattcagcctccaacttatggaaacctagtaactattcttagcatcgatgggggtgggattcggggcatcatccccgctaccattattggtttccttgaatcccagcttcaggagttggacggtccagaagcgaggcttgcagactattttgatgtgatatcaggaacaagcacaggaggtcttgtaactgctatgataactgctccagacaacaataatcgacctcttttcgctgccaaagatatcaagcctttttacatggaccactgtcctaaaattttcccacagcatagtggccttggtgggacgatattagcaaagatgataagatctctgggaggacccaaatacgacgggaaatacctgcatgaggtcgtgaaagagaaacttggagacattcggttgcatgagacactcaccaacgttgtcattcccactttcgacatcaagtctttgcaacccattattttctcatcttataagcttaagatatccccttgcatggatgctaaactctcagacatatgcatcagcacgtctgctgcacctacctatctccccgctcacaatttcaacaatcaagattcaaaaggaaacgtacacgaattcaacctcattgatggtggtgtttgtgcaaataacccgaccttagttgccatgaacgaagttacaaagcaaatcattatgcaaaatcctgatttctttccaattaagccaatggaatatggtcgcttcctaataatttcaataggcaccgggacagccaaaaatgaggaaaaattcaatgcacaaatggcagccaaatggggtttattggattggctaacccaaagtggtagtaatcctttaattgatgttttctcccaatccagttcagatatggtggattttcatttatctgctgtgactcaagcacttcattcagaagataattaccttcgaatacaggatgacacattgaccggaacagattcttcagttgacattgctacaaaggagaacttggagaagctttgccacgttggagaaaaactgttaaagaaaccagtctctaggatcaatttagagaatggtctctttgagccactaaaaaacagggaaaccaatgaagatgctcttaaaaggtttgcaaaaatactttcacaagaaaggagactccgtgaaatgagatccccacacactaaaaagacattctag

SEQ ID NO: 2648 - DNA, 1308 bp, Glycine max var. Williams 82
atgagtagaagaagcatgcctgcaaaattgttgctcacaactttgtatatcctcttggtgtctcttcctattcacatgtcaccacatgatgttaacatagacacacacaaattcagaagtagtagtggccacagaagcaaaactgttggtggtggctcagccaaaggttgcaacaacaaccaatttgacacaaacacaacaccatgtcaaaaatcgacaaccattcaagcagttccagcttcttcacctccccttgtgtttgcagaccaaagacttgaagtagtgtatccaataatccaaaaattcaagtccaccatcacctcagatccactaggagtgaccaaaacttgggtaggatcagatatatgcagctacaaaggcttctactgtgacattcccccagacaatagttctgccactgctttggcttctattgacttaaatggtttccaactatctgcttccacccttgatggcttcattgataatctccctgatattgctctcttccatgctaattccaacaattttggtggcacaatctcaccccaaatagccaaactcccttacctatatgagcttgatgttagcaacaaccaattatctggtccatttcccactgctgttctaggcatgaactctttaacattcttggacttaaggttcaattctttttctggggaagttccaccacaaattttcacacaaaacctccaagtccttttcataaacaacaacatcttcactcaagggttgcctgataacttagcctccactcatattctcttgctcaccttagcaaacaacaagttcatgggtccaattccaagaagtcttcccaaggctttggccactctaagtgaagtgcttttactaaacaaccagttaacaggttgtttgccttatgagattggttttctcgaagaggccacagtgtttgatgctggcaacaaccagttaactggtcctttgcctttatctttgagttgtcttgagaaggtggaggtgctcaatttgggtggtaatatgttgtatggcatggtgccagaagtggtgtgtgtaggattggtgaatttggtaaacttttcattatctgataactatttcacacatgtggggccactttgtaggatgctgattcagagaggggttcttgatgttaggaacaattgtattcctgatcttccgtttcagagatcagtgatggagtgtgctgagttctttgcaacaccaaggatgtgtcccttcatgtggtttcatggtctcatcccttgtaagcttccttttcaacattccattcacaattag

SEQ ID NO: 2649 - DNA, 1449 bp, Glycine max var. Williams 82
atgcccactttttttcttccaacgctcctcctccttctcatagccttcgccacctctgtctccggccgccgtgacctcgtcggagactttctccggctgccctccgaaactgataacgacgacaacttcaagggcacccggtgggccgtcctcctcgccggttccaatggttactggaattacagacatcaggctgatgtttgtcacgcctatcaaatattgaggaaaggtggtctgaaagaagaaaatattattgtttttatgtatgatgacattgcattcaatggggaaaacccaaggcctggagtcatcattaacaaaccagatggaggtgatgtttataaaggagttccaaaggattacaccggcgaagatgttactgttgataacttttttgctgctttacttggaaataagtcagcactgactggtggcagtgggaaggttgtggacagtggtcctgatgatcatatatttgtatactatactgaccatggaggtcctggggtgctcgggatgcctgctggtccttacttatacgcggatgatctgattgaagtcttgaagaaaaagcatgcttctggaacatataaaaacctagtattttatctggaggcatgtgaatctgggagtatctttgaaggtcttcttcctgaagatatcaatatttatgcaaccactgcttccaatgcagaagaaagtagttggggaacatattgccccggggagtatcctagtcctcccccagaatatacaacctgtttgggtgacttgtacagtgttgcttggatggaagacagtgacagacacaatttgcgaacagaaactctgcaccaacaatataaattggttaaagagaggactatatctggagattcatactatggctctcacgtgatgcagtatggtgatgtagggcttagcagagatgttctcttccattatttgggtacagatcctgctaatgataatttcacttttgtggatgaaaactccttatggtcaccttcaaaaccagtcaaccaacgtgatgctgatctcatccatttttgggataagttccgcaaagctcctgagggttctctcaggaaaaatacagctcagaaacaagttttggaagcaatgtctcacagaatgcatgtagacaacagtgtaaaactgattgggaagcttttatttggcattgaaaagggtccagaagtactcaacgctgttagaccggctggatcggcacttgttgatgactggcactgcctgaaaaccatggtgaggacttttgagacacattgtggatccttgtctcaatacgggatgaaacacatgaggtcctttgcaaacatctgcaatgtagggataaagaatgaacaaatggctgaggcttcagcacaagcttgtgtcagtattccttccaatccctggagttctctgcaaaggggtttcagtgcataa

SEQ ID NO: 2650 - DNA, 1245 bp, Glycine max var. Williams 82
atgaacaacgatttcctttggcttccatcgctatactcggatccggaagtgttcacgtatttagaacccttcgtgttccgcagctcttctctgagctcgcattttctgcattcgctggcgacaaattcccgaagcttcgcgctcgaggaggcgttcggacatgtgtcgcggttctccggcgcgttgctgttctggctctcgcgcgcgtcgagctccaatgtggcgcgttccttgcgcggttcgccgccgctccggttcggtagcgtgcaggttaaggctgggtcgacgacgaatgtgcgcgtgttcgggtttccgttcggatcgaagtggaaatcgtcgttttcgagtgtgaggttggggaagatttcgagtttggcgatgaggatgatttggagagaagcgaagaggcttagcttgttccccgttctgtcgctggctgttgcgttggttccaccgtttcaaaacttgtcatcaaatgtactagctagcccgttgctcaatcctgatgtgcaaatttttggagccatggaccaagtgcctaaggaagttgaatgccaaggatgttcgtttctaccgtgtcttgagttgagccaggcaaaacctgcagtggagcctaaaactggtattgaatttcctttggttctagacaatctattcactggagagaagaattacaacttaaactctgaggtcctggttggaacaggatccagaaccatgacaattgttaaaatcaagtcactgaaggtctatgcttttggagtttatgttcatccatattccctctgtgagaaattggggccaaaatatgcatcaatttctgctgatgaattgaataaccatcatgacttctacaaggatcttctcagggaggatatcaatatgactgttagacttgttgcaaattgcaggggtatgaaaattaacagcgtgaaagatgcttttgaaaaatcacttcgagctcgattagtaaaggcaaatccatccacagactttagttgcctaaagacatttggttcatacttcacagagaatatctcaattcctttgggaacagtaattgagttcaaacgaacagttgatggacgtctgatcactaaaattagtgggaatcagataggaagtgttcacagcaaagatttgtgtcgggctttctttgacatgtacattggagatgtccctgtgtgtgaacaaactaaaaaggagattggcatgaatgctgcaaatattattaacaagtgctaa

SEQ ID NO: 2651 - DNA, 804 bp, Glycine max var. Williams 82
atgtattcaatttcagagtcccaaacccaatcttacgcgccgaaagaaatagagtggcacatgctcgacaagtcaaagttcttcttcctcggagcatccttgttctccgctctctccgccgccctctaccccgccgtggtcttaaagacacgtcagcaagtgtcctccgccaaagtctcgtgcggcaacatgtcgcgcgccatcatgcgctgcgagggtttccgaggtttcggcacttccttgatgggaacaatttccgcacgtgcgctccacatcttccgcatgcccgcacaattgctgtggaccccagttgatgtcgtgagccaaagactcatgtgttacaggaatggttttgaggcattaaggaaaattctgggtgttgatgggccaagggggttttacagaggcttcggggtttcgattgtgacttatgttccctctaacgcggtttggtgggcttcgtattctatggtggttgtggtgattgtgggtgtgcaatggttgagtgcggttatggctagtggggtttcggctgttgtggctatgccacttgactcgatcaagacaatgtggatgcttcataagctgcaagtgttggattcagaagagattaagggacaaaggaggtcactgactcttgtgcaagtggttcggaattcggtgaagaaagggggaatcttgggttgttacaaaggattgggaccaaggtgggcttcgatgtccatgtctgcggcaaccatgattactacctacgagttcttgaaacgcgtgtctgctaagaatctagatagattgactgtgtag

SEQ ID NO: 2652 - DNA, 2589 bp, Glycine max var. Williams 82
atgacacattctaagacaattattcgaataaccgtcttagaaattcgaatatatgacgatggttccaaaactgtcttaaaaaaaaccttgaaaaagcacacagattgttctgagtgggatggggtcacgtgcgacaccatctcaggccatgtcatcggtcttgaccttagcttctgtaatcttcaaggtcagctccatcccaactgcaccatattcagcctaagccaccttcaacgactcaacctagccaaaaatgaattttttggtgacattccctccataatctcttgcttgtccaaattactattccttgatcttagtagcaactacgactccaggagaatgagagttgatccatacacatggaacaaactcattcaaaacgcaactaatttaagagagctttatttagatgacgtggacatgtcttcaatcggagtcagctctttgtcattgctaaccaatctatcttcctctctcatctctcttagtcttgtatccaccgaattgcaagggaatctatggagtcacatcctctctttacccaatcttcaaatgctagatttgagttttaataaagaccttggaggtgaacttccaaagtccaactggagtactccactaagcaacttggctctcgcttatactgctttttcgggaaacattcccaattccattggccatttgatgtctcttaacagtctagctctgcagagttgcaattttgaaggactgattccctcatcattgtttaatctaactcaactctccactttagatctatcatttaataaattagttggccccattccaagcaaaatcaataaacttccaaaattgcagtttctatatttgactgataacaagttaaatggaacaattccatattggtgttattctttgccttcgttgttatggttggatcttagccacaaccacctcacggggtcaattggtgaattctcatcttattctttggattacttgtcactctctaataacaaactgcaaggtaattttcccaattcaatatttgaactccaaaatcttactggtttgagtttgtcatcaactgacttgagtggtcatctggactttcatcaattttcaaaattcaaaaatctattttacctcgatctttctcacaataattttctctctattaactttgatagtaccgctgactacatcttacccaaccttcaatccttatatttatcttcctgtaatattaatagtttccctaaattcttagcaccacttgaattattgtcgaatctagatctttctcataacaacattcgtggaagcattccccagtcgtttcatgagaagctcttacactcctggaattatacaattgctcatattgatctcagtttcaacaagttgcaaggagatctcccaattccacccaatggaattgaatactttttagtctcaaatgatgagctgaccgggaacattccttcagcaatgtgcaatgcaagcaccctcaatatactcaacttggctcataacaacttgaccggccaaattccacaatgtctgtcaacatttccttatctttcagcattggatttgcaaatgaacaacctttatggaaacataccttggaacttttctaagggaaatgcatttgagactataaagttgaatggcaaccaattcgatggaccattaccacggtctttggcccactgcacaaatttggaagttttggacctgacaggcaataacatagaggatacatttccccattggctagaaagcctccaggagttacaggtattcagtttgcgatcaaataagtttcatggtgtcatcacatctttcggtgccaagtatccatttcccaggctgagaattttttatgtctcaaataacaattttagtgggcccttgccagcttcatacatcaagaactttcaaggaatggtgagtgtgaatgacaaccaaactggtttgaaatatatgggtaaccaaaatttatataatgattcagtagtggttgtaatgaaaggtagatacatggagctcgagaggatattaagtatttttacaactattgatttatcaaataatatgtttgaaggagaacttccaaaagtcattggagaattgcattctctcaaaggacttaacctttcgcacaatgcaatcactggtaccattccaggatcctttggtaatttaagaaatttggaatggttggacctctcgtggaaccagttgaaaggagagattcctgtggctttgatcaatttgaattttctggcagtgttgaacctttcacaaaaccactttgagggaatcatacctacaggtggacaatttaacacgtttgaaaatgattcttatgctggaaatcaaatgctatgtggatttcctttgtcaaaatcctgcaataaggatgaagattggccaccatattcaacatttcaccatgaagaatcaggatttggctggaaagctgtagcagtgggatattcatgtgggttgctatttggaatgcttttgggatataatgttttcatgactgggaaaccacaatggctcgcgagacttgttgaaggtttgcttaattaa

SEQ ID NO: 2653 - DNA, 927 bp, Glycine max var. Williams 82
atgtggagagagggagcgttattggtggtcctgctgctgctgctcctcctagtccagcaaaattgtgctaccaaggatgagcaagagcatggttgccctccttcttcctgtggcaaaatcaccagcataacttatccatttcgattaaaaggtgacccaaaaagttgcggccacaacaggtacgagctagcttgtgaaaataatgttacagtgttatatttgtactccgggaaatatcatgtacaggcaatcaactacaacaacttcacagtccgagtggttgatcccggagttcaacaacaaaactactcttcccttccacgctatttcttgtcacaatccaatttcagtgattcctatagtgacgccacggatccataccaagccggtctaaaaccaattaacaattgggcatggctcattttccagcatgtagtgtttatgaattgtagccacccagtgacctacaatcgtaaatatgtggatactgctccctgcgtcaactctgactccaaaggctattacatatactctattgctggtgacttaaaagcacatgactttgaagttggttgtcacgtaaagctggttgctctcacatcttggtggggtttcgacacaaacaatcattcctacactgccatgcacacggggctagtctacggattcgagatttcatggatgcacctcgcctgtgagaatcattgtcgatataaatatggacgtttatatagatatggatatggaaatggaaatagatactgctatttcgactattccatccagaaccttcgatgccctctgtgtaatcgccaacgttcccgcattatatgtggaatactggaaatactgctattcgttgccggtggtaagaattttatcatcttaatttacctatcctttaattattacattaccaagaattag

SEQ ID NO: 2654 - DNA, 381 bp, Glycine max var. Williams 82
atggcttccaacaaggttattgccaccatcttggttctttctctccttgcctactcaacatcattcaccaatgcatgtggcacatgccacccaaaacctactccttctccccctcctccatcagggaagtgccccaaggacacattgaagctaggggtgtgtgctgatgttctaggacttgttaatgttgttgttggttcccctgtctctagcaagtgttgtgcattgcttgaaggtttggctgattcggaggctgcactttgcctttgcactgctattaaggccaatgttcttggaatcaacttgaatgtgcctatcacactcagtgtgctactcagtgcttgccaaaaaactgttcctgctggcttccaatgtgcatag

SEQ ID NO: 2655 - DNA, 1059 bp, Glycine max var. Williams 82
gatagtcctagtctttaacaaccactaagcaaggaacctattatttcagaagcatacaaaaacatccaactgtaacattatcaccctctcttccactcaatcagatttgcacatgatcgagcctcacaatttgcctttaaattggtccacccccccttgtccttccccattgtgattcatttgcacatttggaaagtgttgtttttctttttttcatttgcattgcaaagcaaaaaccttgcaaattgcaatggcttccaacaaggttattgccaccatcttggttctttctctccttgcctactcaacatcattcaccaatgcatgtggcacatgccacccaaaacctactccttctccccctcctccatcagggaagtgccccaaggacacattgaagctaggggtgtgtgctgatgttctaggacttgttaatgttgttgttggttcccctgtctctagcaagtgttgtgcattgcttgaaggtttggctgattcggaggctgcactttgcctttgcactgctattaaggccaatgttcttggaatcaacttgaatgtgcctatcacactcagtgtgctactcagtgcttgccaaaaaactgttcctgctggcttccaatgtgcatagaactccatcacatgctaggttcattccatcacctgtgtcctcaaattgttgttttgttttagttcttctttgtgctatgacacgtttcattttaataataagctaggtaaacacgtgtttgccttagttagtaaccttttctcttttctagtaaatttggggaactttgattattgtaatttttacttttggggtatattggaggtggaaaatgttaagtagagaaagagagtgacttccttaggggatgattaaacctctgatggcattgttaaaccttaaagaccaatgttagtcgacaaaattgtatgcaaattgtaatgtacgttacaatcaagtgtgtgtattatcaatttatgttaactacggtctattattttttttatattgttgtcattattcacatatctctgtttacaagagaaatc

SEQ ID NO: 2656 - DNA, 1122 bp, Glycine max var. Williams 82
atgctcaaaattcgcgtcctcgtaccactcccacaaccttgattagttgtcttttaaatgtgttctaggtgttgttggctcaacctcaaacaaagtttgtagccccacacatcaacctcaaagtccttaatattaacacgacaaaacacataataatagtagtttcttgcaattacttgcataaaaaattgttctggtaacacttttctcacacacagaacatgtttgtcctagaaaatggtgcgaagaagaagggggaagacccaaggcttcaagcaatctcccaagccatcagagtggtgcctcacttccccaaacaaggaataatgtttcaagacataacaacattgctgttggatcacagcgcgtttaaagacgtggttgacatttttgttgatcgttacagagacatggatatttctgttgttgccggagttgaagccaggggattcatttttggttcctcaattgcgttaggcattggtgccaagtttgttcctttatgcaaacctggaaagctaccaggtgaagtaatttcagaaaaatatgttctagaatatggaactgattgcttggagatgcatgttggcgctgtccaacacaatgaacgggtcataattatcgatgatttggtggctacaggtggaactctgtcagcagcaattatacttctagaacgtgctgatgctgaagtagtggagtgtgcttgtgtgattggtctctctgatctcaagtccaagttcttcaccaaaaataataaaacagataaaggtacgcagcaaacttaatggaaagccactttatatccttgtggagccacgtcaagtagaaaatggtttttgaggttgaaattcaaattgtacactacacatgaagaaatggttgcatataaatgaccctttggagaactctacaattgtattttgtttggagtctcacaatgagaacactcaagatttcaaacatccttacccaatggaggcaccattttgctaatttagagacattttaatatgtcgtgtgagtatatatatatatataagattatacttctttttggggtgtttcccattacagtctccctaagagaattatgttcaacatagtaaaacacattaaata

SEQ ID NO: 2657 - DNA, 1173 bp, Glycine max var. Williams 82
atgtctaaagaagttattgctactcaatcacctactccttttgagtatgagatcttggatagtgatgctgaagtccttagaactgttagagcctcatccaattgtgctaatccatggattgaacctgaaaggttgaaacttagacatagaattggccgaggcccctttggtgatgtctggctagcaactcatcatcagtcaactgaagattttgatgagtaccatgaagttgctgctaagatgttgcatccaatcagagaggatcatgtgaagattgtattagagaagttcaatgaattgtattttaagtgccaaggagttgctagcgtttcctggctacatggaatttcagtcttaaatgggaggatatgcatcattatgaatttgtgtgagggttcaattggtgacaagatggcaggactcaaagaaggaaggatttcattgaatgatgtcttaaggtatggaatcaatctagctcaaggtgttcaggaacttcactctaaaggcagcttcatcctgaaccttaaaccttttaatgttcttctcaatgataatgatcaagcaattttgggagatgttggtattcctagccttttgcttggctcatcattcctgagctcagacatggctaagaggcttggaactccaaattacatggctccagagcaatgggaaccagaggtcagaggtcctatatcctttgaaacagattcttggggatttgggtgcaccattgtcgaaatgttgactggtaaccaaccttggtatggatgtcctgttcgcagaatataccagtcagttgttgaaaaacatgaaaaaccaaatattccaagtggccttccttcttcagttgagaatatcctcagtggatgctttgagtatgatttgaggaatcgcccgttaatggtagatattctgagtgtctttcaaagtgtgaatgatagtcttctggcaagcatttctggcttcatcatgttattttgtctatatttgcttccaaaatattgtatcaagagaaagttcaaaggtgttgaaattataatatctttgggtctagagtttgaacatgttctactactactactattattattattattattatttgtggctactggtgcagttcttacttttgtctatgcaaataaattaacatgtttgctccacatttga

SEQ ID NO: 2658 - DNA, 3217 bp, Glycine max var. Williams 82
tttttcttgctttttgtctctttttgggttgatttgagttggtttatttcccttggtttggttgtgttttggtgaatgtgtgagaatgttcttatgggtatgttagggttttttagcctctgcaagtgtaaggggtatctttagattgaatgaaattgaactcgttggttcctgcatttgggtgttgctattttgatgttagatgtttatatccatgattacttagtgaagagggatttgaaagcttcagctcaggcttttcaagctgaagggaaagtgtcctcggaccctgttgctattgatgcccctggaggatttctgtttgagtggtggtctgttttctgggacatatttattgccaggactaatgagaagcactcagaggttgctgcatcttatatcgagacccagttaattaaggcgagagagcaacaacagcagcagcagcagccacaacctcagcagtcgcaacatcaacaacagcagcagcagcaacaacagcaacaacaacagcaacacatgcagatgcaacaaatccttttacagagggctcagcagcaacaacagcagcagcagcagcagcagcagcagcaaccacaacagcagcagctgcagcaaccacagctgcaacatcagcagcagccaccacagcaacaacagggtagggatagggctcatctcttaaatggtggtacgaatgggttagttggaaaccctggcacggcaaatgcactagcaacaaagatgtatgaggaaaggttaaaattgccccttcaaagggactctttggaagatgcagcaatgaagcaaagatatggagaccaactcttagacccaaatcatgcctcaatattgaagtcatctgcagctactggccagccttcagggcaagttttgcatggtgctgctggtgcaatgtcttcacaagttcaagctcgtagtcagcaattaccaggatctactcctgatataaagagtgagatcaatcctgttttaaatcccagagctgcagctcctgaaggatcattgatagcaatgcctggttcgaatcaaggtagcaataatttgactctgaaagggtggccgctcacaggcttggagcaactacgttctggtctactccagcaacaaaaacctcctttcatacagtctcctcagccatttcatcaacttccaatgttgacaccacagcatcagcaacaactaatgctagcacaacaaaatttggcatctccatctgcaagtgatgataatagaagactcagaatgctgctgaataataggaatatcggtgtaactaaggatggtctttcaaaccctgttggtgatatagtatcaaatcttggatcacctcttcaagcaggtggccctgcttttccacgtagtgatacagatatgctaatgaagttgaaactggcgcaattacaacatcaacagcagaatgccaatccacaacagcagcaactgcaacagcatactctttcgaatcagcaatctcagacttcaaatcatagcatgcatcaacaagataaaatggggggaggtggtggcagtgtcaatgtggatggtagcatgtcaaactcctttagaggcaatgatcaggtttccaaaaaccagactgggagaaagagaaagcagcctgcatcttctggtcctgccaatagttctggaacagctaatacagctggtccatctccaagttcagcaccctcaactccctcaacacatacacctggtgatgtgatgtcaatgcctgctttacctcacagtggtagttcttcaaagccattaatgatgtttagtgctgatggctctggaactctgacatcaccttcaaaccaattggctgatgtggaccgttttgtggaggatggatctcttgatgataatgtggagtcttttttatcccatgatgatacagaccctagagatactgttggtcgttgtatggatgtaagcaaaggtttcacattttctgaaataaattctgtacgtgcaagcactaacaaagttgtctgttgccatttctcatctgatgggaaattgcttgctagcggtggccatgacaaaaaggctgttttatggttcacagattctctaaaacagaaagccactcttgaagagcatgcatatttaatcactgatgtccgtttcagtccaagcatgcctcgtcttgcaacatcttcatatgacaaaactgtcagggtgtgggatgttgaaaatcctggatattcgcttcgtaccttcacgggacattcttcatctgttatgtcactagattttcaccctaataaagatgatcttatctgctcttgtgatgttgatggtgagataagatattggagcattaacaatggcagttgtgctagagtctcaaagggtggcacagctcaaatgagatttcaacctcgtctagggaggtacctagctgcagctgcagagaatgttgtttctatacttgatgtggaaactcaagcatgtcgatattcattaaaaggacatacaaaatcgatacattctgtgtgttgggatccttctggggagtttctggcatctgtaagtgaggactctgtcagggtttggactcttggatcagggagtgaaggggagtgcgttcatgagcttagctgtaatggcaataagtttcactcgtgtgttttccatccaacatattcttcgctgttggtcgttggttgttaccagtcattggagctctggaacatgactgagaacaagacgatgactctatctgctcatgaaggtcttattgcggcattggcggtttctactgtaaatggtttggttgcttcagccagtcatgacaagtttgtcaagctctggaagtgactttattgtgtcattaatacaggttatttttatctgtgttgatattgttgtagtttatgatccctttttttggtttaatcaacccaccttcacaacatgttggtagtttatgtacccttttatgtagcttgatcattcaccctcatcacatgtttgtagtttatatgcccttttatgtagcttgatcaaccaccctccctcttttgccatttggtataatctgattttctttgtaaccatagatagtaacttttgtaatattgccacccctgttgtatcctgtttcataattgttatacttggagatttctgctcgtgtcatttagattagctattataatttatgaggagtactaacgactcattttct

SEQ ID NO: 2659 - DNA, 447 bp, Glycine max var. Williams 82
atggcttccatgaatttattcaccaccattttccttgtcaccgacgcccggaatccggccatctattttccccggcggtggcggcccaacactgtcccttttgccgcctcttcgccggcttctcctcccgaaatagagctcgagttcgtcgggaaagcgaaagcaataagtggagagaagttgttgaggaacatcatgttggataacaagatcgagctgtatgccacctacgggaagctgatgaactgcgggggaggtggtagctgcggaacatgcatagtagagattcttgaaggaaaggatcttttaaatgaaagaacaaacactgaattcagatatcttaagaagaaacccgaatcttggaggctggcttgtcaaactattgtcggaaacaaagaaaactctggcaaggttgttgttcaaaggattcctcagtggaagaagtaa

SEQ ID NO: 2660 - DNA, 525 bp, Glycine max var. Williams 82
atgacggaagacagaatacaaaaaagactccaaaggcatcatttttcactgacatattaccctttatatgattctttcctgatatctgtattgatgttctatgaaaaaatagaacatcttgtagaagtatctgttaaggattgttcatataccttatcattctttaaggataatttcatgcattatgttagatatcaaggaaaattcattttggtttcaaagaatactcctcttttgataaataaatggaaatacaattttatctatttatggcaatgtcattttgatatttgtattcggcctaatctttcagtggtacaaaatcatatgttgcaaaattcatttctaataaaaatggttatgaaaaggctggatacaatagttccaattattcctctaattagatcattggcgaaagcaaaattttgtaatgtatttggccatcccatttgtaagccgagtttgtatcaaataagatatatacttcgactttcttgtataaaaactttgactcgtaagcacaaa

SEQ ID NO: 2661 - DNA, 1938 bp, Glycine max var. Williams 82
atggctcttagaagagcatactattgccttcttacgcttttggtgttcgccctatgttttgagccattgttgggagacacagatgctcaaattttgatgaggttcaaagcttccttgtccaataacaatgccttaaacaactgggtgaatgagtctagtttatgtagttggagaggtttgttatgcaaccacactgaccaaacattttatggcttgagactacacaatatgagtctaggtgggaagattgatgtagacaccttgttggaattgccaactttgacaagctttagtgtcatgaacaatacatttgagggtccaatgcctgagttcaaaaagcttgtgaggttaagggcattgtttctgtccaacaataaattctctggcgatattccggatgatgcttttgagggcatgacaaaactgaaaagggttttcttggcagagaatggcttcacgggtcatattcctaagtcacttgctaacttgcctagactttgggatttggacttgcgtgggaatagttttggaggaagcataccagagtttcaacaaaaggatttcagaatgtttaatttgtcgcataaccaattggaaggttcaataccagaaagcttaagcaacaaggatccaagttcatttgctggcaacaaaggcctatgtggaaaaccgatgagtccgtgcaatgagattggtggcaacgagtctagatcagagattccctaccctgattcatctcaaagaaagggaaacaaataccgaatccttataaccgtcattatagtgatcgtagtggttgttgttgcttcaatagtagcacttctatttatccgtaaccactggagaaaaaggttgcaacccttaatattaagcaagcaggagaattccaagaacagtgtagacttcagggagtcacaatccattgatgtgacaagtgatttcaagaagggtggtgatggggcattgaactttgttagggaagacaaaggggggtttgatttgcaagacctgcttagagcctctgccgtggttcttggtagtggcagtttcgggtccacatacaaggctatgattttgaatggaccaactgtggttgtgaagaggtttaggcacatgaacaatgctgggaaacaagagttcattgagcacatgaaaaggcttggaagtttgacacaccctaatcttctcccccttgatgcattctactacagaaaagaagataagtttttggtttatgactatgccgaaaatggcagcttggccagtcatctacatgatagaaatggctcagtgctaaactggtcaacccgtttgaaaatcgtaaaaggagtagctagaggcttagcatacctctacgaaagcttccctggccaaaatctaccgcatggccatctcaagtcctccaatgttgttttggaccattcatttgagccacacttgacagagtatggccttgtgccagtgatgaccaagagtcatgctcagcggttcatggcggcctacaaggccccagaggtgaaccaatttggaaggccaaatgtgaaaagtgatgtgtggtgtctggggatcctcattctggagcttctaacagggaagttcccagcaaattatctgaggcatgggaagggtgggaacaattctgacttggcaacatgggtggactcagtagtgagggaagagtggactggtgaggtgtttgataaggacattatggggaccaggaatggggagggtgagatgctgaagctgctgaggattggaatgttttgctgcaaatggagtgtggagagtaggtgggattggagggaggcactggcaaagattgaggagttaaaggagaaggatagtgatgaagaatactcttcttatgtcagtgaaggggatttgtattcaaggactatgactgaagatgagttctctttttctgtcactaattga

SEQ ID NO: 2662 - DNA, 282 bp, Glycine max var. Williams 82
atgggcgacaccgtgagtttgcccaacttatcgaccaaagtagtagctattgctgcaggggaagcacacactctccttcttacaggggatggacgtgtttattcctggggaagaggaatactgggacggcttggtcaaggttctgaacatgacaagcattttcctgttgaagtcaagtttggatcagaagaagacagcgtaagaatagtgggaattgccgctggtgcttatcatagtcttgctctagcagatgtcgataatgctcctggctccggcacgtga

SEQ ID NO: 2663 - DNA, 952 bp, Glycine max var. Williams 82
tagttataatctacacacacccgagacaatgggcgacaccgtgagtttgcccaacttatcgaccaaagtagtagctattgctgcaggggaagcacacactctccttcttacaggggatggacgtgtttattcctggggaagaggaatactgggacggcttggtcaaggttctgaacatgacaagcattttcctgttgaagtcaagtttggatcagaagaagacagcgtaagaatagtgggaattgccgctggtgcttatcatagtcttgctctagcagatgtcgataatgctcctggctccggcacgtgagggatatcagtctgcggagcctaagggatgactcggggctacggggcatgaccatcatgcaaaggatctgatgcgtggcctggtgtcatgaaaggatgcgagatgcggaagaaccagtccatgtagtcactagcacactgacctggcacagcgcacacatcacctgttggaatgatatgatctgagtagtgcatccacctgtcgtttatatcatcatacgagacccatgaatcgacaggaggagcaggaatggtctgtgtgtatccaaactgccgcacgaccctctctggtcgataataaacagcaacaggcccccagcgcaagagaccagaatagcatgatctgatgtggaagtcccggaccaatcggtaatccccatacgagatccaacacacatccggaatctgaagtcggtccaggcactccctgtacgccggcgtacgaatgctcttcacgatcttcttcgtcacaatccacctacacgcacatggagaatcctcgtcgtagtcctgatcagtagtggagtctgcgactgacggaaagtgctcgtaaatccagcactacagatgtaacatcaaaattataaacattaataatgaaagtgtaacaaaatttaaagttgaacattgttgagtctgaacg

SEQ ID NO: 2664 - DNA, 1449 bp, Glycine max var. Williams 82
atggatggtcaacttggtatacatggagaggaatttcatggcagaaaatacaccgatggagattattctatagtgccctgcttattgaataagtttcttgacttgcacccccctgattcttcatcaatatcaattgttccagaaacagaaggccaagcatcactaaagataattgatgtcaaagcaggaggaatgatgtctctgtgtattgataatcttggggccctctggctgtggggaaattgccctcaacaaagcaaagaaggcgacttctctcttataagcaatttcactccaacaccagtgtgggattttcatggccacactgtagttaaagtagcatgtggaaacgaacatgtcgtggcacttgttactgctggagaatcatacaagggcgtggatgatctagtgtgctacacttggggtaacaacagtcatggtcaattaggcttaggggacacaaagaataggccaagaccacaagtggtgaaaacatttgatcttgaatccccttgggcaatatatgaggtagcatgtggtgccttccacactgctttgcttactcacaaaaagaggcacagtgacacattagaaagcacatgctggacctttggccttggggataatggccaactaggtcgtggcacaacacaaagcacatcacttcctgaacctgttaaggaattgccacaaaatgtgcatcttgtttctgttgactgtggcttgtttcacacttgtgttgtttcctctgatggggatgtgtggtcatggggaatggagaagggtcttggcttgtgttctgatgatagcaatggtggaacacattctggtgatgctctttctccgtttcttatctcttgcaatccacatcaacctaaattttcacaaccagttcaagttgcatgtggggctgctcatactgtcattattgcgcatgagggttgcaagctatggtcttgggggagaggaaggagtggagttcttggaaatggtaagactatggatagttacactcccaccatagtgttgtggcctccactgatggaagatttcaaacaagaggaactatatagctcatgtgagcatgataaaaatgagactaaagaagtcacagaaatagatgagagactatcttcagcattgaatcaactgaagctgcttcaaacaaagctatccataatagaaagatatgccagtatacttcatagttccctatttggtgaaccttttgatgagcaagatgttcctgcttcattgaaaaattcaggtgcatttgacattgcaaaggaatgggagaacatgttagaggcagcagatggtacaaagctgattaatttggaaatgctctaccgaaacatgcatgctagtgtgaaagaaaagctaatgaaaagaaggatcaaggcgattatagatgaatgcctactacaatcttcacaggtgaaaaattag

SEQ ID NO: 2665 - DNA, 2073 bp, Glycine max var. Williams 82
gttctggggggatcatgagaagttagacattgctaagcaggggaagtgaatctcctcccttacccttgatgatggggacacaaactcaagaggcttaattaattatcaagattaaatactatgtgccttatttggaatttaaagatttttccccctttctaacatttcctgctacttgtgttgtgtgttaacagatgatggatatgtttggtgttggggctacaatatatgtatccttattaataagcttgaaatcccttggtggaattaaattacagaaattcattgttcagttgtttatagttctaaaaatattattgatttatattgtttatcaacatccttgaccactatatggatggtcaacttggtatacatggagaggaatttcatggcagaaaatacaccgatggagattattctatagtgccctgcttattgaataagtttcttgacttgcacccccctgattcttcatcaatatcaattgttccagaaacagaaggccaagcatcactaaagataattgatgtcaaagcaggaggaatgatgtctctgtgtattgataatcttggggccctctggctgtggggaaattgccctcaacaaagcaaagaaggcgacttctctcttataagcaatttcactccaacaccagtgtgggattttcatggccacactgtagttaaagtagcatgtggaaacgaacatgtcgtggcacttgttactgctggagaatcatacaagggcgtggatgatctagtgtgctacacttggggtaacaacagtcatggtcaattaggcttaggggacacaaagaataggccaagaccacaagtggtgaaaacatttgatcttgaatccccttgggcaatatatgaggtagcatgtggtgccttccacactgctttgcttactcacaaaaagaggcacagtgacacattagaaagcacatgctggacctttggccttggggataatggccaactaggtcgtggcacaacacaaagcacatcacttcctgaacctgttaaggaattgccacaaaatgtgcatcttgtttctgttgactgtggcttgtttcacacttgtgttgtttcctctgatggggatgtgtggtcatggggaatggagaagggtcttggcttgtgttctgatgatagcaatggtggaacacattctggtgatgctctttctccgtttcttatctcttgcaatccacatcaacctaaattttcacaaccagttcaagttgcatgtggggctgctcatactgtcattattgcgcatgagggttgcaagctatggtcttgggggagaggaaggagtggagttcttggaaatggtaagactatggatagttacactcccaccatagtgttgtggcctccactgatggaagatttcaaacaagaggaactatatagctcatgtgagcatgataaaaatgagactaaagaagtcacagaaatagatgagagactatcttcagcattgaatcaactgaagctgcttcaaacaaagctatccataatagaaagatatgccagtatacttcatagttccctatttggtgaaccttttgatgagcaagatgttcctgcttcattgaaaaattcaggtgcatttgacattgcaaaggaatgggagaacatgttagaggcagcagatggtacaaagctgattaatttggaaatgctctaccgaaacatgcatgctagtgtgaaagaaaagctaatgaaaagaaggatcaaggcgattatagatgaatgcctactacaatcttcacaggtgaaaaattagtacatataaaagtaagaagtgaaccattctggtcaaaggattgcacatacaaattaataagctaattgtctccaaattattgtctttattttgtgtccgtgagaatatttttgtaagcctctcgtgtgattgagttctgtacagagttgagcaccaactggcattgatttttatgccataaatgtttagtatgccatatccatgagtagttgtatccgtcctcttgttgtagtatgacttactccctaatctccttattcaattgaagct

SEQ ID NO: 2666 - DNA, 1116 bp, Glycine max var. Williams 82
atgcgtgcagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaa

SEQ ID NO: 2667 - DNA, 2921 bp, Glycine max var. Williams 82
aaaagctcaaaatttgccattttcacaagtatgttttgggcaattagagatccttcggggtgttttgacagataggtcattttgtgctgtgtatggtgatggtcttctctgattcaaataccacacgctgcctcctcctctctccaatttgcagcaagtgcagctttgagagtggaacggtcaacagaagctgtagaactgcggtggcgcaatttgaccactccggctgccgttatctgcaattttggaagtgaaaagtgctgctaccgccgtgatggccagctatgtgaggaagcaacatattaagatctgagacgattgtgcaaacatggagtgcaacaaagatgaggcagctagggtcaaagaaatagcagagaggaaatttactgaaagggaatatgctggtgcaaaaaagtttgctctcaaggctctaaatttgtttcctgcactggagggtctttcccagttgctaacaacacttgatgtttatatctgtgccgagaataaaatacatggagaaatggattggtatggtatacttggagtgtatccatatgcggatgaagagacagttaggaagcagtacagaaagctggctctaactcttcaccctgacaaaaacaagtctccaggtgcagaaggtgcattcaagcttgtttcagaggcgtggagtttactatcagataaggtcaaaagactagcatataaccagaacaggagattggaaggatttcaggataatgctcccaacaagaatggttatataaaacttaacaagaatgcaacttcaagcatgagaacaggaaataatgatgctcgggcacatccacatccgcatacaccctccattcctcctccacatacaaatgctggtaccttttggactatctgtaataagtgcaagacacattatgagtatctcaggacatatttgaatcaaacccttttatgtcccaattgtaaacaagcttttgtggctatagagaagggtccgcctcccaatgttttcaagtcatctaattggtcttctcggcaacatcatcagaagtcttctcggcaacattccaatgttggaaggaatcaccctgtgaatccaggaagaactggtgctgtttctcaaaatttacaatccagcggttttagtaaaccaaacttccagtggggtcctcactcgagaatggctggctttgttaaaaaagatggatcatcttctgtttcagctgcaaatgttaagcagcagtcaagtgagacaaaaagagaatgcgagggagtccagtcaattgctgcatgggagaggaatcatatgcataagaggtctgatgttccttttagtaatgccgaaaaacctatgaagaaaatgaggacagatgatatgtacaatacaaatcatatgaccatgagagatggatcaagcagtttgggccatttttatggatcaggaaaagctaatgtgggagcagaaaggattcatgttttttcaggtacttacaagcattacagcacaaaagagttgtcattgtttgaattacgaaatatgttggttgataaggcacagactgaaattcgcgagaaacttctagaatggagatcaatggctgaagctaggattacaaacaaggacaaaggaaacgagagacagaaaagcacattcaatgacaaaacaactggtccagagaaagattccactattaatggtaacaggcacgtggacagtgattctatcccagtcaaatctgatgatactgaaaaggagaaggcagcctatgttacaatcaatgttccagatcccgattttcacaattttgacttggacagaactgaaaattcttttgcggaggaccaggtctgggcagcttatgatgatgatgatggaatgcctcgctattatgctagaattcacaaggtgatttccacaaagccatttagaatgcgaatcagttggcttaactctcgaagcaacagtgaattgggcccaatagattgggtaggtgctggtttttacaaaacatgtggggatttcaggactggcagacatgaaataactgaatcgttaaattccttttcgcacaaggtaaggtggacaaaaggcaccagaggagttgttcgcatctttcctgggaagggggaggtctgggctctctatagaaactggtctcctgattggaatgaaaatactccagatgaagtgatacacaagtatgatatggtggaagtggttgaagatttcaatgaagaggaaggtttattggtcacaccacttgttaaagttgatggttttaggacagtgtttcacaggcgcagccatgatcaggcaagaaagattcctaaagtggagatatttcaattctctcatcaggttcctaattacttgcttactgggcaagaagctcataatgctccaaagggctgccgagagttggatccagcagctactcctttagaccttcttcagacaacagctgaagaggcattggataatgtcggaaaatcaaaggaagacacttaccccgggtcacctgaaaaccatgctgctggtaagggggagaatgcttcaaaacctactagagaagatatgttagacgaggatggtaaacaggtaaagtatgatagatgaccctgcacagtatagaaaagtgatgactgataatgcaaataggcttaagaaattaaattcaagattggtgaaaatatagtatgataggttactctgcattttgtaagcctgaccccaacaatttaatagtgttttcttgtctcataattggatggaagggattagcagcatttgggttttgctatataattttgagacttgttattcgtatagttatcgttatactcaactgtcaaacgaagttttcatctttgacaagcttaaatgagtagactattgttcttgcaatttcttttgctcgtctcgt

SEQ ID NO: 2668 - DNA, 513 bp, Glycine max var. Williams 82
atggtcatgagcagcatcacatttcctccaaacagtgacgactacattggcactgagagctgcacggacctccaaaacatagaccatgtcattgataaccaccagtcctttaaatccaacgatgcaggaaacaaaaccaaggtcaagaacaacatcaaaatgaaagagaacaaagtgttccctccccctatacccttactagctcgaactcagaacctggcctcacacatgccatgggtgttgaagaggtactacacaaacgagggaaggttgattttgaaagaggaaaaggtgaagcaccatgagtactttcgtgcacatagtgccaatggcagactcacattgcagcttgttaacgttccctttgatgaccatgatgagtactttgaagaagcaacacctagtccacatgaagcggctgatattattgataacgttactcatgataatgatattactagtaatggtaggtttgatgaagatgaagagaatgaggctaggcattgttgctga

SEQ ID NO: 2669 - DNA, 456 bp, Glycine max var. Williams 82
atgctgctcggaaagagacctcgtcctccaatgaagagaaccacaagcatgtccgaaatgaccttggatctgaacaccgccgccgccgccgatgccgccgccaaccaacagagatcaggtgttggtcccggtgctgcagcagatcagactacgaggatgttggcaacacccaaaatcctcagaagacattcttcggatttcggagacacgcctcccttccttcgcgcctgctccctctgcaaacgttgtctggtgcccggtcacgacatctacatgtacaggggtgataatgctttttgcagcctggagtgccgccaacagcagatgaaccaggacgagagaaaagagaagtttgtcatggcgtcgaagaaaaaggtcgtggctactccaccgtctgggtctcaagtcgccgtcgccaccgccaccaagggtgaaacaaccgtggtggcgttgtag

SEQ ID NO: 2670 - DNA, 1869 bp, Glycine max var. Williams 82
atgagaaatgaagaactaggaacttggttgaacgggttttccaacaacaacagcatccttcaccgtggccacgtcacctcaccaccacaacctcaaccttcttcgagtgttttctccatgatccatgatgatggtgttgatattgatgcgatgctgtgtagtgattttgctagaatgagtgtttttcacgaactagggaatgttggtgccaaaaccagaggatatggtgctaatgttatggattcatcatacccacatgcattcttaaactcacactcaccttgttcttttgatgcacatgcacatgttcatgaagaaatgggtaccccattacctacttggggtgtttcagttccttctgatgtgaagggacacacttttggacccccaatggagtcttcttctcatacccaaaggagcaacacttgctatgggcacgttccactgcaaaacccatttcatgctacaaggccttttgtagtggattgtgatgtgaaaaaacccattgtgttctctcaaagtcaaaccatgatgcaaccaaagattgctatgaatgtaaacacgccatcatcacattgtttccctgcagcaaaagaaagaggaacaacaagtgtagctgtaaccaccaatggtgatttttctcactctagagggaacactttggggtttcaatttgacggtggttttgtcctacaagagaagaatgtaaaatgctatgctggtagagggtgtcattctttgtggggttgcaaagagagtttacctttactagttcaacaagcagtgggagaggaacttcctcaactcattcctcctcgtgttgctcccactagacatgaaaagaatggcattctcgccagcgatgtttcgctttctctgcggccattgttgtacaattttagtcctttgtctaagttccatggctacatttactacctggctaagcaccagaacggttgccgcttcctgcagaggatgattgatgagggcacctctgaacatgtgctaatagtgttcaatggagtcatagatgatgttgttgagcttatggtggacccttttggcaactaccttgtgcagaagttgcttgatgtgggcggagatgatgaaaggttgcaggttgtgtcaatgttgacaaaagaaccagggcagctaatcaaaacctctttgaatatacacgggactcgggtggttcagaagctgatcacgactgtcgactctagaaaacaaattgcaatgcttatgtctgctattcaatctggttttcttgctcttattaaggatctaaatgggaatcatgtcatacagcgttgcttgcaatactttagctgtaaagataatgagtttattttttatgctgctacaaagttttgtgtggagatagctactcatcaacatgggtgttgtgtattacaacgttgcattgattattccaccggaaaataccaagataaactggtaaaggaaatatgcagacatgggcttctacttgctcaagatccatttggaaattatgttgttcagtatattatagagatggagaacccaactgcctcattcaaactgcattctcagttcaaagggaactacaccaacctctcaatgcaaaaatatagcagtcatgtggttgaaaaatgcctcgtgcatcttgcagagatcaagtcaaggatagtccaagaatttttatcttttcctcactttgagcagttgctacaagacctatatggcaactatgttgttcaacgtgctctcggagtgaccaagggctttctgcatgcatctctagctgaagcagttcgcccctacaaaatgttgcgcaccagcccttattgcaaaagggttttctcgaggaacctgcttaacaagtga

SEQ ID NO: 2671 - DNA, 813 bp, Glycine max var. Williams 82
atggctgattcactatcggttaattttgattcttcaatcaagtctgaattctccaccgaacaagcacacaaaactacccatgaggctaaacactctccatctaacatccaaaaggctattgctgaggttgttggtacatacattcttatatttgcaggatgtggagctgctcttgtaaatgagaagttgccccttacaatagtaggcatagcaatggtttcgggtctaggtctaacggtggctacatattctgttggccatgtctctggtggccatttcaatcctgcagtcacaattgctttggctgctgtcagaaaagttcaatttaaacttgtgcctatttatgtgttgtgccagatgatgggtgctacactggcccctctcaccctcaaagtgttgtatcatgacaaggcagatattggagtaacagtgactaaatacttgagctcaacttctgatctagaagcaatagtgtgggaattcatcaccacatccatactaatgctcaccattcgcggtgttgccactgatcacagagggagcaaagatctcactggagttgcaataggcatttcagttctgattaacgtcatcattgccgggcctattactggagcttcaatgaatccagcaaggagtttaggtccagctattgtatctggtgattacaaaaacatttgggtttatatcataagcccaattcttggtgcagtctcagcaagtacactttacaaattcctagaagtaaacaaaccagttaaacccgaaccatgccattgtaacatatgcaatcataatcatttacctttctaa

SEQ ID NO: 2672 - DNA, 813 bp, Glycine max var. Williams 82; identical to SEQ ID NO: 2671

SEQ ID NO: 2673 - DNA, 1440 bp, Glycine max var. Williams 82
atgggttctctggaagcaatcaagaagccccatgccgtgtgcgttccattccctgcacaaggccatataaacccaatgctgaaactagcaaaactccttcacttcaaaggctttcacataacctttgtcaacactgagtacaaccacaaacgccttctcaaagcgagaggccctgattcccttaatggtctctcttcatttcgttttgagaccctcgccgacgggcttccccagcctgacattgaaggcacacagcacgtgccttcgctctgtgactacaccaaaagaacttgcttgccgcacttcaggaacctcctttccaagctcaatgattccccggatgtcccttctgtgagttgtgttgtttctgatggcatcatgagcttcactttggatgctgcccaagaacttggcgtaccaaacgtcttgttttggaccaccagtgcttgtggattcatgtgctacgtacaataccagcaacttgttgaaagggaccttacaccgctcaaagatgctagttatctcacaaatgggtatttggagactagcattgattggatacccggcatcaaggaaattcgactgaaggatatccctaccttcattagaaccacagatccagatgatatcatgcttaatttcgcacgtggcgagtgcataagagctcagaaagcttctgcaataattttgaacacatttgatgccttagagcacgatatcttggaagctttctcaaccattttgccacctgtgtattccatcggccctttaaattttctcttgaatgaggtcaaggataaggacttgaatgcaatcgggtccaacttatggaaggaggagccagggtgtttggaatggctcgacacaaaagaagtcaacacagtggtttatgtgaactttggaagcgtcacggttatgacaaatgaccaattgattgagtttgcatggggacttgccgccagcaacaaaaccttcgtgtgggttataagaccagatcttgtgattggtgaaaacgctattttacctaaagagtttgtggcacaaacgaaaaatagaggcctattgtctagttggtgtccccaagagcaagtgttggctcatccagcaattggggggtttttgacacacaacggctggaattcaacgttggaaagtgtgtgtggaggtgttccaatgatatgttggcctttttttgcagagcaacataccaattgtcggttctgttgcaaggagtgggggattgggttggagattgaggatattgagaggggcaaaatagagagccttgtgagggagttgatggatggtgaaaagggtaaagagatgaaaaagaaagctttggagtggaaaagattggcaaaagtggcagcttctagtccaagtgggtactcgttggttcaatttgagaaaatgattcgtgaagttcttatagcattttga

SEQ ID NO: 2674 - DNA, 1044 bp, Glycine max var. Williams 82
atgggtgtctccttcctctcgacttgcccttccctgcttccactcgttgcttatgatacaccaccctccaccagataccaacctcgttcagtgtccatttgttgtaataaaaccataagcaatgttagtgatgaagagccgttccattggagaaggagagaaattcttaaatgcgctggggcaaccgttggcttggaattgattggaagctccggatcgcttgttggaatggctaatgctgctgacttgatacagcgcagacagcgttctgaatttcaatctaaggttaaggaaacactttttacagccataaagggaaatcctgatcttatcccatccttactgacactggctctaaatgatgctttgacttatgataaggcaacaaaatcgggtggtccaaatggctctatacggttcagctcagaaataggtagaccagaaaatacagggctttctgctgccatgaatttattagaggaagcaaaaaaggaaatagactcatattccaaaggtggacccatttcctatgcagatctgatccactttgcagcgcaaagtgctgccaaggctacatttttagctgctgccattcgaaaatgtggtggaaatgaggagaaagggaaaacactgtacaatgcatacggatcgaatgggcagtggggtttgttcgataggcaatttggtagggctgatactcaagacccagatccagagggaagagttccaatatgggagaaggcaagtgtacaggaaatgaaagacaagtttgttgctgtaggctttggtcctcgccagctggctgttttatctgcattcttaggtcctgatcagactgcaacagagaccttattggccactgatcctgatgttgctccatgggttcagaaataccaacggagccgtgaaacagtctctcagacagattatgaggttgatctgataaccactttcacaaaactgagtaccttgggccaacaaatcaactatgaggcatatacatatcctccaccaaagatcgacattaccaaactcaaattgtaa

SEQ ID NO: 2675 - DNA, 618 bp, Glycine max var. Williams 82
atggcttcctctgttgctttagttttgggtctatgtctagcactcaacatggttctgccgacacgtgcagctacccacacagtgggagacacctcaggttgggcactcggtgctgattacagtacatgggccagtggcttgaaattgaaagtcggagatagtcttgttttcaattatggggctggtcacacagtggacgaagtgaaagaaagtgattacaagagctgcaccacaggcaattcactaagcacagacagcagtggcaccaccacaatcaccctcaagactgccggcactcactacttcatatgtgcttctcctggccattgtgatggtggtatgaagcttgctgttaaagtaaaggctaaaaaagcatctgctcctgctacagcaccttcaccagctgcaaaggactcaccttctgattctgatgacaccaaagacacacccacttccacctccactaaccctaaaacttcaacctccaccaccccttcaactgaaacctccaccactaccacatcttcttatacatcatctgcaactgctgctggctccccaattgttgctatgttttttgcttctttgatcccatactttgtgttgcgtttgatgtga

SEQ ID NO: 2676 - DNA, 1023 bp, Glycine max var. Williams 82
atgtttagcattaaggaattagttgaatcgaattgtctgaagtctgttccctccaactacttttgccttaaaaaccccgaagattccatattgtattatgaagctgataatattccaaccattgatttttcccaactcacctcttcaaatctcaatgaacgctccaagggaatccaacaactaggcaatgcttgtcgcgattggggtttcttcaagctaattaatcacggtgtgtcggagacactaatggataagatgcttagggcaagccagaggttttttgacctgagtgaggaagaaaaaagggagtacgcaggagggaaggtacttgatccaataagatatgggacaagcttcaatctcatggtggacaaggcgcttttctggagagattatctcaaatgtcatgttcaccctcactttaatgttccttccaaaccccatggttttagcgaaactgtggatgaatacatcacaaagagcagggaagtggttggagagttgctaaaaggaatatctctaagcttagggcttgaagaaaactacatacataaaaggctgaatgtagagttgggctcccagtttcttattctcaacttttacccaccttgtcctaagcctgaacttgtaatgggcctgcctgcacacacagaccatgggcttctgaccctcttgatggaaaatgagcttggagggcttcaaattcaacataagggcaggtggattcctgtccatgccttacccaactccttccttatcaacactggggatcacttggagatactgaccaatgggaaatacaagagtgttcttcatcgtgcagtagtgaatacgaaagccacaagaatttctgttgctacagcacacggggccccccttgacaccagtgtgggccctgcaccggagcttgttggagatgaaaatcctgctgcataccgtgccatcaaatacagagattacatacactttcagcaaagcaatgaactggacagaaggtcctgcttggatcatattcggatttga

SEQ ID NO: 2677 - DNA, 660 bp, Glycine max var. Williams 82
atggtttggtcaattaggtccagaataagttcacttctctgttcaaaggcacctttagtgggttcatacgtctatgactcatgttggtgcttatgcttttctgctccaaccagctcctccatagcaaggccttggccaaactttatggattgggtacaaatggaccgttgccgtgcagcagcatcgttgcctttgatcaaagagcagaatggaccatcagaaagtaatgctgctcttgagtttgcagtaactactcttcaggttgagaatatattagtcattggtcatagtagctgcgctggaattgaagctttgatgaatatgcaagaagatgtagaatcaggaaacttcacacacaagtgggttgccaatggaaaacttgccaaacaaaggacaaaagctgccacagctcatcttagctttgatcagcaatgcaaattctgtgagaaggaatctattaaccaatcattattgaacttgctcagttatccttggatagaagatagagtaagaagagagttgctttctctacatggagggcattataatttttccaattgctcgtttgagaaatggacccttgattttaaagaatgcaatgttaaagaagaagaagaagaaagcagttatgttgtcaaagaacaagaattctggtgctga

SEQ ID NO: 2678 - DNA, 1617 bp, Glycine max var. Williams 82
atggctgtttcaaccagcttctcgggtgtaaagttggaggctttgttgctgaaatgtggttcctccaatgctgccaccaccaccactcatatatcatgttttggcaaaaacagaaagacacttgttcagagtcagagaggggctattcgttgtgaggcttcttctgcttctgatgttgtggctgatgccaccaagaaagctgctagtgtctctgctcttgagcagcttaagacctctgcagctgataggtatacaaaggaaaggagcagcatcatggttattggactgagtgtgcatagtacacctgtggaaatgcgtgaaaaacttgccataccagaagcagaatggccaagagccattgcggagctttgtagtctgaatcatattgaggaagcagctgttctgagcacctgcaacagaatggagatatatgttgttgctctgtccaagcaccgcggtgtcaaagaagtcactgaatggatgtccaaaacaagtgggatcccggttgcagacctttgccagcatcagtttctgctatacaacaaagatgcgacacagcacctttttgaagtatctgctggtcttgattctcttgtgttgggagaaggtcaaatccttgcccaggtgaagcaggttgtcaaagttggacaaggagtgaatggctttgggaggaacattagtggactattcaagcatgcaatcactgtggggaagagggttagaactgagacaaacattgctgctggtgcagtttctgttagctcagcagctgttgaactggccctgatgaagctacctgaagcctcacatgccaatgcaaggatgctggtcattggagctgggaaaatgggaaagcttgtgatcaagcatttggtggcaaaagggtgcacaaagatggtggttgtcaatagaagtcaggagagagttactgcgatccacgaagaaatcaaggatgttgagataatctacaagccactctcggagatgctcacatgtattggtgaggcagatgtggttttcaccagcacagcatcagagaatccattgttcttgaaggatgatgtcaaggaccttcctcctgccaccaatgaagttggtggccgtcgcctgttcgtcgatatttctgttcctagaaatgttggatcatgtctctcagaccttgagtctgtgagagtgtacaatgttgatgaccttaaggaggttgtggcagccaacaaagaggataggctaagaaaagctatggaggctcaagcaatcattggtgaagaatcaaaacaatttgaggcttggagggactcattggaaactgtccctaccattaaaaagttgagggcatatgctgaaagaataaggttggctgagcttgagaagtgcctaggtaagatgggtgatgatatcaacaagaagacacaaagagctgtggatgatcttagcaggggtatagtgaataagttgcttcatgggccaatgcaacacttgaggtgtgatggcagtgacagcaggactctaagtgagacccttgagaacatgcatgctttgaatagaatgttcaaccttgagactgaaatatctgttttggagcagaagattcgagccaaggtggagcaaaagccatag

SEQ ID NO: 2679 - DNA, 489 bp, Glycine max var. Williams 82
atgaaagggtctttgtatgttgctgatttccatatgttatccacttctctttctatgagtaaatccaataacccttcctctccttgtcaaacccgtgtctctcctagtagtgtgagaggtttgagcttcaaggtcaacatttcttggccgatccatgcttcttgtattgtgcagcgacaaaagaagaagaataacaatggttttgttgtggtggggtgtgcaaaatgggatttggaagctgacatgaaaccacaagaagatgaggaaaagggtaggagtggaatggcaacgtttaggcacaagtgtggagaaagaaagggggttgtggagctgttggagtgtttggaaagagaagctataatgggtgaagatgtgggaaaagagccttctgattacaaccgaagggctcagatatttgatagaagttctcaagttttccaagctctcaagcaactcaacaatgatgttttcccagagtcttcacaatag

SEQ ID NO: 2680 - DNA, 1081 bp, Glycine max var. Williams 82
atacataataatccatccaaagtcctcaaacatgaaagggtctttgtatgttgctgatttccatatgttatccacttctctttctatgagtaaatccaataacccttcctctccttgtcaaacccgtgtctctcctagtagtgtgagaggtttgagcttcaaggtcaacatttcttggccgatccatgcttcttgtattgtgcagcgacaaaagaagaagaataacaatggttttgttgtggtggggtgtgcaaaatgggatttggaagctgacatgaaaccacaagaagatgaggaaaagggtaggagtggaatggcaacgtttaggcacaagtgtggagaaagaaagggggttgtggagctgttggagtgtttggaaagagaagctataatgggtgaagatgtgggaaaagagccttctgattacaaccgaagggctcagatatttgatagaagttctcaagttttccaagctctcaagcaactcaacaatgatgttttcccagagtcttcacaatagaaggcagtggctttggtttcattttgactccatacttggtattttgaaataaacaagtagtgggcaatttgtatcatagaatttggatcttttgatgcattaccaagtagtattatagtactcagaatcctctctcttgtacatgttgcgtctttatttgcttgttgaatgttgagaaaccaaactatacatccaaaacattttgttaacttcataatcaaatgaagaatctagctttcttgaaatagaatcatgccacaaacaaaatagagtttgcattagacaaattgtttacaacatacaagaaagataactagagacattatccataccatttttcgaatatcatttgaggagggatcagagaaaatctatatcatattattaggtgaaactcggtgtgagttcctttaaataacttgggccaatatatttccatttgtaggttttcaacattttattctaacagtatcaaagataatcaaagaacaaaatttccagcattcctcttagttacaatacacattcattgaatgtcaaaaagtggtgacctttctcaag

SEQ ID NO: 2681 - DNA, 753 bp, Glycine max var. Williams 82
atggaaaagaaagtccttgatctcatattagtcccaagtggcttccttgtgatgttggcttaccatttctggctcctccaccaaatcatgaaacaccccaccaaaacagtcattggtgtcaatgcaatcaatcgccgtttatgggtccaagccatgatggaggatgtgtccaagaatggggttctagcagtgcaatctttgaggaacaacataatggcatcaacccttttggcttcaacagctataatgttgagttctctcattgctgtgttaatgagcagtggcaatgagagaaaaaccgtggtttatgaggtgtttggggacaggagtgagcttggtttgtccataaagttcttttccatattggtgtgtttctcgttggcgtctttgttgaatgtgcaatccataagatactatagccatgcaagcatcttactcaacgtgcccttcaagaaagtgtctccaaaccttaggcaccaaatgctcacagctgagtatgttgccaacactgtgaaccgaggcagttacttctggtccctcggcttgcgtgccttctacttctctttccctctcttcatgtggctctttggacccattccagtgttcttctcttgcgttgcccttgttttcatgctatacttcttggatgttacatttgagtgtggatgtgctggagtttctgacactcatagtgttgaatctgctgaattgaacaaacacaatgttgatgtggaaattggaaaggccaattag

SEQ ID NO: 2682 - DNA, 960 bp, Glycine max var. Williams 82
atgggtgaggaagcaaaacaggaacaagtacaaccggtggctgaagccaagcctgaggagaagaaagaagagatggcagaggaaaagaaggaagaaaagccagaagaagagaagaagaaagagcctaaaccaccttccccatgtgtgctgtttgtggacttgcattgtgtgggatgtgccaagaaaattgagagatacattatgaaaatgagaggagttgaaggagtggtaattgacatggctaagaatgaagtgaccataaagggtatagtggagcctcaagcaatctgcaacgcaatcaccaagaaaactaagagaagagcaagtgttatatctccgttgcctgaagcagaaggagaacctatacctgaagttgtcaattctcaggttagtggaccagttactgtggaacttaatgtaaacatgcactgtgaggcctgtgctgagcaactcaagaggaagatactacaaatgagaggagttcaaacaacaatgacagagtttagcacagggaaggttcttgtgacaggaaccatggatgcaaacaagctagtggattatgtatatagacgcaccaaaaagcaagccaagatagttccccagccagaacctgaaccagaaaagaaagaagagagcaaagaagctgaaaaacctgcagaagaagagaataaaccagaagagaagaaagaagaggagaagccaccagaggaaccaaagaaagaagagggtggtgagggtggtgaaggtggtggtgagaacaaagaagaaaagggtggtgaagaaggcaaagaagaagccaaaaaagaagacaatgtggtggtggtggctaataacattgacgacgaaggcttgaagagaatgatgtactattaccagtaccctccactttatgtcattgaaagaataccacctccacaactcttcagtgatgaaaatcctaatgcatgctgcattacatga

SEQ ID NO: 2683 - DNA, 180 bp, Glycine max var. Williams 82
atgataatggttgtggttatgacaggtatattaggagagtacacagcagtgctaacaagggtcacagagcgccttcttcctcgccatggcataagttttcgtggtctaaggaggaaccttcgttttgcttccacaacctcttcttcagattcagcttcttcttttctggtttacttttaa

SEQ ID NO: 2684 - DNA, 369 bp, Glycine max var. Williams 82
atgagtcaaagtggctacatcaatgagaaatcaggcttgtccttgagacagaattcccataggaaatcaaacagaaatgggcaagtgaagagctgcatgttcaggattccttggcagtctgagagctctcccattgaacttgtgaaggatcttgcagaaagagtcacaaatgctctacgcttgatctctccaaagagatctttacaccaaggctcgtcttccttatcaagatcaaaatcaacagggtcctctattgattctcatagaactgctgctgttgaggactgcattgagttcatccactcttccttttccagatcaaattcatcaaccgaagcaccccgccaagattctattcaagctccttga

SEQ ID NO: 2685 - DNA, 1464 bp, Glycine max var. Williams 82
atggtttcgtcagtttcgtgggtgagaggcaagtgcgtcggtaagggcgcgtttggggttgtcaacgtggcggtttcgaaaagagataatcgcgttttcgcggtgaagtccgtggattgcggaagggggctttctggtcaggtggaggcgttggagaacgagattgggattctgaaacgagttacctcgccgcacgtggtggcttatatcggcgacgatgtcacgtgcgagggaacggcgtcgttcaggaaccttcatttggagtacatgccaggtggcaccgtcgctgatttggaccgcgctgacgtggacgagcggttagtgaggcgctacgcgtggtgcctcgcgaccgcgctgcgtgacgtccacgcgcaaggcttcgtccactgcgacgtgaaagggaggaacgtgcttctctccggcgacggcgaaatggcgaagctcgccgacttcggcgcggcggtggaaattgaatcctctccggcgatgttgctgttcccgcgggggagtccgatgtggatggcgcccgaggtggtgcgccgggagcggcaggggccggagtccgacgtgtggtcgctcggatgcacggtgatcgagattgccatcgggaaaccggcgtgggaggaccgcggcgtcgacacgctgagtcgaatcggttactcggacgagttgccggaatttccaatccagttgtcggagctagggaaggattttctcgagaagtgtcttagaagagaaccgagtgaacggtggagttgcgatcagttgcttcagcatccatatttgcttccctactacgcccttgttgaatcgtcgcctcggtgcgttctcgaccgggttgactcggagttgaattccgagtcagattataacgaccgtgatcatcaagaagaggtgttttcaatatttactaacatcgaagaaaattcagttattaaaaatagaataagtaaattagcgacagagtcgagggtaaattgggaaacacatggttgggtagtggtgagggaagttgagtccaacggagaaccaacgacaacgggaacagaggaagaaggagcgtgtacgtgtgagcgtgatggtgttggttccaacaaagaaggggtaaattgggaatttcacaatgtggcagagactggtatggtatattcggattctgtaggggcaaatcggagaataagaaagtttggtgggagtaacaccgctggagggggtgttggttgttgctgtcggtatgggtgtggatgggaaaagttgggtaggaatagaggaataatcagcatttacagcttgtattgtaaaaatttcatgtcgtataatttaatattcttaatgtatatcaatatattatgcttttcgattatttatgttgtttaccttttactgcacgtgactgaaaagattagggatgtgaaaaaattaattggaaaggaaaggtgtttgcaattgagagccagaaggtag

SEQ ID NO: 2686 - DNA, 1464 bp, Glycine max var. Williams 82; identical to SEQ ID NO: 2685

SEQ ID NO: 2687 - DNA, 504 bp, Glycine max var. Williams 82
atgggtaacagcttaaggtgttgtttggcttgcgttcttccgtgtggagccctagacttgatccgcatagtgcacttgaacgggtacgtggaagaaatcacgcgtccaatcacggcgggggaagttcttaaagcgaatccaaaccatgtcttgagcaaaccgacctcccaaggcgtggttcgccggattctgatcctctcaccagataccgaactcaagagagggagcatatacttcttgatcccgacagcatcgctgccggaaaaaaagaaaagacgttgcagtgacgatggtggtaatgataatgatcatcgtaataagaatgaccttgtcaaagtgtcttccaagaagagcatgaagagcaaccatgatttgccatcatcacaacaatgtgataatgagggctttgtactttctaaggagaagaaatgctcacggcgggatcaccggagccgtcgcggcggattgtggcagcctcggttggagagcatctcagaagactag

SEQ ID NO: 2688 - DNA, 1728 bp, Glycine max var. Williams 82
atggcatcttcttctggtagtttagacacctctgcaagtgcaaactccttcaccaacttcaccttctccacacaccctttcatgaccacttctttctctgacctccttgcttctcccttggacaacaacaagccaccacagggtggtttgtctgagagaactggctctggtgttcccaaattcaagtccacaccaccaccttctctgcctctctctccccctcccatttctccttcttcttactttgctattcctcctggtttgagccctgctgagcttcttgactcgccggttctccttaattcttccaacattctgccatctccaacaactggagcatttgttgctcagagcttcaattggaagagcagttcaggggggaatcagcaaattgtcaaggaagaagacaaaagcttctcaaatttctctttccaaacccgatcaggacctcctgcttcatccacagcaacataccagtcttcaaatgtcacagttcaaacacaacagccatggagttttcaggaggccacgaaacaggataatttttcctcaggaaagggtatgatgaaaactgaaaactcttcttccatgcagagtttttcccctgagattgctagtgtccaaactaaccatagcaatgggtttcaatccgattatggcaattaccccccacaatctcagactttaagtagaaggtcagatgatgggtacaattggaggaaatatggtcaaaaacaagtgaagggaagtgaaaatccaagaagttattacaaatgcacataccccaattgccctacaaagaagaaggttgagaggtctttagatggacaaattactgagatagtttataagggtactcataaccatcctaagcctcaaaatactaggagaaactcatcaaactcctcttctcttgcaatccctcattcaaattccatcaggactgaaatcccagatcaatcctatgccacacatggaagtggacaaatggattcagctgccaccccagaaaactcatcaatatcaattggagatgatgattttgagcagagttcccaaaagtgtaaatcaggaggggatgaatatgatgaagatgaacctgatgccaaaagatggaaaattgaaggtgaaaatgagggtatgtcagcccctggaagtagaacagtgagagaacctagagttgtagttcagacaaccagtgacattgatatccttgatgatggctataggtggagaaaatacgggcagaaagtagtgaagggcaatccaaatccaaggagttactacaagtgcacacacccaggatgtccagtgaggaagcacgtggaaagagcctcacatgacctaagggctgtgatcacaacttatgagggaaagcacaaccatgatgttcctgcagcccgtggcagtggcagccattctgttaacagaccaatgccaaacaatgcttcaaaccacaccaacactgcagccacttccgtaaggctcttgccagtgatccaccaaagtgacaattcccttcagaaccaaagatcacaagcaccaccagaagggcaatcacccttcaccctagagatgctacaaagtccaggaagttttggattctcagggtttgggaatccaatgcaatcttacgtgaaccagcagcaactatctgacaatgttttctcctccaggaccaaggaggagcctagagatgacatgttccttgagtctctactatgctga

SEQ ID NO: 2689 - DNA, 1077 bp, Glycine max var. Williams 82
atggaatcccatgatgaagagcatgctgccaaactacttagagctcaaacccacatatggaatcacatatttagcttcataaactccatgtcccttaaatgtgtggttgacttaggcataccagatatcatacacaactatggccaacccatgccactctcaaacctcattgcttcactaccaatccacccatccaaaacttgcttcgtccatcgcttgatgcgaatcatgatccattctggcttcttctctcaacaaaagcatgacttggagaatgagctagaagccaagtatgtgctaaccgatgcatctgtactattgcttaagaaccatccgatgagtgtgacacctttcttgcatgccatgcttgatccagttttgacaaatccatggaatcaattttctacttggttcaaaaatggtgaccctacaccatttgaaacggcacatgggatgatgctttgggattatgctggcgctgatccgaaacttaataacttgttcaatgatgccatggcaagtgatgctcgatttgtcactagtttggtgattgagaaatgtaagggagtgttcatgggattggagtcattggttgatgttgggggaggcacagggaccatggcaaaagccattgctaaatcattccctcgggtggaatgcattgtgtttgatctaccacatgttgtttctggcttgaaaggaagtgagaaccttaaatatgtttcaggggacatgtttgaggcaattcctccagctgatgccattctgttaaagtggatattgcatgactggaatgatgaggagtgtgtggacatattgaagaaatgcaaagaggcgataacgaggaaaggcaaagaagggaaggtgatcatcatagacatggtggtggagaatgagaagagagatgatgaatcagttgaaacacagctcttctttgatatgctgatgatggtgttggtcactggaaaagagagaagcaagaaagaatgggctaagttgatttcctctgctggttataacaactacaagataactccagtctttggcttaaggtctctcattgagatctatccatag

SEQ ID NO: 2690 - DNA, 1206 bp, Glycine max var. Williams 82
atgccttcatcaactgcttttcaatggctaagccttgttggcatcatttggctccaatccataaatggaacaaacaccaatttccctgcttactcctcccagctgaagcagctcctctccatttcccaatttcagctcaacaaccttgcttttgcctccgatgcaggcaaaatctttggctttttttctggcatggctgctttttacctccccctttggcttgtcctcatgattggttcaactcttggactaattggctatggtgttcaatatctcttgataacaaaccaaatctcctctctctcctattggcatgtgttcttgctaactgttctagcagggaacagcatttgctggatcaacactgtgtgctatgtgatcacaataaggaacttctcatctgatcatcgccaagttgctgtggggttaacaactagttaccaagggttgagtgctaagatttacaccagcattgttggaactgtttctggacaaaacaaggctaagacatttctctttctgaactcattcttgccactgatagtttccctaatagcagctcctgtggtcagagaaattgaagctgtcacaaggcctaaacacatgagtgttggatttgttgttatgtttgttattacaattgccactggaatatatgctgtgatgagcagcttgcaatttgtctcaaacaagatatctccacttagtaaccttgttggtgttctagtgttccttttattccctctattagttccactttccatgaagatcaatgcactagtagggtcatggcacaaaaatagagaaaaacaaagagtctatcattttactgcagaggagagtcatgatatagaagagaggatagagaatgaggttaaagagggtgaagatagtagagaagttaatcaagaagttggtattggtataagagaagaagtaggagtgaaattgatgctgagaagaatagatttctggttatatttctttgtctatttattcggtgcaacacttggtttagtatttctgaacaacttaggacaaatagctgaatcacgaggttactctggaacttcatcattggtgtctttgtcctcttcttttgggttctttggccgtctcatgccatctataggggactacttctaccgaggtaagtttacaatatcaagaccagcaactatggactcgcaagttttactcacataa

SEQ ID NO: 2691 - DNA, 840 bp, Glycine max var. Williams 82
atgaacaaaaagccaatcttaataggtcttgaggatttgtaccaaggaatccctgatgaatccgttaacctcacctttcaacacctggctgaagtgaaaacatcagataagagaaaaccaacaacaacaacaacaacaccttcacgctccatagccaaactacctagtcttgatttcaccaaaggcttgcaagcttctaatcaccaacaccatgaacactatctacaagactttggccatggtgaaccatcaccattgggtcattctggtcattttattagccatgctagtggtggtgcacaaagacaaagccctcgactcatggctggaaatgatcatttggggcatggaatgagctttgatggtgtgagtgttgcttcaggaagaggtagccgacggcgccgacccgggattcctcactctaagatttgcacaatttgcaatacctatgtttatatcttccggactagatgcctggtgtgcggcagggtttactgcaggcaatgtgtagaaagaggaatgggggagatgatagaaggaagaaagtgtattgagtgccttggattgagattcagccaaaggtacatagaaagagcagggaaggtagggtgctgtagttggaggtatccaaatacattaaaacaggctgagctcaagtgtgctgagaaaggaccaaggagaagcgtaaggcatggtcacagtgggatggcaaactcaacaagatcacgaagtcctattagccctagaaggactcataatgctattggtagcaatgaacactcttttgtcatgtcctcatccttttctcccttctcacctcattacaacctcccattataa

SEQ ID NO: 2692 - DNA, 627 bp, Glycine max var. Williams 82
atggaagagagaagtggagtgcttgaaacttcgagatcttgcaagcaactcataggacctgaagggtccgataaggaatttgaaggctatattgatagcaacctacgtgttgtggagaccttcttgcgtttgttccccattggtctttgtgtcacagctcttgtaattatgctcaagaactctcaggaaaataagtatggctctgttagctacaccgaccttggtgctttcaggtatttggtgcatgccaatggcatttgtgcaggatattcattattttcagccatttttgttgctttgcctcgtctgtcgagcatgcatatagcttggactttctttgtgcttgaccaggttttaacgtacataatcctgtctgctggagctgcatcagcagaggtgttatacctggccgaaaagggaaacatggcaacagcatggagctcagcttgtaggtcttttggtccattttgtcataaggttactgcatcaacaactatcacatttgttgttgttgttttctatgtcttgctttccctcatttcatcctacaagttgttcagcaagtatgatgcaccaactgtgagcaacccctctatgggtgctgacattgttgctttccatggctag

SEQ ID NO: 2693 - DNA, 579 bp, Glycine max var. Williams 82
atggaacagctaaagtataaggttggccaaggtgatgataataacaacaaaggacaagttgatgagtatggtcttgttcgttctttttcttctgagtctgaatctggaatttcaagtggttcatcattggattctgattcatttgaagaagttacatcccctacttcctcttcttcttcatcatcatctgatcaacttgtaactgaaccgttgaatgaaatgtcttctttgtttcaacaacttcccatcaagaggggaatttccaagtattacgaggggaaggcacagtctttcacttcattagcaaaagtgagcagcttggaggatcttgtcaagccagagaatccatacaacaagaagttgaagacttgtagaagctatggaggggtaatgggtgagactcagatagcaaagtgcagtcctagtgctatatctatgcagggttctcaaaggggttcatgttcttttcttattgcaaataggagcagtgacaacatcatgggtagaagacccccaataccacctcatagatctaccactaccagctccattcctaatcaaactgctttgtttgtttga

SEQ ID NO: 2694 - DNA, 1659 bp, Glycine max var. Williams 82
atggataacattccaaaatgcgaagcaaattatagccctctcagtcctgtaactttcttgaccaggtgtgccaaatgctatggcaatcgtatctctatcatccatgaaggaatccgcttcacatggcaacaaacttatgagcgttgctgccgccttgcctcctctatacgctccctcaatcttgcaaagaatgatgttgtatccgtgttggcccctaacattcctgcaatgtatgagatgcattttgcagtgccaatggcaggtggagtgctcaacaccattaacacccgtttggatgcaaataatatagccaccattttacttcactctgaagcaaaagtcttgtttgtggactatgagtatgtacccaaggcaaaggaaaccttagaattgctaatgggcaaaaaatgtcattcatctaccccactactcattctcattgatgacataaactcacccaccggcttacaatttggtgagttagaatatgagcaattggtctataatggtgatccaacctttgttccagagaaaatccatgatgagtgggccccaattgctttgaactacacatcaggaacaacctcagcacccaaaggagtagtttacagccatagaggtgcataccttagtacccttagccttatactaggttggaaaatgggtactgaaccagtgtatctttggacattaccaatgttccattgtaatgggtggactttcacatggggtgtggctgcacgtggtggaactaatgtttgccttagaaatatttcagcctataacatatacaagaacatatctttgcatcatgtgacacacatgtgttgtgctcctattgtctttaacatcattctagaagccaagccaagtgagcgtattgaaatcaaatccagtgtggaaatactcactggtggagcaccaccaccaccttcgttgattgagaagattgagtctcttggatttcatgtcatgcatgcatacgggtcaacagaagcaactggaccagcgttggtgtgtgagtggcaacaacaatggaatcagctcccaaaagttgaacaagctcaattgaaagctcgtcaaggaattagtatattgacacttgaagatgttgatgtgatcaatgtggacacaatggaaagtgtgccaagagatgggaagacaatgggagagattgtgttaaggggaagtagcataatgaaggggtatttgaaagatcctgagtcaacctcaaaagccttttgtgatgggtggtttcacactggggatgttggggttgtacacaaagatggttatttggaaataaaggatagatccaaagatgtgattatttcaggaggggaaaatattagtagtgtggagttggaatctgtgctttataagcacccaagggtgttggaggctgcagtggtggcaatgccacacccaagatggggggagagtccatgtgcatttgttgtgttgaagaaatttgaaggtaataataaaacgaatgatgtgactgaggctgacattattggatattgtaggaagaatatgcctccctttatggttcccaagttggttaagtttgtggaggatttgccaaagacttcaaccggtaagattaagaaatttgaattaagggacaaggtcaagaataccgtgtctcgtctttaa

SEQ ID NO: 2695 - DNA, 1767 bp, Glycine max var. Williams 82
atggatgagacttcagctctcatcgaagccattctcagagagcaagaggaagaagaagaagaagctcacagaagaagaaggaacctcaccacgcaaaacaccacaatcaaaagtaacaaccaatggcaaacggtgtcgtatcacaagcgcaaccgcaacaacaacaagtcttcctccaagcagcctctcgccgccgatccttcccccgatgtcttcagctctgttcagcgccattccgagcacagccgccgccgactactcgagtctcagatcgcctccgaggctgaagcagctgcagccgccgctccgagcagatcgaagcggcattccgacgacgaagacgacggcgatgcggagcatgaagccagcgccgttcaggaggtgaagaaggcgaagcagaagaaaccgaagaagccgaaggtgacggtggccgaagctgcttctagaatcagcgccgatgatctcgacgcgtttctcgctgagattaccgcttcgtatgaatcgcagcaagatattatgctgatgcgatttgctgactacttcggtcgcgcattctcgtcggtgagtgcagctcaattcccgtggctgaagacgttcaaagagtccaccgttgcgaagattgttgatatccctcttttgcatatatctgaggatatttacaaaatatcaacggattggatcagtcatcgatcatatgaagcacttggttcctttgtgctatggtcgttggacagcattctttcagaccttgccagtcatcagggagttaagaaggcagtccagcaatcatcatcgaaatctcaggttgccatgtttgtggttttaacaatggtgcttcgacgaaaacctgatgtcttgattagcttattaccaatattaaaggagaataaaaaatatcaaggacaggataaactccctgtcattgtttgggtgataactcaggcttctcaaggagatctagttatggggttgtacttgtgggtatatcttctcttgccgatgctgagtgtgaagtctggttgcaatccacagtcaagagacttgatattacagttggttgagagaattatcacatttcctaaagctcactctatcttgctaagtggggctgtcagaaagggggagcgtgttgtgcccccatgggcacttgattctctattgagagttactttccctcttcattcagcccgggtcaaggccactgaaagatttgaagctgtttatccaacgttaagagaagttgcccttgccggttcccctggaagtaaagcaataaagcatcttgcacaacagatactaagctttgcaattaaagctgcgggaaaagctaatctggacctatcaaaggaggcaagtgacatttttatttggtgtttgactcagaaccctgaatgttacaagcaatgggatttgctttatatggataaccttgaagcaagtattgttgtattaagaatactttctggtgaatggaaggaatactttatcaaacatcctactcttgatcctttgagggaaactcttaagagcttcagtcaaaagaatgaaaaggccttggctaaggcggatgatgctgctcgccatgcattattgaaggatgcagacaagtactgcaaagcccttttgggaagattgtcacaagaccatggatgcatgaagagcgtgacaattctttctgttgtatttgcggttggtgccattttcgtgtaccagaacttgcatttatgggattatagtcaactgacagaaatgttgaacctatcctag

SEQ ID NO: 2696 - DNA, 1002 bp, Glycine max var. Williams 82
atggctgggttcttctctttaggagcaggaaggcagaacaaggcggaacaagaagaagatcaaagagaagagaacgttaacaacgccggtggtaataataacagtcaattcttgttcagaaacaacgttagcgaagagatctacaacaagggattcgagatatggccacaatcctcgtaccaccaccaccagaacttgaccaacttctactccttcggtgtgggccctagtcgcaggaacaaccacaacaacagctcctccaacaacgtaaacgacgacgtttctgtgtctttctcggatgagtcgaaccggttcgggttcacggtgatgagctccggtggcggcggcggcggaggaatgaactgtcaggactgtgggaaccaagcgaagaaagattgtcaacacctcagatgcagaacctgctgcaagagtcgagggtttcagtgtcaaacgcacgttaagagcacttgggttcctgcggctaaacgccgtgaacgacagcaacaactttctgctttgcagcagcaacaaaatcaacacccacagtttcgtggagatcactcaaaacgacacagagaaagcatcgaaggtgctgctgctggttctctcgcttgcgttccagttccgatcaccaccacagggttggagctggggcaatttccaccagagctaaactcaccggcggtgtttcggtgtgtgaaagtgagtgcaatggacgcaccggacgagcgttacgcgtatcaaaccgcagtgaacataggagggcacgtcttcaagggaattctctacgaccaaggaatggacggtccttatgcgggtgcaggttgtgagggttcctccggtgtcggtggcgaagctcagccactaagtctcatggccgccgccacaaccaccaccgccgccacaacaacaagcggaaacccttttgaggcttcactctacacggctccgatgaatgcctacatggctggtacgcacttcttcccaccctcaagatcctaa

SEQ ID NO: 2697 - DNA, 1374 bp, Glycine max var. Williams 82
atgagggagatattgcacgtgcaaggtgggcaatgcgggaaccaaatcggttccaagttctgggaagtgatatgcgacgagcatggcatcgaccccaccggaaagtacaccggcgacgaggcctccgatctccaactggagaggatcaacgtctactacaatgaagcctccggcggaaggtacgttccccgggccgtcctcatggatctcgagcccggcaccatggacagcatcagatccggcccatacggcaagatcttccgccccgacaacttcgtcttcggccagtccggcgccggcaacaattgggccaagggccactacaccgaaggcgccgagttgatcgactctgtcctcgacgtcgttcgcaaagaagccgagaattgtgactgcttacaaggttttcaagtgtgtcactcacttggaggaggcacgggttctggcatgggaacactgttgatatcgaagatcagggaggagtacccggacagaatgatgctcacattctctgttttcccatccccaaaggtctctgacacggttgtggagccttacaatgctactttgtccgttcaccaactagtggagaatgcagatgagtgcatggttcttgacaatgaagcactctatgacatttgcttcaggaccttaaaactcaccactcctagttttggtgatctgaaccacctgatttctgcgacaatgagtggagtgacatgttgcttgaggttccccggacaactgaactccgacctgaggaagctagcagtgaacctgatcccattcccacgtctccacttcttcatggtggggtttgcacctctcacctcacgcgggtctcagcagtacgtgtccctcactgtccccgaactcacccagcaaatgtgggacgccaagaacatgatgtgtgccgccgatcctcgccacggccgatacctgacagcatcagccatgttcaggggaaagatgagcaccaaggaagtggatgagcaaatgatcaacgtgcaaaacaagaactcatcctacttcgttgagtggattcccaacaacgttaagtcaagtgtgtgtgacatccctcccaagaacttgaagatgtcgtgcactttcattggaaactccacctcaattcaggagatgttcagaagggtgagtgagcaattcactgcaatgtacaggcgcaaggccttcttgcactggtacaccggggaaggaatggacgaaatggagttcactgaggcagagagcaacatgaacgatttggtagcagagtaccagcaatatcaggatgctactgctgatgaggatgagtacgatgatgaggatgagtacgatgatgaggatgaggatggggagcatgctttcgaggaccagtaa

SEQ ID NO: 2698 - DNA, 3753 bp, Glycine max var. Williams 82
atggcagaagtggaactagccccagattcacttatagaacaaaatgtaacatctaaaacggtccaacaatccaaaaccgatagtgtttcgtttttcggcttgtttgctgcggctgatgcaactgactgtgtcttgatgttcctcggaagtgtcggttcgtgtgtccatggtgctgctcttcccgttttcttcattttgtttggtcgtatgatcgactctttgggacatctctctaataatcctcacaaattgtcctcgcgaatttctgagcatgctttgtatttggtctatcttggaggagttgttctggtatcagcttggatgggtgttgcattctggatgcaaacaggggagaggcaaacggcacgtttgcgcttgaaatatttgcaggcagtgctaaagaaggatattaatttctttgacaatgaagccagggatgctaatatcattttccacatctcgagtgacgcaatattggtacaagatgcaattggagacaagacaggccatgccattcgttacctttcccaattcattgttggattcgccattggatttacctcagtgtggcagctcacactactcaccttggctgtggttccgttgatagctgtagctgggggagcttatacaataattatgtctactttatcagaaaagggtgaagcagcttatgctgaagctggaaaggttgcagaagaggtgatttctcaggtgcgtactgtttactcatttgtaggagaagagaaagcagctggctcatactcaaagtctcttgataatgctctgaagttgggcaagaagggtggttttgcaaaaggagttggagtaggcttcacatatgggctattattttgtgcttgggcattgcttttatggtatgctagcatacttgtgaggcatcataagacaaatggaggcaaagcgttcacaacaattatcaatgtcatctttagtggatttgctcttggtcaagctgctccaaaccttggttccattgccaaagggcgcgttgctgcagccaatatcatgaacatgattgcgtccgcttcaagaaattctaaaaagttggatgatggcaatattgtcccacaagtagcaggggaaattgaattttgtgaggtctgctttgcttacccctcaagatccaatatgatctttgaaaaattgagcttctcagtgagtgctgggaagactatagcagttgtaggtccaagtggttccggaaagagcacgatcgtttcactaattcaacggttctatgaccccacttcaggtaagatcctgttggatggatatgacctaaagaatcttcaattgaaatggttgagagaacagatgggcttggttagtcaagaaccagcactatttgccacaacaatcgctggaaatattttattcggaaaggaagacgcagacatggataaagtcatacaagctgccatggctgcaaatgctcattctttcattcaaggattacctgatggttatcaaactcaggttggagaaggtggcacccaactttcagggggccaaaagcaaagaattgccatagcaagagcagtgctaagaaacccaaaagtattgcttttagatgaggccacaagtgctctagatgctgaatcggagctcattgtccaacaggcattggaaaaaataatgtcaaacagaacaacaatagttgttgctcatagattatccaccatacgcgatgtagatacaattgttgtgttgaagaacggccaggtggttgaaagtgggactcatttggaattaatgtccaacaatggagagtatgtgaatctggtgagtttgcaagcatcacaaagcctcacaaactctagatcaatatcttgctccgaaagttcaagaaattctagttttagagaaccttcagacaacctgaccttagaggagccgttgaagttggatacagcagcagaactgcaatcaagagatcaacacttgccatcaaagactacttccactccatcaattttggatttactgaaactgaatgctccagagtggccctatgcaatacttgggtcagtaggtgcaatattggctggcatggaagcccctctctttgcacttggaatcactcacattttgactgcattttattctcctcagggttctaaaatcaagcaagaagttgattgggttgcttttatatttcttggagtagctgttattactatacctatttatctattactacactacttctatacattgatgggagagcgtctcactgcccgtgtgcgtttattaatgttctcagctattctcaacaatgaagttgcatggtttgatatggatgagcacaacacaggctcactaacggccatgctagctgcggatgcaacattagtaagaagtgctctagctgacagactctcaaccattgttcaaaatgtagctctcactgtaacagcttttgttattggcttcacattgagttggaaactaacagcagtggttgtagcctgccttccccttctcataggagcttctattactgagcaactatttctcaaggggtttggaggagactatggccatgcttactctagagcaacttctttggctcgtgaagctattgccaacatacgtaccgttgctgcttttggcgcagaagatcgaatctcaatccagtttgcatctgaactgaacaaacccaacaaacaagctcttctacgtggccacatatcaggttttggctatggcataacacagctattggctttctgttcctatgcacttggcctttggtatgcatcagtattaatcaagaagaatgagtcaaattttggagacatcatgaagtccttcatggtcttaatcatcacttctctggcaatagcagaaacactagctcttaccccagacattgtgaagggatcacaagcattgggatcagtttttggcattatccaaaggagaacagccatcaccccaaatgaccccaactcaaagatgataactgatgtcaaaggagagatagagtttagaaatgttagcttcaagtaccctatgagacctgatatcaccatatttcagaacttaaacctcatagtcccagcaggtaagagtctggcagtagtggggcaaagtggttcagggaaaagcacagtgatttctttggtaatgagattttacgaccccgatttggggtcagtcctaatagatgaatgtgatatcaaaagcctaaaccttagatccttaaggctgagaataggattggttcagcaagaacctgctttgttctcaaccacagtttatgaaaacatcaagtatggaaaagaggaggcatcagaaatagaggtaatgaaggcagccaaagcagcaaatgctcatgaattcattagcagaatgccagaagggtacaaaactgaggttggtgagagaggggcgcagttgtcaggaggacaaaaacaaagagtggcaattgctagagctattctgaaagatccatccattcttttgttggatgaagcaacaagtgcactagacacagtatcagagaggctggtccaagaggctcttgataagcttatggaaggtagaacaactattttagtagctcacaggctatcaactgttcgcgatgccgacagcattgcagtgcttcaaaatggcagggttgctgaaatgggaagccatgagaggctgatggccaaacctgcaagcatctacaagcaattggttagtctacagcatgaaacacgtgaccaacaagaccattga

SEQ ID NO: 2699 - DNA, 741 bp, Glycine max var. Williams 82
atggagaaggagaaagagaaagaatctaagctgaagaacaagatcttcaaaatactgccaaaagcagcggctgcagcagtgagcatgacattccaaaaccctcccttcagcccaggcagggatcacaagttcaaacaccatggcggcaaagggttcttctctggccctatgattcccgttgaagccagaagaaaatcaaaggatggttgtgttgaaactcaagaacccacttcccccaaaatctcctgcatgggacagatcaagcacaagaagaagaaaaaccaaatcaaaaaagcggcaaagaccatgtccatgcctacagaagaaaagaaacaagcttccaagtttcagaggatgatgtcgttccactcggggaaaccaaaacgacccgcggcgaggaaacagcaatctgatgcggacttggagagtgagagatcacctgcaccgccgttgggtcacatgaggcgatttgcaagtgggcgtgaaacattttcgaatttcgattggaaggctcagattgctcctgaggaaagggattgctattcgtattatgatgatagattggagagcgatgcagaggatgaaatcataatccctttctctgctcctcttaccgttggtggtgctgcaagtgcgcttaatcttaatgcgcagccacggaaagagattaatctatggaagagaagaaccatggcaccacctaggcctcttcagttgaatcccgtgcttacggccaaatga

SEQ ID NO: 2700 - DNA, 303 bp, Glycine max var. Williams 82
atgcagcttctttcaaatgcacaatttgaagaactatcagctagggacctgatgttaacgtctgcattgaacacagactatctccttaccttgccaacgtatgttgattggaagagagcgtatgagtctaatgccataatatttaggcgtggttacgcaactgagaagcagaagggtctattattaattgtggaaaaactggattacttacagtctaagcttctacgaaggaccttcttttctatatcaaaaccactaacaaaacttggcacctggatgagcgaggttatatttttgtggtag

SEQ ID NO: 2701 - DNA, 3276 bp, Glycine max var. Williams 82
atgagcaacgttaacatagcctccacctcgcgtggttccacctcctcctccaatggccttctcaccgtcaccattaccagcaccagccaccctgacgaccctcccaccgacgacaacgatgacgacgacttgctcgctgatccggacgatcctttcgatattacgcataccaaaaatgcacctcccgaggccctcaagcgttggagacaagcagctttcgtgctcaatgcgtccaggcgttttaggtacactcttgacttgaaaaaggaagaggagaaagagcaaaagaaaagcatgattagatcccacgcacaagtcatcagagcagcattgcttttcagattggctggtgaacgggaactagtgacaagtaaagcagcagtggcatccccatctccagttggtgaatatacagttgggctcgaacaacttgtttcaatgactaagaatcagaatatttctgctttacaacaatacggaggggttaaaggcttatcaaatttactaaaatcaaatccggataaggggattagtggagatgatgttgatctatcaaagaggaaaaatgcatttggaactaatacataccctcggaaaaaggggagaagtttctggaggtttctatgggaatcttggcaagatctgactcttataatattgattatagcagctgtagtgtcgttggtacttggaataaaaacagagggcttggaagaagggtggtacgacgggggcagcattgctttcgctgtttttcttgtcattatagttacagctgtcagtgattatcggcaatctttgcagtttcagaatttaaatgcagagaaacaaaatataaaattggaggtcattagaggtggcagaacaatacaaatatccatatttgatattgttgttggtgatttagtgccccttaaaataggagatcaggttcctgctgatggagttgtaatcactggtcactcgcttgccattgatgaatcgagtatgactggtgaaagcaagattattcacaaggatcaaaaagcaccttttttgatgtctggttgcaaagtagcagatggagttggtgctatgctggtaactggtgttggtataaatactgagtggggattgttgatggcaagtatctcagaggatactggagaagagactccattacaggttcgtttgaatggagtagcaacttttattggcatagttgggcttactgtagctgtttgtgtacttgcagtcctcttgggaagatatttctctggccatacgaaagatttagatggaagagtacaatttgttgctggagagactagtattagcgaagcagtagatggggtcatcaaaatttttaccattgcagtaacaattgtggtggttgcagtgcccgaaggtctacctttagcagttaccttaaccttggcatactcaatgcggaaaatgatggcagacaaagccttggtgcgaaggctgtcagcatgcgaaactatgggatctgctacaacaatttgcagtgataagactggaactttgaccttaaatcagatgactgtagttgaggcatgtgttggaaggaagaaactaaacccaccagatgacttgacaaaattgcatccggaagttttatctttgataaatgagggcattgcacaaaatacaactggcaatgtttttgtgcctaaggatggtggagaggtggaggtttcagggtctcctacggagaaagcaattctttcttgggcagtgaagttggggatgaattttgatcttattagatcaaattcaacaattctacacgtcttccccttcaattctgagaaaaagcgaggaggccttgctctgaaactgccggactctgcagtacatatacattggaaaggagctgcggagatagttttaggaacatgtactcaatatcttgattctgatggtcacttgaaatctattgaagaagagaaggtattcttcaagaactctatcgaagacatggctgctcagagcttgcgttgtgttgccattgcatacagatcgtatgatttagacaaaattccatcaaatgaggaggaattagaccagtggtccttacctgaacacgagcttgtcttgcttgctattgttggaataaaggatccttgtcgccctggagtcaaggatgctgtgaaaatatgcaccgaagccggtgttaaggtacggatggttacgggtgacaatcttcaaacagcaaaagcaatagcttttgagtgtggaatactgatgtcaaatgatgatgctgttgagccaaatataattgaaggaaagacattccgtgaactatctgaaaaggaaagggaacaagttgcaaaaaagataacagttatggggaggtcttctcctactgacaagctgttgctcgtgcaagcactacgtacaggtggtgaagttgttgctgtcacaggagatggcaccaatgatgctcctgcacttcatgaggcagatattggtctttctatgggcatccaaggaacagaagttgcaaaagaaagttcagatattataatcttggatgataactttgcatcagtagtaaaggttgttcgctggggccgttctgtatatgcaaatattcagaaatttattcagttccagctcactgttaatgtagctgctcttgtaataaatgttgtggccgcaatatcttctggtgatgttcctttaaatgctgtacagcttttgtgggtcaacgttatcatggacacacttggggctcttgcactggctacggaaccgccaacagacaaccttatgcacagatcaccagttggccgaagggaacctcttataacaaatgtcatgtggaggaacttgggcgtacaggctctctatcaagtcactgtccttctcgttcttaacttcggtggtgaaagtattctacgtaatgatcaggattctgtagcccataccatacaagtgaagaatactttaattttcaatgcattcgtcttttgccaaatattcaacgagttcaatgctcgaaaaccagaagagatgaatgtcttccggggagtgactaagaacggtctcttcatgggaattgttggaatgaccttcgtgcttcagataatcataatagagttccttggaaaattcacaacgacagtgaagcttgattggaagctgtggcttgcttctctttgtattgggcttttaagctggcctcttgcgataattggaaaattcattccagttcccaaaacaccactgtcccgatatttcaggagattcagcaagtccaagtcgcaatag

SEQ ID NO: 2702 - DNA, 627 bp, Glycine max var. Williams 82
atgaatgtgactacagatacttatggtcaggctgcttcaaatttagttgctggtagtagtcttgagcagactattcagcaaattatggacctgggtggtggcagttgggacagagatacagttagtcgtgctcttcgagcagcttacaataacccaaagcgtgctgtagattatttatattctagaattcctgaagcagcagaaattgctgtgccagctgctccttacccaatcagtcaaacaacggaaacaggtggggtcaccgccggggctgtttctgggtttcaagcattacgctcaatggtgcaatccaatccacaaattctgcagcctgtacttcaggaacttggaaagcagaatcttagtctctcaagacttattcaagagcatcatggtgaatttctccagttgattaacgatcctgttgagggttctgaaggtgatatatttgatcaacctgagcaagatatgcctcatgctatcaatgtgacgccagcggagcaggaggcaattggaaggcttgaggctatgggatttgatagagcctcagtcatcgaggcatgtgaccgtgacgagcaattggcagccaactacttactggaaaatgctggagattttgaggattaa

SEQ ID NO: 2703 - DNA, 1283 bp, Glycine max var. Williams 82
gagggaccgcttttatctgctcctacatagcatggtatacccttgctagcttcacagagatgtaatgtaaattctccaccaaacgcgtcgctgtttttgttgttgtccaaatgtataaaagatataatgagtggatgtcaggacactgagataaagaaaccaatgcattcttctatcttcattccttccctattactctttctctgctaaattatttaaattttctctctttctctaattaattccctttgttatcaaaatggctgtggctatggctgcttgcagtcttggacttcacttgagtgctgacaacaccttgagaccttttgaaaaaaccactatcttgaaggccctctctatctctgatgctactaaaccatgttacatttctcacaaaacaagattatcatcttcatcttcaggaataacaatgatcccacgagcaacaacagttattggtactgtggaggatggaaatcaaggagaggctgataccattccaactccggtagttattattgatcaagactctgatccagatgcaactgtggtcgagataacctttggtgatcgccttggggctcttcttgacactatgaatgcgttaaaaaacttggggctgaatgttgttaaggcaaatgtctttctagattcttctggcaagcacaacaagttttccatcacaaaagctgattctggaagaaaagtggaagatccggagttgttagaggcaatccgtttgacaatattgaataatatgattcagtatcacccggaatcaagcgcccaattagctctgggagcagcttttggacttgtgcctccaaaagagcaggttgacgtggagatagcaacccaaataaccatctctgatgacggcccaaaacgaagtttgttgtatgtggagacagctgatcggcctggattactggtggatcttgtaaagactattacggacattaacattgccgttgaatccggagaatttgacactgaggttcttgttaacagcttgagatatttcttgaggcggcctgagactgaggaatccagtttttaagtgcaacacatcatatttgcctctggattataagcaccatggaattgtagaatgcatgtattcttttccatttggagaacaatatttgcagtacatagttaactcttaaaatttaataaacctgcatatcattgtaaagttaccattctcgatcaatttatttatttaacattgttgtttttttttacatcatataaaatgtttgcctacttccttactcatc

SEQ ID NO: 2704 - DNA, 915 bp, Glycine max var. Williams 82
atggacaataacgaggaaataccctcaacacccgcaacaccaggcactcctggtgcacctctttttggtggcttcagtaatggtaggaacaataatagcaagaagtccctcctgaagagttgtaggtgcttcagtgtggaggagtggagcttagaagatggagggctaccggcagtgtcatgctcattgccactgccatcgcctccaccggtagtccctcttgcaagaaagattggagcggagttcatagggaccttcatcctcatgttcgcaggcactgccgctgccattgtcaaccaaaagacaaatggctctgagacccttattggatgtgctgccaccactggtctcgccgtcatgatcgtgatcctcgccaccggccacatctccggtgctcatctcaaccctgctgtcaccatttccttcgctgcattaaagcacttcccttggaagcatgtgcccatgtatattggtgcacaagttttggcatctatatgcgccggatttgctctcaagggggtttatcaccctttcatgagtggaggagtcaccgttccttccggaggatacggccaatcttttgctttggagttcattattggcttcaacctcatgttcgttgtcactgcagtcgccaccgacaccagagctgtgggagaactcgcgggaatcgcggtgggagcgactgtgatgctcaatatactcatagcagggccagtatccgggggctcaatgaacccagtaagaacactaggtcctgctgtggcggcaaacaactacaaagccatatgggtctatctagtagctcccatacttggagctttagctggggcaggtacctacactgcagtgaagctgcctgaagaagatgatgacgccaaggcaaagacttcaatcagcagcttcagaaggtga

SEQ ID NO: 2705 - DNA, 988 bp, Glycine max var. Williams 82
taaaaggaagaaaagaaagtagcaagtgattagtattggtcgttgtgaacaaaagaaaattacagtgtatgggtgaaagtaattggaagttgttattgttatttaaatgggggggttcacatgacatgatgagagtcataagccagttgggcaaggtcttcttggtgctggggaagacagaatggagcaatcatattcatgggagaattgggctcttgacaaggaaatgggggaggatgaggaggagttccttcgcgacatccttagtaaaccggctttttcttccgagagtgaaagtcaagcaccagttgtctcatgctctgccaaaagcaaaagggctccgatgacatacattttgtcttttgataactccaccataacaccagcaccttcttccccccccaccctagaggcccaacctggaaagagggctaaaagagcttcccacattatggctgaaagaaaaaggagacagcaactcacccagagcttcattgcactttcagccaccatccctggcttgaacaagaaggacaagagttctatgcttggcaaagcaattgattacgtgaaacaacttcaagaacgcgtgacggagcttgaacagagaaagaagagaggcaaagaatcgatgataatcctcaagaagagtgaagcaaattctgaggattgctgtagagccaacaaaatgctccctgatgttgaagcaagagtgacggagaatgaggtactcattgagatccattgcgagaaggaagatgggcttgagctgatcaaaatattggaccaccttgaaaatcttcatctctgtgtcaccgccagcagcgtattgccctttgggaattcaactcttagcatcactattatcgctcaggtacacattcattaattctctacattatactgcaactatttcaaaggcataatatcttctaatattaatttgaatatatattcaaatttcaatttacatgctaagagttgatcc

SEQ ID NO: 2706 - DNA, 1242 bp, Glycine max var. Williams 82
atgctggctctgtgttttcccatcagtacacatctttgcaccaagaagcatttgttagttttttgcgatcaaagtaaaatcaaagctatgcaggaggcgaagctcggtggcgaaatcaacatgcaacgcagtggaagtatgcaactaaaggagaagaaggtgagggatttgatggtggacaagaagaggctagtggaggtgccgtacatggcgtcgctggcccacacaatgactacactggtagcgaacaaggttgtggcggtgccggtggctgcgccgccggggaaatggatcggagccggaggttccatgatcgtggagtctgataagcaaaccggagacgtacggaagcactacatagggatggtgactatgcttgacattgtggcccacatcgctggtgatgaccatttgggtggtggcgatgatatcaccaaagaccttgatcaaaagatgtctgaccctgtctcctccgtcattggccactcctttgaaggtcttaccttgtggactctcaatcctaataccagtctgctagattgtatggaagtgttgagcaaaggggtgcatcgtgctatggtaccggtagatgggcaggcggagaacatgtcagctggggtggaacttgtagagtctgcttccagctaccaaatgctgactcagatggatgtgcttaggttcttgcatgatcgtgctggtgaagctgatcgtgaactgcagagcattctctctcgttctgttcaagatttgggggccgacactgaacagatttatgccatcactgaccgcacaaaactcgtggatgccattaagtgcttaaaggccgctatgttaaatgctgttcctattgttagagcctctgatgtcggtcaagatgatcacaagcagcatataaatggcagatgcaggaagcttattggtacattttctgcaactgatttgaggggatgccacgtagccacgctgaaatcatggttgggaataagtgcactagcattcactgaagaagttgcatcgagtcctttgtacacagaatcggacacccagatcaatagaagggagcttgtcacttgctttgccgaatcacccttgtctgaggtgattgaaaaggcagtgactaggcatgttcatcgagtttgggtggtggatcatgaaggtttgctcgtgggggttgtttcacttacagatgtaattagagttacaagacattctatgctatcatcagattctgatgatctgtaa

SEQ ID NO: 2707 - DNA, 1906 bp, Glycine max var. Williams 82
aagactacacgtataatcactcatcaaaagaaaggaattaattagagccaaaacattgatatatatccaaaccactgctttcctaaaatgcttacatatctttgatgctggctctgtgttttcccatcagtacacatctttgcaccaagaagcatttgttagttttttgcgatcaaagtaaaatcaaagctatgcaggaggcgaagctcggtggcgaaatcaacatgcaacgcagtggaagtatgcaactaaaggagaagaaggtgagggatttgatggtggacaagaagaggctagtggaggtgccgtacatggcgtcgctggcccacacaatgactacactggtagcgaacaaggttgtggcggtgccggtggctgcgccgccggggaaatggatcggagccggaggttccatgatcgtggagtctgataagcaaaccggagacgtacggaagcactacatagggatggtgactatgcttgacattgtggcccacatcgctggtgatgaccatttgggtggtggcgatgatatcaccaaagaccttgatcaaaagatgtctgaccctgtctcctccgtcattggccactcctttgaaggtcttaccttgtggactctcaatcctaataccagtctgctagattgtatggaagtgttgagcaaaggggtgcatcgtgctatggtaccggtagatgggcaggcggagaacatgtcagctggggtggaacttgtagagtctgcttccagctaccaaatgctgactcagatggatgtgcttaggttcttgcatgatcgtgctggtgaagctgatcgtgaactgcagagcattctctctcgttctgttcaagatttgggggccgacactgaacagatttatgccatcactgaccgcacaaaactcgtggatgccattaagtgcttaaaggccgctatgttaaatgctgttcctattgttagagcctctgatgtcggtcaagatgatcacaagcagcatataaatggcagatgcaggaagcttattggtacattttctgcaactgatttgaggggatgccacgtagccacgctgaaatcatggttgggaataagtgcactagcattcactgaagaagttgcatcgagtcctttgtacacagaatcggacacccagatcaatagaagggagcttgtcacttgctttgccgaatcacccttgtctgaggtgattgaaaaggcagtgactaggcatgttcatcgagtttgggtggtggatcatgaaggtttgctcgtgggggttgtttcacttacagatgtaattagagttacaagacattctatgctatcatcagattctgatgatctgtaacaagctcagtttcatgcccagttggagctttgcttaatctgtcatgagaactgagcattttggaaaattagtaaaataggtctgttgctacatgtatggtgtgatcctaaagaatatctatagatattaatatacactatacagtagtactcctttggactcaatcgatgttagttgcacgttccatgtttcgttggtaacatcttgtttatgaaacattgagaaaattactggctgcataataatgcacaaatgttacatatgaaaagtgtttgactcaagtggaatatgctttacttagtgattctaaattttgattggagtcaagccatttatgggtcaggcacagtcctcgggcaaaactgaaggtcagaaggtggttcatacctattccaccaagtcatgtgcaaactgtgatgatattattgagatgaaaagattgaatatcgatgaaactatgacatattagtattatcgagatgagaaattggatgtccaattaggatgcagtgagggagaatgctcatgcaaaaatcatgggggaggagaaaaagtcttct

SEQ ID NO: 2708 - DNA, 2295 bp, Glycine max var. Williams 82
atggctgaagctgaagattatgggttcctcccagaggaaatggcggtgaatgaaaaccttggctaccctaaagctttcgctaaactctgccgtgaccgcggtttcggtccctacagccatggccctcccttttccttcatcccttatgctttgtcagaagatgaggctgagacagccaaagatttggatgagatatttccgattattgatccgaaagctaaggcgaccagcaagccgaaaatctttgtcagtgtcttgtggaagcagctccgccatcttgggaatgctggctttgaccctgcagtgattcgggtggatggttatggcaatgtgctctattatcatgctgactcagcctctcctctggcttgggatgttgatcactggtttccttgttcaaggggaggtttgactgttcttagcaatctaaggttattacagcggcaagcctgtaagaggaagaaaaacaagctggaattcttggtgccatggtgggatttccaattggggatctctgtgaaccagttcctgtctgtttttgcttcttcaaactctgacttcaggcacagagccttttcatttttgttctatgaaggagaaaatcaagaattgaatgcttcacaaatagtggattctcattcttttccacaacactttttcgcgctaaaagaagaggtaggcctggctcctgcttcaattgttgaatctcgaagggaaccttgcgatgcattagctttgagacaacttgattacaataagaagccaatgcccatgtctcctgcaatagtagctgcaaggaaaaggaatggcagtctcctgaaagaaaatgaagatccagactttgtgaaaaacccctaccaagcaattgtcatggctagagattccctgaagcaaagagaggaaactacaaaaaagcaagctgaaatacagaagctagatgatgaagtgaatgaaatgaagctcaaaaatgaggaagaaaaactcactattcaagacctggaaatggcacttataaaacgtaggaggaaggcagaaaagtgcagacggttagctgaggctcaatcttcttacaggactatgctagagaagatgatcagagacactatgcaccagagtgtcatttataaggaacaggtaaggttgaaccaggctgcaagtaatgcactaatggctagacttgaagcacagagggcaatttgtgatgctgcagagaaagatcttcacaagaaatacaaacaaagagatgacatagagaaacagattagacctgaatgggagcaaggaaggaagaggtcaagaatagatgatgccacctatgaagagagagacagtaaacctgctctttatttgcctgggccaagaccaagaacacctttgcgcaaggagctcagagtgtttttagaggaggaacaaaggtcatccgaagttgacttatctgcaaacgaagagcaaaagcgggaagaaaaagtagagcaaaagcgggaagaaaaagtagagcaaaagcaggaagaaaaagtagagaagctgaaaatgccagctaataatgacccagaagagaagcttgaggagcataccagatcaagtgttgcattggatgaagaaaactcaattgagcaaagacttcagaagctcaaaatcagcgaaggcaagaggagttatggcatttcattctcaggtcttcataagacagaaattgaggaagatgaagaaaccagaaagcaacgtggaaaagggaatgtcgagaagtggcttcaaatgcttttagagaatggtcaacaacaagaaggaactgatccacaagaaacaagtgaaaatgcttcttgtggcactgaagaaaaaataatccaacaactgaatcagaagttcccacaaaaggagttgaagatctcaaaagtttcagattctgattataaagagaagcagctgcaacttcttcaagacaggaacggatggacagagaaagaggatagaatagaaaacgaagctagaaatattattccgacaggatacaaaaattactctggagaagcttgcataggtgaaggaaattgcactcctaatgttgaagggatggaaagaaaggaacaacataaaaaggaaaaaagacttcctagatcagagagtgctaggagcttgagacgaattccatcatctccatctttgcttcttgggatcaaaaaaggtgtggactacatttggaagaagccaacggcaagtgatgatgccgatcttgcagcatcaaacagtttcttgaggtcatccatcaagacaatcaagaaaggtgtgaaattatga

SEQ ID NO: 2709 - DNA, 4281 bp, Glycine max var. Williams 82
atggagggaagtgatatatacagagcaagtaacagtttacgaagaagttccacggtttggagaaacagtggtgtggaggtattctcaaggtcttctcgcgaagaggatgacgaagaagctctgaaatgggctgcacttgagaagctccctacctacaaccgtctcaggaaaggcttgctcacagcttcccatggcgtcgccaacgaaatcgacgtctctgatctcggcatccaagagagacagaaacttctcgagaggttggtcaaagtagctgaagaggacaatgagaggttcctgttgaagctcaaggaacgtattgatagagttggacttgatattccaacaattgaagttcgatatgagcaccttaatattgaggcagaggcctttgtgggaagtagagctttgccctctttcatcaactctgttactaatgtcgtagagggatttttcaatcttctccacattagcacaagcaaaaagaaacacgtgactattcttaaagatgttagcgggattattaaacctcgcaggatgacactgcttttgggtcctccaagttcaggaaaaaccacactccttttggccttatcaggaaagctcgacaaaactcttaaggtatctgggagagtgacttacaacgggcatgaattgaatgagtttgtgccccagagaactgctgcttacatcagccagcatgatcttcatatcggagaaatgactgtgagggaaaccttggctttttcagcaaggtgccaaggggttggatcgcgttatgacatgctatctgagttgtctagaagagagaaagcagcaaatatcaagcctgacccagatcttgatgtctacatgaaggcaactgcaactgaaggtcaggagtcaagcttagtaacagattatacactaaagattttggggttggatatttgtgctgatactatggtgggggatgaaatgttgcgtgggatctctggaggacaaaggaagcgtgttactacaggagagatgttggttggaccagcaaatgccttgttcatggatgaaatttctactgggttggacagttccacaacatttcagattgtgagctttctcaggcaatatgtccacattctaaatggaaccgctgttatatctttgctccagccagcacccgagacttatgacctttttgacgacattatcttaatctctgatggccaagttgtataccatggtccccgtgaatatgttctggacttctttgaatccatgggtttcagatgtcctgagaggaaaggtgttgctgacttccttcaagaagtgacttccaaaaaagatcaagcacaatattgggcacgcagagatcaaccatacagatttgtcacagttacccaattttctgaggcatttcaatcattccatattggtgggaaacttggagaggagcttgcagttccatttgacaagaccaagagccaccctgcagcattaaccactaagaagtatggtatcaataagaaggagctgttaaaggctaacctctcaagggagtatttgcttatgaaaaggaactcatttgtttacatcttcaagctatgccagctttccatcatggcgttaatgacaatgacactgtttttgagaaccgagttgcatcgtaacaatatggatgatgcgggtctttatgctggtgctctattttttaccttagtaatgattatgtttaatggaatggctgagatttctatgaccattgctaagcttcctgtattctacaagcaacgggaccttctattttatccctcttgggcatatgcaatcccttcatggattctcaagattcctgttactctactggaagttgctgtttgggtattcctcacctactatgttattggatttgatccaaatgttgggaggttgttcaagcagtatctcattctactgtttatcggccagatggcttcggcactatttcgtgctattgcagcactgggtagaaacatgattgtttccaacacatttggagcctttgcagttctcacgttccttacattgggtggtttcgttatggcaaaaagtgatataaaaaactggtggatttggggttactggatttcacctttaatgtatgggcagactgctttgatggtcaatgaatttctttcaaacagttggcacaactctagccgaaatttaggagttgaatatctggagtctcgtgggttcccctcaagtgcatattggtattggttaggcttaggggcaatggctggatttgtgttgcttttcaacgtgatgttttctgctgcacttgaaatccttggcccatttgataagccacaagcaacaatagctgaagaagaatcacctaatgaagtaaccgtagcagaagttgaattgccacgcatagaaagttcaggaagaggtggttctgttgtggagtccagccatggaaagaaaaaaggaatggttcttccttttgagccacattctatcacctttgacgaagtcgtatactctgttgacatgccacaggaaatgaaggaacaaggtgtacaagaggacagattggtgcttttgaagggtgttagtggtgcattcaggcctggtgttctcacggctttgatgggtgtaagtggagctggtaagactactttgatggatgttctggctggcaggaaaactggtggatatattgatggaaacatcaaaatttctgggtaccctaagaagcaagaaacatttgctcgtatctctggctactgtgagcaaaatgatatccactcacctcatgttactgtttatgaatccttgctctactcagcatggcttcgtttaccttcaagtgttgattcccaaaccagaaagatgttcattgaggaagtcatggaactggtggagctgaacccattaaggaactcactggttggattgcctggtgtgagtggtctctcaactgaacagcgcaagaggctgactattgcagttgaattagtggctaacccatctataattttcatggatgagcctacttctgggttagatgcaagagctgctgcaattgttatgagaacagtcaggaacactgtggacactggaagaaccgttgtctgcaccatccatcagcctagcattgacatatttgaagcatttgatgagctattcctaatgaagcgtggaggacaagaaatatatgttgggccgctgggtcgtcactctagtcatttgatcaagtattttgagagcattgaaggggtgagcaaaatcaaagacggatataacccagctacttggatgttggaagttacaacttcagcacaagaacttagtttgggtgttgattttactgacttgtacaagaattctgatctatataggagaaacaagcagcttatacaagaactgggtcagcccgctcccggttcaaaggatctttatttccctactcaatactctcagtcattcttggtccaatgccaagcttgcttatggaagcaacgttggtcatattggcgtaatccaccatacactgctgtgaggtttttcttcactactttcatagccctgatgtttggaacaatgttctgggacctcggaagcagacgtacaacaagaggagacctgttgaatgctctaggttcaatgtatactgctgttctcttccttggaatacaaaatgcttcctctgttcagccagtggtagcagttgaaaggactgtcttttatagagaaaaagctgcgggaatgtattctgccttaccctatgcatttgcacaggttctggtagagataccatatatcttcgctcaagctgtgacatacggtttaattgtttatgccatgatcggatttgactggactgcagagaaattcttttggtatctatttttcagtttcttctcattgttgtactttactttctacggtatgatggctgtgggagtgacgccaaaccaccatgttgctgccattgtggctgctgcattctatgcaatttggaatctcttctcgggatttattgtcgttagacctaaaatgcccgtgtggtggagatggtactattgggcatgtccagtggcttggaccttatatggattgattgcatctcagtttggagatataacggaaagaatgccgggtgaagataacaagatggtgaaagatttcgtagaagactactttggtttcaaacatgacttcgttggagtgtgtgctgttgtggttgctggcatcgcagttgcctttgcattaatcttcggtgttgcaatcaagacctttaacttccaaaagagatag

SEQ ID NO: 2710 - DNA, 4284 bp, Glycine max var. Williams 82
atggagggaagtgatatatacagagcaagtaacagtttacgatcaagaagttccacagtttggagaaacagtggtgtggaggcattctcaaggtcttctcgcgaagaggatgacgaagaagctctgaaatgggctgcacttgagaagctccctacctacaaccgtctcaggaaaggcttgctcacagcttcccatggcgtcgccaacgaaatcgacgtctctgatctcggcatccaagagagacagaaacttctcgagaggttggtcaaagtagctgaagaggacaatgagaggttcctgttgaagctcaaggaacgtattgatagagttggacttgatattccaacaattgaagttcgatatgagcaccttaatattgaggcagaggcctttgtgggaagtagagctttgccctctttcatcaactctgttactaatgtcgtagagggatttttcaatcttctccacgttagcacaagcaaaaagaaacacgtgactattcttaaagatgttagcgggattattaaacctcgcaggatgacactgcttttgggtcctccaagttcaggaaaaaccacactccttttggccttatcaggaaagctcgataaaactcttaaggtatctgggagagtgacttacaacgggcatgaattgaatgagtttgtgccccaaagaactgctgcttacatcagccaacatgatcttcatattggagaaatgactgtgagggaaaccttggctttctcagcaaggtgccaaggggttggatcgcgttatgacatgctatctgagttgtctagaagagagaaagcagcaaatatcaagcctgacccagatcttgatgtctacatgaaggcaactgcaactgaaggccaggagtcaaacatagtgacagattatacactgaagattctggggttggatatatgtgcggatactatggtgggggatgaaatgttgcgtgggatctctggaggacaaaggaagcgtgttactacaggagagatgttggttggaccagcaaatgccttattcatggatgaaatctctactgggttggacagttccacaacatttcagattgtaagctctctcaggcactatgtccacattctaaatggaactgctgttatatctttgctccagccagcacctgagacttacgacctttttgatgacattatcttaatctctgatggccaagttgtataccatggtccccgtgaatatgttctggacttctttgaatctatgggtttcagatgtcctgagaggaaaggtgttgctgacttccttcaagaagttacttccaaaaaagatcaagcacagtactgggtgcgtagagatcaaccttacagatttgtcacggttactcaatttgctgaggcatttcaatcattccatattggtgggaaacttggagaggagcttacagttccatttgacaggactaagagccaccctgctgcattaaccaccaagaagtatggtatcaataaaaaggagctgttaaaggctaacttctcaagggagtatttgcttatgaaaaggaattcatttgtttatctcttcaagctaagtcagcttttcatcatggcattagttgcaatgacactgtttctccgaactgagatgcatcatgaaaatatggatgatgcgggtgtttatgccggtgctgtattttttatgttaataacggttatgtttaatggactggctgagatttctatgaccattgctaagcttcctgttttctacaagcaacgaaaccttctattttatccttcttgggcatatgctattccttcgtggattctcaagattcccgttacaattgtggaggttgctgtttgggtattcctcacctactatgttattggatttgatccaaatgttgggaggttcttcaagcagtacctcgtgctattaattgttagccagatggcttcgggattattccgaactattgcagcgctaggtagaaacatgattgttgccaacacatttggagcctttgcaattatcacagttgttgcattgggtggtttcattctgtcaaaaagggatatcaaaagctggtggatttggggttactggatttcacctttaatgtatgggcagaatgctttgatggtcaatgaatttctttcaaacagttggcacaacgctacccacaatttaggagttgaatatctggagtctcgtgcgttcttcacagattcatattggtattggttaggcttaggggcactggttggatttgtgttccttttcaatgtgatgtttggtcttgctcttgaattccttggcccatttgataagccacaagcaacaataactgaagatgaatcatctaatgaaggaaccttagcagatattgaattaccaggcatagaaagttcaggaagaggtgattcccttgtggagtccagccatggaaagaaaaaaggaatggttcttccttttgagccacattctatcacctttgatgaagtcgtatactcggttgacatgccacaggaaatgaaggagcaaggtgtacaagaggacagattggtgcttttgaagggtgttagtggtgcattcaggcctggtgttctcacagctttgatgggtgtaagtggagctggtaagactactttgatggatgttctggcgggtaggaaaactggtggatacattgatggaagcatcaaaatttctgggtaccctaagaagcaagaaacatttgctcgtatctctggctactgtgagcaaaatgatatccactcacctcatgttacagtttacgaatccttgctctactcggcatggcttcgtttaccttcaagtgttgattccaaaaccagaaagatgttcattgaggaagtcatggaattggtggagctgaacccagtaaggaactcactggttggattgcccggtgtgagtggtctctcaactgaacaacgcaagaggctgactattgctgttgaattagtggctaacccgtccataattttcatggatgagcctacttctgggttagatgcaagagctgctgcaattgttatgagaacagtcaggaacactgtggacactggaagaaccgttgtctgcaccatccatcagcctagcattgacatatttgaagcatttgatgagctattcctaatgaagcgtggaggacaagaaatatatgttgggccactgggtcgtcactctagtcatttgatcaagtattttgagagcattgaaggggtgagcaaaatcaaagatggatataatccggctacttggatgttggaagttacagcaacagcacaagaacttagtttgggtgttgattttactgacttgtacaagaattctgatctgtataggagaaacaagcagcttatacaagaactgggtcagcctgctcctggttcaaaggatcttcatttccctactcaatactctcagtcattcttggtccaatgccaagcttgcttatggaaacaacgttggtcatattggcgcaatccaccatacactgctgtgaggtttttcttcactactttcatagccttgatgtttggaacaattttctgggacctcggaggcaaacattctacaagaggagacctgttgaatgcgataggttcaatgtacactgctgttctcttccttggagtacaaaatgcttcctctgtacagccagtggtagcaattgaaaggactgttttttacagagaaaaggctgccggaatgtattccgccttaccctatgcatttgcgcagattctggtagagctaccctatgtctttgttcaagcagtgacatatggtgtaatagtttatgccatgatcggatttgagtggactgctgagaaattcttttggtatctatttttcatgtacttcacattgttgtactacaccttctacggcatgatgacagtgggactgacgccaaaccaccatattgcttccattgtggctgctgcattttatgcagtttggaatctcttctctggatttgttgttacaagaccaagcatccccgtgtggtggagatggtactattgggcttgtccagtggcttggaccatatatggattggttgcatctcaatttggagatttaacagaaccaatgacgtctgaaggtcaaaagattgtgaaagatttcttagaagattattatggtatcaaacatgactttattggagttagtgctgttgtggttgctggcatcgccgttctctttgcattgatttttgctgtttcaatcaagacctttaacttccaaaagagatag

SEQ ID NO: 2711 - DNA, 1641 bp, Glycine max var. Williams 82
gtttttgttcaaagattctttgtcttctcttccttcccagaagctcacccaacaattctttccctcaatttctgcgagtaggttcacgggtaggcatttttatttgcacgtttctctggtgagggcaagatcacagaattggtgtgagagagatgggttcgtccgtgaagctttcaaggagggccttggaaactgagatgcccgttatggttcagatgcaggaattgcaacgaggagctaagaatgccttgtctttggcccagggggtggtttactggcagcctcccaagcaagcgttggaaaaagtgaaagaacttgtatctgagcctttaattagtcgttatggtaacgatgaaggtattcctgaactcagagcagcattagtcaaaaagttgcgtgatgaaaataatttgcacaaatcttcagtaatggttacatcaggtgccaatcaggcatttgtgaatctagttcttactctctgtgatccgggtgattctgtggttatgtttgctccttactacttcaatgcgtacatgtccttccagatgactggcattaccaatattctagttggtcctggtagctcagacacactccatcctgatgcagattggttggaaagaatattatcagaaaataaaccggctccaaagcttgttactgttgtaaatccaggcaatccatctggaacttacattccagagccccttctaaagaggatttcagatctctgcaagaatgctggctcttggcttgttgttgataatacatacgagtattttatgtatgatggcctgaaacactcttgtgttgagggaaatcatattgttaatgttttctcattctcaaaagcatatggaatgatgggatggcgggttggatatatagcgtacccctctgaagtaaaagacttcgctgaacaacttctcaaagttcaagacaacattcccatctgtgcttcaatattatcacagtatcttgccctgtattcattggaagtggggcctcaatgggttttagaccaggtaaaaactcttgaaaagaacagagaaattgttttagaagctctctcccctcttggagagggttctgtgaaaggaggagaaggtgctatatacctgtgggcaaagctcccagacttagacgctcacgatgattttgatgttgttcgctggctagctaacaagcatggggttgcagtaatcccaggaaaagcatgtggttgtcccagcaatcttagaatttcatttggaggcttgacggagaatgactgcagagctgccgcagaaagactgaagaaaggcttagaagaattggttagagacggactgcgggagtaactgaaactaatcatagaacatccccttcccaagccaagcctccaaaaaactatagatatcaatagaaagaaatttcacttgccaatgtagcaagtttgcaacttttgcatttgaataaatggaggattttactttctatccggttaaagttgtgggatatcaatagaaagaaatttcacttgccaatgtagcaagtttgcaacttttgcatttgaataaatggaggatttactttctatccggttaaagttgtgggatagcaaaattttattattttaattttgataaatttcaaaatatt

SEQ ID NO: 2712 - DNA, 216 bp, Glycine max var. Williams 82
atgtccgacttacacttgctgaagagccctccagatggaaccaccaacaaccgacaatgggatattggaaaaccaatcgcggggcagagaagctgcacagaaccatcaaagcaaacccaagcacagttgaaagaatggatcaggagatcactgaatgcatcaattgaagtgtgcttctttgatgttaggatttacacatcaagatttagagtctag

SEQ ID NO: 2713 - DNA, 924 bp, Glycine max var. Williams 82
atggaacagaccctctcctttgaatttgagcatgaatttgttcaaaacacggcaagagtgaaatctgttgatatgcatccaactgagccatggattctactgggtttgtattcaggaactatttctatttggaactatcagacaaagactgaagagaagtctttaaaaatcagcgaatctccagtgagatcagcaaagttcattgctcgggaaaactggattgttgcagctacggatgacaaaaacattcacgtctacaattatgacaaaatggaaaagatagtagaatttgcggaacataaagattatatcaggagtttagctgttcatcctgtcctgccatatgtaatatcagcttcagatgatcaggttctaaaattgtggaattggaggaaaggttggtcttgttatgagaactttgaagggcactcacattatgtgatgcaagtggcattcaaccctaaggatccatctacctttgctagtgcatcccttgatggcaccttgaagatctggagccttgattcctctgctccaaattttaccctggaaggacaccagaaaggagtgaattgtgttgattacttcataaccaacgacaaacaatatcttttaagtggttctgatgattacactgccaaggtatgggattatcattctagaaactgtgtacagacgcttgaaggacatgaaaacaatgttacagcaatatgtgctcatcctgagcttcctataataataacagcttcagaggattctactgttaaaatatgggatgctgtcacttacaggcttcaaaccacgttgaactttggtctcaagagagtatggagtattggatacaagaaaggatcatctcagcttgcatttggttgtgaccaaggatttctaattgttaagatttcagaaggaagaccccaataa

SEQ ID NO: 2714 - DNA, 2256 bp, Glycine max var. Williams 82
atggccgccgacatgtccaacaataataatcctcctcccacttctcacgccaaagacttctttgcttctcctgctctctctctcagccttgctggtatttttcgccatgccggggttgccgcggcggatgaggctgccacttcggtggaggagggtgaagagtgtgagaggttagatgatattagcagcgagaactccggtcccacaagatccagatcagaggatgatttcgaagttgaagctgaacatgaagatgacgatgctgatggagacaagaacaagaacaagaagaggaagaaatatcacaggcacactgctgaccagatcaaagaaatggaagcgcttttcaaagagtcaccacatcctgatgaaaagcagaggcaacaactaagcaagcaattaggccttgccccaaggcaagtcaagttttggttccaaaatcgtcgaacccaaatcaaggcaatacaagagcgtcatgaaaattctttgttgaagtcagaaatagagaaactaaaggagaaaaacaagaccttacgagagaccataaacaaagcttgttgccccaactgtggcgtgcctaccacaagcagagatggtgccatgccaactgaagaacaacaactacgtattgaaaatgccaaactcaaagctgaggtagagaagctccgagcagttttagggaaatacgcaccagggtcaacgtccccttcatgttcttctggccatgaccaagagaatagaagctctttggatttttacactggaatttttggacttgataagtcaaggataatggatacagtaaaccaagctatggaggagctcatcaagatggctaccgtgggggaaccattatggcttcgtagcttcgagactggtcgcgaaattcttaactatgatgaatatgttagggagtttgcagttgaaaattcaagcagtggaaagccaaggagatccattgaagcctcaagagacactgcagttgtttttgtggatctccctcggcttgtccaaagttttctagatgtgaatcagtggaaggaaatgtttccgtgtttaatatctaaggcggccactgttgatgtaatatgcaatggagagggtcctggcaggaatggtgcagtgcaactgatgtttgctgagctgcaaatgctcactcctatggtgcccacaagagaagtatattttgtccgtttctgcaagcagttgagtgctgaacagtgggcaatcgttgatgtatccatagacaaagtagaagacaacattgacgcgtccctcgtgaaatgcagaaaacgcccttccggttgcattattgaggacaagtccaatggccattgcaaagtaatatgggtggagcacttggaatgccagaagagtgcagtccattcaatgtatcgcaccattgtgaacagtggcctagcttttggggccaggcattggattgcgactctacaacttcaatgtgaacgtctagttttcttcatggcaacaaatgttcccatgaaggattcaaccggtgttgccacgttggccgggagaaaaagcattttgaagttggcacaaagaatgacatggagtttctgccatgcaattggcgcgtcaagcttccacacatggactaagtttacaagtaaaactggagaagacataaggataagttctagaaagaacttgaacgatcctggtgaacctcttgggttgatattgtgcgctgtttgttctgtatggttgcctgtctcacctaatgttctgtttgatttcctgagggatgaaacgcgacgaactgaatgggacatcatgtcaagtggtgggacagtgcagtccattgcaaatttagccaaaggacaagaccgaggaaatgccgtagccattcaaacaattaaatcgaaagaaaacagtgtgtggatactgcaagatagctacacaaacccttatgagtcaatggtggtatatgcttctgtggacattactggcactcagtctgtgatgacaggatgtgattcgagcaatcttgccatactgccctcaggattctctattattcctgatggtcttgagtcaaggccattggtgattagttcaaggcaggaagaaaaaaataccgagggaggatctttgtttacaatggcattccagattcttaccaatgcttctcccgctgccaagttaacaatggagtctgtggactcggtcaacactcttgtatcttgtacattgagaaatatccgaacgagtctacaatgtgaagatggctag

SEQ ID NO: 2715 - DNA, 507 bp, Glycine max var. Williams 82
atgcagggcattgaggatcagaaaattcaacagaatgaacccgttggttcaattgctccaaggtatgaagctgataggattcagcaaatagggaatccatggagcactggactatttgactgtcatgagaatcagacaaatgctgttatgacagcattttttccctgtgtaacatttgggcagatagcagaagtacaagatggtggagaacttagttgtcatctggggagcttcatttatctattaatgatgcctgctttgtgctctcaatggattatggggtcaaagtaccgcacaaagttgaggaagaggtataatttggtggaagctccatatacggatatagtctctcacatcttttgtccatgttgttccctctgtcaagaattcagagagctaaaaattagaggacttgaccctgctcttggatggaatggcattcttgcacaacagcaaagtgatcaaacattaaagaatcctcctttaaaccaagtcatgtccaagtga

SEQ ID NO: 2716 - DNA, 2355 bp, Glycine max var. Williams 82
atggaattgcagcttattttcctgctaattaagctacattttgttatatgtattccccagcttcatgaatatgctgccacttatctgcaccattcgagaatcagaagcccttcaagtattgcattcccgccatcagaatcactttctggacttcctcatagtattgcacttccaccttccaaggcatcttctagaaatgccggaagtattgcactttcaccttccaaatcattccccaaaatgaaatggacgcacagttctatggactctccaatatcacaccataagcatcgccattccagaagaaagtccaacaaccaagttcctggcccaacctatccaatccaccctcatactcatcaaggttctccagtcttcaaatatcaacattcattctcttcacctatgagcctgcgtttaaatgcacccacatcagcaccagcaccagcacctgcatcatcaccaacagttctatcacaccacttgaatgtaccctctccttcacctagaatttcacctccaggttcatcattgaagaagacagagactccaccaccagcatatactttggttctaccatctccaccacctaacaaagattgtatatcggtgacttgctctgagcccttgacatatacacctcctggatcaccttgtggttgtgtgtggccacttcaagttaaacttcgcatcaacattgcaatatacaagttttttcctttggtttccaagcttgccaatgaaattgctgctagtgttttgctgaaccataatcaagtacgcgttgtgggagctgatgcaactagccagcagctcgagaaaaccattgttctcataaatttggtacctcaaggagtgaagtttgatgacacaactgcatttttaatatataagaaattctggcagagagaggttctcaatgatgcttctgcctttggtgactatgaagtgctctatgttcattatccaggccttccaccatctccaccttcaaatgttcacggtatagatgttgaaccataccctggtcgcaggaacgatggaacaatagtgaaacctttaggagtagatgtctcagggaagaaaaaagaagggagtggtggaagaatggttattatgatcgtgctgtcatcttttgctgcctttgttctattcattggagttgcctggctttgtctcttgaaatgtggttcctgcactcttgaacctgaacaaattccagatgtcaaaattccattctcttcaaagcgatcagcagggactgccagtgcaagggcattgaattatgggagcatgccgggttctagatcaatgtccttcaattctggaacaataatatatacaggatcagctaaaatatttactttgaatgaaatagagaaagcaacaaataacttcgattcttcaagaatattaggagaaggtggcttcggtcttgtttacaaaggtgacctagatgacggcagggatgtggcagtgaagattctcaaaagagaggaccagcatggagaccgtgaattctttgtagaagctgagacgcttagctgcttgcaccatagaaatttagttaaattgataggtttatgcacagagaaacaaactcgctgcttagtctacgagcttgtccctaatggcagcgttgaatcccacttacatggtgctgacaaggaaaccgagccacttgattgggatgcacggatgaagattgcacttggtgcagctaggggattggcttatctgcatgaagattgtaatccatgtgtcatacatagggacttcaaatccagcaacatcttgttggaatatgattttacacccaaagtttcagattttggattggctagaacaacactgaacgagggaagcaaccacatctcaacacatgtcattggaacatttggctacgtagctcctgaatatgcaatgaccggccatcttcttgtgaaaagtgatgtttacagctatggagttgtactccttgagctcctaactggaagaaagcctgtggatttgtcacagccaccaggtcaagaaaaccttgttgcttgggctcgtccacttcttacaagtaaggagggtttgcagaagatcatagacccaattataaaacccgttttttctgtcgataccatggtaaaagttgcagcaattgcatccatgtgtgtgcaaccagaagtcactcaacgtcctttcatgggtgaagttgttcaggcattgaagctggtatgcagtgagtttgaggaaacaagttatgtaagactgaaaagctttcgagaagatgatcttgcaaccagtgttccaggtgagagagtgggaatttcagagtgtaacataacactgcctcagcctggttaa

SEQ ID NO: 2717 - DNA, 1728 bp, Glycine max var. Williams 82
atggccgtatctccaattttgttgttgttggctatcttctctctcatttatggcaatggtattcttcccattgaagctacccaccatgtttacagaaatcttcagactctatcttctgattcctctgatcaaccttatagaaccgcttaccatttccaacctcccaaaaattggataaatgaccctaatggaccaatgaggtacaaaggactttatcatctcttctaccaatacaatccaaaaggtgctgtttggggtaatattgtgtgggcccactcagtatcaaaggatcttgtgaattggacccctctagatcatgccatctacccttctcaaccgtctgatatcaacggttgttggtcaggctcagccacaatacttcctgggggcaaaccagccattttatacacaggaattgaccctaataatcaccaagttcaaaacttagccctacccaaaaacatgtctgacccattacttagggaatgggttaagtcacccaaaaatccactaatggcaccaactagtgctaacatgatcaattcaagctcatttagggatcctaccactgcttggctaggcaaagatgggtactggagggtgctgattggaagcaaaatacacactaggggtatggcaattttgtacaagagcaaaaactttgttaattgggttcaagccaaacaacccctacattcagctgaaggcactggaatgtgggagtgccctgatttctatccagtgctgaataataaaccatcatcaactattggtcttgacacatctgtgaatggtgataatgttaggcatgtgcttaaggttagtttggatgataaaaaacatgatcattatttgattgggacttatgacattgccaaggatatcttcactccggataatggatttgaggatagtcaaactgtcctaagatatgactatggaaaatattatgcctcaaaaaccatttttgaggatggaaagaacagaagggtcttattgggttgggttaatgaatcctcaagtgtttcggatgatatcaagaaaggatgggctggaatccatactattccaagggccatctggcttcataaatctggaaaacagttggtgcaatggccggtggtggaacttgaaagcttacgtgtgaatcctgtccactggcccaccaaagtggtcaaaggtggtgaaatgcttcaagttactggtgttactgcggcacaggctgacgttgaaatttcatttgacgtgaatgagtttggaaagggcgaagtattggaccaatgggtggatccccaaattctgtgtagtagaaagggtgcagccgtaaagggtggtttgggaccctttggcttgctagtttttgcttctcgtggcttgcaagagtacacggcagtattctttagaatattcagataccaaaataaaaatttggttctcatgtgtagcgaccaaagcagatcctctttgaataaagataacgatatgaccacctatgggacttttgtggacatggaccctcttcatgagaagctgtcactaagaactttgattgatcactcagtagtggagagttttggaggagagggaagggcttgcatcacagccagagtatatcccacaatagcaattaatgaaaaggcacaactatatgctttcaataatggaactgccgccgtcaagattacaagattgagtgcttggagcatggagaaggcaaaaataaactga

SEQ ID NO: 2718 - DNA, 2055 bp, Glycine max var. Williams 82
acctcacctcattccattaaaagccaccatggccgtatctccaattttgttgttgttggctatcttctctctcatttatggcaatggtattcttcccattgaagctacccaccatgtttacagaaatcttcagactctatcttctgattcctctgatcaaccttatagaaccgcttaccatttccaacctcccaaaaattggataaatgaccctaatggaccaatgaggtacaaaggactttatcatctcttctaccaatacaatccaaaaggtgctgtttggggtaatattgtgtgggcccactcagtatcaaaggatcttgtgaattggacccctctagatcatgccatctacccttctcaaccgtctgatatcaacggttgttggtcaggctcagccacaatacttcctgggggcaaaccagccattttatacacaggaattgaccctaataatcaccaagttcaaaacttagccctacccaaaaacatgtctgacccattacttagggaatgggttaagtcacccaaaaatccactaatggcaccaactagtgctaacatgatcaattcaagctcatttagggatcctaccactgcttggctaggcaaagatgggtactggagggtgctgattggaagcaaaatacacactaggggtatggcaattttgtacaagagcaaaaactttgttaattgggttcaagccaaacaacccctacattcagctgaaggcactggaatgtgggagtgccctgatttctatccagtgctgaataataaaccatcatcaactattggtcttgacacatctgtgaatggtgataatgttaggcatgtgcttaaggttagtttggatgataaaaaacatgatcattatttgattgggacttatgacattgccaaggatatcttcactccggataatggatttgaggatagtcaaactgtcctaagatatgactatggaaaatattatgcctcaaaaaccatttttgaggatggaaagaacagaagggtcttattgggttgggttaatgaatcctcaagtgtttcggatgatatcaagaaaggatgggctggaatccatactattccaagggccatctggcttcataaatctggaaaacagttggtgcaatggccggtggtggaacttgaaagcttacgtgtgaatcctgtccactggcccaccaaagtggtcaaaggtggtgaaatgcttcaagttactggtgttactgcggcacaggctgacgttgaaatttcatttgacgtgaatgagtttggaaagggcgaagtattggaccaatgggtggatccccaaattctgtgtagtagaaagggtgcagccgtaaagggtggtttgggaccctttggcttgctagtttttgcttctcgtggcttgcaagagtacacggcagtattctttagaatattcagataccaaaataaaaatttggttctcatgtgtagcgaccaaagcagatcctctttgaataaagataacgatatgaccacctatgggacttttgtggacatggaccctcttcatgagaagctgtcactaagaactttgattgatcactcagtagtggagagttttggaggagagggaagggcttgcatcacagccagagtatatcccacaatagcaattaatgaaaaggcacaactatatgctttcaataatggaactgccgccgtcaagattacaagattgagtgcttggagcatggagaaggcaaaaataaactgataccaacaattaaagaggaacccaatataggattaatgataaccaatatttgtgttcttttattagtgccaacaaattttattattactgtactactataaccatagtgcttgttattcaggttaaaagcaataatttgataagaaaataagaacaaaaatatgttttgtaaacatgttatagtcttctaggttacctgtcaatttattttatcattttgtattaacttttatttacatgatgacacgtacatgtaattggcaggaacaattttaactcagtatctttgattcataagc

SEQ ID NO: 2719 - DNA, 1480 bp, Glycine max var. Williams 82
agacattgcaaccaagttcaagtctatgaaattagctagccaaaatatcagaatattaatctcaagttaaattaaatcgagctcataaacatgtatagcttggaccatgtagtaaatatttgagtcttgagtaactagaatctgttagtatgtggtaaaataagcagcagaagatgagggacgacgctcaaatttaatgccatgtaaacggatggtccagattttggatataggtgaagagattttgtctgtttcccaacaaccaacaaagaaaagttgaccctagtatccacacgttaatctatttatgatttttttagtaccacttaattatagccttaagtttttcacaatgattcccagatgtaactgccaccctgccattgatttctttcttccgtatatggcaacgaaatcaaagcatcactaaaagacaaaggtgtttgaggcccaaaatgggtgctgttattctgcacttgtggatcaccgtatatagtgtcttacccttagattgatttgagagagagaaaggctctttggcttgtattgaaaggtaagcaattgaaggttagaggccgaaagagagtggaataacagactagtcttaggaactccctagtgaaggtgaaacttgctctaagtgaagcaaaatcacttgcttgtgaagaagctcacaaaatctcttgcaagttaagtttgtaggctctgaccttgtttttgggaattgcaagctaagctggtttagttagtagctagcctttctcgcccttcttatatatattccacaattcaacaatcaatcatcatgcctaattgcctcttgttgtgaagggagaaagaagattctcatcatcatcacattcatcattttaggttttgaaaaacaaaaaaaaaaaaatgaaagcaacattctgttgttttatgctagctctactaatagttagttgggaatccgtagtagtagtagtagcaaggaggccctttcctccaactgatggaatgtcccatccaggccccaaagcggcaccaggaccagggccagtgtcttcaccatctaatactgtagagccagaaaagggtttaatggaagaagcatactactatagaggagtgagcaaaatagggtcaagtccaccaagttgtgagcacaagtgttatggttgcactccatgtgaagcgattcaagtgccgagcaccagcagcaggcgcagtcatttgggattgcagtacacaaattatgagcccgaaagttggaaatgcaagtgtggtccttccctctacagcccgtgaattagcactactatgttgttcttgacttgttcatatataccccatttaatattagtttatatataatcaatgatctcctatgtgtctcaccttcatatttatggttccctcgtacaaacctcaattcaaaggattttattctattatgtcatacttgtgactacaattcgaatgccaacttatttataaa

SEQ ID NO: 2720 - DNA, 1416 bp, Glycine max var. Williams 82
atgcaatcggacactaaactcactttttgtctttggtttcatggaagagtatataagaggccgggaagtgccatttcaaagactaaactctgttgtatacatgaaactataaagaacctgacatttttactaccaggaatgggaatgcttgcgattagcaaggaaggagaggtcacagtgagcttcaagaacaacataaacttgaatgatttctacaagcctgaacaatctactagcttgaagagaaggaaggtgggaaatctgaagctccaaaccacattctcattcaaacatctactttcagcgaactgtggttcacaagaggaagttgaggacttgttcaacaaacgaagccccatggttttgtcaaaaaaaccaaaacaaatgttttctccaacttcctctgaccagcttgatttagctgcattaatgattcagaaagtttacaagagttataggattagaagaaatctggctgattgtgcagttgtttgcgaggagctatggtggaaagattcaatgattactgcttttaacaggtgctccatatctagttttgactctgataaatcagaaaaagctatttcaaaatggacactagctaggaagatggctgctaaggtggggaaagatttgtccaaagatgataaggcacaaaaattggcactaaggcactggcttgaagctattgatcctcgtcatcgttatggccacaaccttcatttctattacttggtttggtttcatagccagagttgtcagccttttttctactggttggatgttggaggtggcaaggaattaaatcttgaagaatgccctacagagcaactgcagagacagcgcataaaataccttggaccagaagagagggaagcatacgaagtgattgtggagggaggaaggcttgtttatagacaaagcagggaccttgtacatactacggaggattccaagtggatttttgtcctgagcacatctagaattttgtacgttgggcagaagaagaaaggtcaatttcagcactccagttttctagccggtggtgctaccattgcatccggaagattggttgctcaaaatggagttcttcatgctatatggccctatagtggtcactaccgtccaacggagaagaactttatggaattcattagcttcttggaggaacacaaagtggacatgacaaatgtaaagagagatccaattgatgaagatgtcccaccttctaatcctgtgaatgaggagccactatttgagtacatggaaggcaatgtgggtgccagtgacagtgccaataattgtggtaaagatgttgaagagaacaagccaatgtcaagcaaatggactactggagtaggtcctagaattggttgtctgagagtatccagcaaatttccaagttcaggcatttga

SEQ ID NO: 2721 - DNA, 1194 bp, Glycine max var. Williams 82
tgggtgtttcgggttaatcatttcaaatcttttcatcataaattattcgtagaaggaaagcttagtggaggtataaaccaagaaggagtcaaatactacaacaaccttatcaatgaactgctagctaatggtctacaaccatttgtgaccctttttcattgggatcttccccagactttggaagacgagtatggcggcttcctaagccctcgcattataaatgatttccaagactatacagaactttgtttcaaagaatttggagatagggtgaagcattggattactataaatgagccatggagttatagcatatttggttatgcaactgggatgatgccgccaagtcgatgctctaaatggctaaatccaaattgcatggatggtgattcagggaaagagccttatttagtttcacatcatttacttcttgctcatgcagcagttgtcaaaatgtacaagaaaaagcataccatagtgtctaattggtttgaggcatattcaaataacaaattagataaatatgctgcccaacgagcaattgatttcatgtttggatggtttatggaaccattgacatcaggaaattatccacaaagtatgcgttctctacttggtagacgattgccaaagttcactaaacaacaagtcaagcttatcaatggctcatttgattttcttggcctaaactattatacctctaactatgttgtcaatgcacctaagttaagcaatggcaaacctaattacgctacagattctaatgccaatcttacaactcaacgcaacgggactcctataggtccaatggcggcttcaaattggttatatgtgtatcccaaaggaattagagaattgttgctctataccaaagaaaagtacaacaatcctttaatttatatcactgaaaatggcattgatgagttcaatgatccaaccttgtcccttgaggaagcccttttagattcttttagaatagactatcattatcgtcatctcttttatcttcattcagcaattagggatggcgtaaacgtaaaaggatattttgcatggtcattgctggacaactttgaatggaacaatggctataaagtgcgatttggaataaactttgtagattacaaaaatggtttgaagcgatatcaaaagctctcagcaaaatggttcaaaaattttcttaaaaaatattag

SEQ ID NO: 2722 - DNA, 1194 bp, Glycine max var. Williams 82; identical to SEQ ID NO: 2721

SEQ ID NO: 2723 - DNA, 1542 bp, Glycine max var. Williams 82
atgcatcatatggcgcttctacttgtcgctctcttggctcttgttactacattaccatcggttactgttggagaagtgctttcacccattctcgacgttgcttcactgaaccgaaccagttttcccaagggcttcatttttggggcaggatccgcatcgtatcagtacgaaggtggggcaaacgaaggtggcaaaggaccaagtatatgggataccttcacccacaaatatccagataaaattgtggatagaagcaatggagatgtcgcaaatgaccaatatcaccactataaggaagatgttgggatcatgaagtatatgaatttggatgcttatagattctccatctcttggtcaagaattcttccaaaaggaaagctaaatgggggcataaatcaagaaggagtcaaatattacaacaacctcatcaacgaactaatagctaacggcttacaaccatttgtgaccctttttcattgggatcttccccaagctttggaagatgaatacggcggcttcttaaatccacgcattataaatgattttcaagactacgcggaactttgttttaaggaatttggagatagggtgaagtattgggttactttaaaccaaccatatacttatagtacgggtggctatgcgaatggggtaaaagcaccaggtcgatgctctaaatggttgaatccaaaatgcactgctggtgattcagggacagagccttatttagtttcacatcaccaacttcttgctcatgcagcagttgtccaagtgtataagaggaagtatcaggcatctcaaaatggtgtgatcggcataacccttgtgtctcattggtttgtgccaatttcaaataacaaattagatcaaaatgctgctgaaagagcaattgacttcatgcttggatggtttttggagccactgacaacaggaaactatccccaaagcatgcgttccttagttggtaaacgattaccaaagttctctaaacaacaaaccaagtcaatactcggttcatttgattttattggattaaactactacacctctaactatgctatccatgaacctcaactaaggaatgctaaacccaattacctcaccgattttcaagcgaaactcacgactcagcgcaatggaattcccataggttcaaatgcagcatcaagttggttatatgtttatcctaaaggaattcaagaattattgctctacgtcaagaaaaagtataacaatcctttgatttacatcaccgaaaatggaattgacgagttcaatgatccaacgttatcaattgaggaagtccttatagatacatatagaattgactattattatcgtcatcttttttatcttaaatctgcaatcaaggatggtgcaaatgtaaaaggatattttgtctggtcgttgttggacaattttgaatgggctaatggttatacagtacgctttggaatgaactttgtggactacaaaaatggcttaaagagataccagaaactatcagcaaaatggttcaagaattttctcaagaaatattag

SEQ ID NO: 2724 - DNA, 1737 bp, Glycine max var. Williams 82
atggctgcaactgcaaccgcaaaaaccaacaatgacaacaaccctgaaataacaagggaggaaatccaaactgccatagccaaagcagtggaattaagggcccttcatactgcattaacacaaggaagtagtccaggcacaaacaatgctagatttccgtcaccttccccggcttctcacttctctgcccaagactaccctgttttcacaccaagttatgaagatgaggcacaccagaacccaacaaggagcagaacaatatcagaaagctgggatgagaatggggtagaaggaaggaacagcatggccccctcagattacaaggagaaattaaattcaagaaaggaactaccttttggatttggcaaccttgacactcacatgtgtcctgctgatgatagcaaatctgtgactggttcttgtgcaaatcacattacttttctccaaacatcgccggcggcagtggcgaatgactacttcaaatccaggaggagaaacagtctgggggatttgaagcccttatcttcctgcaatagatgcaaccctgctgtcataactagtgaatatgagagcactaggaacaacaagagctccaacattgttgtccccctcacagactctcatgtctcttttcaaacccaaccaaaaagtaaaggggtgatttcatggctgttccctaggttcaagaagaagcataagaatgtgagttccccaagcagaacagaatctgaggaagtctcccaggttctcaaggacatggggatagtgtcagttgaggcactgaagagggaactgatggaggcaaatgagagtagagatactgccttgatggaagtttctgagatgagatcttcacttggagaactgaaacaaaagttggagtacttggagagttactgtgaagagttgaagaaagctttgaggcaagcaatgctcaccaaagaaaccacattttcagaaaagctcaatagccctccccagagaggaacaccctttgatgggaatggggaaaatttgatgcctgtgagtgaggatgttatggtagagggcttcttgcagatagtgtcagaatcaaggttatcagtgaagcaattctgcaagacccttatatgccagatagaggaaactgatcatcctttgatggacaacttgaacttgctcctccaaccatataggctctccttgaattccaaatactcaaaggctgttctataccattttgaagccttcataaaccagtccttctaccaagactttgagaatagtgtgttccaaaagaatggctgcacaaaattcttggaccctcggcaggatcgccaagcgcaattctcatcgtttgttgcacttaggaatttgagctggaacgaggttctcagaaagggtactaagtattacagtgaagagtttagcaagttctgcgaccagaaaatgagttgcatcatcactacactgaattggactaggccttggcctgagcaactccttcaggctttctttgtggcagcaaagtgcatatggttgcttcatttgctggccttttctttcaaccctccattgggaattttaagagtggaagagaatagaaactttgatcctcactacatggaagatttggttactgatagacagaggtcacaaggtccaagccgagtcaagattatggtggtgccagggttctatgttcaggataggatcttgaggtgtagagttatttgcaggcacaaatccgcaccataa

SEQ ID NO: 2725 - DNA, 2922 bp, Glycine max var. Williams 82
agggttttacttttagcgattcacaacacattatcataatccgtttgagattcacaattcagattttagatttcagatttcagattcagaatgagagaacaacacaatttccaaaatgggcaccctctcaaaccaacatttcctgcataattgagatttttttttcttctctggggtggaatcatttttgctctgaattctctctcacaaattccccatctcgaaattccgaaaatttgccgaaatttccattctctgggagtaaaagtttcgtctttgaacgagaatccgtgccaagaggctttccaattgagaccagtggggtaaaaaacatccagaattcaagtttatttatgattattggattgctgatgttccatgtttgatcaatccttatattggcatggttcctgagatatggtgttgcagaagaggttagactatagcttttatggctatcatgtgccaaccaagcgccgagctactcgatcagctaagaggagggctacatttcaaagaaggttggaagacaatcaaatgtgtgcatttgacttattggccaccatagctgacaatttgttgcaagagaaacagaatccaaccatatccagtgatagatcatcggaaaaggatagggatggattttctaaagtggaatgccaggatgcaaataaaccattcaaaactgagctttctgatgaagcaagttgtgacagaaaatgtcagcatgaatttgttagagaaggatgcccagatgcaaataaaccattcaaagctgagctttcagatgaaggaagtagtgacagaaagtgtttctctaatatttcttcacaattatacaatcaaaattgctgtttgaaggaactcctgcaacatgaaattgatggtcattcatgcattgcttctatagtaacaagttccagttgctcagagaagattgttgctgagagactggtggatggaaaaggccacaatggagtggaaaatttagcgagcaaagttgaattaggttcctctggatgtctagagagtagtggttgcaagttagatggtgatgttagtaaagtaaaagatggtaaggttgggaaggttccaattgatactgggactgggatgtgctgttttgaggatcccttggatgaaaaacctcctgcactgatcagttcatgtggcaatgccaagatgtctgggtatgatgacagcaagcctcagagctcattgtccaaaggttgtgacaatgtactagtagatagtagagatgatgacgaaaacttttctgggtatgctcaccctagtaccaaaataaattcctttaagcaaattacttgtatagatgatagaaaaataaagaaaacattggattctaaatatcataaagtttctcaagaatccaagcacgatatactatctaacagtgttttggatggaaatttgaagtcagtttacagcagtaggaagaactattataaaagccaaagatctcaaatgtgtattcctttcaaaaagaggaagctttttaactgcagcagctctgatacaaattctaacggatatatcagaagtgatgacacttgttattcacccaagaatgacacgaaccaaagtgtttcttgttcatcttctggtatgagcaaagatcatggaacatcatccttgggacactctgcattacgatctagagattctcatgtgaagcttaggatcaaatcattcagagtgcctgagctttttatcgagattccagaaactgcaaccgtcgggtccctgaagaggacagtgatggaggcagtgactgctgtacttggaggtggattgcgcgtgggtgtgattctccatggaaagaaggttagagatgacagtaaaactctacttcagactggaatttctcatgataaccacctggatgctttgggctttgccttggagcctaattgttcacaaaaccgatcatctgcatgtgctacaacagattctctctgcgttcctggtgcagatatgcatcagcctttaatagggtatccttcaagtcgtgctgcaattcatcagaggattcagggcttttctaacatgttagctgagcatcaagcaaccggtttaggtaaccttgttgaaagtgatcatgactcagcaccttctccaatcaacacatcaggtgaaaaaaatttgacagattcaaaagaacttattactgttcctgaaatgggtatggaggcactagctgtactacctgtgcatcagaagtcaaagcgaactgagatcgcaccacgccgaattcgtaggcccttttctgttgctgaagtggaagcattggttcaagcagttgagaaacttggaactggaaggtggcgtgatgttaaacttcatgcttttgataatgcaaagcatcggacatacgtcgatttgaagtgcaggataaatggaaaacactggtgcacacagcaagaatatcacctcagcaaaggaggggagagcctgttccccaagaacttttggacagggtcctaactgcccacgcatattggtcccagcagcagactaagcaacagctcaagcaccactctacaaaaccttgccttctcctttaataaggacttgacaccaccacgtgcctttgttaaaagtgtcatttatcattttttcttcttcctgtatttatgacaaagtgtgtttatcactttgatttttagtacaatgtcacactttatctatcatgtaaaattagaacaaggtgatgcctatagagaatttgcgtcataggttttcactccaaagtcaaggttcggtgtgtaactggagtggaggggcacgtgttgatgatagaagtttatcagcaaattgaattatggacccacagcagctaataatgttaatcagtgtagctagagcttatccatgaataaaaaagagctaatattattctaa

SEQ ID NO: 2726 - DNA, 537 bp, Glycine max var. Williams 82
atgttgataatagtctttctctctgacaaagatctgaaaggagtgataaacaacacggatcatcatgaagtgggtttattggtacacaaggaaggctgccaaagtttgatccaagaagatcaccagattattagactcaaacaactatcggtgcaacagcgtgaccaagaagaaggagataataaagacgatcatcaccaagaagagcaaaagcaacgacgcaacaacatgatcgttacagcaaaaccggtgtgtcctcctataaacttgaaactagagattccgtattcgcgtgtgggatcagagaacgatgacgacgggttgaagactccaacatcttcggaccacaaaatcccggtgatcctagagtgcccaggtgcacccaagaagacaaaatcaaagccagacacgaaaagaaaagagtgtcgaccaagaattgtgcttgatctgtccaaagatttggaatctttgttccctatgccgcatgctgttgatgttcttggcggtggcctcaagaataagagagtcaaacagtga

SEQ ID NO: 2727 - DNA, 768 bp, Glycine max var. Williams 82
atggttcaacaggaagtgcgtaaaggtccttggacagaacaggaagacttcaaattggtgtcctttgttggcttgtttggggaccgtagatgggactttatagctaaggtatcaggtttgaatagaacaggtaagagttgcagattacggtgggttaattacctacatcctggcctcaaacgtggaaagatgaccccccaggaagaacgccttgtcttggagcttcactcaaaatggggaaataggtggtcaagaattgctcgaaagttaccagggcgcactgacaatgagatcaagaactactggaggactctgatgaggaaaaaggctcaggacaaaaagcgaggagaagctgcatcatcatcatcatctagtgttgattcctcaatatcctcaaacaaccatgcggtggatccacatgcttccaagaaagcaggagaagagagcttttatgacactggaggtcatggtgtgacagcctcaacccaagatcagggtcaaaaaggtgaacaagggttgttctctatggatgatatatggaaggatattgacaatatgtcagaagagaacaacactcttcagccagtttatgaagggaacagtgaagagggttgcaacttctcttgcccaccacaagtgccttctccatcatcatgggaatattcttctgaccctctatgggtgatggatgaggaaagtttgttttgccctttgagtgaaccatatttttcctgctatgcacaaggcagcgtttttttaaccggctaa

SEQ ID NO: 2728 - DNA, 3497 bp, Glycine max var. Williams 82
ccgagtaattttctagcaagcaacaaattaaattttgcagtgggtccttggggcatgcattcctcctcagtgataggaacccttaatccctccccttttttgtagaatttgccaattctttgaatcatcatcataataataataccacgcaataagcgaagaaggaaacacctacttcttctaaaacagtgattaaggacccacttcttctaaaagtatttctattacccaatctaagcgcactttaaaaaaaaaatagagttgaaataagcgaaagatagagcgcattgttggcttggctcttgggttgtgaaatgatttttctattgacgtagcttgtcttctttataacggtcggatgatatgatacgagaaacgttccacgcagacgccgtcatcctcacccttttcctgctcactgagtagagtctttgacttgacgatttatcacgtgaagttccgtttgaaacagaacacactagaaggccaaggccggcacactgtaagttccgatttcagtttcacacccgattcttccttccttctcgatccgcacatttcattgttcttcacactttcactcttccatcacgcggatcgtaccgagagtgatcgcgattcgccgaaccgatttagaaagtggaaccgcaatggaggcaacgcagagaagattgggtggaggaatggtgccggtgtcgccgtcgcagactccgcgctccagcgataagccggtgcgagatctgcgatctgcggattcgaattccaacagtcacagcaagtatgacaaggacaaaggcgtcaatgtgcaggtcctcgtgaggtgcaggccactgaatgaagatgaaacgaggctgcacacgccggttgtgatttcgtgtaacgaaggtagaagagaggtttcagctgttcagaatatcgccaacaaacagatcgatagaaccttcgcatttgacaaggtgtttggtcctaactctcaacagaaagaactgtatgatcaggcagtgtctcccattgtgtatgaagtgcttgagggctataactgcactatttttgcgtatggacagaccgggacagggaagacatacaccatggaaggaggtgcaagaaagaagaatggcgaatttccgagtgatgctggtgtcatcccaagagctgtgaagcagatttttgatatattggaagctcagaatgctgagtataacatgaaagtaacgtttctagagctttacaatgaggaaataacagatcttttggcccctgaggagacttcaaaatttatagatgataagtctaggaaacctattgctctaatggaggatgggaaggggggtgtttttgtcaggggtttggaagaagagattgtttgcacagcaaatgaaatttacaagatattagaaaaaggttctgcaaagaggcgtacagctgagactcttcttaacaaacaaagcagccgttctcactccatattttctatcacaattcatattaaggaatgcactccagagggtgaggaaatgattaaatgtgggaagctaaatcttgtggacctcgcaggctctgagaatatttcacgttctggtgcaagagagggtagagcaagggaggctggggagataaataaaagcttgcttacacttggacgagtgattaatgctctagttgagcactcaggtcatgttccatatagagatagcaaattaaccagattgttgagggattctttgggtggtaaaaccaaaacgtgcattattgccacaatatccccttccattcactgtctggaagaaacccttagtaccttggattatgcacaccgtgccaaaaatatcaagaacaaaccagagattaatcagaaaatgatgaaatctgcaatgattaaggatttgtattcagaaattgacagactaaagcaagaggtgtatgcagcaagagagaagaatgggatctatataccacgtgatcgctaccttcatgaagaagcagagaagaaggccatgactgaaaagatagaacgcatggaactagaagcagagtctaaggataagcaactggtggagcttcaagaactctacaattctcagcaacttttgaccgatgaattgagtgttaaacttgaaaaaactgagaaaagtctagaagaaactgagcagtcattgtttgatcttgaggaaaggcacaaacaagcaaatgcaacaattaaggaaaaggaatttttgatattaaatctcctaaaatctgagaaagcacttgtggagcgtgcaattgaactgcgagcggagcttgagaatgctgcatcagatgtgtcaaacctcttttctaaaattgagcggaaggataaaattgaagaaggaaacagaatacttatccagaaattccagtctcagttagctcaacaacttgaagtgctgcacaagacagtttcagcttcagtaatgcatcaagagcagcaactgaaggacatggaggaggatatgcagtcttttgtatcaacgaaagcagaggctactgaagatcttagacaacgggtaggaaagttgaaaaacatgtatggttctggtatcaaagctctggatgatttagctgaggagcttaaagtaaataaccagttaacttatgatgacttgaaatctgaagtagccaagcattcatctgccttggaggatctttttaaaggaattgccttagaagctgattcgttactaaatgatcttcaaagtagtctccacaagcaagaggccaatttaacagcttatgctcatcaacaaagagaggcacatgccagagcagtggagactacacgggcagtatctaaaataacagtgaacttttttgagacaatagacaggcatgcatccagtctgacccaaattgtagaagaagcacaattggtcaatgatcagaaattgtgtgaacttgagaagaagtttgaggagtgtactgcctatgaagaaaaacaactactggagaaagtggcagaaatgctagcaagttctaatgctagaaagaaacagttggttcaaatggcagtcaatgatcttcgagaaagtgcaaattgtagaaccagtaaactgcggcaagaagcattaaccatgcaggattctacttcttctgtcaaggcagaatggagagttcacatggaaaaaacagaatccaactatcatgaggatacttccgctgtagaatctgggaagagagaccttgtggaggttcttcaaatctgcctcaacaaggcaaaagtaggttctcaacaatggagaaaagctcaagagtctttgcttagtttggagaagagaaatgctgcttctgtggatactatagttaggggaggaatggaagctaatcatgccctacgtgcccgattctccagtgctgtatcaactacacttgaagatgccggaacagcaaacaaggatattaactcatccattgattgtcagtattgtgttatatctatgcatcatcattgttgtctaggtaggtaataccatgaatgtcat

SEQ ID NO: 2729 - DNA, 1848 bp, Glycine max var. Williams 82
atgcagaccccaaagacaagaaatactagtagtagctcctctgaagtgccccagaaggtgtcccctcgtggtggacgccaactcaggcctgctacattagacagtactgcatcttcattaaataaaacatcaaaggataatagaagtcccaaactcaccgaccgcagatcacccagaagccccgcaccagagaggaagcgtccaagcagaatatctgaattggaatctcagatttctcaactcaaagaggatttgaaggtggtgaggaaccagctcggtgtgtctgaatcatgcaagaagcaagctcagcaagatgctgaagagtccaagaagcaagtagcttccctatccttgaaacttgaagattctcaacagcaacttgtgaagttctcagctactgaacaagctcgtgttgttgagctccagaaaaccatagaagagcatgataaggcgtggcaatccgagctcagggctgcccaacagaagctctcagacaacacccttgcgcttacctctgccatcgacgaaattcagcagctcaaggttcagcttgaattggtagctaactgtgagaatgcgcacacgcaaatcgcggaatcatcagacgtggaactgctaaacttgacggataacttggcagaatctctctctcttgtggagaacatgagaaaccaactcagggattccaaagagtcagctcaggcacaagctttggtcaatgagactttgaggcaacttgaggctgcaaaaagaactgttgagttcctgagagctgacgctgccaaagctgtgaatggctacaactctgctgctttggacttagaccaatctagagcacgagtgaactcactagaggaactagtaagcaaacttgagtttggcctcactagtaacaaatgcaacagttctttaaatcttgcagatgttggtaacatggagctgaaagctgaggtattacacaagggtgagacagatcttaatcgcattgaagcagaaatttattctctgaggtctgctatagagagtgctgatactaagcaccaggaagaacagattgagtgttcagtgaagattaggaaagcctatgagttgattgaacagataaaatcagaatcaagcaagagagaatctcagctagaggctgaattgaaaagaaagaatgctgatgtcgaagagttgaaggctaacctgatggataaggaaaccgagttgcagtgcattgtggaggagaatgagaagttgaatttgcagcttgaaaaaagcatgtcatcacaaagagaacatgaacttaggaaggagcttcgaaaactagatgaatccgtggctggattgaaggctgatctgatggacaaggaaacaacattgcaaagtatatctgaagagaatgaaatgctgaagttggagatcagtaagaggtttgcaaatggtggtaatgtggtggaggaagttgctgcacaactagagacagctaaggccgcagaacgcgaggctgttataaagcttggtattgtgatggaagatgcagataggtgcaaccgaaaggcggcgagggtggctgagcaactggaagcatctcaggcagcaaattcaataatagaagctgaactaagaagattgaagatacagtctgatcaatggagaaaggctgcagaggctgctgctgctatgctctcagcagggaacaatgggaaactcactgagagatcaatgtctttggacaacaactataactctataatgaacaagtactcacctttttgtgaagaacttgatgatgatttccagaccaagaaaaatggcaacatgctgaagaagattggggtcttgtggaggaaacctcaaaaatag

SEQ ID NO: 2730 - DNA, 648 bp, Glycine max var. Williams 82
atggagaaaatgagagtggtactaattactctattgttgtttataggtgcagcagttgcagaaaaagctggtaatggcaaagctgccaataatcctgcagaagatgctagtgatggcgaagccattaatcttgtagaagaagctggtggtattggtgatgccattactcctgcagaaggcaaagccactaatcttcaagcgtatgagtcagctagattcaaaaagtttgtgacacattgcagctcacatgttgctcaaacatgcagtggaaatgatccattgcatcatcaggaaggtggccatggaataaacgttccacttgggttgtcattttgcctttttgattctatggagaaatgcttgggagaccatgaagccaaacttatagatcccaacccaggtcccatgtcggctattcctaattcaatccaatctcagcaactcctcattgagactgtaaaattcagaactgtcttgaaaacctgtactcgtgttagtgcacaattttgtttaactgctcctaacgttgatacatcggttttaccggcatgtctcgggccatctctcaatcaatgtgtttatcctgcagctgatgcatttacacctggcccgccgctcgaactcccacctattattatttataattag

SEQ ID NO: 2731 - DNA, 6510 bp, Glycine max var. Williams 82
atggcttctccctcggaatcctccctcatctccaagcttcagtcctccgattcccccggcatccacgcccttgtctctgattacctccgtcccctgtcagatcttaagccaaccaaaaaatccaaccccgaccaaaccctaattcgctcactcgccaagcgttttctctctttcctcaacgcctccttatccatcctcccaaaacggctccccgaggtctccaagtctaacaatgccgtctccctcctcgagttgctccgcgtttacaggctctgcctcgattgcttggacgccgtcgcttctcagttggcttccaagcccttctccgtcgagttccagcgacttcgcctgattcactgcctcgagtcatgtggcctgtttgacgaagcccaacttgagggtttaggggttttggagaagcttccacccgccaagaggaagggtaagcttctccctgaaatagacaagggcagtggagaggtgtgcccaaagatgatctcaattatgcataggaggatgatcccttacatgaagaagctactgcctgtctctagctttgttttgagattggattccaattcatatgagaagttgcacaagatgttagtaactcatttgggcaagtgcactttaaatttattggggaggacgccatttccggatagagacttggtgaccttgttttggtgtacaacgttgactgaatatgtgaaatctcccatcaaagatcaagtctacaagattgccctcagggtatgctcatcattgtttgcactgagggataataactccttgtatatcatggatatactggactccatagttcgcgagtgcaaggttgaggagggaaacacaggaactgactttgttgaacttgtatattactgtgcaaataaatgtcaaactgcaaatgcaagtttttgtagtacatttgcagcatatttgaacaaaatagcagaacatttcaaacaggttatgacacccataaattcaatactgaggctttatgctgctggattgctccttgttagttgtaatttgaggtccagaactggagatctagcatcctctggcagtgcaaaatttgagtgtttgcttggaactttactagaaaacgagaaaatactacagaattcaccaccattgcttggttccttgcatatttgcagcaaaagtaattgtatgtcgtccagcgtagaagaccaatgttttgctggtcacccatgtgcattatcaggtttcgatggcgaggcttctatgacttacctgtcaggttacttagaggcattgaaatatctatgccaaccacttgctaaatcaattaattcagaaaggaaagagttagttaccaaagtggacgatgcttctgctatgactatgatgtccactgtccaagatgcattccatatcctttgtcatcttattctttctagtacaagctctatgcctaaaaacaatggagatggatttgatgaaaagagtaaaacagtgcttaatttagttgtagcagccttcaccctttccatcagaaccaatcttaaagtccaggagagcaaacaattaattaatcagatcattgctagcaaatggattgaagcagaaggattaaaatacataattgcttgtctctacaatattgctgtagttttatacagaaacaggctactgaaaaaggcttcaaaggtgctaaacttgtgttgtaaagcttcatggctctgtattaaatatcattctgctaatctgtcagaaggtgctttgaaagagtttgtaatggaggcttgcaccagaagtgctctccttttagatattatccatgatgtcaacaatctaaagataaacaaaaaaatgattgacatcctgaaaaactggttcactgctaatgatttgtttgaggggcttccagcacctatacctgtagtaaagcagtgggtaaagatagaatgtaaacgtgctacgcaggtggatgagagaattgattctcttaccttgtatagcctgctgtcatcttctttggaattgtcaaagaggaacattgccatgatcttggagcaggagcttactgcatatgaggaaatgggttttaaatacccagaattttgccagaaaatgcaaatgaaaataacagacattctcctgcaagatatatatatcactctagatagtcgttttcagaaggcacaaactctagtgagaaagggaaaagcaattagggttaggggcataggtggtctcagggactgcattcagtgtctgtcagaagcaataactattatgaatgaaatttttggtgagatatgtactgataataatcccattcatcatcaattgtgtgtgacatattgcttgcgtgcaatatgtacacaggaagcagaagctaattcgaagcagcaaatctttgaagatgtcaaggctgctttggatctatggttgagcatttctcatcttaatcgctttgaagagggagattcttctgcattatctgacaatataatgattctactctataatgtagttgatttattacaattgaagggtttcatggaactgttcaatgatgcatatcaattgttgattaaaatgtttaaacggaagaatgtcccaattgagaagtggttgcccctaatgtgggaaagtagaagtctaagtcacgccctttgtgtttcacctgttaacgaggaattcatcatgaattcactggatgagtttagtgaactttcaaatattgatttctggatacgttatcttcagggaaatcaatcatcattgatagggtttcagcagaatttttctttcttgtttgctagctctcataggaattcttgcagtcatgggagctcttttcaaacggacatcacaattgatgaagttcaaaaagcagcacttgatctgatttcaaatgttcctgtcccaagtcattctacatttcttgctgggtgtcttttttatgatttgtgcccaagacttgttgcaaatggacagttaatagaggctctttcatctgcaaaagaagctcatagattacatgccaaactcttccaaaggaagtttacacataatgttcagcagcagaatgaagagaaaaatgtaatggttgattcctcaaagaatcttatggatggtgttgaaaatattggactgaacttatcagttgccagggaagttttgctatttgattctatatcatgggacttgaaagacagttatcttagtgcatggaaagttatgcaatgctatcttgagagcactcttcagctaggaatcatccatgaaatgattggagatggagctgaggctgaaacctatctcaagtggggcaaagccatatcctgttcactaaagctccccttctttataattattttttcttcctctttaggaaaactttatcttaagaaaagactttgggatttagcagaaaaagaactactgagtgctgaacagattttaaaggaaagcaacacacccttttgttgctcaaagtgtaaattgaagctcgaagttactctgtatgagtatcttggagatttgtgtcagagtaaatttgacacttgtgatggggttatgtctgaagaaactgcaaaaaattggtatacatcagctctggataaactaaatctttctgagtggaaaaatcctcttagctgtccagaagatggcagtgatggaactgcaacagacataaaatgtcctgctggtaagacttgtacttgctttataatgaatgaagtaggtgaaagtgtaaagaaatccatgaaagcggggcgagaaactgagattggggcaaaacaaaatagaaagaccaaaaatgcagcaaaggttttaccaaaggaaccaaacttagtggttgagaataaatcaaggttaactcgttctagatatcgatcttcacagaaccaatacacaagcattcacgggaagttagaagtccatgaaagtctggaggggaatcatgtttctgattcatctgatatgcttagtcagaatgggtcagttttgagcaacataggttgcacttttgcttcaaggtgtgcaataacctgtgttttctcgaaaatgaagtgttggtactgtcttccatctgaagttgtaaaatctggattactaaatgattttattaatcttaaatgggagtttgtccggaggcaacattcgatgaagctactcagtcgagtagtgaaatgctttgcatatcctggtcaaattgatgaagcacgtaaaattcttctaagaagtatatcagttctggtcagcagaaacccattctaccccatgccttcatctattcctctagattattttcttcatttggttgcgagggagatcccgggagatgtatttactattgaacgtgcagaaatagttcatgacatatgctggtattctttgaagaactatcattccaagtttgcgaggaacattttctgtaatctgtccttcatcaagtttgaagacctggcttcttggctgatggtagcttttgtactctctcgtgaggttcctgtaatttttcaaaaggtgtcgaaattacttgctgtgatgtgtgtagtttcttccttgagcgagcaattttctctgtcatcttttagcaaagctttgggcgaaaattattggtcttcatatttccaccaagcttcaattggaactcatcttacttatcaatttctttcacatctaactgggagatgcaagggttcatatgttactggatcttctagcatcaaagagtgcacatctgacttactcaggcttgtgcctgataccactgtagatcttgcagagtatgtgaagaagtttttggctggtcttccatcaacgactataatcagtataagtttgcttggacgtgattatactagtttactacaggaattgttgtcttatcctacatgtgttcaagcatggatgctggtgtcaagactgagctttaagaacgaacctgttgtaatgttactgccacttgattctattttacaagcttcatgtgagggtgatctgagtactggttcgggaacttctcccaagtgtgaggagcatagtgaaaaatggcattgcccatggggttttacagttgttgatgatgtggctccaacattcaaaacaattttagaagaaaactacttgtcaacaaaatctcctcttgaagatacaacacaaaataggatgttatggtggaagcggagaaagaaccttgatcactgtcttgataaattactgaggaaccttgaagagtcgtggtttggttcatggaaatgcttgcttcttggagaatggttgaactgcaaaaattttgacttggtgcttaagaatcttgtgaatgatttaagatctaaatgcaaattggatgtaaatgagggtcttcttaaaattattctcggaggctccaaatatgtttgtgatgggaaaacattggtttcacaactatgctcaaagaaagactgctacattgctaaagtaggctattgtgatgaagcgaggagggggatattaaattccgccaatggaattggagtatcatctgaggttgcttttgaactgttaagtgaggcattaaatgtgctggaagtggatgactctgtgaatagagaacctataattcttgtgttggattatgaggtgcagatgcttccttgggaaaacttgcccattctaaggaaccaggaggtttatcgcatgccttccgtgagctgcatttctgctgttcttcataaaggcagcaaccataaggagcaagtgggaaggaatttagggccttttcctttgatagatccactggatgctttttatttattaaatccagatggagatcttggtggcactcagattgaatttgagaattattttagagatcaaaacctggagggaaaggctggtttgagacccaccatcaaagaattggcttcagcattggaaagtcacgaccttttcatatattttggacatggaagtggaggacagtacattcccaggcatgagattcagaaactagacaaatgtgctgctacgcttctaatgggttgcagtagtggttcattgaccttacctggtcaatatgcgccacaaggtattcccctgtcatatctgctggctggttctccagccattgtcggcaatctgtgggaagtgacagacaaggatatagatcgatttggcaaggcaatgcttgatgcatggttgaaagaaagatcagatatgccaacagaatgcttgcaatgcaatttattgtctgaagaatttgaggccatgaacttgaagggctgcaagggtagagcaaagaggaaggctccacgaaagaaattactagagttggctgagagtgagtcacctaagaactgtggtcacagacgcaaaattggagctttcatgggtcaggcacgggaggtttgcactcttcctttcttgacaggtgcatcaccagtatgttatggtgttcctactggaatttggaggaaaggaatgtgtagcctaaccaacccaacccaagagtcgcttccacaaccactgttggtatag

SEQ ID NO: 2732 - DNA, 1455 bp, Glycine max var. Williams 82
atgtcaaagatgatgggtttactaggaggaaccaagaagccacatgctgttctgatcccatttccatcacaaggtcacataaacccatttctcaaactagcaaagctcctccacagcaacggcttccacataacctttgtcaacactgacttcaatcaccaacgcctcgtcaagtctagaggccctaatgccctcattggcttcccaaatttccaatttgagaccattcctgatggtctccctccctccaacatggattcaactcaaagcatcccagctctttgtgactctaccagaaagcattgtttgatcccattctgcaaccttatctcaaaacttaatcactctcatgcccctccagttacttgcattttctcagatggtgtcatgtccttcacaatcaaagcttctcagcagtttgggctacccaacatactcttttggactcacagtgcttgtgccttcatgagcttcaaggaatgcaagaatctcatggagagaggcctaataccacttaaagatgcaaactatttgacaaatgggcatttagactctgccatagactggattcctggcttgaagaacatcactctaagggaccttcctggcatctatcgtaccacagatccaaatgatatacttttggactttttggtggaacaaattgaagcaacttcaaaagcttcggctattattctgcccacatttgatgccttggagcatgatgtgctgaatgcactctccacaatgtttcctaaactttacaccataggcccactggagttgctccttgttcaaacttcagagagtacatttgactctattaagtgtaatttgtggaaggaagagtccgagtgtctcaaatggttggattcacaggaacccaattcggttctctatgtgaattttggcagtgttatagtcatgagacaccaacaactagttgaattggcctggggcctagcaaatagcaagaaaaagttcatgtgggtgattaggcctgatttagttgagggtgaggcctcaattttgccaccagaaattgtagaagaaaccaaagacagaggcctattggtgggttggtgtcctcaagagcaagttttgaagcacccagcagtggctgggtttttgactcactgtggttggaattccacgcttgaaagcataaccaacggggtgcctctgatctgttgtccctttttcaatgaccaaactctcaattgcaggtatatctctcgtgaatgggcttttggcatggagatggatagtgataatgttacaagggctgaagtggaaaagcttgtgaaggagttattagagggtgagaagggtaaagagatgaagaaaaaagcaattgagtggaagaaattggcacaagaagctacccacactaatggttcttcctttttgaatttggaaaaactggtgaatgaattgttgtttgtcaagagttag

SEQ ID NO: 2733 - DNA, 1440 bp, Glycine max var. Williams 82
atgcattttttaagaaaagaaccaatggatcactcagtttcagtttcatccaataagcctcttcatgttgtaatgttcccatggctagccatgggtcacgtatacccctgcttcgaggtttccaagatccttgcacaaaagggtcactatgtcactcttgtttccacccctaagataatagatcgcttgcccaaactccctcaaaccttatcaccatttgttaaactaaccaaattactcttatcgccccacatcgacaagaaccatctcccacaagatgctgactccacaatggacattccctccaacaaactctattacctcaaattggcctatgatgctctccaagaacctgtctttgaggttctcaaaacttcaaatcctgattgggttttctatgattttgcagcaagctggattccacagctagccaagaccctcaaaattcacagtgcctatttcagtccctgccctgcatggaccatatgcttctttgacacaccaaaacaacaacttggtgatgctgctgctgccaatagatcaaaccctgaagactactatggccctcccaagtgggttcctttccctacaaagattggtctaagaccctatgaggtgaggaagctcttagaagatatcaaggtcaacgagacaggtgcctcacctgtttttgatctcaacacagcaaattcaggttgtgacatgtttgtcatcagaagctccagagaccttgaacaagagtggttggattatcttgctgagttttaccacaagcctgtggttcctgtggggttgcttccaccgttaagaggctctgatgaggaggacaatagccccgattggcttcagatcaaggcatggctagatacacagaaagggtcatcagtggtgtacattgcatttgggagtgaggtgaaactgagccaagagaacctcaatgagttggctcttggaattgagctttcagggttgtctttcttctgggtcttgaggaagggctcggttgagtttttgcgagaagggtttgaggatcggaccaaagatcgaggtgttgtttggaaaacttgggcaccccagcctaagatattggctcatgcatcggttggtgggtgcttgactcattgtggttctggttcaatgatcgaaaatctcatctttggacacgttcttgtgatgttgcccttcttgctagaccaagctttatattcaagagtgatggaagagaagaaagtgggaattgagattccaaggaatgagcaagatgggtcgttcacaagaagctcagtggccaaggcattgagattggcaatggtggaagaggagggaagtgcttataggaacaatgctaaagagttgggcaagaaatttagcaacaaggagctcgatgaccaatacattgaagatttcattgcttcccttcacaatcacaagcatacatag

SEQ ID NO: 2734 - DNA, 2730 bp, Glycine max var. Williams 82
gtcggtttttgcgtgataccttttgcccaaattaaaaaatagtaataattttttaaagaagaaaatctgcgggcaagttcaagttggaggatagtaaagaagggtctggaaaggaatccccacgcgtgaggtgaacaaacaacgaaaccaaaccaacgcttcccactccaatttctctgaattttctttcgcttcttattcccaaactctgtgattttgcacgaaatttcatcttcagcataatcttattagcaggctgttgtgcaatctgatctcaaaagagctagagatgaagatgtcgcttggtagtttgttaataagactcctgaaacactacccttgaaaagctagttgtggattggtggtggggtagctgatgctacagttaatttgaagtgtacagtactcgttaatgcttgaagattagataacgtgtgggatggatttggtgaaaatgatgatcatagagtgccccatgctagtgacaaacataataatcagtttgtaatacaaggagatagctgtaagaaaacacgtcttgaattacatggtatcagaaatagtgattatgtgaatagctacggtactcagggtaaagaggaattgtacttagaaaatatgattcaaaaagaaagaatgctggaaaaggattcatggtctcacacacctgaaggtgtgttttcttcatgtggtagtgactcaagcaaagaagccaaaaggctaacatcagatgacacgggcatgcccgatcattgcttcaagagcagtaatttagattctggtggttgtgagctctgtgaagatgatattatcttgggagacaagtgtgtggtggaaaatgatagtgtctgtcaatatccaaccagtcacatatcccaagttgacaatgaactcagttttcttgataatgatgggtggctggatataggagactttgaagatgttgacaggatgttaagttgtgatttaacatttggagcgggaagtctcaataacgaagaggagttttgctggctctcatcttctcatggtgctgaaggttctgatgatgcattgaagtctgacttcaagttttcatatgcagaaatgagtccattgaaaaatatatcagattataatatggattccaaggaaagtattgtaggtcttccgatcaatgatcccaaccaaagatcatctgctcttgatgaaaaaatcaggtctcaaatggatgttattgacaatggtgtccctgctccattatcaatgttcagtgagagtgattcagacatgaaatctgttaatatagatgacttgctgcccaaagaaaagctgcagaggaagttgccaaagccatcagcgggaaggcgaaaaaatggttacctacaaaatggtggttctgtgcatccttatgctgatccagagcaatgtgcagatacaaagcaatcctttggagcctcttccagtggggttacttctcttgatagcatccagaaacataagttgaacatagattctgattctttaggctgtatacagacacaaattcctatgacacgccctgactatagtcatgctccaaatcacacttccctctttccgactttgtctggatcaagatctgagcatgatggacatctgtctccttctcttaaagaatcatcttatgcatcaaacatggagagttcccatggtcattctttggaggctgcggccttgaaaacaaaagagaatagagaaaagttgtataattgctgtgatggacccctaaatagtagtttcaaaaatgaaaatacaccaaatcaaatgccattttgcagtccgggttcagctcagcaagtaggtcatcattttgaaaatgaaaatgaaggtcatagtgaattccgaggagttggcctaggcttttcaccagaaatagattcatcaacagtgcaggaaagctcatccatgggctctgctctggaccaagcttcacttgaagcaactagcttttgccacctgcaacagatcatggatcagttggatattaaaaccaaaatgtgcataagggacagtctataccgcttggctaagagtgctgagcatagacacaataattcaaatgcaaatggttgcattggagacgatgaaacatgcaaagcaatgatggcgcaggatgcaaacaggtgtgccggattaatggatatggaaactgacacaaaccccattgatcggtctgtagcacacttactgtttcacaggccctcagatccatcagtgttgcttcctaacgaaactttacctttcaaatccagtgccacgatgcatcatggatcagtgatcaatccaccagtgaagactgagaaacaggtctgtcaggaagattctactggagtggaaaaaaaggttttacggggtaacacctaatgaaagtgaaaccagcgttggcgcatttcgttgtacaatttatacttttccggtcattgtcgtatatgatgatgtataattatttcgggctaactcggatccctttgttaatttctgaagcatttttgcataggatgccataatactaatgtaactttgtgctaatcaaatcatcaaaaggtagcatacgatgatttagtgtaatgctacgctcgcaactattttcacccgaaagatcacaattatcctgcgcagcccatgatcactcatcaaattaatttgaaactagcgtcacttgattgtaccatttattttctggaatgaatcttttctcatgacattttt

SEQ ID NO: 2735 - DNA, 1635 bp, Glycine max var. Williams 82
atggcttctttcaatctctcttattcttcctcaccagccctctcatgtcctcgggcgagcaaacaattcaaattattcaatgatgtgccttttgtccgaatgaattctaaatttccctcaagtgacaatgctattgggagaattaaagctaagttgatctctggagggggtgatctactttcctatccaaatggcaatggcattgtgataggtaaaaatctggttggtgatgaatctgttcgaattgaggtacagccgaatagaacactggcagcagacacagggctaacaagcaatgttttctctattgacaacgatgaatttgatttggacagccccacagcaggttttgcttccatttctgaggcaattgaagacattcgccagggaaagatggtagtggttgtggacgatgaagatcgagaaaatgaaggagacttgataatggcagcacagttggcaacacccgaggcaatggcttttattgtaaaacatggaactggtatagtttgtgtaagcatgaaagaggaagatctggatagattggaacttcctttgatggtgaatagtaaggctaatgatgagaaacttcgtacagcatttactgtgacagtggatgctaaacatggtacaaccactggggtgtcagctcacgatagggcaacaacagtcttggcccttgcgtctagagattctactccaggcgatttcaaccggccaggccatattttcccactaaaatacagggaaggtggtgtcttgaagagagctggacatacagaagcttctgctgatcttgctgtacttgctggcttggatccagtggcagttctgtgtgagattgtagatgatgatggttccatggctagactgccaaagcttcgccagtttgcagagcgtgaaaatttaaaaattgtatctattgctgacttaataagatatagaagaaaaagagataagttagtggatcgctcttctgctgcacggatacctacaacgtggggaccattcacagcttactgttacagatcacttttagatgggattgagcatattgccatggttaagggtgacattggagacggacaagatgttcttgtgagagtacactcagagtgtctgacaggagacatatttggatctgccagatgtgactgtggaaatcagcttgcacttgcgatgcaacagattgaggctgctggtaggggtgtgctggtatatctccgtggacacgaaggaaggggcattggattgggtcacaagcttcgtgcttataacctacaggacgatggacgagatactgttgaagccaatgaggagttgggattgccagttgactccagggagtatggcattggcgcacagatgttgagagacttgggtgtacgatctatgaagctgatgacaaacaatccagcaaaatatattgggctcaaaggttatggtttgacagtttcgggtaggatcccattgttaactcttatcacttcggagaacaagagatatttagagaccaaacgtgtgaaaatgggtcacatatacgccatggaatttaacggccaattgagcactcatgacagtggtaatgataatgccaccagggttgatgactctaatacagttactggtttataa

SEQ ID NO: 2736 - DNA, 270 bp, Glycine max var. Williams 82
atgggttctagcagattatcattcattttagtacttgtgcttgtaaccttttcatccatgatcattgactcaagggttgcagaggcacgtaccctgccaaaatcagccttattgccttccaaagttgatatacctactgttgttcctcttccactggtggcaccactgccaaatttgcctgttactctccctccagtgcctgaactacctgcagtacctaaagtaccaattcctgaagtaatagttaataacgccaaaataatcccttga

SEQ ID NO: 2737 - DNA, 1096 bp, Glycine max var. Williams 82
ggccactacctcaagcataacttgcatagactattgattaagaaagctattgtcattgatttgctagctccaacaatgggttctagcagattatcattcattttagtacttgtgcttgtaaccttttcatccatgatcattgactcaagggttgcagaggcacgtaccctgccaaaatcagccttattgccttccaaagttgatatacctactgttgttcctcttccactggtggcaccactgccaaatttgcctgttactctccctccagtgcctgaactacctgcagtacctaaagtaccaattcctgaagtaatagttaataacgccaaaataatcccttgagtacctatgatctatccagtcactactacttattttgtcacttgctaaattaacttgttgttgccatcccagggtggttctggttctgttggggtttaatttctgtcattcaattacatgctatgttcagtttatatgttgcttcagtcagttgaacttcagcatattatttattgtgacctgtgtaatgtaatgtatcaacttatcttctagttcaataaattctggaatttctgaatactgtcatcatggaggaagaagaagtttatttctatatgacctaattaagctatggcatattttctatttagctccatgtcttttctctttagccggattcattcatcatctacagagcatgctggaattatcaaatatctatcgtcatcatggcttgtagctgtcattattctttccaaattccaactaaaaattaaatgtccatatcgatccttcaaagatatacacatcaaattggtccttaactaataccatcagttttgtctttcaaggactaaacttgatattacttgaagacgatttttttacccccaaaaataggacgaatttgatgtcatttatacttttagaggaataattttgtgtattattagtaaataaaagactcagagatggtgttacaagtatctttagaggatccaaagaagtcgaggagatctagcttaattgattgaacaaagatatgtgaattgttgtaaatctgttgacaccattttcaattcctacaaat

SEQ ID NO: 2738 - DNA, 495 bp, Glycine max var. Williams 82
atggggttgtgcaaggtttcatttcctgtattatgtgtgttggggttggtcatgattgtgagtcacgttgccaatgctcaagactcaccagcagattacgtcaatgcacacaacgctgcaagatcagaggtgggtgttcaaaacttggcttgggatgacacggttgctgcttttgcacagaactatgctaatcaacgtaaaggtgattgtcaactgatccactctggtggtggtggccaatacggggagaatcttgctatgagcactggtgacctaagtggcacagatgcagtgaaattgtgggttgatgagaagtctaactatgactacaattctaattcctgtgttggtggagagtgtctgcattacactcaggttgtttggagagactctgtgcgtcttggatgtgccaaagtagcatgtgataatggaggcactttcatcacttgcaactatgctcctcctggcaactatgttggccaaagaccctactag

SEQ ID NO: 2739 - DNA, 495 bp, Glycine max var. Williams 82
atggggttgtacaagatttcattatgtctattgtgtgtgttggggttagtcattgtgggtgatcatgttgcgtatgctcaagactcaccaacagactatgttaatgcacacaacgctgcaagatcacaggttggtgttccaaatatagtttgggataacgcagtcgctgcttttgcacagaactatgctaaccaacgcaaaggtgactgcaaactcgtccactctggtggtgatggaaaatacggggagaatcttgcaggaagcaccggtaacctaagtgggaaagatgcagtgcaattgtgggtgaatgagaaatccaagtataactacaactccaactcgtgtgttggtggggagtgcctgcactacactcaggtcgtttggagaaactctttgcgccttggatgtgccaaagtaaggtgtaacaatggaggcacattcataggttgcaactatgctccccctggcaactatattggccaaagaccatactaa

SEQ ID NO: 2740 - DNA, 276 bp, Glycine max var. Williams 82
atgatatataatacaaaggaaaaaagaaaaggtttgaggccatctgattctaaagcatgtagagagaaaatgcgaagggatcgacttaatgacaggtttatggaactggggtctatcttggaccctagaaagcctctcaaaatggacaaggctgttatattaagtgatgcagttcgagttgtttctcagttacgagaggaagctcaaaagctgagggagtccactgagaatctacaagagaaaatcaatgcattgaaggtgtgtaagcttatgtaa

SEQ ID NO: 2741 - DNA, 639 bp, Glycine max var. Williams 82
atgagtaatagtaattgggtgttggattatgattatctagacaacattcctctcaccacccttgaaccacccaatttctcttggtcttcctcctctcctcctcctacactcagtgtggagctagatgactcatttggaattttggatggtctcaaggaaaacaggtcaagaaaacgtttgaggccatctgattctaaagcatgtagagagaaaatgcgaagggatcgacttaatgacaggtttatggaactggggtctatcttggaccctagaaagcctctcaaaatggacaaggctgttatattaagtgatgcagttcgagttgtttctcagttacgagaggaagctcaaaagctgagggagtccactgagaatctacaagagaaaatcaatgcattgaaggatgagaaaaatgagcttcgcgatgagaagcagcgactaaaagtagagaaagaaaaccttgagcagaaggttaaagctttgagttcacaacctagctttctggctgcagcaggacaagttgttggcagcaagctggtgccattcatgggctacccaggagttgccatgtggcagtttttatcacctgctgctgttgatacctcacaggaccatgttctcaggcccccagtagcataa

SEQ ID NO: 2742 - DNA, 1026 bp, Glycine max var. Williams 82
tattgatgtcgcactgtgagtctttcgtatcaaacacaccaaactctcactttgatccatatatttttctctccatatcatcatattcatatctttgtccctaactccagcatacccttttggccggagatgagtaatagtaattgggtgttggattatgattatctagacaacattcctctcaccacccttgaaccacccaatttctcttggtcttcctcctctcctcctcctacactcagtgtggagctagatgactcatttggaattttggatggtctcaaggaaaacaggtcaagaaaacgtttgaggccatctgattctaaagcatgtagagagaaaatgcgaagggatcgacttaatgacaggtttatggaactggggtctatcttggaccctagaaagcctctcaaaatggacaaggctgttatattaagtgatgcagttcgagttgtttctcagttacgagaggaagctcaaaagctgagggagtccactgagaatctacaagagaaaatcaatgcattgaaggatgagaaaaatgagcttcgcgatgagaagcagcgactaaaagtagagaaagaaaaccttgagcagaaggttaaagctttgagttcacaacctagctttctggctgcagcaggacaagttgttggcagcaagctggtgccattcatgggctacccaggagttgccatgtggcagtttttatcacctgctgctgttgatacctcacaggaccatgttctcaggcccccagtagcataacttgccaaaggctctgtgttttggtccaatggagaaagagaatttatctttttattttttgcttttgtgaaatgtgaaaaaagaaatcttattgttgaggcagctttttgataactatttaacttccggttataggctaagtttgaataaacttctttataggttctaatataaaagttctatcatctaaattgtctataagtagaagtgcatgagttagattttaacttgtgaaataaatttaatttattctacttt

SEQ ID NO: 2743 - DNA, 2535 bp, Glycine max var. Williams 82
atgccaggtttcttattcttcctcttttgcttcttctttgcatcatcacaacacatcgcaatttcattctccacagacaccttaagctcaacacaaattcttctaaccaaccaaaccctcgtatcaccaagccacatcttcgctctgggcttctttccggggaccaattccacatggtacttaggcgcatggtacaacaacatcaccgacgacaaaaccgtagtatgggtggccaatagagacaaccctctcgagaattccagtggttttctaaccatcggagaaaacggaaacatcgtcctcagaaatccatcaaagaagaaccccgtttggtcctccgacgcaaccaaagccaacaaccccgtgcttcagcttttggacacaggaaacctaattctcagagaagcaaacataaccgacccgacaaagtatctctggcaaagcttcgattacccaacagacacactcttacccggcatgaaaatggggtggaacctagacactggcgcggagaaacacttaacatcgtggaaaaacacagggagcgacccttcaagcggagattactctttcaagatagacacacgtggaataccagaaattttcttaagtgatgatcaaaacattgcatacagaagtggcccttggaatggtgagagattcagtggggtgccagagatgcaacccgacacagattctataacgtttgatttttcttatgataaacatggtgtgtactattcgttctccattgggaaccgttcgattttgtcgaggctggttgtgacttcgggtggtgaacttaagcgtcttacttgggtgccaagtagcaaaacttggaccacgttttggtacgcgcctaaggatcagtgtgacggctacagagcgtgtggtccatatgggttgtgtgactccaacgcttcgccggtttgcacgtgcgtgggagggttcaggccgaggaaccagcaggcgtggaatttgagagatgggtctgatgggtgtgagaggaacacggatttggattgtgggagtgacaagtttttgcatgtcaagaacgtgaagctgccggagacaacctatgtgtttgcgaacgggagcatgaacctaagggagtgtcaggatttgtgcctcagggattgttcttgcactgcttatgccaacattcagatcacaaacggaggaagcggatgcgtgacgtggagtggtgaactcgaagatatgaggctgtatcctgcgggtggacaacatctctatgttagattagcagcttctgacgtagatgacatagtaggtggctctcacaagaaaaaccatacaggtgaggttgtaggaattacaatttctgcagctgtaataattttgggattggttgtcattttctggaagaagaggaaactgttcagtatatcaaatgttaagacagcccctagaggttctttccgaagaagtcgggatttgctaacgagtgagaggatgttttcaactaatagagaaaactcaggagaaaggaacatggatgacatagagttgccaatgtttgattttaataccataacaatggccacagacaacttctctgaagcaaataaacttggacaaggaggctttggtattgtttacaggggcaggttgatggaaggccaagatattgctgtcaagaggttatcaaaaaactccgtgcaaggagttgaagaatttaagaatgaggtcaagttaattgtcaggcttcaacatcgaaatcttgttcggctctttggttgctgcattgagatggatgagaagttgctagtgtatgagtacatggaaaatagaagccttgattctattttgtttgacaaagccaaaaaacccatattggattggaaaagacgcttcaacattatatgtggcatagctagagggctactttatctgcaccatgattccagatttaggattatccatagggatctcaaggcaagcaacattctacttgatagtgaaatgaacccaaagatatcagactttgggatggctagactttttggcacgaatcagacagaagcaaacacattgagagttgttggaacatatggctatatgtcccctgaatatgctatggatgggaacttctcagtgaaatctgatgtttttagctttggagttctagtgctggaaattataactgggaaaaaaaatagaggattctattactcaaatgaagatatgaatcttctagggaatgcatggaggcagtggagagatggcagtacattggaactcattgattcatccattggcgattcatgttcacaatctgaagttcttagatgcatacacgttggactcttgtgtgtccaagaacgtgcagaagataggccaacaatgtcttcagtgttattgatgctgagtagtgaatccgcaataatgccacaacccagaaaccctgggttttccatagggaagaatcctgtggagaccgattcttcttcaagcaagaaagatcaatcatggagtgtgaaccaagtcacagtcacattactagatgctaggtag

SEQ ID NO: 2744 - DNA, 1820 bp, Glycine max var. Williams 82
tcaaatgtaacattggtagggatcactgtttattaaaaatcttgtagcgaactttctgttcttttcgtacaaagttctaattgggttcaagaggcacatctggttttttcattcgtgtatgttgtttctcttttcttcatttttttttcttccaattccaaacggttgttaatgtatcatctccttgagaatgttttactgaacatcgaccagtctattgttatgataaattgcttctaacagcgtactagtcatgactatttctaatgaaaataaagcaccgagaaggttggaggggaaatttcaagcaacggtggtgtgtttcattcttggattggggtcccttgttgcatggaacagtatgttgacagtaggagattattactacaatctgttccctacataccatccttcccgtgtactcactctcatttatcaaccatttgcacttgtaactatggcaatactggcgtataatgagtcaaggatcaacactaggaagcggaacttaattggctacactcttttctccattagtactttgctagttcttgttttagatctagcaacatcagggaaagggggaattggaccttacattggtttgtgtgcactttctgcttgttttggagtcgcagatgctcatgtccaaggtggcatggttggagatttgtcttttatgtgtcctgagttcatccagtccttctttgctggtttggctgcctcaggagctctagcttctggtttgagacttctcaccaaagtgggttttgagaaatctgatcatggtcttcgaaaaggggctatgctattctttgcaatctctacactttttgaattcttctgcgtaattctctacgcaatatacttccctaagttgtccatagtaaagtattaccgttcaaaggcagcttcagaaggatcaaaaactgtgtcagctgatcttgcagctgccggcattcacaatgacaccaacctgcaagttggatttgatgctaaacagcaagaacggttgagcaataaacagctaattcttcagaacatggattatgcagctgatttgtttctgatatatgtattgacactgtcaattttccctggattcctgtttgaaaatactggatctcaccagctaggaacatggtacccacttgttttgattgcaatgtacaacctattggatctaatatccagatatattcccctcatcaaatgcctgaagttggaatccagaaagggcttactcattgcagtgctttctagattccttttggtcccagcattttacttcacagcaaaatatggtgaccagggatggatgatccttcttgtgtctttcttgggactaaccaatggttatctcactgtttgtgtatttaccgtggcaccccaaggttacaagggccctgaacagaatgcattgggtaatttgctcgtgctgtttcttttaatcggcatattttctggggttgctcttgattggttgtggctcataggaaaatcaggattctaaaatgaaacagtatatgtaaagactaaaaattcaggcagcttctctttgcttaagcatgtgtataaaataaatagccagtgagagattcatatctttgacccatgttatagataggggagaaaagcattgaatatagcagtatgttctcttttattatttactcttataatatagatcatttagaatctctacttcaaaaaacaaatagattaatatagaatctctaattttgaaagtgaaactttcactttttccttcattttatttgaattagaaattctcagtactccatttcttttcttgaata

SEQ ID NO: 2745 - DNA, 2543 bp, Glycine max var. Williams 82
aatttcttgggccttagggtttgtattggttatgaccgcctcaaagacaagacagacggaccgtgttctcacaatcgcacaacaaaactgaggctcacctccttaatcgcgtcttccattccatttcctcaccttcttcaaactaccataccataccataccatagcatgttctcttccttctcaggcagtacctgagtggaaacaagaggtaatacccgcaaagtaggaatgaattgggactccaaaaaatgaggaatttatagtgggacatattataaacctggatcaactgagttttcatcttgttgatgcctcttagaggaatggacattgtgtacactcatgtaaaatttaacgctcatctatcgtggtcatgagtgaagagaagtcactatatttgatgcttagaaatataaggagagccgcccaatctgtttgtagaatcaatagaagatacttggaggtgagtgaaaatggggcagttgccttagttggaccgaatatccaccactgccggttgtacatgcaatataagtttccaagtgaagcatgcagttcattcttgtggcatgggacaagggaaggctttcgtaaatgtggttctttcaggaacttttccgtaacctcagcaagtaatgcagtcacacatcattcccagattgcttggaaaaggctgtacagaaagtattgttccagtggtgatggtacatttcctcccaccgtaaatatgattgctcaggcagtaagcttggctttggctcgttcttattttctagttcctggtattttggcatttacatggggagagcttgcattagctcagcgaaattgggcagaagcagaacgttacccatcacaaaatggtttgtatatgcgcgcacaagatgggtataattacatgtttacatttacattcataatagttgaaggacttatcttattaatgagggctctctatctagcaatattattctctcctagcattgtgatggcaccatttgctgattgttttggaccaaactttaggaaactgtggctcaatgtagttcatcgcacactagaaaaatcaggtccagcattcataaaatggggtcagtgggcagctacacggcctgatctctttcctcgagatctgtgcactaagctttcagaacttcataccaaagctcctgagcatagtttcagctacacaaagaaaactatagaaagagcatttggtcgaaaaatttcagaaatttttgacaattttgaagaacttcctgttgcatctggaagtattgctcaagtgcaccgtgcttcattaaaatgtcgttatcctggtcagcaagcaaagccactattggttgcagttaaggttagacatcctggcgtgggagagtcaatcagacgggattttgctattattaatttggcggcaaaaatttcaaagttcattcctgctcttaattggttacgattagatgagagtgtacaacaatttgcggttttcatgatgtctcaagttgaccttgctagggaagctgcccatttgagtcgcttcatttataatttccgcagatggaaggatgtttcttttcccaagcctgtctatccacttgtgcacccggctgttctggtggaaacatatgaaaagggtgaaagtgtctcatattatgttgatgatcttcaaggacatgaacgggttaaatccgctcttgctcacattgggactcatgcacttttgaaaatgcttctggtggacaacttcattcatgcagatatgcatcctggaaatatccttgttcgagtgtctcagagcaagtctcgcaaacggctcttcaaatcaaagcctcatgtagttttccttgatgtaggcatgactgctgaactctctggtagtgatagagtaaatttactggaattttttaaagctgttgcccgccgagatggccggactgctgcagaatgtgccctcaacttgtcaaagcaacagaactgtccaaatccggaggccttcatagaggaggtggaagagtcgtttactttttggggcaccccagaaggtgatattgttcatcctgcagagtgcatggagcaattacttgagaaagttaggcgtcatagagttaatattgatggcaatgtttgtactgttatggtgacaaccttggttcttgagggttggcagagaaagcttgatcctgggtacaatgtgatgcagacactgcagacattgctacttagagctgattgggcaaagtctctttcttacacaattgacggactcatggccccttagggaggaagttcctttctttgttgaggctcttgagaaacaattttgactaacataaaacccaaacacaaacatatgtcctaagggctctcccacatctgttttttttttttttaagatttatcccttgtatttatcttggttaatttccaagttatttttgtgagcatcacagttaactacaaaaatggacacaataaagcggtgaatatattctcctctcccttctttacccgcaggatgaatgaacggtatagttagaccct

SEQ ID NO: 2746 - DNA, 1107 bp, Glycine max var. Williams 82
atgggaagagcaccttgttgtgacaagaatggtctcaagaaagggccatggacaaccgaggaggaccagaaactcattgattacattcagaaaaatggatatggcaattggaggacactcccaaagaatgctgggttgcaaagatgtggaaagagttgccgtctccgttggacaaactatctccggccagatataaagcgaggtcggttttcatttgaggaggaagagacaataattcaactacatagcattcttggaaacaagtggtctgcgattgcatctcgcttaccaggaaggacagacaatgaaataaagaactattggaacactcacattagaaaaaggcttctgagaatgggaattgaccctgtgacacacagtcctcgacttgatctattggacatcaattccattctaaacgcatctttctatggttcatcacaaatcaacatccaaagactccttggcatgcaccagtacatggtgaaccctgagcttttaaaattggcttcttcactcttctccacctcacagcagcaacacaatgaccctgatgacatgcctgctcaaaaaggtcaattacagaaccagctttgtgatcctcaaattcagaatcatgttccacactttgtccaatttcaagatccggttcaagaggtgcctgcatgcagcaccatgttcagcaccccttgtgtttcaattcctctaactcaaccacagttggttgagccaaataatgtggaccaatatccatcgtcaactttcacagacttcagttaccaacaactaagtgattggcaactatcaagcttaacagatgattatgtccctcaattatcaagctataattattatagttctgatggtcaaaatctcatgtatgatccattgtccgagccttcaaattttcattccaataacagcaatcagaacttcaggttcgcttcagttctatcgacaccttcgtcaagccctacaccgctgaattcgaactccacgataatcaatgggagcaacacagaagacgagagagatcaaagctatgacagtagtaacatgttgaaatttgaaatcccagatattttagatgtgaatgagttcatgtaa

SEQ ID NO: 2747 - DNA, 441 bp, Glycine max var. Williams 82
atgaaacctacgatcaccattttgttctctctactacttttcatagcttcaccctccttggcaacccgacccgcatccaaccctgatcaagtcatgcactccaaggacaacaaaaacaacaacaaccaaggtgatggtggtgggttctttggccccggaggaaggttcagcatacccggttttggaaacgggtttggaaatggcatcataggaggaggatacggatccgggtatggaggtccgaatggtggctcctctaaaggtggtatcatacgaccaaccgttctgtgcaaagacaaaggcccttgtttccaaaagaaggttacttgtcctgccaagtgcttctcctcattcagccgctccggcaagggctacggcgccggtggcggtggcggtggctgcaccgttgattgcaaaaagaagtgcatcgcttattgctaa

SEQ ID NO: 2748 - DNA, 1875 bp, Glycine max var. Williams 82
acagaagaaggaaaagagggagaagtgagagtgagacagagagcgaaagtgacggtgtgattagagcaagtaaagtagtactgtagtgaagagtaacgacatagatggtgttagcaggtgggactgataaaggtttggttttggttttggatgagaagaggaggaattgacacgagtgagtgagtgagaacaagacattgcacttgtcatcatcatcaagctctacatttctttatcatcagtcaacagacacgcatgcattcatttgttcagctgccaccgttctcggtatctcatgtgatcttcaaagtttgttgctttcagccttttcaagctgtccatttaagtttttgagttatcacatttcccatgcataatgtctccttttgcacaaaatatagttagtgttctggctgcctggttttacacatgaatgaagagcaagcagttttttatgaggaccgaataaaagattcaaatttctatgacgtctatcaaatcattgagatggctgatgagaaaaaagagtggattgtctgatgggggtaaatcaagtttcaagatgaaacatctgccttttctggcagttttgtgcacgataatgttattcattgtgtatagaaccacaaagtatcagtatcaccaagaagagattgacaaaaaatggagtttctggggacaaccaaaggtgtatccttcaacttatgggaagttgaaaggcttgccacgaggtataatacatgataattcagatttggagttaagaccattatggtcaagaagtagttcaagatcaaaggctgtttactctaactctaacttactggcagttccagttggtattaaacaaaagcagaatgttgatgctatggtgcaaaagtttcttcaagaaaacttcacaattattttattccattatgatggcaatgtggatggatggtggaatcttgactggagtagcaaggccatacacattattgctcggaatcaaacaaagtggtggtttgcaaaaaggtttctacatccagatatagtgtctatttatgattatatctttctctgggatgaggatctaggtgtggagcatttttcaccttcaagatatgttgaaattataaagagagaaggtttggagatatctcaaccagctcttgacccaaattcaacagagatacaccatagaattacaattagagctagaaccaagaaatttcatagaagagtctatgaacgcagaggcagtacaaggtgttcagatttaagtgagggaccgccgtgcactgggtttgtggaaggtatggctcctgttttctctcaatctgcctggtactgcacttggcatcttatacagaatgaccttgtccatggatggggagttgatatgaagctaggatattgtgcacagggagatcgaactaaaaaggtgggagttgttgacagcgaatatgtttttcacaagggaatacaaactctgggggggagtggtcacagaatgacaaaggtttcgaaactacaaaggacaactatgcagaaacaaggtggagtaggaattgatgtgcgaactgagataagaaggcaatcgacatgggaatttgaaatcttcaaagagcgttggaataaagccattggtgcagacaaaaactgggttgatccatttaagagtgaccaaagacgcataagaaaatggcgtgacacgcaacgccttgctaagaacaatatttaactctgttgcatatcttacagtttcattcacagggcattaccttttatttataggcataatttagtttgtgtagatgagtaaaaattcattcaattttgaaaaggaaaaaaatagagagtttttcttctttatattatcttgttatggttcgg

SEQ ID NO: 2749 - DNA, 759 bp, Glycine max var. Williams 82
atgggttgctgcgtcagtaccaacagatctcattcttcaccctcaagcaagcctttggagacaccaagatctgccgcgaaaggttcagaaaacagagcaccgccaccggaggaagaaacggtgaaggaagtgttgtctgaaacacccaaatggaagcccaaattcgaagcggagaagccaacagagaccgaagttgagaacgagaaggagaagcttttcatcaagcccgatgagatctctgaggtttctgaagtttgcagcgtgagtgagagcgtttccacattcgccgaagaagaagcgcgtcagagggtcaacagatccccggcgaaggtgagcaaagcacgctccttttccggcgagttcggctgccggagggaaatgacggcggggaagtctccggcgaggaggccggagcagtctccggcaagaagaaatattgggtcggtgagagttgttcaaatgggcaatgggggaaccgggagccaacctcgccggcgtgactccggcgagatttccggtcgccgatccaggtcgccggcgacccgcaccgacagcgtggcaactagatccatcctgggtcagagcccgtcgaagaggagaacgcacacgaatcaatcaccggctagggtaagaaccggcacggcggagagcggtggccggaaaatggagaattcgagcatggagggtaaatggccttcatcagctattgagtcactagaaaaccctcttgtgtcgttggaatgcttcatatttctctag

SEQ ID NO: 2750 - DNA, 1737 bp, Glycine max var. Williams 82
atggcttccctatatcctccacccttttccattgcaaccaataataatacttccaccccagctgccaccggaacccatgtttctacctcttgttccatccccttaatcagaaatcacaattccaatgccccaaaagttgcgaagtctagagtgtcatgcaaagccacaaagggtgacacccaagaagaggcctttatgtttgacagaagaaatatcctcattggcctaggaggcttttatggtaccctaagcaatgattcattgtcccttgcagcacctatctcccctccagagataaccaaatgtggcccacctgaccttccctcaggagccaaacagaccaattgttgccctccaatttcctcaaacatcatagacttcacacttccaatcaccccccaagttaaggtcagacccgctgcacatttggtagatgccacatacctccaaaattacaaagaagcccttcgtcgcatgaaagccctgcctcccaacgatccacgaagcttcacacaacaagctaacattcattgtgcttattgtgatggtgcatatcaccaagttgggttcccttctcttgattttcaagttcataactcttggctcttctttcccttccaccgctggtacctctacttctatgagaaaatcttgggaagcttgatcaaagatcttgacccaaattttgcccttcccttttggaactgggatttccccaatggcatgccaatgccagccatgtacactgatcccaagtcaccactttatgactccctcagaaacgcaaatcataaaccgccaaaactcgttgacctagactacaacggcgttgaagaccaatcctcaacacaagaacaaatatcaaccaatctcaacaccatgtaccggcaactggtgtcaagttcaaagactccaacgctcttcttcggtagcccttaccgtgcaggagaagatagtgatcccggtggtggcctgtggagaacattcctcacggacatggggactctctattctgctgctagagaccctattttctattctcaccacgctaatgtggatagaatgtggtccatatggaaaactcttggaggaaagagaagtgacatcaaagaccctgattggttggaatctgggtttcttttctacgatgagaacaagaatcttgttcgtgtgaaggttaaggattgtcttgatactagaaagcttggatatgtttaccaagatgttgatgttccgtggttagaagctaagccaacaccgcgttttcgaagagtggttgcaaggagctttggtgctggtgcagcactggctgctgagactactaataaaactactaataagtttcctttggttttggattcaagtgtgagtgctcttgtgaagaggccaaagaagggaaggagtgagaaggaaaaggaagaggaggaagaggttttggtgatagaagggattgagtttgagagggatttgggtgtgaagtttgatgtgtatattaacgatgaagatgatgtgccaggtgggccaagtaagactgagtttgcgggaagctttgtgagtgtgcctcataagcacaagcacaagcatgggaagatgaagactaacttgaggcttgggataacggagttgttggaggatttgggtgctgaagatgatgagcatgtggtggtgactttggtgcccaagtttgggaaggggcatgtcatcgttggtgggatcaagatagagtttcacaagtga

SEQ ID NO: 2751 - DNA, 1809 bp, Glycine max var. Williams 82
atggcatctatctctcctctatccttcgtgcccacagtcaataatgtctcttccaactccatcgctcccccttctccgttgcatccattttcacgattccaatccattaaaaatagaaagccaaaaccccatcatattcctagaatcacatgcagtggaaaccaaaacaatccaacaccaaaccctaattcccagggagaacctccacatattgtaggacataggaggaacgttctacttggcctaggagggctttgtggtgctgttactcttaacaacaacaacccttttgcctttgcagctccaatatctcctcctgacctaaacacgtgcggtccaccagacctacccgcaggtgtaaaacccaccaattgttgccccccatcttccaaaatcatagatttcaagttctctccctctaaccaacccttgagggtaagaccagccgcacatttggtcaacgatgagtatctagccaaatacaaaaaagcccttgacctcatgaaaaaactcccctctgatgacccgcgtaatttcacccaacaagccaacgttcattgtgcttattgtgatggtgcatatcaccaagttgggttccctgacctcgatctccaagtccacaactcctggctcttcttccctttccatcgttggtatctttatttctatgaaaggatcttggggagcttgatcaatgatccaacctttgcccttccattttggaactgggatgctcctaagggcatgcaacttccttccatttacgcagaccctaaatcacccctttatgacactctccgcaatgccaatcatcaacccccaacactcgtagacctcgacttcaatctcgaggatcctatttccaatggcaaaatttccaacaacctcaccataatgtataggcaagttgtgtctaacgggaagactcctacattgttccttggaaatccttaccgtgctggggatgagcctgacccgggttttggatcagtagagaatgttccacatggccctgttcatctttggaccggtgatatcaaccaacctaacattgagaacatgggaactttctattcagctgcaagagaccccattttttattctcatcattcaaacattgataggatgtggtccatatggaaaacacttggtgggaaaagaagggattttactgattcagattggttagaatctgcgtttctcttctacgatgagaacaagaaccttgtgcgtgtgaaggtcaaggattctcttgacactagaaaactagggtatgtttaccaagatgttgacattccatggttaaattctaagcccacgccgcgtaggtcaagggttcagaaggtagcattagcacaaaattttggtgttggtgcagcacatgctgctgagacttcaaggaatgtgaagttcccactagtgttggattcagttgtgagcacaatggttaaaaggccaaacaagtcgaggagcaagaaggagaaggaagaggaggaagaggttttggtgattgaagggattgagtttgagagaaacacacctgtgaaatttgatgtgtttatcaatgatgaagatgataagcagattcgaccagataatacagaatttgcaggaagctttgtgagtgtgcctcattcacatatgcacaaaaacaaggacatcattacttgtttgaggctgggacttacggatttgttggaagaattggaagcggaagatgatgacagtgttagggtgacgctggttccgagatatgggaaagggcgtgttaaaatcagaggcatcaaaatagagcttctttcggattga

SEQ ID NO: 2752 - DNA, 756 bp, Glycine max var. Williams 82
atgttgggaattttcaagcagaagttggttaatgcacccaaggagctgaacagtccagcttctttgaattcatgcattaagcctaagctaagtcatgaaatcctgaaggatttcatgtcctgcaattcctccaatgctttctcaatgtgctttgggaatgatgctttgctagcctattccacttcatacaagccctccattaatcataggttattctctggattggataacatatactgtgttttcctgggtggcctgcacaaccttagcatgctcaacaagcagtatggactatcaaagggaacaaatgaggccatgtttatcattgaagcatatcgtacacttcgcgacaggggtccataccctgctgatcaagtcctcaaagaacttgaaggcagttttgcatttgtgatctatgacaacaaggatggaacagtttttgttgcatctggttctaatggccatattgagctctactggggtattgcaggtgatggttctgttataatttctgaaaatctggagcttataaaagcaagttgtgctaaatcatttgcaccatttccagctgggtgtatgtttcatagtgaacacggtctcatgaactttgagcatccaacacagaagatgaaagcaatgcctcggattgacagcgagggggttatgtgcggggccaacttcaatgttgactctcagtcaaagatccaggtgatgccacgtgttggaagtgaagctaattgggcaacttggggctaa

SEQ ID NO: 2753 - DNA, 756 bp, Glycine max var. Williams 82
atgttgggaattttcaaggagaagttggttaaagcacccaaagagctgaacagtccagcttcgttgaattcatgcactaagcctaagctaagtcacgaaatccttcaggatttcatgtcctgcaattcctccaatgctttctcaatgtgctttgggaatgaagctttgctagcctattccccttcaaacaagccctccattcatcaaaggttgtttagtggtttggataacatatactgtgtcttcctgggtggcctgcacaaccttagcatgctcaacaagcagtatgggctatcaaagggaacaaatgaggccatgtttatcactgaagcatatcgaactcttcgtgacaggggtccataccccgctgatcaagtcctcaaagaacttgaaggcagttttggatttgtgatctatgacaacaaggatggaacagtttttgttgcatctggttctaatggccagattgggctctactggggtgttgcagctgatggttccatagttatttctgaaaatctggagcttataaaagcaagctgtgctaaatcatttgcaccatttccgaatgggtgtatgtttcatagtgagcatggtctcatgagcattgaacatccaacaaagaagatgaaagcaatgcctaggattgacagcgagggatttatgtgtggggctaacttcaatgttgactctcagacaaagatccaagtgatgcctcgtgttggaagtgaagctaattgggccacatggagctaa

SEQ ID NO: 2754 - DNA, 1305 bp, Glycine max var. Williams 82
atggagccaaaactgagcaacccagttgcattgaactggttgaaacactttaatgtgggggatgagaggtccacatacaaagtagagtttgagatagattcagatttggggttctcgggagctattactgtgacaaacaaatacgacaaagagatctttttggaaggcttttccattgaaggtgcatgttgtggatattgcctgcaattcttggattcaaccctgaaggttcatccagaggagagaattttcttcaccggcctttatgcaacacgcaccatcttgtatttgacccgactaggtactttgaaatctattgccatcgagctgagtcttccagaatccaaacagcaaattgccaaagcacatgtttgcttcaatgacgctggtgttcaccaacttgtccatcattggttgagaatccacgcttgcatggagccattcatcatagctgctcatcgccatctaagtgttatgcacccggttttcaaactcctaaagcctcatttgaaacacacattgcaaataaatgcattggctctcatcaacgaaggaggcatcattgagtctgatttttctgccggcaaacacagcactgaaataatctcagctgcttacaaagattggtggcgttttgacatggaagccattcttgctgatctcatcagaaggggactagcagaaccagacccaacacaaccctatggactaagactactcattgaagactacccttatgcaaatgatggacttctttacagtgagcttcaagcatggtatagtgaggtcatcaatgtgggccatgctgatcatgcaaatgtgagttggtggcccacactctccactcccaatgatcacactcatatgggttgcttcggttcagcattcagcggtgaattttgggcaataacctcttggtggaagttgttgcccaaagaggaggattcagaatacaaagattttttggaggacccagaaggatacttgttgtcttgcttgccaaatttgttggaaaccaccaagtttctagctgtagttaacatactttctcagcattcgccggatgaagagtgcatagggcagaggaaggacttgtcagattggactggtgacacagaaatcatacaggcattttatgagttttccatggatataaagataatagaaaaggagattgacaagagaaataaagacccaacacgtagaaatagatgtggtgctggaattccaccatatgagtcgctaatagcctcctctggtcctggagttacaggtagaggggtgccgaatagcataagtatatag

SEQ ID NO: 2755 - DNA, 903 bp, Glycine max var. Williams 82
atgggtggaacctctgtggccgccggcagaagagtcacgaggtttttggccagtcaccaccgtgacgtcacgtgcgttgttgccgatgttgagttcgactttcttgacgatattggagaaacgttgttagctcaaagtgctagcagtgatgaaatggatcggttcgatgaagacgaggatcacagagataccgtcgaggagaatagaaccttttgggacaaccaacaccagcttttgcagaccagtatatgcagaacgagttctttggagtcacggataaggcatgccaccaaagaagcgcttcaggaaattcaaagcgcggaaactgtgtgcggttgtggcagacagatggctgtcaccagttgtcgaaactgtttgatgagagaagtttcttggcggctccagaaagcgggttataatagtgctatttgcaaaactaaatggagaagctcacccgatattccatcaggggagcacaattttttggatgtgatagacagcacaaagaaggggaaggtaagggtgattgtggagctgaatttcagaggagagtttgagatggcgaggggaagtgaagactacaaccgacttgttaggaggcttccagaggtgtttgtggggaaggtggagaggttgagcaacctaataaagatattgtgtatgggagccaaaaggtgcatgaaggaaaagaaaatgcacatggggccatggaggaagcataggtacatgcaagctaaatggttaggtccatgtgaaaggaacacttccacagcctcactttcagtgggatattctgagaggatattgccaatggctaagccaaggccaaaggcatccatgttaactgttgatctgctagagaagcttcccaatatgcattgcaatgctgttgaggttgtgtaa

SEQ ID NO: 2756 - DNA, 1071 bp, Glycine max var. Williams 82
atggtgaaaatgatactagcactagcaatgggcatgatgatgatgatgccatggtattcacttgctgtggacattgagcgagtgagggaagtagcagctaagcataacgtgtcttgcatcctagtttttggagactcaagtgttgatgcagggaacaacaatgcccttcacaccactatgaaaagcaactttcctccctatggcaaagacttctttgacagccgcccaacaggaaggtttagcaatgggagacttgccacagacttcgttgctgaagcattggggtacagaaaagcgattccaccttttcttgacccaaatttgaagccggaagatctgcaatatggtgttagttttgcatcagcagccacgggttttgatgactataccgctgaagtttcgaatgttctgtctgtttccaaacagatagagtattttgcacattataagatccacttgaaaaatgcggtgggtgaagaaagggcagaattgattacgagaaatgcgttgtatataattagtatgggtaccaatgactttctgcagaactatttcttggaacctactcgccctaagcaattcagcttgcttgaatttgagaatttcttgctctcccgcttctctaaggacgttgaggcaatgcatagactgggtgccaggaggttgatcattgtaggggtcctacctctgggatgcattccacttatcaagacgattaggaacgtggaagactgtgataaaagtttaaacagcgttgcttactcattcaatgctaaattattacagcaattagacaacttaaagacaaagctgggcttaaagactgctttggttgatgtttatggtatgatccaacgcgcggtcaccaaccctaaaaaatacggttttgtcgatggttcaaaaggatgtgttgggacggggacagtagaatatggagattcatgcaaagggatggatacttgttcagatccagacaaatatgtattctgggatgctgttcatccaacgcaaaagatgtacaagataatagctgatgaggccactgaatcttttattaataacttcttttaa

SEQ ID NO: 2757 - DNA, 1311 bp, Glycine max var. Williams 82
atgtcaaccccttcatcatcatcatcatcatcttcttctatttgggtgttgtctaacataaagcttcagttctttgcccgcatcagaaggtttctccaatccaaagcaaccagaaagcgttgtgacccctctgatcggtttgacacagctaagagcagagttgaacacaacaacaaggttgaaaatcttgaaacagttcacgttatggagaagcataaggaggaggaagagtctgtgatcatgttgcagagaactgtgaagatgcttcactttggaagctgggaagagaagatagtggcagcaaaggagattgaaaagttagccaaggaagatgttaaggttagtaagttgataacagaacttggcgtggtgccggtgttggtatctatggtggcgtcgccggtggctagccgccggcgagtagggttgacggcgttgatccacctagctgatggaacctacacgaacaaggctttgatagttgaggcaggaatattgtccaagctgcctaagacaattgaccttgtagatgaatcaacaacaagtaaattggcagagatacttttgtcattgtcatctcttgcaaacactcaattccctcttgcttcattagactttataccgttacttagaaacattcttgagacaggcccaagttttgacaccaaaagttcgtgtttatgtgccttacataacctatcaactgtgttagagaatgcatgccctttggtttcaagtggggtggtccctatcctcttggatgtgtcctcaataaaagaaatttcagagaaagcacttgccactctagggaacttgtcagtgactttgatgggaaagaaagcaatagagaacaattcaatggtgccagaaacctttattgagatcttgtcatgggaagacaaacccaaatgccaagagttgtcagtgtatattttgatgattctagcacatcaaagctcactgcaaagaaagaaaatggcacaggcagggattgttcctgtgcttcttgaagtggttttgttggggagccctttggctcagaagagagcaatgaaactattgcaatggttcaaggatgagaggcaaaccaaggtggggccacattctggtccacaaacaccaagatttgcaatggggtcaccagtgaatcaaagagaagcaaaagaagggaagagattgatgaagagtttggtgaaacaaagtttgcataggaatatggaaataatagcgcagagggcaaatgcagcaggggagtcttctagattgaagtctttgattattagcacaagttccaagagtttgccttactaa

SEQ ID NO: 2758 - DNA, 291 bp, Glycine max var. Williams 82
atgcctttacgtttccttatctttgtattcggccatttctctgtaacagtccacctaataaacctgcgaagtagtgtccaccttcaattagcatttagcagcaccttattcccctcgttcattgcttattttttcatggtttcggggtaccaattctgtgcaaacttcaggcctatacaaaagagaggaaatgtttatcacatgaatgtggcaaaagagaggcctaaggttcagtgcattttagattataaatttactaaaacaactaaagtacaaaaatattcattttag

SEQ ID NO: 2759 - DNA, 942 bp, Glycine max var. Williams 82
atgaagatcaaacaacaatctctcttctcagcctcaattttactagttatagcacttattaccttcttccacaccacttcagcccaactcacaccaattcaagccccagtttcatcacccccatccccaccacaacaacaaccacaaccaccagcattcacaccaccctctccaccagccactgctccagccccaggattcaacacagtacccttagtccccgtgacaccaagtggcgcccccacacccaccatcccaaaagcaccatccattgacatagtccaaatcctaagaaaagcaaagagattctccgttctcattaggcttctcaaaaccactcaactcatcaaccaactcaactcacagcttctaacctcaggctcaggagggttaaccctcttcgccccagaagacagtgccttctcaaaactaaaagctggtttcctcaactctcttagtgacagacaaaaagtggaacttttacaattccacacactctcttccttcatttccatctcaaacttcgacacactcaccaaccccgttcagactcaggccggagacgaccccaagcggctccagctcaacgttaccacgtttggtggcagccaggtgagcatggccaccggcgccgtcaacgcctccgtcaccggaacagtttacacggacaacaagctcgccatataccaggtggacaaggtgcttctcccacttgaccttgtgcttcccagtgaggctccggcaccggcgccaggaaaggctaaaggggcttccccgaagacggataagacgaagtccggtgccgctggggatgatagtgacaatggtgataacaaggacttgcccgctgaagcttcttctgctggttcttccgtgagtttcaagtttggagtggttgcgtttgttcttggggtgggtctgatgggtgaagccatggtgtga

SEQ ID NO: 2760 - DNA, 1800 bp, Glycine max var. Williams 82
atggaaaagcccgaggttgtagatgtgaaagaggaagcagattttcagctggttgatgaaaataaagtggattggaaaggaagacgagctcttaaattcaaatatggggggatgtgtgcttctgtgctcatactagctatgattggtttcgagaatttgggaacattttcactagctgtgaactcggtgccatacttcagtgggataatgcattatagtataccagatgcagctaacatgctcaccaactacatgggaaccggttacatactcgccattccagtggctgttcttgctgacacatggattggcagatacagatctgttttaatttctggggtcttcgagtttgtgggacttgcattgcttacagcacaagcacactatcccagccttaagccacccctttgcaacatttatgatataactgctcactgcaaaacaccgagtggtggccaagaagctcttctgttcattggcctatacctgttggcttttggcactgcaggagtgaaagctgccctaccatcacatggtgcagatcagtttgatgaaaaggaccctcgagaagagaggcgaatgtccaccttcttcaacaccctcttgttagccatttgctttggtggtgcagtcagcttaacgttcattgtgtggatacagatcaacaagggttgggattggggctttggtattggcaccattgctatatttttaggtatcgttatctttgcagctggactgccactatacagatttcgtgttggtcaaggaacaaatgctttcaatgagatcattcaggtctacgttgctgcaatccgcaatagaaatcttcctcttcctgaagatccaacagaactgtacgagattgaacaagacaaggaagctgctgaggaaatagagtttctacctcatagagacactttaaggtttttagacagagcagccatccaaataaaacatggagtgcaatctgagaaaccatcaagcccatggaaactttgtagggtcacccaagtagaaaatgccaaaattgttcttggcatgatcccaatattctgctgcacaattataatgaccctttgcctagctcagctgcaaaccttttcaatccaacaaggctacaccatggacaccactttcaccaagcattttcacatccctcccgcatccctcccaatcatcccagtttctttcctaatcattattgttcctatctacgatttcatttttgtgcctgttatgcgcaaaatcactggcattccaaccggtgtcacacacttgcagcgcataggagttggtctagtactctcttgcatatccatggccgtggcttcagttatagaggtgaaaaggaaaagagtggccagagacaacaacatgcttgatgctgtgccaatacttatgccaccattgcccataagcacattttggctttcttttcagtactttatatttggcattgctgacatgtttacctatgtggggttgcttcagtttttctattcagaggcaccaaaagggcttaaatctacatcaacctgcttcctttggagctctatggcacttgggtattttgctagtaccatagtggtaaaaagtgtgaatggagccaccaagcatatcactagcagtgggggctggttagcagggaacaatattaatagaaaccatctcaatttgttctacttgttcctttctatagtgagcttgatcaacttctttatctatttgttagtttcaatgaggtacaagtacaggtctcaaagccctttagttcctggtggcaattcaaagaagtga

SEQ ID NO: 2761 - DNA, 522 bp, Glycine max var. Williams 82
atggctgaggagttcgtcgaatccgaggttgtctttcccgaccaccgcgccgcccacgactgggtagtggagctggcgcccccgccgcggagggagagggagaattgtcgacggagggcggcgaattcgatgccggtgagtataccggagaggacgggccggcggcactggggctccgccgaggaggaggcggaagaggaggagatgacgccgccgcacgagatcgtgaagaggagggtggctgcaaaaatggcgttttcggtgtgcacggggaatgggaggacattgaagggacgtgatttgagtcaggtcaggaattcgattctcaggttaacttataagaaagctccatgcccaaagtttcatacaagcgaagatgggaaaatggaaaatttaaaaagaaaaagaaaaattgtctccatttcttcatttttcttgctttgttatttaattgattggttaattgggctagctattgagatcgtttttggagtctcgttcattgtaaaagggaacatttga

SEQ ID NO: 2762 - DNA, 614 bp, Glycine max var. Williams 82
caacgacaataataatagaaaccttaacctaaccgaatggctgaggagttcgtcgaatccgaggttgtctttcccgaccaccgcgccgcccacgactgggtagtggagctggcgcccccgccgcggagggagagggagaattgtcgacggagggcggcgaattcgatgccggtgagtataccggagaggacgggccggcggcactggggctccgccgaggaggaggcggaagaggaggagatgacgccgccgcacgagatcgtgaagaggagggtggctgcaaaaatggcgttttcggtgtgcacggggaatgggaggacattgaagggacgtgatttgagtcaggtcaggaattcgattctcaggttaacttataagaaagctccatgcccaaagtttcatacaagcgaagatgggaaaatggaaaatttaaaaagaaaaagaaaaattgtctccatttcttcatttttcttgctttgttatttaattgattggttaattgggctagctattgagatcgtttttggagtctcgttcattgtaaaagggaacatttgaatattagagatggaatgaaatgaaataaaattaaattaatttattgattttcatat

SEQ ID NO: 2763 - DNA, 1182 bp, Glycine max var. Williams 82
atggctcggagctccacaagaatgaaatgggtctccatcttcacacttctattcctctcccactcgcccctcacaaccttcgcagaagatgggctagtggcgaatggagattttgaggttagcccatcaagtgggttccctaacgaggcgattgtggagggccccagcgaggtcccaaactggaagtcaaacggcaacgttgagctagtggaatcggggcaaaaacagggtgggatgatcctcattgtaccgcagggtagacacgcggtgaggctcggcaacgacgctgagatcagccaggagctaccggttgagaagggttccatttactcgctcaccttttgtgcggctcgcacctgcgctcagctggagtccatcaacgtgtcggttgcgcctgcatcgcagacggtagacctgcagacactctataacgtccagggatggaacccttacgcggtttctttcaatgcggatgaggacacttttaggttggtatttaagaatcccggcatggaggatgaccccacttgtggccccatcattgacaacattgctattaagaagcttttcactcctgataaacccaaagacaacgcagtgatcaatggggattttgaagagggtccatggatgttcaggaacacttcactgggtgtgttgcttcccacaaatttggatgaagaagcgtcctcactacccggttggatagtcgaatccaaccgtgccgtccggtacattgattctgatcattactctgttccacaaggcaggagagccattgagttgctctcaggaaaggaaggaatcatatctcaaatggttgagaccaaaccagacaagctctacagcttgaccttctcattgggtcatgctgatgacaagtgcaaggagcctcttgctgttatggcctttgctggtgaccaggctcagaacattcactacactcccaattccaattccaccttccaaactgctaacgtcaatttcactgccaaggctgagaggactagaattgcattctatagcatatactacaacaccagaagtgatgatatgagttctctatgtgggcctgtggtggatgacgtcagggtctggttttctggctccaacgggcttcgtgggttgggcttaggaaggcttgtgcttgtaattttgggtctagttttggttctgatgtaa

SEQ ID NO: 2764 - DNA, 2960 bp, Glycine max var. Williams 82
aaaagaagacgagagaaattaaattaaccctgctaatgctaacttgcgccttctctctctctgtgctctgtgctctgtaatgtagtatgttagtaatgtttatgttaatgttctctctcacactctctgtttcacaccgcttccagctcatgccatcactcagtttgatgttgttgttgtgattttctacatagctcaatctattcggtgctatttggagcttctctttctttctcaccaactttactaggaatcaaacaccctggacttggcgagctttcttgtcacactgacaatgtttttgttttctttcaattgaattttcccttctaccactgtgagtgtttactctgctctgagttttccaagttgagtagtacttgttttctgggcaactgaaaaggaacgatctcgatttgcactctttagagggaaaagtctttgactttgaggataatgtagccaccctttgggaattgtggagtgttagtgtttattgtaggagctctgctctgagcattgaagaagaaaatgttcggattctctcgtaggcacatgaaacttggcagtagattgaaggtccaactttctgatactacccagggaactagaagtcccatcaggcaccataagcgaaatggtgatagagttgcagggacaagtggccattctgaggaaattgattgcccgctttcgtctgcagcacctgagatgcatacttgtacagcaggcagctcagagaactggatggtgttgtcaattgcagggaataagcccactcctagatcccatcatgctgcagctgtcattcagaataaaatgatagtggttggtggtgaatctggaagtggattgttagacggcgtacaggtgctaaattttgacagattttcatggaccacggcatcgtctaaactttacttgtcaccaagcagtcttccactaaagattccggcttgcaaggggcattgtttggtttcttgggggaaaaaggcactcctcattggagggaaaacagatccagcaagcgacaaaatttctgtatgggcgtttgatacagagacagagtgctggtcactcatggaagcaaagggagacataccagttgctcgcagtggtcacactgttgttatggctaactctgttttaatattgtttggaggagaagatgcaaaaaggaggaaactgaatgatctacatatgtttgatctcaaatccttgacatggcttcctctccactgcacgggagcagcaccttgtccaagattcaaccatgtggcagctctttatgatggtaaaattctttttatatttggaggagcatcaaaatctaggaccttgaatgacttgtattcacttgactttgaaacaatggcatggtcaagaataaaaatacatggtttccatccatcaccaagagctggttgctgtggtgttttatgtggcactaaatggtatattacagggggtggaagcaagaaaaaacgacatggggagactttggtatatgatgttgtaaaaagtgaatggtctgtggcaattacgtcacctccatcttctattactaccaacaagggttttagcgtagcacttgtgcaacacaaggataaagatttccttgttgcatttgggggatccaaaaaggagccatcaaatcaggtggaagtgttgataacagaaaaaattgaatcagtcctgggaagacgaccaacttctaccaaagatccaagatctatacttcttgaaaaacattcattatctgctggattggcttctcaacttaaaaatgattcttcgcaacatttgattaactctgttgctcgacaaaatcttgcgtctgtaattgaacatagttctgaaagaaaatctctctcagaatccctacttgtacaagattccaattctctccctaccaacatctcccttcgcaggcaatttgatcatgatgaagaatgcaatgcagatgtcaggattgacaagcattcagaagatgaaagttctttccctcggaattcacttcaggcagctgatcacaaaacaaatcaaaatgaccctcgaaatcacatgagcagaagtggagccaaaaccaacatggaggaacaggtgtcagtatctagaagttcaaatcagaaaaacctcggttttggaaaccccgtgctagaaagtgatgatgtgtcattccctgaaaacagtaaatcaggatcactgtccgctgcttcagacatccatcattactatgaaactaaagtggcttccctaatgagaaaatttggcattctggagggacaattggcagttgcattagcaagcagagaagcttctgagaaaagcttagcatctgcctttaaaagcaggcaggagatggagagaaaattggctgacacactgaaggagatggaattactgagagagaagctggtgagtgcagagttagttcaagaagaagctaacaacctatccaacatggtccatgctgacaatgtaaggcttgagcatgacgtggctttcctcaaggctgttttagatgatactcaaaagtaggaattgcactcaaccagaggggttcttgcagcagaaagaactagggcattccaattacaggttgaagtttttcatctcaaacagagacttcaatcaatggaaaaacgagcccctactcccaggaaaccttttcaagtgtagtgttttgaaaggccaatgatgtcatgcctatgaatttcagcataaatgatgagacaatactcctatattatgaggacacaatctattaagggaagggaaagttaatgtggcgttgaagacttggatggaccagctccaaagaaaaagaagcacaattaatggaactgccctttggctgagaaaattggatctgtacatatgttttaatcactgacctccacggctccaccattgtcattatgtaattagtttattaaataataaattaacatttcctc

SEQ ID NO: 2765 - DNA, 309 bp, Glycine max var. Williams 82
atggatagggtgacacagatggcatcagagaggccagtggtgatattcagcagaagttcatgctgcatgtgccacaccatcaaaaccctcttcagtgactttggagtgcatccaaatgttcatgaacttgatgagataccaagagggaaggacattgagcaagctctttcaaggctagggtgcagcccctctgtgcctgctgtgttcattggtggtgagcttgttggtggagccaatgaagtcatgagccttcaccttaaccgctccttgatccctatgcttaggagagcaggagctctttgggtttaa

SEQ ID NO: 2766 - DNA, 1239 bp, Glycine max var. Williams 82
atgtccctctgctacacttccaatttcatctcactgaaccatcaaaagagcttctccttaaccttctcttcagagtcttctcctcacttcatcaacctatttccggttaagcctcagaaaccacaccaccctattaagttcaccgcagaaaggttcaaactttttgcctctctgacatcatctccatccgttgagacctccccatcaagttataggagcaagagccccaaagatgttaacgtcttggtggtgggttcaactgggtacattggaaagttcgtggtgagagagttagttaagagagggtttaatgttacagccatagctagagagaggagtggaattaagggcagtgttgataaggatcagactttgggtcagttgagaggggccaatgtgtgtttctcagacgtgaccaatttggatgtttttgaggaatctctgaacaggttggggaagtcatttgatgttgtggtgtcatgtcttgctagtagaaatggaggtgtgaaggactcttggaagatagattatgaggcaacaaggaatagccttgttgctggaagaaaacgtggggcttcacattttgtgttgctttcagcaatatgtgtgcagaagccgctcctcgagtttcagcgtgccaagttgaagtttgaggatgagttggtgaagttagctgaggaggatggtggattcacttatagcatagtgaggccaactgcatttttcaagagtttggggggtcaggttgagttagtgaaggatgggaaaccttatgttatgtttggagatgggaaactgtgtgcttgtaagcctataagtgagtctgatttggcttcttttattgtggattgtgtgctgagtgaggataagattaaccaggtgttgccaattggagggcctgggaaggcattgactccattggaacaaggggagatgctgtttaggcttttggggaaggagcctaagttcttgaaagttccaatcgggatcatggatttcgccattggggttcttgactttttggttaaggtctttccttcactggaagatgctgctgagtttgggaagattggaaggtactatgcggcggaaagtatgttgcttctggatcccgagaccggagaatacagtgctgagaaaacacctagctatgggaatgatacattggaagagttttttgcaagggttctcagggagggcatggctggtcaagaactaggtgagcaaacaatattttaa

SEQ ID NO: 2767 - DNA, 1611 bp, Glycine max var. Williams 82
atggaggtttcggtgattggaagctctcaagcgaatctgggagcgtcggaattggcatctagggaagttggattttgcaatcttaagaacaatttaagggctttgaatgatagagttagttttggtaggaataatatacggtgggagaaggctgggattagcttcactttgagggctcttcagactgaacccgttagagaggagaagaagccttctgggattggaacaagatccaaaatggcaaatggtttaagattatttgtggggcttcccctagatgcagtttcttatgcctgcaattcaataaaccatgctagagcaatttcagctggcctaaaagctttgaagctcttaggagttgaaggtgttgagctccctatttggtggggaattgttgagaaagatgccatgggacaatatgactggtcaggctatcttgctattgctgagatggtccagaaagtgggtctcaagcttcatgtgtctctttgctttcatgggtctaagaaaccaaatatccccctacctaaatgggtatctcagattggtgaatctcaacccagtattttcttcacagataggtcaggacagcattataaagaatgcctgtccatggcagttgataatcttcctgttcttgatgggaagactccagtccaagtgtaccagagtttctgtgagagcttcaagtcttcattctctccattcatgggctctacaatcacgagcatttccatgggtttaggaccagatggtgagctacgttatccatctcaccactggctgccgagtaatggtaaaactcaaggtgctggggaattccagtgttatgaccaaaacatgctcagctttctcaagcaacatgctgaagcatctggaaatcctctgtgggggcttggtggtcctcatgatgcacctatctatgaccagcccccatacaatggcttcttcaatgatggggcttcttgggagtctacttatggggacttcttcctctcttggtattccaatcagctcatagctcatggagactgcctcctttcattagcatcttcaacttttggtgactctggagtggcgatctatggaaaaatccctcttatgcactcttggtatggaactcgatcccatccttcagagctaacagcagggttctataacacagttaacagggatggctatggaccagttgcacagatgtttgctcggaactcgtgcaaaattatattacctggcatggacctttcggacgcgaaccaaccaaaggaaaaccattctagccctgagttgctacttgcacaaattatggaagcttgcaaaaagcatgaggttcaggtttcaggtcaaaattcgtctgaatctggtgttccaggggggtttgaacaaattaagaagaatttatctggagataatgtattggacttgttcacatatcatagaatgggagcatcattcttctctccagagcattttcctttgttcactgagtttgtccggagccttaagcaaccggaactgcattcagatgatctacctgctgaggaggaagtaggtgctgaatccgccgtggttatgagccgtgattcaactgtgagcatgcaagcagcctaa

SEQ ID NO: 2768 - DNA, 1200 bp, Glycine max var. Williams 82
atgctgaaaatgaataccatattagacctggaagctttagagattgaagagggctctcctaggagtcaagggtctgaaaccccaagttcaagggccagcacttctgattcggagagtcagggatcttttgctgggacacctaataacaataaccagtggcgtggtttctttaaactactcaagaaaggatcccaaatgcctttccaaacttttcacccacttaaaaatgttccaaaactgacaagaagaaaaagcaagagaatcagggaggacctcattccatcactgaatgcagcatctcttgacactgagtttggctgcttcaaatcttcctggaaaaacttcaccctcgcggagatccaggctgcaactgatgactttagccatgaaaatttgattggggagggaggctatgctgaggtttacttgggcaaattggaggatggaaactttgttgccattaaacggttgacaagagggtgccaagaagaaatgactgcagatttcttgtctgagcttggcattatagtgcacgtggaccaccccaacatagctagattgattggatatggtgttgaaggaggaatgtttcttgttcttcaattgtctccacatgtttgtttaatgctaatcttataccagatatctgattttgggcttgcaaagtggttacctgaccaatggactcaccatactgtctcaaaagtggaaggcacattcggctaccttcctcctgaattcttcatgcatggtatagtagatgaaaagacagatgtctatgcttatggtgtactattattggagctcattactggtcgacaagctttggatagctcacagaaaagtctggtgatgtgggcaaaacctttgctaactgcaaataacatcaaagagcttgtggatccagttttggctgatgcttatgatgaagagcagatgaagcttgtaaccttaacagcttctctctgtgtagaccagtcctcaattcagcgaccggtgttagatatactaagaggggaagaagagagcttaagaatcatgaaagaacgatcgaagtcaaaacttcagaggacatactctgaagaactcttagatgcagaagagtacaactcaacaaagtttttgagtgagagggatcgacatatggagactattctaggctgcagtagctctgttacagaagatgaggataaaatctag

SEQ ID NO: 2769 - DNA, 1299 bp, Glycine max var. Williams 82
atggcacagattttggctccctctacgcaatggcagatgagaatctcaaaatcctctcccaatgcaagtcccattacatcaaacatgtggagttctttattgtggaaacaaaataagaaagtttcacccacaagttctgctaaatttagagtgatggcaattaagtctgacaatagcatcatcaacaggctagagggtctacttaatttggatatcactccattcacggacaagataattgctgagtacatttggattggggggacaggaattgatgtgcgcagtaaatcaagaacaatatcaaagcctgttgaacatccctctgagctccctaaatggaactatgatggatctagcactggacaggcaccgggtgatgatagtgaagtaatcctatatcctcaagcaattttcaaagatcctttccgtggtggtaacaatattttggtcatttgcgattcttacaccccacaaggtgagcctatccctacaaacaagagacacagagctgctgaaattttcagtaacccaaaggtccaagcagaagttccatggtatggaatagaacaagagtacaccttacttcaaacaaatgtgaaatggccattaggttggcccgttggtggctatcctggtcctcagggtccttattattgcagcgctggggcagacaagtcatttggacgtgacatatctgatgctcattacaaggcttgcttatatgctggaattaacatcagtggtaccaatggggaggttatgcctgggcagtgggagtaccaagttggtcctagtgtaggtattgaggctggtgatcatatctgggcttcaaggtacatcctcgagagaattaccgagcaagctggtgttgtgctctctcttgatccaaaaccaatagagggtgactggaatggagcaggatgccacaccaattacagtacaaagagcatgagggaagatggaggctttgaggtaataaagaaggcaatattgaatctatcgcttcgccacaaagatcacatcagtgcatatggagaaggaaatgagagaaggttgactggaaagcatgagacagcaagcatcaacacattttcttggggagtggctaaccgtggttgctcaatccgtgtgggaagagacactgagaagaatggcaaaggttacttggaagataggcgaccggcttcaaacatggatccatatgttgtgacatcattacttgcagagactacactattgtgggagccaactctggaggctgaagctcttgcagctcagaagttagcattgaaggtctaa

SEQ ID NO: 2770 - DNA, 141 bp, Glycine max var. Williams 82
atggccagacatttcttgtcatggagatttcctaagcttcagttatggaaaaggttttcaaggcatttccgggagcagaaaactagattttatatcatatggaggtgtatagtgattcttctaaggtggcaggagcgataa

SEQ ID NO: 2771 - DNA, 396 bp, Glycine max var. Williams 82
atggcactgttctattcgagaatatcgccctcaaagactcccaggtttgcgcctccgtggtcggcgtcgtgctggagaaccaacgccgcgatcgaatcgccatctgggttggacaggtttgattccatttcatctgggtcgggcttctcttgcggagttttgaagggtagtgatcgggttcggtgttggggtgttgggtctatagccagaaaaatggagagtgagtttaggaacatgtttatggtgagtcttgtggatggggagtcacatgtttgtgggttgaattcaagtgggtatttggtttgcagaggaagtaacgactttggtcaaattgatgttcctaaaggaggtgctttggagttttctggtttggcacttggggttgagcacacttga

SEQ ID NO: 2772 - DNA, 1479 bp, Glycine max var. Williams 82
atgagtaaagaagagtttttgaagatacagaaatgtgttctcaaagtgaacatacactgtgacgggtgcaagaacaaagttaagaaaatcttgcagaagattgatggggtgtttaccaccgagatagatgcagaacaagggaaggtgacggtttcagggaatgtggaccccaacgttctcatcaagaagcttgcgaaatcagggaaacatgctgaactctggggtgcccccaaaggaaacaacaacatccagaacaacatggcgaaccagtttaagaacatgcagattgacaataatggcaaaggtgggggaaacaacaagggtcaaaagggtggtggtgggaataaccagccaaagggtaataatcaacaagggcagaacccccaacagcagcttcagcagcatctgcaacagcttcagcatatgaaagggttccaagatctgaagctgcctcaattcaaggacatgaaactgcccaacccgaacccgaacccgaacccgaaagcggttaaattcagtttgcctgaggaggatgatttgtctgatgatgaattagacgagtttgatgatgagttcgacgacgagttcgatgacgatgaaatggatgatcctcagcatcctctgaataagatgatgatgatgaagccccctatgggtggtaagcctcctgtgggtaatgtccctatgggtaatggggcttcgatgatgttgaatagtatgatgaatgctcagaaaggtggcaatggtggtggtggtaatgggaagaaaggaggaggtggtggtggtggaggacctgtgcctgttcaagtgcataacatgggtggtggaaatgagggtaaaaatggaaatggaggaaagaaaggtggcggcggaaataatcagaatcagggtggaggtaacaaaaacaacggtggcaaaaatggaggtgggatgccagagggtaagaatggaaacagcaaaaataatggtggtggtggaattccaaataacaatgggaatggaggtaaaaagggtaataatggaatgggtgaaggtgttcaagctatgaacatgttcccaaacatgggtggtcataatcctagtatggttggggctaatatgggccccatgaataacatgagcatccctatgggcaacatgcccatgacccaaatgggcaacatcccagcagttcaaggcctaccagctgctgccgcgatgaacggtggtgccgccggcggtggatacttccaaggtggtggtggtggtccagatatgatgcctggcggcaactcttaccaacaacaacaatacatggctgcaatgatgaaccagcaaagggcaatggggaatgatagattccagccaatgatgtatgctaggcctcctatggctgtcaattacatgtaccctcctccttatagctaccctcctcctcctcatgaaccatattccaactatttcagtgatgagaatacttccagctgcagtgttatgtga

SEQ ID NO: 2773 - DNA, 1212 bp, Glycine max var. Williams 82
atggcttcctcttccctctctctctcactctctctcaccctttgccttgtttccactctctgctacgctcacacatcttccctaaccctacctgtgacaaaagaccattcaacacaccaatacctaacaatcctctcttatggcacccctgttgagtctgcaaaatttgtgcttgatctcggaggctcactcctctgggctgattgtgcatccagaaccaccccatcttccaccctcgcccccattttccaccgttcaattcgctgcctcacagcaaagggtcctgaaattgagacccacaggtggctctcgagtcttgcaaatcctatagatcaagatcagccatgtcaaattacagcagagaacagcatcacggggaaaagggtcaccgaaggagagcttgtggaagacctagtgattcatcgttctcacgagcttctcttcacgtgctcgcccacttttcttttgaatggtttagccactgatgctaaaggcattataggtcttgataaatctcgtatttctttctcatcacaagtttttcactcacttaaaatccagagaaaaatcactctttgcctttctcacacttctggtgttattcaatttggaaaaatgacgcataaatcccaaactgaatctgaaattttcagatatcttactttcacaccccttgtcgcaaaccaagacccgacacagacccagtcttcaatcaacgttaattccgtcaaaatcaacggcaaaaaggttgcttttgacacccccttaggtgggggcgcgcagctgagcacggtcgtgccttacaccactctccaaacctcgatctatgataacttcgaaagcgcttatttgaaagccgcttcgtctatggacatgaaaagggtcgatccagtttccccctttgggctttgcttcgaatccaatggcgttggaagctcccaagtggggcccaacgtgccgatcattgatctggtgctgcagagcgagatggtgaagtggagcatatacggaagaaactctatggtgcaggtgagcgacgatgttatgtgcttagggtttgttgatggaggtgagaatcccagaaattcaattgtgattggagggtttcaattggaggatgtgttggtgcagattgattttgatacttccatggtgggatttagtccttcccttctcacgaagcaagctagttgctctgatttccaaccatag

SEQ ID NO: 2774 - DNA, 1176 bp, Glycine max var. Williams 82
atgatctcttcaatgaagtgcacagcctcatctctcacatgttccgctttctcaaacagaaagattcccattgcaaggccacaacttgtcacgttaccaaccattaacaacgttgaacaaaacacgggtctctctcagttgtgttcacagaaaccgctctacctttcatccactgagaacttggcattggtgaagagaaggagggagactgagtgccaggcctatgaagccgataggtcacggcctctggagattaacattgagctgccgggcgaagaggcggcgcagaggttcaagattgggctgtattttgctacatggtgggctttgaatgtggtgttcaacatttacaacaagaaggttttgaatgcttttccttacccatggctcacctccactttgtcccttgctgctggctccctcatgatgttagtctcctgggccaccagggttgctgaggtcccaaaagttaacttggacttctggaaggccttgtttcctgttgcggtggcacacacaattgggcatgttgctgcaactgtgagcatgtccaaggttgctgtttcattcactcacatcatcaagagtggagagccagctttcagtgttcttgtgtcaaggttcttgctcggagaagcattcccaatgccggtatatctgtcactgctgccaattattggtggttgtgcattagctgcagtgactgagctcaatttcaatatgattggctttatgggggctatgatatcaaatttggcattcgtcttccgcaatatattctcaaagaaagggatgaagggaatgtctgttagtggaatgaactactatgcttgtctttccataatgtcactactaattctcacaccttttgccattgctgttgagggccccaaggtttggattgcaggctggcaaacagctgtgtctcagattggtcccaattttgtatggtgggtagctgcccagagtgtcttctaccacttgtacaatcaagtctcatacatgtctcttgatcagatttctcccttaacattcagcattggaaacacaatgaagaggatttcggtcattgtctcttccatccttatctttcacacgcctgttcagcccatcaatgctcttggtgctgccattgcaattcttggcaccttcctctattcacaggctaaacagtaa

SEQ ID NO: 2775 - DNA, 1764 bp, Glycine max var. Williams 82
tcacctaggaaaaaccgtttccaactctaccattttcccaccaaccctccactctcttcctcaaaacaatcgttaatctcttctacattgtgaagtctgatattctctaagtagacaacacaaacacacctcaatttatagcacccatctttcttttctcccacaaattcagctccattttgttacacgttcaaataataagccaagaagccaccatgatctcttcaatgaagtgcacagcctcatctctcacatgttccgctttctcaaacagaaagattcccattgcaaggccacaacttgtcacgttaccaaccattaacaacgttgaacaaaacacgggtctctctcagttgtgttcacagaaaccgctctacctttcatccactgagaacttggcattggtgaagagaaggagggagactgagtgccaggcctatgaagccgataggtcacggcctctggagattaacattgagctgccgggcgaagaggcggcgcagaggttcaagattgggctgtattttgctacatggtgggctttgaatgtggtgttcaacatttacaacaagaaggttttgaatgcttttccttacccatggctcacctccactttgtcccttgctgctggctccctcatgatgttagtctcctgggccaccagggttgctgaggtcccaaaagttaacttggacttctggaaggccttgtttcctgttgcggtggcacacacaattgggcatgttgctgcaactgtgagcatgtccaaggttgctgtttcattcactcacatcatcaagagtggagagccagctttcagtgttcttgtgtcaaggttcttgctcggagaagcattcccaatgccggtatatctgtcactgctgccaattattggtggttgtgcattagctgcagtgactgagctcaatttcaatatgattggctttatgggggctatgatatcaaatttggcattcgtcttccgcaatatattctcaaagaaagggatgaagggaatgtctgttagtggaatgaactactatgcttgtctttccataatgtcactactaattctcacaccttttgccattgctgttgagggccccaaggtttggattgcaggctggcaaacagctgtgtctcagattggtcccaattttgtatggtgggtagctgcccagagtgtcttctaccacttgtacaatcaagtctcatacatgtctcttgatcagatttctcccttaacattcagcattggaaacacaatgaagaggatttcggtcattgtctcttccatccttatctttcacacgcctgttcagcccatcaatgctcttggtgctgccattgcaattcttggcaccttcctctattcacaggctaaacagtaaggtgataattttgaagctgttaagtaacacacgcgaacaatgactcatggctggagctcaaagtgtcactaatgaggactacggcattaattagctagttttgttgtcaataggaatttaagtttatttcttttgggccatagcaggagcatttctaatcacgtttcgatctgtgtaaattagctttagaagaatggaatgcactaagccgtacttgatctttaggatgtaggtatatcaattctcgaaaaaaaaaatcgttgtaaagtcatgtaaatcagtacttattattttattggtttgttacttattattgtgcagactaacttgaaagctcaatattgattattagacagtccaacattgtttggtg

SEQ ID NO: 2776 - DNA, 336 bp, Glycine max var. Williams 82
atggctctgtgtagaaggccttatgcttactcaaaggtggacaaggaggaccctgaagacataatccatagaagggcacagtttttgatccacaaagtgttggagcaagcagattcacgtagaaagccatcatgccttagaatcagaatctctaagatgaaggtgaagattggaaaaaggttaaggaggctcaggaggagaattatgtccggtgtgtctgctgctagacttggttttcatggacatgttatgagtcaaatcaaaacgtggaagagactctttagccgaggaagacaatctcaaaccctcataacccttcctcctcttatcaaatga

SEQ ID NO: 2777 - DNA, 1128 bp, Glycine max var. Williams 82
atgtcttgctccaatctcacaatgttggtgtcctcaaaaccttccctttccgatccctccaatctctccttccgctctgtcctcaacccttttcagctcccttcacaaaacccaacttcatgcactccttcacgctcctcaaccacccaaattcagtgtggtctgagagaactcagaacccgcattgattccgtgaagaacactcagaaaatcaccgaggctatgaagcttgtggctgcagccaaagtgagaagagctcaagaagctgttgtcaacggaagacccttctcagagaccctcgttgaagtcctctacaacatcaacgagcagctcctaactgaggacgtagacatccctctcacaaaggttaggcctgtcaagaaagttgcacttgttgtggtcaccggcgaccgtggtctctgcggcggtttcaacaacgcaatcataaagaaagctgaggctagaatcagggaattgaaggagcttggcttggaattcactgtcataagtgttggcaagaagggtaactcttatttcatcagaaggccttatattccggttgacaggtttctagaaggtggcacacttccaactgctaaggaagctcaggccattgctgatgatgttttctcactctttgtgagtgaagaggttgacaaggtggagcttctatacaccaagttcgtgtcgttggtgaaatcggatcccgtgattcataccttgcttcctctttcgccaaagggagagatttgtgatgtgaatggtgtgtgtgttgatgctgctgaggatgagttcttcaggttgactaccaaggaaggaaagttgactgtggagagagatgttgtgaggactaaaaccgcggatttttcgccaattttgcagtttgaacaagaccccgttcagatccttgatgcactgctgccactgtatttgaacagccaggttctgagggcattgcaggagtccttggcgagtgaactcgccgccagaatgagtgccatgagcaatgccacagataatgctattgagttgaagaagaacttgtccattgtgtacaatagggagcgccaggctaagatcactggtgaaattctggaaattgtggctggtgccaatgccttgcaatag

SEQ ID NO: 2778 - DNA, 786 bp, Glycine max var. Williams 82
atgcatgatggtcgaccagtcaacacccctttattgaccacatgcaatctcgcatcaggtgacgtctcctcatttcttagacaacatcactatattcatgatcttcttcaagcccacaacatgcatgatgctcgaccagtcaacacccctttattgaccacatgcaatctcgcatcaggtgacgtctcctcatttcttagacaacatcactatattcatgatcttcttcaagcccacaacatgcatgatggtcgaccagtcaacacccctttattgaccacatgcaatctcgcatcaggtgacgtctcctcatttcttagacaacatcactatattcatgatcttcttcaagcccacaacatgcatgatggtcgaccagtcaacacccttttattgaccacatgcaatctcgcatcaggtgacgtctcctcatttcttagacaacatcactatattcatgatcttcttcaagcccacaacatgcatgatgctcgaccagtcaacacccctttattgaccacatgcaatctcgtatcaggtgacgtctcctcatttcttagacaacatcactatattcatgatcttcttcaagcccacaacatgcatgatgctcgaccagtcaacacccctttattgaccacatgcaatctcgcatcaggtgatgtcccctcttgtgatggcattgtttactgccagcttgtcgactcgctgcaatatctctctctcacatgccctgatatagcattccctatcaacaagctcttagatcatgaaggaccctactaa

SEQ ID NO: 2779 - DNA, 1674 bp, Glycine max var. Williams 82
atggacaaaggatggggactcacccttgatacctcttcctctcaatctcttccattattcccttccaacgataataagatgtttcctctcctcggattccccgtcaacctcagccgcgcctccaaggaagacgatgaaaaccgcaaagttgtcggtgaagttgacttcttctctgatagaaacaaacctacacctccaccctctcacgaccacaacgttaaacccaacatcgtcaagaaggaaatcgatgaaacacctcttcacattaatactggtttacaactccttactgctaacaccgggagtgaccaatctaccgtggatgacggggtttcatctgatgcagaaaataagcgagccaaaaccactgagcttgcacagttgcaggtggagcttcaacgcatgaactctgagaacaagaagctgaaagagatgctcagccatgtgaccggtaactacaccgccttgcagatgcatcttgtcacattaatgcaacagaaccagcagcgaacaggaagcacggaaaatgaggttgttcagggaaaggtagaggataaaaacgttggtgttggtggagggaaggtaccaagacagttccttgatataggtcccagtggcacagcagaagtagatgatcaagtttcggattcttcttctgatgaaagaacacgatcgagcacacctcagaaccataacattgaagctggagctagagatggtgcgagaaataacaatggtaaaagccagttgggtagggaagagagtccagactcagaatcacaaggttggagtcccaataagcttcagaaaatgaacccttccaaccctatggatcaatccactgcagaagccacaatgagaaaagctcgtgtatcagttcgtgcccgatcagaagctcccatgatcagtgatggatgccaatggagaaaatatggacaaaaaatggccaaggggaatccatgccctcgagcatactacagatgcactatggcagttggttgcccagttcgcaaacaagctcaacgttgtactgatgatagaaccattttggttacaacatatgaaggcacgcataaccatccactgccacctgctgctatggccatggcatcaaccactacagctgctgctagcatgttgctttctggatcaatgtccagtgcagatggaataatgaacccaaatttgctagctagagcaattcttccttgctctacaagcatggcaacactctcagcttcagcaccattccccactgtgactttggacctcacacacaaccctaacccattgcaatttcaaaggcctggtgccccattccaagtacccttccttcaagcacagcctcagaactttgggtcaggagccgccccaattgcacaagcacaagcactttataatcaatcaaaattctctggtcttcagttgtctcaggatgtaggatcttctcaattagcaccacaagctcctagaccacccttacaaccaagccaacagccctcacttgctgacacagtcagcgccgccgcctccgccatcaccgccgatccaaacttcaccgccgtgctcgccgccgccatctcctccatcataggcagtgctcataattcaaacaacaacaacagcaacaacaacacaagccggactaccattagcagcttttcaggaaactga

SEQ ID NO: 2780 - DNA, 396 bp, Glycine max var. Williams 82
atgaagtccttgaagaccctcttccttgtggccttgttaattatggctttggccattactctgtcagcaacatcttcccaaactgaagaaccaaagtctctaagaggaacaagccggttcctttcccagaaaagggtagcgttgacatgtgacaaaaacccaaaaatttgccttgttaaaggcagcgcaggccctaattgctgcagcaacaaatgtgtaaacttttccacagacagacttaactgtgggaggtgtggaaagaaatgcagcttcggaaagatatgttgcgaaggcaagtgcgtgaaccctaagaccaacgagaagcattgcggcaaatgtggcaacaagtgcaacgccaaaggttcttgtgtttttgggatgtgcagctatgcatag

SEQ ID NO: 2781 - DNA, 1101 bp, Glycine max var. Williams 82
atgagacgtaaatgccgcctattgactaaaagctgcgaatcaacgtggaccactcaccttcttgtctttcccctttcatctcttcaattcaatactcacacacaaagttccctcctctccaaacatggcggcaattttctcttcttcactcttcgcttcctcgcctcttcccaaaccactttcttcctcctattctcgaatccataccgctccacaacttttcaggataacgagaaaaaagtgatcgtgcatgattccttcccctccaaaacctctcctcttcacaccgctgataaatcaactggtggaaactcaattaacacctctgcgttcgagaaacggattatcaaggtcgaacaatcggtcaatatctttcttacggattccgtgataaagatacttgatactctgtaccatgatagacactatgcaaggttttttgtgcttgaaactattgcgagggttccttactttgcctttatgtcagttctccacatgtatgagagttttggttggtggaggcgggcggactatctgaaagtgcattttgctgagagctggaatgaaatgcatcatttgctcatcatggaagaactaggggggaatgcttggtggtttgatcggtttctcgctcaacatattgcaatattttattatattatgacagttttaatgtatgcagtaagcccaagaatggcatatcacttttctgaatgtgtagagagtcatgcatttgaaacttatgacaaatttatcaaggttcaaggagatgaattgaaaaaaatgccagctcctgaggttgctgtgaattattatacaggagatgacttgtatttatttgatgaatttcaaacttccagagttcctaattcaagaagacctaagatagagaatctgtacgatgtatttgtaaatatcagagatgacgaagctgaacattgtaagacaatgaaggcttgtcaaacccatgggaacctccggtcacctcattcatatgcagaggatgatgacagctcagtctgtgctcttgaagcagattgtgaaggaatagtagactgtataaagaaatctgttgcttctaatccagctaaggtgaagtaa

SEQ ID NO: 2782 - DNA, 768 bp, Glycine max var. Williams 82
atggagataaccaaacttggcaagagatttcaaggtaaggtagctattgtgacagcttccacccttggaattggctttagcatagcagagaggcttggcttggagggtgcatctgttgtcatctcttctcgcaaacagcaaaatgttgatgaggctgctggtaaactgagagctaaaggaatcgaagtattggcggttgtttgccacgtttcaaatgcccaacaaaggaaaaatttgatagacaaaactttacagaagtatggaaagatagatgttgttgtgtccaatgctgccgtacatccttctgtagatcccattttgcaaacacaagaatcgatccttgacaagttgtgggagataaatgtcaaatccactatacttcttctcaaggatgcagctcctcacttgaagaagggttcttctgttgttctcattgcctcacttgttgcttataatccaccacctactatggctatgtatggagtgaccaaaacagcagttcttggacttaccaaagctatggctagtgaaatgggccctaatactcgggtgaattgtgttgttcctgggattgtgccaactcattttgttgcactttatacctcaaatgatgctacaagagaggaacttgaaagaaaggcattgcttggaaggcttggtacaactgaagacatggctgctgcgacagcgtttttggcgtctgatgatgcttcttacataacaggagaaaatctagtggtttctgggggaatgccttctaggttgtag

SEQ ID NO: 2783 - DNA, 1611 bp, Glycine max var. Williams 82
atggtcggagaacacagtacgacgtcaccagcttccggtgatcacaaaataccacttcttcccgttcacgagccagtggaaggaacacatacaaacatctccttcagcaccaaatcgattctaacactacaaaacttctacgtgattctgggacctatgctgtctcttttcatatgcctcttcgtgaaactcgacgcgccacccaccagccagaaaatgcttggtgtgattgcttgggtcttctcttggtgggtgacgcaggccgtgccacttcccgtcacctccatgtgtcctctgtttctgttcccaatttttgggatagcttcagctgatagcgtggcgcactcttacatggacgacgtcatcaccctcgttttgggaagcttcattctcgctctcgccgtcgaacgctacaacgttcaccggagattggccttgaatgtaacactgctgttttgtggcgacccggtgaatccagcgctgttactgttagggctatgcgcgacaatattcttcgtgagcatgtggctgcacaacgtggcgacggcggtgatgatgatgccggtggcgacggggatcgtgcagcggctgccgccggcgcacgagcagtcggaggcggtgaacaaattctgccgcgcggtgattctcacggtggtttacgccacgcccatcggtggaataagcactctaacgggaacgggtgtgaacttgataataatcggaatgtggaagagcctcttccctgaggcaaagccaataagcttcaacacgtggttcttctacggtttccctgtggctgttctcatcctcatttgttattggtgcatcatttgcctcctctatgtgcccaaaggttcggctcgggctttgtctgcttacttggatagagctcacttgaagagagacctcgaagctctcggtcccatggcttttgccgagaagatggtgttgtctgtgtttgggttgctgatcatactttggatgacaagaagaataacagatgacattcctggatggggatctttattccatgaccttgttggagatggaagtgtcagtattatggtggctgttttattgttcataatcccaaacatgaagcaagagggggagaagctaatgagctggaatgactgcaaaaagctaccttggaacctcattttgcttctaggagctggttttgccatagctgatggagtacaatctagtggcctggcagatgtgttatcaagagccttggatttcttggaagatgctccatacttggcaattgttcctgctgttagtctaatatgtagtattatcactgagttcatcacctctaatgatgctactgccacccttctagtcccacttctttatcacatagcaagaacaatgcatgtgcaccctcttcttcttatggtccctggaggaatagcaaccgagtttgctttctggcttccaacttctacaccatcaaatgtagttggctttgccactggacacatagaaattaaagacatgctcaaagttggcgtgccactcaaggttgttgggattgttgtgttatctcttctcatgccatcactaggaactattgtttttggaacaaacaatgatactcaataa

SEQ ID NO: 2784 - DNA, 294 bp, Glycine max var. Williams 82
atggatatatcagaaaagcttctacaatatagatatcacataaccatagcaatagtagtttcactatcattttctttgtttttatatgctgctccacactttctgaccattctggcctatttttggcctttgtttgcttccactactgtcttcttggtagcaataatagcctttggaggcgtttcaaaactctcaaatgaagatcatggtgaaaaggctggtgagggactcctggattatgtagcagaaagaacagaacatactcaagaggctcaaacacttctaagtgaatga

SEQ ID NO: 2785 - DNA, 804 bp, Glycine max var. Williams 82
atgggtgaagagaacaaggaagaagaaaggaaagaagagaccacagaggaaaagaaggaagaagagaaaaaggatgaagagcccccagagatagtactcaaggttgatatgcactgtgaagcttgtgcaaggaaagttgcaaaggcattgaaaggatttgaaggagtggaggaggtgactgcagatagcaaggcaagcaaagtggtagtgaaaggaaaggcagcagaccccataaaggtgtgtgagagactacaaaagaaaagtggcaagaaagtggagctcatttcacctttgcctaagcctccagaggagaaaaaagaagaaattaaagaagaaccgcagccagaggagaaaaaggaggagccccctcctgtggtaacagtagttctcaaagttcgaatgcattgtgaagcatgtgctcaagttatacaaaagcgaatccgcaagattcaaggagtagagtcagtggagacaagcttgggaaatgatcaagtcatagtaaaaggtgtgattgacccagcaaagcttgttgattatgtgtacaagaggaccaaaaagcaagcttctattgtgaaagaggaggaaaaggaaaagaaggaagaagaggagaaaaaggaagagaaagaaaaagagaaaaaagaaggtgaagaaagcaagggagaagatgctgaagagggtgatactaaaactgacatcaagcgaagtgaatactggccattaaggtcctacgttgactacgttgactacccttatgctcctcagattttcagtgatgagaacccaaatgcatgcactgtaatgtag

SEQ ID NO: 2786 - DNA, 1396 bp, Glycine max var. Williams 82
tgactcagccatatggtgttacgtaggtagcattaaacggtccacctcagattttcagaatccccacgttaatttaatgtgcttctctccaacccgtaacatagctctcacagacagagtgcaaagaaaagaaagagaaataagagagagaaagttcagaagaggcatcaattgctagctccaatatattacaccactgcaaaattttctgaagcagagatcattgtccattatcacagaaatgggtgaagagaacaaggaagaagaaaggaaagaagagaccacagaggaaaagaaggaagaagagaaaaaggatgaagagcccccagagatagtactcaaggttgatatgcactgtgaagcttgtgcaaggaaagttgcaaaggcattgaaaggatttgaaggagtggaggaggtgactgcagatagcaaggcaagcaaagtggtagtgaaaggaaaggcagcagaccccataaaggtgtgtgagagactacaaaagaaaagtggcaagaaagtggagctcatttcacctttgcctaagcctccagaggagaaaaaagaagaaattaaagaagaaccgcagccagaggagaaaaaggaggagccccctcctgtggtaacagtagttctcaaagttcgaatgcattgtgaagcatgtgctcaagttatacaaaagcgaatccgcaagattcaaggagtagagtcagtggagacaagcttgggaaatgatcaagtcatagtaaaaggtgtgattgacccagcaaagcttgttgattatgtgtacaagaggaccaaaaagcaagcttctattgtgaaagaggaggaaaaggaaaagaaggaagaagaggagaaaaaggaagagaaagaaaaagagaaaaaagaaggtgaagaaagcaagggagaagatgctgaagagggtgatactaaaactgacatcaagcgaagtgaatactggccattaaggtcctacgttgactacgttgactacccttatgctcctcagattttcagtgatgagaacccaaatgcatgcactgtaatgtagatcagtctattgtactaactcggtattttttagtagctgatcaactgaagcaacttgtgctgtgctgagtcgttggagcgtggaataagatgcatggttgtgaatatttcaaggctttgtatatgatttccacggcatccctcagagttggcattctatatatggagatggatgccttgtttcttatgtttatgagctttctacgtatttccttgccaaagggtggctagaatcagttgtgttagtgtgtactgaatttcggcctacaacttcaattatgtacctataatgatggcattaattaataatttcaagttgtcatctgttatgataaaacttgctgcgaaaatg

SEQ ID NO: 2787 - DNA, 990 bp, Glycine max var. Williams 82
atgggccttgtttcccaggatgccctcaaccaactccaagctctcatggatcaagtgctacttgaggaggagccactgcagagaacgtttcagaatgttcatcaaggatgtgtcgccgaaaccttaacgcggtttctaaaagcaagggagtggaatgctaccaaggcccataaaatgatagtcgattgtttaaagtggagagtacaaaatgagattgacaacatattatctaaaccaataatccctactgatttatacagaggcattcgtgattcacaacttataggattgtccgggtactccagagagggtctgccagtctttgcaattggtgttgggcttagcacatttgacaaagcgtctgtccattattatgtgcagtctcacattcaaattaatgaatatcgtgatcgtgtaatcttgccttcagcatcaaagaagcatgagcggcctattaccacatgtgtaaaggttttggatatgactggtctgaagttgtcagccctgaatcagataaagttgttaacaataatatcatccattgatgatctgaactaccccgagaaaacaaatacttattacattgtaaatgccccatacatattttcagcttgttggaaggttgtgaagccacttttacaagagaggacaagaagaaaagtacaagtcttacaaggttgtgggcgagatgagctattaaagatcatggattacacgtctctgccacatttctgtagaagagaaggctctggatcatcaagacattcagagaatggaaatgaaaattgctattccgtggatcatcctttccataagcagctctacaactacatcaaggagcaatccagaatccatgaagctgttgaacccatcaagcagggatcgttccatgtagattttcccgaacctcctgccgagaaagcagagattgtcaagactttagagtctgagctacacaagtttaagatcagcaatgagaatggtgattga

SEQ ID NO: 2788 - DNA, 1419 bp, Glycine max var. Williams 82
atgttgcagagcctgccaagtggggtgtacaagatgagcctcttttggtttctagttttctctgcacatcttgcactagcatcctctcttgttgaatttcaagataatgataatccaaggcaaaagcaagagggcatgcagctaaatttgtaccatgttaaaggtcttgactcctctcaaacttccacatcaccattttcattctctgacatgatcacaaaagatgaggaacgtgtcaggtttcttcattccagattaacaaacaaggagagtgccagcaattctgccaccactgacaaattggggggaccaagcctagtgagcacaccattgaaatcaggtttgtcaattggttcaggcaactactatgtgaaaataggagttggtacccctgccaagtatttcagcatgattgtagacacaggtagctccctctcatggctccagtgccaaccttgtgtcatatactgccacgtccaagttgaccctatattcaccccttcagtatccaagacctacaaggccttgtcctgctcatcctctcagtgttcctctctcaagagctccacactgaatgctccaggttgctcaaatgcaactggtgcttgtgtctacaaagcaagctatggtgacacttccttctcaattggctatttgagtcaagatgtgctaaccttaaccccttcagcggcaccatcatcaggttttgtatatggctgtggtcaagacaatcaaggcttgtttggaaggtcagcaggtatcataggtctagccaacgacaaactctccatgcttggtcaattgtccaacaaatatggcaatgccttctcctattgtctcccctcatctttttcagcacaaccaaactcttctgtatcaggtttcttgtccattggagcctcatcattgtcatcatcaccatacaagttcactcccttggtcaagaatccaaagattccaagcttgtactttcttggtttgacaactatcactgtggcaggaaagccactaggagtttctgcctcaagctacaatgttcctaccataattgactctggcacagtaatcacaaggcttcctgtggctatttacaatgcattgaaaaaatcttttgtgatgatcatgtccaaaaagtatgcacaggcaccaggattctccatattggatacttgcttcaaggggagtgttaaggaaatgtcaacagtgcctgagattcgaatcatatttcgtgggggtgctggcctagaacttaaggttcataactcccttgtggaaattgagaagggtactacttgtttggccattgctgctagctccaaccccatttccattattgggaattatcaacagcagacattcacagtggcttatgatgttgccaattccaagattggatttgcacctggcggctgccagtga

SEQ ID NO: 2789 - DNA, 1299 bp, Glycine max var. Williams 82
atggcaacaatgtccgcatctccaatgaacctcaacatgattgactctaacttcgaagtcgacaagctcacctacgaaatcttctccattctcgagaacaatttcctcttcggctacggcgacaccgaaaatcgcaccaattcgattaattttccgccgagagacgcgaaaccggcgaaacacgccgccggcaaggtccgcatcctctgcattgacggcgccggcgccactgacggcatcctcgccgcgaagtccctcgcgcacctcgaggcctgcctccgccgcaagtcaggcgacgcgaacgcgcgcgtcgccgatttcttcgacgccgccgccggctccggggtcggtggcgtcctcgccgcgctgcttttcactcgcggcaaggacggaaggccgctgtgcagcgccgagggggcgctgcggttcctcaccgacaaccgccgcaggatttcgcggcgggcggggctcctccggcgagtgctccggcctgcggcaaaggcggagaagctcttccgcaagacgttcggggagtgcacgctgaaggacacggtgaagcccgtgctgatcccctgctacgacctcgtcacgcgcgcgccgttcgttttctcgcgcgccgacgcgcttgaagtggacggctacgatttcaagatgcgcgatgtgtgcgccgccacgtcagcggacccatcctctgcccccacagagatgcggtccgtcgacggcaggaccaggatcatggccgtcgacggaggcgtcgccatgaacaatccaacggctgccgccatcacgcacgtgctcaataacaaacatgagttcccgttctgtaacggcgtttccgacctcctcgtactctccctcggtaacggagagtcagactttaacgccgttaagtcctcctctggcttcgtaaggatcgccggcgaaggagtggatcaagccgtatcgatggcatttggtgagtgtcggacgagcaattatgtgcggattcagtcaaacgggatcatggcaaacaagagcacagaggccaagtcctgcaaaacggcgtcggatttgtttgccatgtcggaggagatgttggcccagaagaacgttgagtccattttgttcagggggaagaaggtggcggagaacaccaacatggacaagttagagttgtttgggggagagttaattaaggagcaagagagaagaaaaacaagcattttagcaacggtggtgttgaagaacaataatgcctcaccctcacccagcagaacttcctctgccactaccttgtccactttgtcctccagtagttaa

SEQ ID NO: 2790 - DNA, 1053 bp, Glycine max var. Williams 82
atggcgatttgcagattgaaatctttgctttctctttcgaaatgcaactctgcattagtctcttcttcaatacgcactttctcttcgtcagaagttccccctcgtcacttgcagaatgttggattcattggtcttggaaatatggggtcccgaatggcaaataatctgatcaaagctggattcagactcacagttcatgacctaaactctgatgttctcgagatgttctctcagatgggagttcccacaaagaaaacaccttatgaagtttcagaagcaagtgatgttgtaatcacaatgctacctaattctgcccatgtgattgatgtttacactggaccaaatggtttgcttcatggtggaaaactcctaaggccatggttgttgttagattcatccactattgatccagaaacatcaagaaacctttctgctacagtatctaattatattctaaaagaaaagaaaggtgattgggaaaaacccttcaagttggatgctcctgtatctggaagtgttactgcagctgaagcagggacacttacttttatggttggtggtttggaggaagcatttcttgctgcaaaacccttgctcttttcaatgggtaaaagtgcaatatattgtggtggagcaggaagtggttctgctgcaaaaatttgcaataatttggctttggctgttagcatgctgggaatatcagaagctcttgctctaggccaatctctaggtgtttctgccagaaccttgacaaatatatttaactgctccagtgctcgctgttggagtagtgatgcttacaacccagttcctgggctgatggaaggggtgccctcgtcaagggattataacggagggtttgcatccaagcttatggcaaaagacttgaatctagcggtagaatcagctaagctggccggatgtaaatacccactaacatcacaagcacaaaagatatatactgagctctgcagcgttggccatgaagccaaagacttttcatgtgcttttcatcattattactctggaatggacgaacctcatgataagtaa

SEQ ID NO: 2791 - DNA, 648 bp, Glycine max var. Williams 82
atggctaatctctcgttgttgctggcagttttggctctttcactttcagttgctttagcagctgataatagtgctctccaagatttctgtgtggcagacccaaaagggcaagtgctggtgaacggtttcgcatgcaaggatccaaaacttgttgaagcaaacgacttcttcttcagtggtcttcacatagcaggcaacaccacaaaccctaatgggtcaaaagtgacaccagccttcgcaactcagcttccagggttgaacactctcggcatctccatggctcgcattgactatgttccatggggcattaaccctcctcacacgcaccctcgcgccaccgaggttttaaccgttctggatggtaccttagaagttggattcgtcacttccaaccccgaaaaccgccacttcaggaaggtcttacagaagggtgatgtgtttgtgttccccacaggacttgtgcattaccagagaaatgttgggtatgacaatgctgtggccattgcagctcttagcagccagaatccaggactcatcaccgttgctaatgcggtgttcggggctacgccggatatagatggagacgttcttgttaaggctttccatttggacaaggctatcgtcagttatctacagtcaaagttctag

SEQ ID NO: 2792 - DNA, 780 bp, Glycine max var. Williams 82
atgccgtcaggaaggcaagataaaacaatacttgtgaagtttcctaacccatgtggcatgtattgcatgatggttgtgcagaactttgtagttgatttgaataaggcccttgttttccaggttgggcatcttggagaagcttatgaagagtgggttcaccagcccattgtcagcaaggaaggcccccgtttctttgaaaatgagattctggagttcttgacgcgcacagtctggtgggcaataccagtcatttggctgccagttgtatgctggtttatatataagtccatacgaatgggcctcagttgtcctcatttagctctattggtggttcttggcatttttgtttggacactgcttgaatactcattgcatcgttttcttttccacattaaaacaaagacctactgggggaataccttgcattatcttctccatggctgccaccataagcaccccatggatggcttaagactcgttttccctcctgctgcaacagctatattattgatgccgttctggaacttggtgaaactcatggcgaccacttcaactgctcctgctttgtttggaggtggtttattgggttatgtaatgtatgattgcacccattattacttgcaccatggtcagccaaggactgaagtgccccgaaatctcaagaagtaccacttgaatcatcactttcggatccaggataaaggctttgggatcacttcatcactatgggataaagtttttggaacacttcctcctaaaatggatgccaaaagtatgtaa

SEQ ID NO: 2793 - DNA, 1635 bp, Glycine max var. Williams 82
atggcgacaaaacctcgtttggcttatctctcttccacttttcttcttcttcttgttgtaactgtctttacttcggtgtcggcacaagccccagaatccccatcactctacaacaccttccttcaatgcctcaccaaatacacaaataacccctccaacatagtcttcgccaacaccaaccccaagttccccactatcctccaaaactacatccgaaacgcgcgtttcaacacctcctcgacgcgaaaaccattactcatcgtcactccccagcaagaatcacacgtccagggcacagtaatctgcgccaaaagcgttgaaattcaactcaaaatcagaagcggaggccatgattacgagggcatctcgtacatctccgaggaacccttcgtcatcctcgacatgttcaactatcgcagaatcaccgtggacgtaaaaaacgaggttgcagtggtcgaagctggagcaacacttggagaagtttattacagaatctgggagaagagtaaagttcttggctttccagcaggggtgtgtcccactgttggcgtcggtggccatttcagcggcggagggtacggcaacatgttgagaaaatatggcttatccgttgataacgtcatcgacgcgcaaattgttgatgtgaaaggaaatcttctaaacagaaaaacaatgggggaagatctgttctgggctattagaggaggtggtggagcgagttttggtgtcattttgtcgtttactattaaactcgttccggtgccggaaacggttaccgttttccgcgttgagaagactcttgaaacgaatgtcactgccactgaccttgtcgtgcagtggcagcaggtggcgccaaatactgatgatagacttttcatgaggttactgttgcagcctgtgagttcgaaggttgtgaagggaacaagaaccgttagagcctcggttgtggctttgttcctcggaggggctaatgaggttgtgtcgattttggcgaaggagtttcctcttcttgggttaaagaaggagaattgcactgaggtgagttggattgactctgttctgtggtggaacgatgacaatagtttgaagaatggtgacaaacctgaaaccttattggatcggaatttaaacaatgcaggttttctcaaaagaaaatctgattacgtccagaatgctatttccagagatgggttggagtggctatttaaaaggatgattgagttgggaaaaacggggcttgttttcaatccttatggagggaaaatggctgagattccttctgatgcgacgccgtttccgcaccgtaaagggaacttgtataagatccagtactctgtgaactgggatgatccttcacccggtgctgctctgaatttcacgaaccaggctaagaggttgttcagttacatgaccccttttgtgtccaagaatcccagaagtgcgtttttgaattatagggatcttgatattggggttaacagctttggtgagaatagctttcaggaagggttggtttatgggaccaaatacttcaatgataattttcagaggcttgtgaagattaagaccacggttgatcctgaaaactttttcaggaatgaacagagtatccctgttcttcatggcgaagcatag

SEQ ID NO: 2794 - DNA, 279 bp, Glycine max var. Williams 82
atgatatcatcacagatttggaagggtggtcccgatcatcatgtggaatctttggaagatccattcctccactttccctttcacctacaaaagccactaacaaaaccaacatgtttccctcacttgagcaccattattgtcaccttctgtttgctctcatcagcaagcattttggcaataactcttctttcttccagcaaaggtcaatatgaatcccaagttcagatcatgggacagtgtttgcaatcatcaagggagcaaaaggaagaagggtgttaa

SEQ ID NO: 2795 - DNA, 1680 bp, Glycine max var. Williams 82
atgggactttcttctacaacactgcttccaattgttgtgctgctttctcttctttgcacagcctgtgccagaaattcagctgaaaacaactttgttcactgccttgtgaaccattctgagccctctcaccccatatctgcagcaattttcacacaaaagagttcctcattctcttcagtcttgcaagcctacatcagaaacctacgtttcaacacctccacaacccataagccgttcctcattgtgaccccatttcaagtctctcatgtgcaagcagccattgtttgtgccaaaaagcacagcttgctgatgaaaattcgaagtggcggccatgactatgaaggggtgtcttatgtggcctcacagccatttttcatccttgacatgttcaatctccgatccattgagatcgacatggacaccgaaaccgcgtgggtccaagccggtgcaacgcttggcgaagtttactatagaattgctgagaagagtaaaactcatggtttccctgcaggggtgtgtcccactgttggggtgggaggtcacattagtggtggtggatatggcaatctcatgagaaaatatggcacttcagttgacaatgttgttgatgcacatatagtggatgctcaaggaaggttgcttaatagaagaaccatgggtgaagatctcttttgggctgttagaggtggtggtggaggtagctttggtgtggttcttgcctacaaaataaagctagttcgagttcctgaaaaagtcactgttttccaagttgggagaaccttagagcaaaatgccacagacatagtttacaattggcaacatgttgcgcctagcattgacaatgatcttttcattaggctcatcttggaggtggtaaatggtacacaaactgcaacaaagactgtgagggctaccttcatagcactcttccttggtgactccaaaagccttgtttctctcatggatgagaagtttcctcaattgggtttgaagcaattcgattgcattgagacaacctggcttcgatcggtgctgttttgggacaacatagacattgcaaccccagttgagattttgcttgaaagacaacctcagtcttttaagtacttgaaaagaaaatctgactatgtgaagaagccaatttccaaggagggttgggaggggatttggaacaagatgattgaattggagaaggcaataatgtacttcaatccttatggtggaagaatggctgagattccatcaacagaaaccgctttccctcaccgtgccgggaacctatggaagatccaataccaagcaaattggtttgaggcaggggaagaggtagcagaataccacataaacttggtaagagaacttcacaaatacatgacaccctttgtgtcccagaatccaagacaagctttcatatgttacaaagacttagaattgggcatcaatcaccacggttactatggctactttgaagggagtgcttatggagttcagtacttcgatgataacttcagaaggttggttcaaataaagaccagggttgatcccagcaatttcttcaggactgaacaaagcatcccggtacatagccatgtggaattttttagaatggttactgaaaaatcgttggtttctgtattgttcgggttgttcgcattaaattggattcggaacctcaagtaa

SEQ ID NO: 2796 - DNA, 1608 bp, Glycine max var. Williams 82
atgggagtcctttcttctcatagaatacaactattattatttcccattgttgtgttgctttggtcagcttcagctgcaaattcagctaacaacacttttcttcattgcctcgtgaaccattctgagccttctcaccccataacttcagcaattttcacaccaaacaacacctcattctcttcagtattggaagcctacattagaaaccttcgtttcaacacctccacaacccgtaagccattcctcataataactgcacttcatgtatcccacatacaagcatccattatttgtgctcaaaaacacaacttgcaaatgaaaatccgaagtggtggccatgactatgagggtgtgtcttacgtggcagaggttccattcttcatccttgacatgttcaatctaagaaccattgaggttgacataggcactgaaaccgcttgggtccaagctggtgcaacacttggtgaagtttattatagaattgctgagaagagtaaaacccatgctttcccagcaggggtttgtcacacagttggggtgggaggacacataagtggtggtggctatggcaacatgatgagaaaatatggtctctcagtggataatgttattgatgcacaaatggttgatgttcaaggtagattgcttgatagaaaatccatgggtgaagatctcttttgggccatcacaggtggtggtggagctagctttggtgttgttcttgcctacaaaataaagctagttcgagttccagaaattgtcactgttttccaagttgggagaaccttagagcaaaatgccactgatatagtttacaattggcagcatgttgcaccaactatcgacaacgatcttttccttagggttatcttggacgttgtgaacggtacacgaaatggaacaaagactgtaagagctaggttcatagctctattccttggtgactccaaaagccttgtttctctcttgaatgacaagtttcctcaattgggtttgaagcaatctgattgcatcgaaacgagctggcttcgatctgtgctgttttgggacaacatagacattgcatcctcacttgacattttgcttgagagacaaccacgatcactcaactacttgaaaaggaaatctgactatgtgaagaaaccgatttccatagagggttttgaagggatttggaagaagatgattgagttggaggatacactatttcaattcaatccttatggcggaagaatggctgagattccttcaacagcatctcctttccctcatcgagctgggaacctatggaagatccaataccaagcgaattggaataagccagggaaagaggtagcagatcactacataaacttgacaagaaaacttcacaagttcatgactccttttgtctccaagaaccctagagaggctttctacaattataaggaccttgacttggggattaaccacaatggtaaaaacagctacgctgaagggagagtttatggagtggagtatttcaaggataacttcgacaggttggttcaaataaagaccaaggttgatccccataatttctttaggaacgaacaaagcatccctacgctgtcatataggaagggttag

SEQ ID NO: 2797 - DNA, 1881 bp, Glycine max var. Williams 82
atggaagagacatttgttccgttttgtgaaattaaaaatgatcttcaagggagattgatgtgttacaagcaagactggattggtgcaattcctgttatttcatttggagaacagttggaaagagacacgggaggccagcctttgctgattcttggagtagcagaaccaactgtaattatgtatacattcatgtttaactttgctacaagtagaccagaattgggttcgaaactctttctagcattgactggatgggtatgcatgtggactgccatcttgttgttcctactggctatcttaggagcttgttccatcatcaacaggttcactcgcctagcaggggaactgtttggccttcttattgcaatgcttttcatgcaagaggctattagaggactcattcatgagtttcacatacctgagagggcaaacctaacatcacctgagtttcaatcttcgtggagatttggaaatggatgtttacgaggcttcatagcagattatggtgtcccattgatggttttgttgtggactgccatttcttatatttcagctggaagtattccaaaaggaatccctaggcgtctcttcagtccaaatccatggtcatctggtgcatttgaaaactggactgtcataaaggacatgctgaatgtgccagttctctatattattggagcctttattccagcaacaatgattgctgtgctttattattttgaccatagtgtggcatctcagcttgctcagcagaaagagttcaacttaagaaagcccccttccttccattatgatttgcttctattgggatttatggttataatatgtggtctaattggaattcctccgtcaaatggtgtcattccacaatctccagtgcataccaaaagtttagctacattgaagcaccagttacttagaaaccggcttgttgcaacagcacgaagttctatgaaaaagctagaaagcttgggacaagtatatggaagtatgcaagattcttactggcagatgcaaacccctctagttcaccaggaaccttccgcgaagggacttaaagagttgaaagagtcaactattcatttggcgtcaagcatggggagtataaatgccccagttgatgagtcagtatttgacattgtgaaggaaattgatgacttattgcctgttgaggtcaaagaagaacgaggatgtgtagcagcaatgcctttcctgaaaattattccaacttctgtactttggggctattttgctttgatggccattgaaaacttacctggcaaccagtttcgggaatggattttattaattttcattgctccaagtcgaagatacaaagtcttggaggagtgccatgcaacttatgtggaaaccgtaccattcaagacaattgcagtattcacagccttccagactgcttacttgcttgtttgtttcggtatcacttgggtgccaatagctggggttctattcccattgatgatcatgcttctggttcctgtaaggcaatacattctgcccaagtttttcaaaggagcacaccttcaagatttagatgctgcagaatatgaagtacctgctttaccattcaacttagtggctgaaagggacttgagcaggacagcttcctttgcagattatggagaggttttagatggaatagttactagaagctggggcgaggttaaacgtgtttgcagtccaaaggtgatgaaatccactccaaacatatcccaagagttaacaagtgcaaggttcccagataaaatatacagccctcggatgagccatctcagaggaaaccaaagccctcgaggtgttggcagaggaccatttagccctgcagaagttaggccatccaatttgaggaaaggtggttga

SEQ ID NO: 2798 - DNA, 705 bp, Glycine max var. Williams 82
atgaatcatagaagtgcaaaggatggggatactgaagttgatcttgaaagtggattgccactaattgaagatgattcaaagacattatttgctaaggtttctggtgggtttgctggaggttctgttaaaggtgatgatgggccaagtttatgctgcaatgaaccaagtttaagtgaagtatctgcagatgtgatgatagtaacaaacaagccaatgatggggagagattcggcaaaccgtgcccaacaaaccccagtgagggagaaacggaaaaaggccagtaataaaaaggctcccaaacctccaagacctccacaagctccatcattggatgcagctgacaataagctaatcagggagatatctgaacttgccatgttgaagcgcgcgaggatagagcgtatgaaagctttgaagaagatgaaagttgttaaatcatcatcaccatcatcttccaataccagcagccttttggctatggttttcactgttgtcttctttgttgtgataatattccaaggcatgtcatccggtaaaacctcagtggcaagtttccagggatcacctgtatctgcaggagaatcagagggtggtttaatttcagttcagtaccaactcaatccttctgcagttgactcaaatgctcctggttcagagtctcactacttattgtacaagtgcaagatgaagtctcacatcaagtag

SEQ ID NO: 2799 - DNA, 1098 bp, Glycine max var. Williams 82
atgcagagttccacccctgctgcgagaaacagcaagaacaagtttattactgctaagaacgtgaagagcctcgtcaacaccatcgtgattccttccatttcatccactccactcgagtctctccacagaggcaactggcccaagctcatttgtggtgatgctgttgatatcagaaatctcagtctggtatacactcttgctggatttgactgcattgactgtgctgctgatgcatcgtttgttagtgctgtgaatgaaggaattgaagctgctaaagatattgtatgccttagaaggccctgggtgatgatcagtgtcaatgatgataaagatcttcattttcgtaaggccgaatttgatccagaggactgtccagcagactgttcacgaccttgtgaaaatgtgtgccctgcaaatgccataacattccaagggaaatctacttcaggaatttcacataatactgaagcacctagagtactgaaggtgcagcaatgttcaattggcttgaaaatgcaggacggagtcataacagaaagctgctatggttgtggtcgctgtcttccggtttgcccctacaataaaataagagaggtaacatatgcaagagatgctattacaactgctgctctcatcaagagaaattgtgttgatgctatggagatacatacaagtgggagtgattcttctatagacagcaaagaactctggagtgctctaggagattcagtagtatatttgaagcttatagctgtaagtgcctcttggcatttgagtgaagaatttattcttgaaataatccgggttagcttacctaatggtggttttcttcacacaattgatgggctgaaaaaagagggactcttccaaacaactactgaatacttacatgataatatgccaacaatcagctcatgtgattcatcacatgctttaattagcggtatagcttatggtggctacgcacggaagccgacacataatctataccccattatttacagtattgggatccatgcaattgaggatcatcccgagcatctcttgatggctcttaaggaagcacttgcattgttggggcctattaaatgtctatga

SEQ ID NO: 2800 - DNA, 2328 bp, Glycine max var. Williams 82
atggcttgtgaaaatgacaacaacaacaaaggcctattacttgccctagggctagtactttgtgtcaccctgtccttcttcccaagggtcacagaagggagggtgccctttgcatgcgaccctaggaacggtctcacgaggggtttcaagttttgcaacacgcacgtgccaatccacgtgagggtgcaggacctcattgcgaggctcacattgccggagaagatcaggctcgtggtcaacaatgccatcgccgtgcccaggctcggcatccaaggctacgagtggtggtccgaggctctccacggcgtctccaatgtgggccccggcaccaagttcggcggagccttccccggcgccaccatgttccctcaggtcatctcgaccgctgcttcgttcaatcagtcgctgtggcaggaaattggacgggtggtgtctgatgaagcaagagcaatgtacaacggtggacaggctggtttgacgtattggagtcctaatgtgaacattttccgtgacccacggtggggccgtggccaagagactcccggcgaggacccaacactggccgcgaaatacgccgccagctatgtcaaaggacttcaaggcgacagtgccggaaaccacctcaaggttgctgcttgttgtaaacactacactgcctatgatcttgataactggaatggtgtggacaggtttcatttcaacgccaaggtgagtaaacaggatttggaggatacttatgatgtaccatttaaagcgtgcgtgttggaagggcaagtggcgagtgtgatgtgctcctacaatcaggtgaatggcaagcccacgtgtgctgacccagatctccttcgcaacactattcgtggccaatggcgcctcaatgggtatattgtctcagactgtgattcagttggagttttctttgacaaccaacactacacaaaaacacctgaagaggcagctgctgaggccattaaagcgggtctagacttggattgtggcccatttttggctatccacactgattctgccattaggaaagggcttatttccgaaaatgatcttaaccttgccttggccaaccttatttcggtccaaatgagattgggtatgttcgacggcgaaccgtcaacccaaccatacggaaacctaggcccaagagatgtgtgcacctcggcccatcaacaattggcccttgaagcagctagagagagtatagtcttactacaaaacaaaggaaactccctaccattatccccttcaagacttcgtactataggtgtcgttggacccaatgctgatgctaccgttacaatgattgggaactatgctggtgtggcatgtggttataccactcctttgcaaggaattgcgaggtatgtgaagacggctcatcaagtggggtgtaggggtgtggcttgtaggggaaatgaactatttggggctgcagagaccatagctaggcaagctgatgcgattgttttggtaatgggccttgaccagactgtagaagcggaaacaagagatagagttgggcttctcttaccgggccttcaacaagaacttgtgacaagggtggctagggccgctaagggcccagttatcttgctcatcatgtctggtggcccagttgatatctcgtttgccaaaaatgaccccaagattagtgccattttgtgggttggttatcccgggcaagctgggggaactgccattgctgatgtaatctttggtacaactaacccaggaggaaggttacccatgacatggtacccacaaggttacttggccaaagtgcccatgacaaacatggacatgcgtccaaacccaacaacagggtacccaggaagaacctatagattctacaaaggtcctgtagtgttcccattcggacatggcctaagttactcaagattcagccacagcttagcacttgcccccaaacaggtctcagtgcccataatgagcctccaagccttgacaaactcaaccctctcaagcaaagcagttaaggtgagccatgccaattgtgatgactcattggagatggaattccacgttgatgtgaaaaacgaaggctcaatggatgggacccacacccttctcatattctcacaaccaccccatggaaaatggtcgcaaattaaacaattggtgggcttccacaagacccatgttcttgctggctcaaagcaacgagtcaaggttggtgttcatgtgtgcaaacacttatccgttgtggaccagttcggggttcgaagaatcccaaccggtgaacatgaactccacattggtgatgtcaaacattcaatttctgttcaaactacgcattaa

SEQ ID NO: 2801 - DNA, 2805 bp, Glycine max var. Williams 82
atgggagttgaaaaagaaggaacaaaaagtggaggaggttatgctggtggttttttccagttgtttgattggagctcaaaatcccgtaagaaattatttgcagccaagtcagatttaccagagtctttaaaacagggaagaaaagtcgattacaatgtggcaatgacacagccctcctatctggttgatgacgatgaaattggagtaggggcaagtgttagaggaagttgtgatcatagttatgcttcatctgttactgatgatgaagcatatggaacaagagcccctagtgttgttgccaggcttatgggtttagattccttgcctacttccagtttttctgatccttattctaccccatactttgatacccgatcccttcaagactctcatgacttcaagaaaaaccttcgtcaccagcatgaccatcataccccatattctggaaagctgcttgaaaaggttgagagctcttctaggaacttcatggagccaaagccgcaaaaggccattaccaggccaattgaaaagttccaaactgaagtattgcctccaaaatcagctaaatcaattcctgttacacaccataaactcttgtcccctattaagaatcctggctttgttcctaccaataatgcggcttatataatggaggctgcggcaagaattattgagcctggatcccaagttagtaccaagttcaagacaccgctgatagcatcatcaacaccattgagagttagagatcttaaagataaggtggaggcttcacaaaaagaacctctaattgggccatcttccatgacctctagaactcgagatctgaaagagaaaagagaaattactcatagaacaaccaggacctcagaatcttctcaaagatcagtcgagtcaaatgctgccaagtatctaaagggacagtctttgaacagaagctggaatggatctgcggatacatctgtatccgtcaaatctcctacaaacgaggaagaagattcttctttgaagaataaggggaagtccatttcacttgcaatccaagcaaaagtgaatgttcaaagaagggaaggtttgagtttgactgggggcagaagtttgacaggccagaaagagcatcctgatgttaaatccaaccaaccaatgaaggcaagtgttcagaaaaatttacacaagaaatcttctggtgctcttagacagaataatctgaaacagaattattcaattgacaaagacaaattaccatcaaagccattggttaccaattcaaacagtaggaaagttctgactggggattcctcttatggacgccatagaagctctagtaataaatccaatgcaaaacctaaagttggatccagaaagtcagccatggaggtgacagatagtgaaaaggaggtcttgtataccagcacaaacagttttcctagaaagaaaaggtctacagacaaggactggaatgatagggttgtggataatttgttcattgaaaaaatgcagaagcctgctaagtctaacctagtgagtaataagcaaaatagttggactgaagaagtcaaaaagaaagacatggatgtagtttccttcacatttaccacaccattaacaagaagcaatccaggttttgagacatctggacaagctggccagaatactaatggcctttccttggatcaacgcattaaaagagtgttactcgacccagacaatacaaagtctccaataggatacaatataattggtggcggtgatgccttaggtatccttttggaacagaagttgagggaattgactaatatggaaaccacttgtcatgactcttctaaagtgaggcaacctgccattactgcaccaatttcagatgatcaagtaaccagccataatgtagttaatctcaatccgaggttgcaacagaaaaaagaccaaggtgtgttattttcagacaagttaagcagtaactatgattcaaacatcttcttcactggtcctcctgaactgtcattgaagcataactcatggattgatgagatggaatcacagttactcaattgccgacacccaagtccaatctctgttcttgagccttctttttcaatggaaagctgtgaatcttcattgagcacagatattactagtacagaaggaagcaagttaagctcatctgttcaagctcacgaagttcatggtttgaatttttcacggaagttctatccttgtgaatctgatactgagttatctgattcagcttcttccacatcagctgggaacccgatgaggaagcgcacaagtacatgttctgtcacgaggtttggaaggtcaagcacatgggagttggactacgtgaaagatatagtgtgtaatgttgagttgatgtatatagacttttcccttggccaagctagcgaggttataaaccctcatctattcaaacagttggaagggtgcaagggagggtttaagcgcggtgacgaatctaggatggcaaggaaagttacatttgattgtgtgagtgaatgtctggatttgagatgcaggcgttatgtagggggaggatacaaaatgtggatcaaagggtttgaaatggtgaaaagaaaagaatggttggcagaagatgtgtacaaggagatctcagattggagtggaatgggagactcaatggtagatgagcttgtggacaaggacatgagcagccaatatagaagatggctagagtatgaggttgatgcttctgaactcggatcagaggttgtggaccaaatatttaattctttggttgatgatgttgtgactgaaatgttgcaattgtaa

SEQ ID NO: 2802 - DNA, 738 bp, Glycine max var. Williams 82
atggcagatgcaagtttctttgttggagtcataggcaacatcatctcaattctcatgtttctttctcctgtacctacgttttggaaaataaagaagcaaggatctaccgaagatttctcaagccttccttacatttgcacattgcttaattgttccctgtggacttactatggaatcataaacgctagagagtatctggtggctactgttaatggctttggcattgtggtggagacaatctatgttattctattcctcatatatgctccaaaagggagaaggggtagaactgccattttggctgtgattttggatgtggcaatcttggcagcagcagtagttattactcaattagcatttcaaggaaaagctcgtagtggtgctgttggtgttatgggagcaggcttgaacattgttatgtatttctcacctctctctgccatgaaaacagtggtgaagacaaaaagcgtggagtatatgccattcttgctttcttttttcttctttttaaacggtggcgtttggttgttgtatgctgttcttgttcgtgatgttatcctcggggtgccaaacggtactggatttttactgggagcgatgcaattagtgctatacgcaatctacagaaatgggaagcctagttcaaataacagattagaagaaggattgcaacatgagcctctcatctcacagcctaataaggagtcacatcagataagggaagacaggcccatctag

SEQ ID NO: 2803 - DNA, 1428 bp, Glycine max var. Williams 82
atgagattctcagtcttaacctttctcttattcttattggtagcacaagaagccacttgcttcaacaaacacacaacactcgctcatttcaggaacatacttaagaatagaatggcctttgccctatcccaaccaccctcagcatctccagaaaccaaaatgagtgggagagtggtgtacccagttgagtatggtgcagaccctacaggggcacaagaaagcagtgaagcaattctaaaagctgttggagatgcttttgggattctgagtgaacttgagttggtggcaggagttaaagaccttggaggggttgtgattgatcttcaaggtggaaactacacaatcagcaaacccatcacatttccttcatccggtggtggcaatattctggtaaaaggaggaacattgagagcttctgattcattccctactggtcgacatctagttgagttatgggctccaaattcccaaaagcttccaaaaacatcagttttgaacagcataaaacttcagcaacctaatggcatttactatgaagacataacatttagggacatcctctttgattctagctacaagggtggagggatattcattgttgattctgttagaacaagaatcaacaactgctttttcttgcatttcaccacagaagggattctagtccaaggtggccatgagaccttcataacaagcagtttccttgggcagcactcaacagttggtggagatccaggggagagggatttctctggcactgccattgatcttgccagcaatgacaatgcaatcactgatgttgcaattttctccgcagccatagggattgttcttaggggtcaggccaacatgctcactggggtgcattgttataacaaggccacaggctttggtggcattggcattttggtgaaactagcagggaattcacaaactagaattgataattgttacatggactatacaggtatagtcatggaagatcctgttcaagttcatgtcactaatgggtttttcttaggggatgctaacatagttttgaagtcaattaaggggcaagtttctggtttgaatatagttaacaatatgttcactgggaaccccaataataaggttccaattgtgaccctagatggccaattcagtaacattgaccaagtggcgattgataggaacaatgtgattggcatgagcttgagatcaacagttgggaagttaactgtgactggaaatggcacacagtgggtggctgatttttcaaacgttttgctattcccaaataggattagcaattttcagtactcattttatgcacaaggggagccaaagtttttggcacattcggtcaccaatgtgactaataatgttatagttgtggaaagtgagaaatcagctcaaggggttgtttccttcttcgttgaacaatga

SEQ ID NO: 2804 - DNA, 759 bp, Glycine max var. Williams 82
atgagggatatgaccatggctgccattactgatcaatggatgcagttctatcaacaacctctaatggatagccatggccatgatcatcatgctttggcaccaatttccacagaattaggcttctctgatgcaaccgtgactacgacaactagttctcccacccccaccatgccatcatcagagagcaatagcatcttgagccaattgagtccaaagggtaatgtgtccaaaccaataagaagaaggtctagagcctctaagaaaaccccaaccacactcctcaatgccaacaccaccaattttagagcattagtacaacaattcacagggtgtcatagcacaaccatgccaacactaggggtccaaaagggccctattaccttgaatttccaacaaggaaatagtagtggacaaaaggttcaccacaacacaagtagtagggtagtgctaccatttagtggcagaagccacaacaacagcaacagcaacaacaaccaggttcatcaagtgccttcaccgtttccaaatgggcagaagcaagaagatgaagaacaacgacaactgcctcagcagagtggttactcttttgattatgtgaagaacagtggttttcttccaagttcgggtaactcaataaggcctaccactactagcatggatcatgtctctgatggtttgctcttggataatgattttaacttggctgatctaactgttaattgcttccccaatgataccttttataagagtgaattatag

SEQ ID NO: 2805 - DNA, 537 bp, Glycine max var. Williams 82
atgggaggttgtttttcttctaaaccatcctccacaatcaacaacgttcgtttggttcatctgagtggctatgtggaggattttgagaatccaatttcagtgagccaagtcacaggcaccccttcaaagcactttgtttgtacctcggttcagcttctttcgtcttgctcaaaaccattgaatggagacacacaactccaacctgggaatgtgtacttcatgctaccttattcaatccttcaaactgatgtttctcctgtggacttggcttcccttgcaaagaggctcactgcaatagccaaaactagcaggaggcttgatggcaaaaagtcttccctcaaagatggttctttttcaagcaatgtttggagttcaccttcaaggagtcctggtaggcttggtgtggtggagcaaattggcatgccgtatggagggcgaagcccgtgtcgagtgcggccgtggaagcctatcttggacacaatcagagagaagtctttcaatcgaagaagtgagtcagatttgcaagaacataattga

SEQ ID NO: 2806 - DNA, 1717 bp, Glycine max var. Williams 82
aagcaatgatgaatagtagtatgagacagctgccattttccgccatcaccggtcgcaataccacgtgtcgtttgtcttttctccacagtttttctctcaccgtcttcgcatctgcattttgaattcaaccaaacacgacgcaagcagcagtttagcttgcacacactccctcactccacaccacactggtttctttgttctccagaatcataaaatatgttcagcttcttcatcaggaaaggcgtcagaaagatcctcaagcgcaaagacagcgatgctggccaaaaaggaagagctttggaagacttgagagcttctctctttaatcaattccgttcctctgaaggtgcaaagcgtcaacagcagcgcatatgtggtccagctattgcactttccttcaattttctggttgcagttggtattattttcatgaacaaaatggtgcttcaaactgttcagttcaaattccctatacttcttacactaattcactacgtagtgagctggttcttaatggcaatactaaaagcattttcttttcttccggctgctccttcctcaaaatcaactcgattgtctactttatttactcttggatttgttatgtctctatccactggctttgctaatgtcagcttgaagtataatagcattggtttctatcagatggcaaagattgcagtgacaccatcaatagttttggcagaatttgtattgtatagaaagaaagtttctttcgcaaaggcattagcattaacagtggtatctattggtgttgctgtggcaactgtgactgatcttcagttccatgtatttggtgcttgtgtagcattggcttggattgttcccagtgctgtaaacaaaatcttgtggtctagactgcagcagcaagagaactggactgctttgtcgctaatgtggaaaaccacacctattactttgattttcctggctgctatgttaccctgcctagaccctccaggtgttctctccttcgattggaactttagcaatagtatggtgatttttgcatcagctattcttggattcttgcttcagtggtctggtgctttagcactaggagctacatctgccatctcccacgtcgtcctggggcagtttaagacctgtgtcctccttctaggaaactattatctctttggatccaatcctggcaaaatcagtatctgtggtgcattcacagctattgctggtatgtctgtttacacttacctcaatatgaggcaacaatcaaacaagccatctcctcgacaggcttctgttttgccaaaatctaaacttggcaaagaaaatggcagcacccatgatggacattacggggccgaatctgtctaactaaatgccttgttataacacattaaccaaacatcgtttgttctttctcttgtttctaagattctgatctaaccatcttgggtgcttgtagtgaagtgtcagctataatacacgatcatgagattttctagggtatatgagtctatatttcacatggctgctactgctcttggaaacttggaacaccaactgtatatgaatgatttggtggattccttgctagaactggttttttcttttggcttttatagtaggagctacagctgcattttgttgtaacggagaacagaaattgctatagggcttttatggctttcacaatttgctgcaattagtcattgagcttttattatgacgacca

SEQ ID NO: 2807 - DNA, 1617 bp, Glycine max var. Williams 82
atgcaccccatggaaagtgtcttctctctctctgtagccgccagaactgattttatccaatttctggtgcagtctttgggctgcagttacatttgtctatgggcatatgattccatttcaccaaatcgtttgagcttcttggatggtatctacaatgtaaggaacaaccaagcaagctctagtttggggagtgtgcaggcacaacagcttttcagtcagttccggactttgacatttgatgtcaatgatgaccgtgttcctggactagcttttaggaatcaacgaccctacctagagctccaacaattggaacttctcagattagcatccacagaaatacaaatacaattctttcaggaggcaaggattaagactgctgttttcatggggtgtaacaagggagaaattgagcttggtttcttaaatatgtcccaagttgacattcaaacagcacttaggagtttgtttcctgaagatttttccactagagtacagtcccagcaaattgatcaaaaccctcctacatcatcttcatcttctctgagatcaatatccacaggtagccctgaatactcatcacttatattcagtattccaggcacatctcaaccccactttccacctgagactcttggagcatcatcatcaagagtagagccaacaatgcagccagtgccaaatagtcctcaccaacgagccattgatattcaagcattgacagaagtcccttctctaacccaattccccacaccagaaactgaacatgatgcaatcatgagagcaatcctccatgttatatctccaacaacttcttatcatcatgagcagcagcaccaccaaaacttgccttatagtaataattttcttcctgtggtgcgtcctgatgctagtgctttccagaggtatagacaagacttaggctccaacatggcctcaaatttcagaaggcaaagcctcatgaagaggtctcttgtgttctttagaaacatgaactttatgagaatgagagaacgcgttcaagcaacgtctcgtcccaccaatactcagcttcatcatatgatatcagagaggagaaggcgtgagaagctaaacgagaattttcaagcacttagagcacttcttcctccgggaacaaagaaagacaaagcgtctatactaatagcagcaaaggagacattgaggtctttgatggctgaagttgataaactaagcaacagaaatcagggattgacgtcacttttgccagccaaagaatctacagctgaagaaaccaaggtagctagtttatcaccaaatgaaagattaagtgtcagaatttcacatgtacccgaatcaagcacatcagaagagagaatggtggagttgcaagtgaatgtgagaggacaagtttctcaaactgatttattaatccggttattgaaattcttaaaactggctcaccacgtgagtttggtttccatggacgcaaacactcacattgcagaagggaacaatgcacttcatcaactaaccttcagattgaggattattcagggaagtgaatgggacgagtctgccttcgaggaagcagtaagaagagtagttgctgacttggcacagtaccaaatggaccaataa

SEQ ID NO: 2808 - DNA, 1692 bp, Glycine max var. Williams 82
atgccccgccgtcgttcctggcactcttcgccacccttactgagccctccgctacttatcattctcttccccattgtgatcctcacgctcctcttcctcgccgtgccgccgatcctctccgccgtcacgcgcctcctccgctcggcatcctccgacgtcaagaccagctgggactccctcaacatcctcctcgtcgttttcgccatcctatgcggcgtgttcgccagacgaaacaacgacgacgaacagaccccgaataaccacgtgcaccagcacgacgacgatgccgtttcggatcgaaacgctgcgtttcgtcgtttgcattcggagggacaatcgcagtggttcgggttcgcagaagaaagaaaggtgtatggtaacgatacacctcttaaccagttgcagtcactggataccgggggaaaccggttgaggatgagacgaaacagcagctcttatccagatctgcgccagtgggaaactggcgatgaccggtacaagttccgcttctacgacgatttcgaaattgacaagccgttccgctcgccggctagggagcacttccccgccgtcgaacaccgcaaacggtggccggaatcaccacaaccacaacaacatcaacatcaatatcaacaacaagaagatcaagttaaggacattccggttgataccttcgaaattcgtccttctccgccgccggtgaagtcaacttcaccacctccgccgccaccaccacctcctcctccgccagaatctgctcgacacaatacgcgacggacgcatcggaaagtagagagagagcgagagagtgagataactgttgagctcgacgatcacgagttcacgacgatccgctctccgccgccggctcctccgacgccgccgcagcctccgtcggtgaagacacgatcggagcgcaagagtgatcgaaggaagagcaccgtgaagagagagatggcgatgatttgggcttcagttctctccaatcagagaaagaaaaagaagaaacaaaagacaaagaataatgaaaatcaggatccgcaatacgatgataatgccgatgaattaacgaataacacgacagtgccaccacctccaccgccacctccgcctctgccttcagtgtttcacagtctattccgaaaaggactaggcaagagcaagaaaatccactcggtgtcggcgccacctccgccgccgcctcctccgccgtctaaacgcaagagccagacccctccaccgccggagcctcctcagcggagaaactccggccgtccacctctccctaacagaacggtcaccttcaacgacgagactctaaacgccggcaaccagtcgccgttaattccagttccaccgccgccgccaccgtttaagatgaaggcgatgaagttcgtagttcgcggagatttcgttaagatacgtagcaaccaaagctcgcggtgtagctctccagaacgcgaggacattattaatgcgtcggaaactacaatcaataacgacgccgttactgacgccgtcaatgacaccgttaacgacagcgttatggatcccaacgttttctgtcccagccccgatgtgaatgcgaaagccgcaacgttcattgctcggctcaggggagaatggaggctcgaaaagcttaactcgttgaaggagaaagacaataatggttcattgccttgtagcttgtaa

SEQ ID NO: 2809 - DNA, 1266 bp, Glycine max var. Williams 82
atggatacaaagtttgcacgaaggactgagcgcattggtagaacaacatgttcttattggagagctggaagatgtaacagaaatccttgcagatttttgcacatagagacaccatctccacctgctgcttgtggttatggcaatactgcatatagctacggaaaaaagccccattccttctctgagaataccctgaaatatggttcaaagaaagcattgcttagagataatggagatagaggagatgcgacaagggttgctaaggctttcaagaaatcatcaccaaggatatgtaaatactggatcaacaacaattgtgtacatggtgaacaatgcctgtatctgcattcatggtttcgtggtgatgggttttccaccgtaacgaaacttcaagaacataagaaggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctgctgcagaggatggtgtcatttttgcttggagaggaagctctaaatctgattctccttttgaactggttgcgtcactcactggccacactaaagcagtggtttgtctggcggttggatgcaagatgctgtactccgggtccatggaccaaagcataaaggtctgggacatggatacattacagtgtacaatgacactaaatgatcatactgacgtagtcacatcccttatctgttgggatcaatatctgttgtcaagttcatctgaccgcacaattaaagtctgggcttgcattgaagcaggatctttggaagtgatatatacacacaccgaagaaaatggtgttgtttcactttttgggatgcctgatgcagagggaaagccaatattattttcctcgtgcagagacaattcagttcacatgtatgaattgccatcattttcagagaggggacgtttatttgccaagaaagatgtggcattaattgagttaggtcctggtggcctcttcttcactggagatgagagtggtttgctgatggtgtggaaatggttggaggtacccaaggtggcatcctcttga

SEQ ID NO: 2810 - DNA, 219 bp, Glycine max var. Williams 82
atgagtatttctttctcaaacttaattgacaagtatgttttacatttctacaaagacaatatgctccttgcctattgcatttgtcatactttctcaattattatgctttctatcattcttattgtgcttatgaattatcgtttgccatacataccattgaagctcttgaaagatgctgaaattggagatgctgcaattgggaaagctcagtctacatga

SEQ ID NO: 2811 - DNA, 1195 bp, Glycine max var. Williams 82
tttaacgactcgtaacatctattatagcatcgggactcagatcgagtctttcgtattatcttccctctcttttaattctgttcatgttttcaatgtaccgggactcttaaaatacaacttgcatcgggactcttaatgcacgcgtatcactctctaactcacgcacaaattaaccaatattgattctccaacaatttcattcccaattcggtttcttttgactgataatgcaggttgacacctaagataccatatctggcaatatccatggaaaacttgatagttgtttaaggagtaagtgcaggcttttctttgagttacttatgaagttcatcttatgagtatttctttctcaaacttaattgacaagtatgttttacatttctacaaagacaatatgctccttgcctattgcatttgtcatactttctcaattattatgctttctatcattcttattgtgcttatgaattatcgtttgccatacataccattgaagctcttgaaagatgctgaaattggagatgctgcaattgggaaagctcagtctacatgaaatctttttgcttgcttcctctcggtgaattttctatatttgaatttgcatcttacaaaagcatacttatcttttaaatgagttttccctattgttgaggatgagtttgtgcacgttttgggcgaggaagcagattgggtccatattataatctggaccttatgtctgaaattcgaattgggaaacaaaattgattttctatactatgtaccatccttatctctgaaattgagtaaccactgttatacttgaaattgaaaaaatgacaaggatttgtgagaaggtaccttttgtgagagaacatcatctagatgttaattaacgtaacttaacaatgtttaattaaatttttagaatatggttgttgaattaagatacctatgatgaaataccctaaaactctgcttataatgcctgatatcggttgaggcaacaaagaattttgtagcgtaccgagagctttgcttattttatctttaaatttaatcattcttatatagtagcagttccgagagctttgcttttttaattttaaaagtttgaagtaattggcataagtcctggtcgtgagcgttgggaacaattggcatgataaaaaaatttcaataccagctttgtgttaatagaagggacataaca

SEQ ID NO: 2812 - DNA, 642 bp, Glycine max var. Williams 82
atgaagaagatgattctaaccctcttcttcaatatcattttatctctcctctccctctcccacgcctccgtggtggatttctgcgtagcagactacacaggccccaatggccccgcagggtactcatgcaagagcccagcaaaggtcacggtggacgacttcgtctactccggccttggcaccgccggcaacacctcaaacatcatcaaagccgcggtgacgccggcgttcgacgcgcaattccccggcgtcaacgggcttggaatctccattgcacgcctagacctagcagccggtggagtcatccctcttcacacgcaccctggtgcctcagagctgctggtggttgtgcagggaacaatctgcaccggcttcgttgcttcggacaacactgtgtacctcaaaaccctaaaaaagggtgatgtcatggtgtaccctcagggcttgttgcacttccagatcaacgatggagagtctcaggctttggcttttgtgagcttcagcagtgctaaccctggcctccagattctggacttttctttgttcaagagtgatttccccactgagcttatcacgcaaaccactttcattgatgctgcagttgtcaagaagctcaagggtgttcttggagggtcaggttaa

SEQ ID NO: 2813 - DNA, 1377 bp, Glycine max var. Williams 82
atgacccttatgaaaaccctatggaaatcaatcttccccggttgttacaagggtgaatatccctctccaaagccaaagaaagtggtggctacaaagccaaattcttcacacagaatttctgtgacggatttgagttatccaagcacgactctttcggaggatctgtcaatttctctagcgggaaccaacctccatgttttctcactcgctgagctcaagattattactcaacaattctcttctagcaattttcttggagaaggtgggttcggacccgtgcataaggggttcattgatgacaagcttaggcatggcctcaaggctcaaccggtggctgttaagctcttggacttggatggctcgcagggccacaaagagtggttgactgaagttgtttttctggggcaactaaggcatccacatctcgtgaagctgataggatactgctgtgaagaagaacacagggttttagtatatgaatatttaccaagaggaagcttggagaatcaattatttagaagattctcggcatcactttcatggtcaacgagaatgaaaattgctgttggagctgcgaagggtttagcatttcttcatgaagctgagaagccagtcatctatagagatttcaaagcttccaacatcttgttaggctctgattacaatgcaaagctatctgattttgggttggcaaaagacggtcccgaaggagatgatactcacgtttcaacccgagttatgggtacacacggctacgcagctccagaatatatcatgacaggtcacttgacagcaatgagtgacgtgtatagttttggagtagtgctgttggagctgctaacagggagaaggtcagtggacaaaaatcgccctccaagggagcaaaacctagtggagtgggcaaggccaatgctaaatgactctaggaaactcagcagaataatggatcctagacttgaaggccaatattctgaaatggggacaaaaaaagcagcagcattggcttaccaatgcctcagccacagaccaaggagcagaccctcaatgagcacagtggtcaagacccttgagccactccaagattttgatgacattccaattggaacatttgtttacacagctccaccggataataatgaaatgcatagtgcaaaggatcaatgtgagacacctaagaggagggaaaataataataacaatggtcaccttcataggaatggccacaggcatcatccacttaaatcccccaagacccctaggccacaatcacaatcacaatcacgttcaaatgatcacaaacaccgaaatggaagaggaagtggatcaaattctcctccatcacatgggaaaattaggcaaggagttcttgcctattag

SEQ ID NO: 2814 - DNA, 612 bp, Glycine max var. Williams 82
atgaatgtgttggattctaatgtggaggctctagccttcaactacttgagcttcggcttgctcacagccctcaacaacttgtggacctggctcgctctcttaaccgccgccttcagcttctggaagattcgctccacgggctgtctcaagcccgagcccaagcccgaggcccaagtccaggcccaaccttccatcaggcccgaccgggttgcggatttgttaacggtggagaaaacggagccgacgcaacaagatgcagtgttggttcctttttctccatcgttattgcaaggagaaaacggcgcgaggaaggggaagcttaccgtttattacgagaaggacatggacatgcaatgcacgtgcggcgagcgtgaggggttgttaacggcgtgggaagagaaagaggggaccgaaacggagtggtggaagaggtgggagaggttgttgcggttgagaaacggggagaacgagaacgggtggtacacgtggcaggacttgacagagcttaacggcaacgtcgttaggttttgggactgtgggttaagtggttctttcgtcagggaatcgtggtacaactccaattccaactccagctgtatccatgtctggtaa

SEQ ID NO: 2815 - DNA, 1212 bp, Glycine max var. Williams 82
atggcaaagcaaaattttcctatggattgctcctttgtctgcataaccttaatccagttcattgcttcaatgagtttcagcaaatcccagagcctcataaacgaaactaataccagcacaactaccactactactaaggcctttttcatattaggtgactctactgtagattctggcaacaacaactacataaacactattcctgagaacaaagcagattacaagccatatggacaaaatggtttttttcaagaacccactggacgattctcagatggccgtgtcattgtagatttcatagctgaatatgctaatctgccactaattcctccgtttttacaaccaaatgctgattatagtaacggtgccaactttgcttctggtggggccggtgttcttgttgaaaccaatcagggactggtgattgaccttcaaacacaattaagtcactttgaagaagtgagaatattattatcagaaaagcttggagagaagaaggcaaaggaattgatctcagaagcaatttatttctttagcataggaagcaacgattacatgggtggttatctaggtaacccgaaaatgcaagaaagctacaatcctgaacaatatattagaatggtcattggaaacttgacacaggcaatccaaactctatatgagaaaggggctagaaagtttgggttcttaagtttgtctcctttgggttgtttgccagctcttagagctttaaacccggaagccaacaaagatggttgttttgaagcagcttctgctcttgctctagcacataataatgctttgagtaatgtcctcacaagcctcgagcatgtccttgaaggattcatgtactctaactctaatttctatgattggcttcgagaaagaatagatgaccccccaaattatggttttaacgatggagttaatgcttgctgtggaagtggaccttatgggggtgtcttcacttgtgggggtacaaagaaaattaaagagttcagtttatgtgacaatgttggcgattttgtatggtgggattcttttcacccaacagagaagatccatgagcaattcgctaaggcgttatggaatggaccagcttcctcggtagggccatacaatttagaaaacttcttcaacaaagagatcaagctcactattgctgatgtagttgatgccccagaaattcaccatggagaatttcactactga

SEQ ID NO: 2816 - DNA, 1424 bp, Glycine max var. Williams 82
acaagatggcaaagcaaaattttcctatggattgctcctttgtctgcataaccttaatccagttcattgcttcaatgagtttcagcaaatcccagagcctcataaacgaaactaataccagcacaactaccactactactaaggcctttttcatattaggtgactctactgtagattctggcaacaacaactacataaacactattcctgagaacaaagcagattacaagccatatggacaaaatggtttttttcaagaacccactggacgattctcagatggccgtgtcattgtagatttcatagctgaatatgctaatctgccactaattcctccgtttttacaaccaaatgctgattatagtaacggtgccaactttgcttctggtggggccggtgttcttgttgaaaccaatcagggactggtgattgaccttcaaacacaattaagtcactttgaagaagtgagaatattattatcagaaaagcttggagagaagaaggcaaaggaattgatctcagaagcaatttatttctttagcataggaagcaacgattacatgggtggttatctaggtaacccgaaaatgcaagaaagctacaatcctgaacaatatattagaatggtcattggaaacttgacacaggcaatccaaactctatatgagaaaggggctagaaagtttgggttcttaagtttgtctcctttgggttgtttgccagctcttagagctttaaacccggaagccaacaaagatggttgttttgaagcagcttctgctcttgctctagcacataataatgctttgagtaatgtcctcacaagcctcgagcatgtccttgaaggattcatgtactctaactctaatttctatgattggcttcgagaaagaatagatgaccccccaaattatggttttaacgatggagttaatgcttgctgtggaagtggaccttatgggggtgtcttcacttgtgggggtacaaagaaaattaaagagttcagtttatgtgacaatgttggcgattttgtatggtgggattcttttcacccaacagagaagatccatgagcaattcgctaaggcgttatggaatggaccagcttcctcggtagggccatacaatttagaaaacttcttcaacaaagagatcaagctcactattgctgatgtagttgatgccccagaaattcaccatggagaatttcactactgagtttattttaaaaaagaaacaataaaagttaaaataacattagaaattttgaatatttgtatgttatatacaaattcaaaatatgagcaaagtgtgtgactttagtgtttagtgcgaatcctggcgctttaagcaccaaatcttcgaactttaagtgctttgctttcctgtataaaaacagcaaaaacataggtaaaaatgaggact

SEQ ID NO: 2817 - DNA, 561 bp, Glycine max var. Williams 82
atggaggaagttaatgtggttcaaaccaagaatggaactgttgcagtagcttctgcgtttgctggacataaggaagctatacagcaaagggaccacaaatttttaagaattgctgttgaagaagcctataaaggggtagactgtgaagatgggggtccctttggtgctattatagtatgtaatgatgaaatagttgctcgatgtcacaacatggttctgaggaacacagaccctactgctcatgcagaagtcactgttataagaaaggcttgtgaaaagttaaaccagatagaactttcagactgtgaaatatatgcttcttgtgaaccttgccctatgtgctttggagcaattcacctctcacgagttaagaggttggtttatggagcaaaggcagaggcagcaattgctattggattcgatgacttcatttcagatgcattgcgaggcactggattctaccagaaagcacaattggagattaaaagggctgatggcaaagcggcaaacattgctgaagaagtttttgagagaaccaaggaaaaattccgaatgtattaa

SEQ ID NO: 2818 - DNA, 1088 bp, Glycine max var. Williams 82
tctgcattcatcgtggattacattttctctctcatggtcatcatccacttggagtcttgatcttgtacttcattgccatcacctatgtactactatatatagcccaacaaagtcgttgatttatcagagttcacacaaggtagtttcagttaagtgtaccaagttaataggtctttatatttagttgttgacatcaacaaagtcatggaggaagttaatgtggttcaaaccaagaatggaactgttgcagtagcttctgcgtttgctggacataaggaagctatacagcaaagggaccacaaatttttaagaattgctgttgaagaagcctataaaggggtagactgtgaagatgggggtccctttggtgctattatagtatgtaatgatgaaatagttgctcgatgtcacaacatggttctgaggaacacagaccctactgctcatgcagaagtcactgttataagaaaggcttgtgaaaagttaaaccagatagaactttcagactgtgaaatatatgcttcttgtgaaccttgccctatgtgctttggagcaattcacctctcacgagttaagaggttggtttatggagcaaaggcagaggcagcaattgctattggattcgatgacttcatttcagatgcattgcgaggcactggattctaccagaaagcacaattggagattaaaagggctgatggcaaagcggcaaacattgctgaagaagtttttgagagaaccaaggaaaaattccgaatgtattaattgaatctccatgtttcctaagccgttaggtatttacacctgatgaaatctgagttcacataaataagctcattgctctcgtgtatcctaaatcctaatgaataaattgtatggggagaagagaatcaaagtgaaatttactttgtgatatttgatgtcattctcatgttaaatccttgtaatgatcgtaaatattgaatggggttttatattttaagacattaaatttattaaagttttcatttaatatctttttaagaggatttatatgaatttgtaagtggatacactattaacttttatacgcatatgatgctaaagaa

SEQ ID NO: 2819 - DNA, 915 bp, Glycine max var. Williams 82
aaaaatcttttctatttcactccctctaattttcctctctctcccaatggttcaaaccaagaatggaactgttgcagtagcttctgcgtttgctggacataaggaagctatacagcaaagggaccacaaatttttaagaattgctgttgaagaagcctataaaggggtagactgtgaagatgggggtccctttggtgctattatagtatgtaatgatgaaatagttgctcgatgtcacaacatggttctgaggaacacagaccctactgctcatgcagaagtcactgttataagaaaggcttgtgaaaagttaaaccagatagaactttcagactgtgaaatatatgcttcttgtgaaccttgccctatgtgctttggagcaattcacctctcacgagttaagaggttggtttatggagcaaaggcagaggcagcaattgctattggattcgatgacttcatttcagatgcattgcgaggcactggattctaccagaaagcacaattggagattaaaagggctgatggcaaagcggcaaacattgctgaagaagtttttgagagaaccaaggaaaaattccgaatgtattaattgaatctccatgtttcctaagccgttaggtatttacacctgatgaaatctgagttcacataaataagctcattgctctcgtgtatcctaaatcctaatgaataaattgtatggggagaagagaatcaaagtgaaatttactttgtgatatttgatgtcattctcatgttaaatccttgtaatgatcgtaaatattgaatggggttttatattttaagacattaaatttattaaagttttcatttaatatctttttaagaggatttatatgaatttgtaagtggatacactattaacttttatacgcatatgatgctaaagaa

SEQ ID NO: 2820 - DNA, 390 bp, Glycine max var. Williams 82
atggcaaccactgtgatgaccactctcccccaattcagtggtcttagaccccaattctcagctgcccctgtgaagaacttggttgctgtgcaacccatgagtcgcaaggggaagggtgcattgggagctcgatgtgactacattggttcatccactaatctgattatggtggcttctacaaccctgatgctgtttgctggaaggtttggattggctccatcagcaaacaggaaagccactgcagggctaaagctggaggtgagggactcaggcttgcagactggtgaccctgctggcttcacccttgctgacaccttggcctgtggatctgttggccacatcattggggttggggttgttcttggtctcaagaacattggtgccctgtaa

SEQ ID NO: 2821 - DNA, 1739 bp, Glycine max var. Williams 82
tgtgaataaataaaaattaatgggccagatagagagagaggttccagagtagaggaaaggcgtctaagaaaggaacattccccactaaaacatcttcctaaacttgattcaagtcacgtcacttgcattgaaagagtgtgtggtcttggtctgaacccaagaggtattcgacctccaaagctacaaatgaattcgataaacttggtcatagatcttccaaaacagatttgagagatgtggactttattatagaggattaagaactcaagtgctggttaaacttcaccaagatgattctttggtcagtgcagaactagttccctaagaatgaaaggaaaaccctcaaaagttttctattccaaattcaaactcaatcaaaactgttgttttaggtataaagaggttatttacaatctagagaagtgctagcaatacactctttctaacacactgtggggcaaaggcagatctatggtcatgtggtgttattctctttgttttaatggctggctatttgccctttgaagaaaccaatctatcagctttatataaaaagattttcaaggccgagttcatgtctcctccatggttctcttcaagtgcaaagaagctaatcaacaaaatccttgatcccaatcctgccactcggattacatttgctgaggtcattgagaatgactggttcaagaagggatataagccacccgtatttgaacaggctaatattagtcttgatgatgtagattctattttcagtaattctacggattcacaaaatcttgttatagagaggcgcgaagaggggcccatggcacctgtggcacctgtgactatgaacgcctttgagcttatctctaaatctcagggcctcaatcttagtagtctttttgagaagcaaatgggactagttaaaagggaaacacggttcacatccaaatgttcagcagatgaaataatttcaaaaattgagaaagctgcaggacccctgggttttgatgttaagaagaacaactgtaagttaaagattgaaggcgaaaagactggacgcaaaggtcatctatctgtagccactgagatcttagaggttgccccttcactatacatggttgagctgcgtaagtctgaaggagatactctcgaatttcacaagtggtttcagagtagccagccatggacaccatcctagtttcctatattgtcacctgcttccaccagttagtgaatgttgtcagctattatagcgagagaaatgttgggaacatactcttttaaatattctatactattggtatattattggttaaatttgttgaaaatcataaaaaattgagtcctatttcttatttaaggagtcttttataattttgtagttttcaataaatttttaacccattagagtgtgtgttgctagcactcttattatatcaataaaaccaatacaatataaaactccattcaacttagttgaaatggtcaaaaagtgtctcctttcccacaggtgttcttgcaaaacatttttgggaaatgctaggtgcacccaacaatattgctggtgcacccaacaatttattgaatgggccattttgcccttcattaaaaaagttaaataaaacatttaaaaagttttccctctcctctcccgaaatcattcatgccttcttcttgcttctgcttttcttccctcttccgcgagcctgcgttttctcctctccgcgagcccgactgctgcttgtttcgct

SEQ ID NO: 2822 - DNA, 1407 bp, Glycine max var. Williams 82
atgatgtctaagaaaactgtcaaagaatctatgttcacaacatggatggaagcaaacaagatttacccacatgatagaaaactaacataccctcaatatgtgtctagctttgtgtatgtggctcgcaatagatgttggaagccaagaaaacaaggatatacaattgggcatctaatatggataccaccatctactggtgagctattcttcgtgagaatgattctttttgttgcaaaaggaccaaccagttatgatgaaatcagaaaaattgatggacaactcatagatgaagaggtgcaacatagatgtttgtgtcgaattgaggaccttttacaaggaaatggtaaaagtctcagtagtttttctgccatgccttatccaatagattatgccccagagcatgttgatgagaaaaatgatatatttcataaaataatgaatgttgttgaagcacaatatggtggagttttcttcctttatggatatggaggtactggaaagactttcatgtggaaaacattggcatcgacaatccgatcaataggtgacattatgttgactgttgcttcaagtggtattgcctctcttttgctacctggaagaagaactgcacattcaaaatttgtcattcctgtacttgcaattgcaaatacaaattcaaatcatttaccattcggtggtaaattagttgtctttggtggtgacttctgtcagattcttccagttgtacctaagggcaatagatctaatatagaccatgcagctataaattcttcttatctttggaatcactgtcaggttttgaggagatggtatacttgtgagcctaatgatggatatgttgaaataactattccagatgaatttctcataaatgattacaataatcctttagaggaaattgtgaacagaacatatcctaatttgctacagttctacaacaatcctgagtacttacaatcaagatccatacttgcctctacaattgaagttgttgataaaaaagaatattacagtgctgatagtatcaacaaatcagatgcacttcaaaatctaacatctgaaacagtcactccagaatttctaaactcacttaacacatcaaaagacggaaagatcatttccacgaagaacattggccataaaacatatattccaaggatgaatatgtctccttcagaatcaccatggcattttaaattgattagaaggcaatttcctttcatggtttcatttgctatgagcataaacaaatctcaaggacaatctttgttagatgttatttatgtggcactatctagagtgcagagtaaacaaggattacgcattttaattcttgatcaacaaggcaagccttgcaataccactattaacatgggatacaaagacgtttttcaaaacctttag

SEQ ID NO: 2823 - DNA, 573 bp, Glycine max var. Williams 82
atggcggctgcttctagaagatcaagcgggccagtcctccgaacactctcgccggcgggaaggtttcgcaattcccggccatcgccggcgaccaccgccttcgcgtcctcaacttcaaccttctccgcacgctccaccgctttcttccagaaccgttccagctctcccacacgtgacaatctatacggttcttcttccggttcggttccctccgtccggttcggttcaattaccccgaactcttccatctccgtcgcgggtgccggcaggcatagccaccaccagaagcggacctgcatgtgctcgccgacgtcgcatcccggttcgttccggtgcagccttcacaagagcttcggctcgcgctcggcagtggcggcggcgtcgcctaaccggctgaacgcgcggcggtcggcgatgacgaactcgctcgtgagaatccgcggcgtcgaaggcgaattggtgaagcgagccttggcggcgctgatccggccgtcgtcgcaccaacagcgccgccgcggcgattttcggccgcggccgagcagactctctatcatgttcacagcaaaagattaa

SEQ ID NO: 2824 - DNA, 336 bp, Glycine max var. Williams 82
atggccgccgccgcagatgggctcttccggccgatctacgagggctgcatctccgcctacgacaacgacgtcgagcgccgcccctaccacaagaactgcggctgcgctctgcacagcaagtcgaggaggaacagcagagcgtgcacgcacaagttgccgaaatgcaacaacgtgtcctaccccatgaggagggcttggagtgaagggagcttgtcaatggcttcggcaacaacttccgcgcattcctctccttcttcttctcccgccgctgggttcaggcctcaacacgacgaagagggaaatagtaacaaattaggagttttatttgagatgtga

SEQ ID NO: 2825 - DNA, 1566 bp, Glycine max var. Williams 82
atggacttagttctaaacaccacaacaattggagttggtgttgtttctctgatcctcttatacttgtttttgtgtcgtcgttcctcgaagagtggcgaagagggtcctcccacagttgcaggtgcgtggccaataattggtcacctcccattgttgcttggttcaaagacacctcataaaacattgggtgacttggctgacaagtatggacccatattctccatcaagcttggtgcaaaaaatgctgtggtgattagcaactgggaaatggctaaagaatgctataccacaaacgacatcgccgtttcctccctccccaatcttatctctgctaacctcttgtgctacaaccgatccatgatactcgtagcaccctacggtccctattggcgccaaatgcgaaagattttaatgtcggagttcctatctccttcccgagtagagcaactacaccatgttcgcgtctctgaagttcaaaattcgatcacggacctcttcggtgcttggcgtagcaataagaatgttgagtccggctgtgccctggtggagttgaagcaatggttctctcttctggtgttcaacatgattctgcggatggtctgtgggaagcgctatttcagcgctaccacttcggatgatgagaaggcaaagagatgcgtgaaggctgtggatgagttcgtgcgtctcgccgccacgttcacggtgggagataccattccttatctgagatggtttgactttggtggctatgagaaggatatgagagaaactgggaaggaattggacgagattattggtgagtggttagaggagcatcgacaaaaaagaaaaatgggtgagaacgttcaagacttcatgaacgtgttgctttccttgcttgaaggaaaaactattgagggcatgaatgttgatatcgtcatcaaatcctttgtattgacaataattcaagcagcaaccgaggcaagcattacgactcttgtatgggcaacaagtttgatattgaataatccaagtgtactagaaaaacttaaagccgaactagacatccaagttggaaaagagagatacatatgtgagtctgatttaagtaagttaacatatcttcaagctgtagtcaaagaaactttaagattgtaccctccaggtcctctctcaagacctcgtgagtttgaagaggattgcactataggtggctacactgtaaaaaagggaactcgtctaattacaaatctttccaagatccacacagatcataatgtttggtcaaatccattagagtttaaaccagaaaggtttcttaccactgataaagatattgacatgaagggtcaacattttcagctattaccatttggaagtggtaggaggatttgtcctggagtaaacttaggccttcaaacagttcatttgacacttgctagttttttgcattcctttgaaatcttaaatccatcaactgaacctcttgatatgactgaagtctttggagtaaccaactctaaagccacttcacttgagattcttattaaaccacgtctatctcctagttgttatgaaagtatgtaa

SEQ ID NO: 2826 - DNA, 1098 bp, Glycine max var. Williams 82
atggccaactcgaagaacaatttaattctagtttccactctccttatgttgcttcaactccacttcaccccatcaaaagccgccatcaaaggaggctactggtactccgaaagtggccttgcagtttccaacattaacccctctcatttcacccacctcttctgtgcatttgcccacctcgaccccaacaccaacaaagtcaccatttcctcgtcagactcatctcagttctcaaccttcactcaaaccctccaagcaaagaacccttcagtgaagacccttttgtccataggcggcggtttcggtccttctttggctgcaaatttctccagaatggcaagacaagccaacaccagaaaatcattcatagactcttcgatccaacaagccagatcgaacaacttcctcggacttgacctagattgggagtacccttcctcggacacagacaagaccaactttgcatcactcatcaaggagtggaaagaagctgtgaccaaagagtctagaacctctggaaaggcaccactgttcttatctgctgctgtggctggctctgaccagatcacacctttaaaatactacccaggaaaagacgtagccaacaacttggactttgtcaatgttatggcctatgaccttttcacctcagaagggtaccccacagtgacacagccacctgctccttggaacaaccctagaggccaattcagtgcagaacaaggggtcacggaatggaacaaaactttaggggtgcccttaaacaaactgaatctgggtttgcccttttatggttacaagtggagtttgtcagattctaataaaaatggactctttgcaccggccaagcagggacttggggcagtgaagtacaaggatatcaagaatgttgcggcgcaggttgtgtttgattccacttatgttaccaattactgcttcaaagggaccgattggtttggctatgacgacactcagagtatatctgcaaaggttgttaatgcaaaacaaaagggattggttggatattttgcttggcatattgaacaagatagcaactgggctctttctcaagccgcttctcaagcatggggaatgtag

SEQ ID NO: 2827 - DNA, 1461 bp, Glycine max var. Williams 82
ggcacaaagaaaatggccaactcgaagaacaatttaattctagtttccactctccttatgttgcttcaactccacttcaccccatcaaaagccgccatcaaaggaggctactggtactccgaaagtggccttgcagtttccaacattaacccctctcatttcacccacctcttctgtgcatttgcccacctcgaccccaacaccaacaaagtcaccatttcctcgtcagactcatctcagttctcaaccttcactcaaaccctccaagcaaagaacccttcagtgaagacccttttgtccataggcggcggtttcggtccttctttggctgcaaatttctccagaatggcaagacaagccaacaccagaaaatcattcatagactcttcgatccaacaagccagatcgaacaacttcctcggacttgacctagattgggagtacccttcctcggacacagacaagaccaactttgcatcactcatcaaggagtggaaagaagctgtgaccaaagagtctagaacctctggaaaggcaccactgttcttatctgctgctgtggctggctctgaccagatcacacctttaaaatactacccaggaaaagacgtagccaacaacttggactttgtcaatgttatggcctatgaccttttcacctcagaagggtaccccacagtgacacagccacctgctccttggaacaaccctagaggccaattcagtgcagaacaaggggtcacggaatggaacaaaactttaggggtgcccttaaacaaactgaatctgggtttgcccttttatggttacaagtggagtttgtcagattctaataaaaatggactctttgcaccggccaagcagggacttggggcagtgaagtacaaggatatcaagaatgttgcggcgcaggttgtgtttgattccacttatgttaccaattactgcttcaaagggaccgattggtttggctatgacgacactcagagtatatctgcaaaggttgttaatgcaaaacaaaagggattggttggatattttgcttggcatattgaacaagatagcaactgggctctttctcaagccgcttctcaagcatggggaatgtagctatggatttcggacacagacagctaataaattgaacttaacaaataaaactgtattacaatctgcgtgcgcagtacattcataaatatgaaataaacttcaatctcagctatatgatatcaatgggttttatcttttgcaggctgtggttcattgttgacttcggtaccgaaaaatattttggtagatataattacgatgacagctaacttactttatgatcatactagttgataaccgtgttgataaccatgcatatgtatgggtcacttgtaatttattctatacaaattttaatttattcaataaaatagaataaaaataaacacaaatatgtgtaatattaataat

SEQ ID NO: 2828 - DNA, 810 bp, Glycine max var. Williams 82
atggctagtgtttcttcggtttcagctccatttagaaggcttgaggggaaggtggcgattatcactggtggtgcgagtggtctaggtgcagccactgcaagactcttctctaagcatggagcacatgtagtcatagctgatattcaagacgacttgggtctctctgttgccaaagagttagaatccgcttcctatgtccattgcgatgccacaaacgaaaacgacgttgaaaactgtgtgaacacagcggtttccaagtatggcaaactcgatatcatgtttaataatgctggcataattgatgagatcaaaacaagcatagttgacaacagcaagtctgattttgagagagtgataggtgttaacttggttggtccttttctgggaacaaagcatgctgcaagggtcatgattcctgctaaaaagggatgcataatcaacacagctagtgttgctggatgcataggtggaggtgctacacatgcctacacaagttcaaagcacgcactaattgggctgacaaaaaacactgcggtggagcttggacaacatggtattagggtaaattgtttgtctccttatcttgttgtcacaccattaagtaagaaatatttcaatattgatgaagacaaaattcgtgagatatattcaaacctaaaaggtgctcatcttgtgcctaacgatgtggccgaagctgctctttacttggcaggtgatgagtccaagtatgttagtggtcacaatcttgtgatagatggagggtacactgatgtaaatgcaggatttaccgtgtttgggcagtctcagtaa

SEQ ID NO: 2829 - DNA, 621 bp, Glycine max var. Williams 82
atgtcaatgaagttgtacgcttcccttacctttgtggtgtggcttttcatggccacatcgtccctagcccaatacgttctcgacacaaaccgcgaacgcgtcgacagcgatgatgagtactacatccggccagccataacggacaacggagggcgtttcacattgatcaacagaaacaggtcgtgtcctttgtacgttggtctcgaaaacaccgacacgccactaggctatcctgtgaaattcacccctttttcccgcaacaacaacgatgatgacgacgacgacataagggtgaatagggacctcagagtggcgttcgatgaagtttccacaacgtgtgtgcaatccacagaatggagagtgggtgagaacgacacgaggagtggaaggaggcttattatcactggccgagacgaaaccacgggatcatacggtaactattttagaattgtggaaacagaaaatgttggtatctataacattcagtggtgccctaccgaagtgtgccccacttgtagattcatttgtggcactggtggtattctgagggagaatggaaggattttgtttgccttggatggtactcctctcccagttatgttccagaaaaaagatgattga

SEQ ID NO: 2830 - DNA, 2421 bp, Glycine max var. Williams 82
atggtgtgttataaactgggggaatctcatttcttgcttgttttaacatgcttgtggttgtggttgtggtggagtactcgtatccacgttattgctgcatatcacagtttgaggcccggtgatactctgaattccacaaccgaactgtgttctgaaaacgataaatattgcttgggtttttcccaatttagttctgctcataacagcacttatttgcggatatacgccaaaggaaaaggtgactggaacatgtggattggtaatagaaaccaaccacttgacatggattccgcagttctgtcgctgagccactctggagtactgaaaatagaatccaaagacatggaacctatcatcctttactcttcaacgcagccgtcgaacaacactgtggccacgttgatgaacacgagcaattttgtgttgcaacgccttcaacccggtgggactgagagtactgtgttgtggcaaagttttgattatcctactgataagttgctccctgggatgaagttaggagtcaatcacaaaactggtcgcaattggtctctagtttcgtcaatgggttatgctaacccagctcttggggcattcaggcttgaatgggaacccagaagaagagaattactcatcaagcaacgaggacaattgtgttggacaagtggagaactcggaaaaaacataggattcatgcacaacacgcattacatgattgtctcaaacgacgacgaaagctacttcacaattacaactttgaatgaagagttaacaagatgggagctattaaaaactgggcagttgattaataggaatggagatgacaatgttgcaagggctgatatgtgttatgggtacaacacagatggagggtgccaaaaatgggaggacatacccttctgcagaaatcctggtgatgcatttgaactcaaagaagtttacctcaatttaaacctgaaaaattttctggctaattcgagttatagcccgagtgattgccgggatacttgctggaaaaattgtagttgtgatggattcacagattattacgatgatggaactggctgtatattcgtgtatttaaatttaacagaaggtgctgattttgcaagtgggggcgaaaaattttacatattggtaaagaacacccatcacaaaggtacaaaaaagtggatatggataagtattctaatagtagctgctctattttcaatatgtgctttcattctgtatctggccttaaagaaaagaaaacttcggtttgaagataaaaacagaaaagaaatggaaattaataagatggaagatttagcaacttcaaatagattctacgatgccagagatcctgaagatgagttcaagaagagacaagatctaaaagtatttagctacacatcagttctgttagcatccaatgatttttcaactgaaaacaagttaggacaaggaggatttggacctgtttataagggaatccaaccaaatgggcaagaagttgccataaaaagactttctaaaacatcttcacaaggaactgcggaattcaaaaatgaactaatgcttataggtgagcttcagcacatgaatcttgtacaactacttggatactgcattcacggcgaagagaggattctaatttacgagtatatgcataacaaaagcttggatttctatttatttgatggtactagaagcaagctactagactggaagaagcgtttcaacataatagaaggaatttctcaaggattactctatcttcacaagtactcaagactgaaagtcattcacagagacttaaaagctagtaatatacttcttgatgagaatatgaaccccaaaatttctgattttggattagcaagaatgtttacacgacaagaatccacaactaacactagtaggattgttggcacctatggttacatgtctcctgaatatgccatggaaggagttttctctgtaaagtctgatgtgtatagctttggagtcttactacttgaaattgttagtggaagaagaaacactagcttctacgatggtgaccgctttctaaatctaataggacatgcatgggagttatggaatgaaggtgcatgtctaaaattaattgatccatctctaactgagtcacctgatcttgatgaagtgcaaagatgtattcatattggtctcttatgtgtagaacaaaatgcaaataatcgacccttaatgtcacaaatcatatcaatgttatcaaacaagaatccaattaccttacctcaaagaccagcattctattttggaagcgagacctttgatgggataatatcttctacagagttttgtacggattcaacgaaagcaataaccacttccagagaaatagaatcaagtgaacatcaatggggagaagaagcacgaaaccaactccatttctcttaa

SEQ ID NO: 2831 - DNA, 2733 bp, Glycine max var. Williams 82
gtgcacagcacgctattcctaactggtagactatcattccacattgaagatggtgtgttataaactgggggaatctcatttcttgcttgttttaacatgcttgtggttgtggttgtggtggagtactcgtatccacgttattgctgcatatcacagtttgaggcccggtgatactctgaattccacaaccgaactgtgttctgaaaacgataaatattgcttgggtttttcccaatttagttctgctcataacagcacttatttgcggatatacgccaaaggaaaaggtgactggaacatgtggattggtaatagaaaccaaccacttgacatggattccgcagttctgtcgctgagccactctggagtactgaaaatagaatccaaagacatggaacctatcatcctttactcttcaacgcagccgtcgaacaacactgtggccacgttgatgaacacgagcaattttgtgttgcaacgccttcaacccggtgggactgagagtactgtgttgtggcaaagttttgattatcctactgataagttgctccctgggatgaagttaggagtcaatcacaaaactggtcgcaattggtctctagtttcgtcaatgggttatgctaacccagctcttggggcattcaggcttgaatgggaacccagaagaagagaattactcatcaagcaacgaggacaattgtgttggacaagtggagaactcggaaaaaacataggattcatgcacaacacgcattacatgattgtctcaaacgacgacgaaagctacttcacaattacaactttgaatgaagagttaacaagatgggagctattaaaaactgggcagttgattaataggaatggagatgacaatgttgcaagggctgatatgtgttatgggtacaacacagatggagggtgccaaaaatgggaggacatacccttctgcagaaatcctgaaggtgctgattttgcaagtgggggcgaaaaattttacatattggtaaagaacacccatcacaaaggtacaaaaaagtggatatggataagtattctaatagtagctgctctattttcaatatgtgctttcattctgtatctggccttaaagaaaagaaaacttcggtttgaagataaaaacagaaaagaaatggaaattaataagatggaagatttagcaacttcaaatagattctacgatgccagagatcctgaagatgagttcaagaagagacaagatctaaaagtatttagctacacatcagttctgttagcatccaatgatttttcaactgaaaacaagttaggacaaggaggatttggacctgtttataagggaatccaaccaaatgggcaagaagttgccataaaaagactttctaaaacatcttcacaaggaactgcggaattcaaaaatgaactaatgcttataggtgagcttcagcacatgaatcttgtacaactacttggatactgcattcacggcgaagagaggattctaatttacgagtatatgcataacaaaagcttggatttctatttatttgatggtactagaagcaagctactagactggaagaagcgtttcaacataatagaaggaatttctcaaggattactctatcttcacaagtactcaagactgaaagtcattcacagagacttaaaagctagtaatatacttcttgatgagaatatgaaccccaaaatttctgattttggattagcaagaatgtttacacgacaagaatccacaactaacactagtaggattgttggcacctatggttacatgtctcctgaatatgccatggaaggagttttctctgtaaagtctgatgtgtatagctttggagtcttactacttgaaattgttagtggaagaagaaacactagcttctacgatggtgaccgctttctaaatctaataggacatgcatgggagttatggaatgaaggtgcatgtctaaaattaattgatccatctctaactgagtcacctgatcttgatgaagtgcaaagatgtattcatattggtctcttatgtgtagaacaaaatgcaaataatcgacccttaatgtcacaaatcatatcaatgttatcaaacaagaatccaattaccttacctcaaagaccagcattctattttggaagcgagacctttgatgggataatatcttctacagagttttgtacggattcaacgaaagcaataaccacttccagagaaatagaatcaagtgaacatcaatggggagaagaagcacgaaaccaactccatttctcttaatttgcaaggtgacaataaggagaccttcaccaatgactgaaatattaaaaattggtgaattttacatatttgtgattgattttgacgtgctagataactggggtttgggtccctccccaaaagatccggtgaagtcttagggtttgatttttctagtttgatgttgttttgattccaacaaataggttgtataatcaattatcccgagttccttgcccatgcttaagtattaatttcttcttctggtggtttaatgtttcattttgtggatttgtgatcgtgcgacatggtaaatggcgttgcatgttgtatttggaaattgatgcccatgcatgaagatttacaactcaaggatcctttaacccttgagttggacatgttgaatcttcaagtcttatattactattattattattattattattattattattataatatgg

SEQ ID NO: 2832 - DNA, 1605 bp, Glycine max var. Williams 82
atggtggacctaaattggctttttgttttacttggtttgggagaaaagggagcacccatttctgataacaccaaagcttggcatcagatattgttgctgacaattgtgattggaatctggtggctattgtgtcattttgcagatgatagagaagtcaatcccaatatcaacgaggttgatgacgagctgggggagatggagcaccccaatgatgaactagaccatttttttgatgaggatgatcaccgggcagccgtcgtggtcggtgatgaagctcgtgggagacacggtggttgttccatctgtggggattttagcaccacaaggtgtgctcgctgcaaggctgctagatactgctcagggaaatgccaaattatacattggaggttggggcataaatatgaatgttctgaatcagggactgcagcagatgaagcgagaccaactcatgatcatggaacctccaagcttgtcgagaagtcggaaatggagagtacctctaatgggtccaatgttgatgatggagtggaatggaatccagaatctcatgtgggagaggaagtatccagtggcaatgatgttaacaaattccatggttgtgaaatatgtggtagcccaagtaccacaagatgttcacgatgcaaagccgtcaaatactgctcagtgaagtgcttgattatggactggaaatggcataaagatcactgcattgcaagagacgtggattcagctccaatagaaagatctcgtagagatgttggatttctaaagaattcttatgaagaggaagagagtattcgttcatcttgtcccctttctttggagtttcatccggaagaaagcacaagcttcaagtctccaattgaagtatcacaggatcctaccaacaaagtgttatatcttgaggacgaagtagccaagtctaggaatgagattttattactacagtcagaacttgacgagtggaagaatcgagcgaatttcgcaagagaaaaattccgaagcctcaagagagaatcaaattaccagttgcttgtgttgaagaatgaaaaggaatcaatagcagaggctgaaactagagctcgcaatgtgattcacagtttacataaaaagctaaaccacttgcagaatgtagtgcaagaaagcattgcagagaagagaaagctagaagaagatatacaaagtttagagagtgaatgtgctgacctgaagaaacaactgcaagaagagcataaatatgctcaacgccttacaatggaatctgacaagagtcgtgaggctgcaaaaatagctatgagagaagttgaagcagttagacaagagttacaagaagagcgagaacatgctcaacgacttaaggagaattttcatagagatgttatattttctgaatccagagctacctttgctgaggcaaaactcagtgatctttataggaaaatcagaatgtcagattataaggtctgttctatatgcctttccaatgacagggacttggcctttggatgtgggcacatgacttgtagagactgtggatcgaagttatcaaagtgtcctatatgccgtgagcagatcacaaaccatatcaagctatttactgggtga

SEQ ID NO: 2833 - DNA, 1899 bp, Glycine max var. Williams 82
ggaagttcaatggattctttttatttttcactgttaattattcacaacatttcacttcatcgtggcacaaaatattctttctgactgttaagaaataaaaaatccactttctgattcatcctttgacaatcgaggctcagaaccttctatgtcttctagtgaagcaattcaaaatttcagagtttttgcagcaacatggaatgtaggagggcaatgccccactggaaaccttgatctgaatgattttcttcaagttcgaaacgaaccagatatgtatgttttgggctttcaggaaattgtccctttaaatgctggaaatgtgctggtattagaggataatgagcctgctgcaaaatggcttgctttaatcaaccaatcactcaatggttcttcagatttggcttctaagggactaaaactgactgcatcttttggaggcccattgttctcgcaaaagccttctttgaagaagattaagaaaactttcaagaaactaaatggaaagaggctaaaaagttgtaactgtgttcttgaaatggaaaggaaggctgctaaggatttctgttttcgctgccaagaatcaaacttcaattcagatgattcttccacagaagaggaggatgagaatttcacaattcctgttgcattggcaactagtcagatgaaatacagtcttgttgcatgtaagcaaatggttggaatttttgtaagtgtctggatgaggagggaacttgttcagtatgtaggccatttgagaatatgctgtactagccgcgggatcatgggttgccttgggaacaaggggtgtatatcagtgagcatgtcattttatcagacaagtttttgctttatctgtagtcatttggcatctggagagaaagagggtgacgagcttcgtagaaaccttgatgtcatagagattctgaagaacactcaattcccaaggatttgcaagacaccacatagtaggatgcctgacaaaattttagatcacgaccgaatcatatggtttggggacttgaattacagaatttctttgagccatgatgatgcaaaaaggcttgtggaaaagagggactggccagctctttttaacaaggatcagcttaaaatggaaagggaagcaggtcgtgtattcaaggggtggaaagagggaaagatctactttgcacctacttataaatatgccttcaactcagacacttactatgttgaaggtgtaaaagtttcaaagaacaaaaggagaactccagcttggtgcgatagaatcttgtggcatggaaggggaatacaacaacttttgtacgtccgtagagaatttaagttctctgaccatcgacctgtttgtgcaacatttaatgtagaagttgaggttatgttcaggggacagaagaagaaagtttcaacttgcaactttcagaacattgatgatcttgtatccacaagaagtccatatttttcttgaaaattcgtatattggtgcactaaccacaatgactgcaagtgaataataaatatcaaaattttgcggttgaccgtgaagaaaagtttgaaggttttggaatgcatcaagaagcatgttgcatccagaacgaagaagctatcaaaatgtaatagaaatgttattagaattaaccttttttttattaaaaaaaaaaaggggaaacaagttcctatattagattgtactgaagaacaatacgtccgtgctttatttttgggaatatatataggaactaggcattggtagactgagggaagggaatagaactagcttctcacgtaagtgaagagcctaggttatatgacatagtatataactatatttttttttttcctaatgctgcttacattgctgttaagtgttaaccaagatgtgttaattgaagttgctttgtt

SEQ ID NO: 2834 - DNA, 1086 bp, Glycine max var. Williams 82
atggctgaacaaaaaaatcatgtcatccctcttcttactccttacgggatggggaacttcaatctatcccacagaatcgttttggcaccactatttagagcaagatcttacaacaacgttgctcagccccatgctattctatattactctcaaagagctaccaagggaggtcttctaattactgaagccaatagtatttcacccacttgtcaataccatccaaacgcagttggtatatggtcaaaagagcaaattgaagcatggaaacccattgtggatgctgttcatgccaaaggtggtatattcttctgtcagattcttcatactggaagggtttcagatccagattttaagcccaatagacaaaccttaatatcatcaaccaacaagccattgacacataatggcatcgaaccaagggcactaaggacagatgaaattcctcatatcgtcaatgacttcaggcttgctgcaaggaatgctattgaagcagggtttgatggagttgagatacatggggcacatggttttctaattgatcagtttttgaaagatcaagttaacgacagaacagacaaatatggtggatccacggagaaccgttgtcgctttgcattagaagttgttgaagctgttgtagaagaaataggggcagatagagttggaataagactttcacccttttcagactacaatgaatgtaatgactctaatcctcaagcattgggtctctacatggccaaatcacttaacaaacatggtgtgctttattgtcacatggttgagccaagatgggacatttctggggagaataaggaaacccctcacactcttgcaccaatgaagaaggcctttaatggcactttcattgttgctgggggttatgatagaaaagaagggaacaaggctgtggctgaggagaaggcaaatcttgttgcttatggtcgtttgtttttggctaatccagatttgcctaagaggtttgaggttgatgcaccactcaacaagtacaatagggagaccttctacactcctgatccagttgtgggttatactgactatccatttctagaaggaagttcttaa

SEQ ID NO: 2835 - DNA, 1532 bp, Glycine max var. Williams 82
gtaattaacgcactcccttacatcatatcatcggataattgacatttgacaaatgaggactttgttccatgaaagcaatcgccctaagatgtataaacataaactacaaatacacaactgaatctgcattaacacaatcaaaataataaaggaaagggcaactagggagaaggcagagaaagaaataggaaaggaaaccaaagaattctacacaaaaatggctgaacaaaaaaatcatgtcatccctcttcttactccttacgggatggggaacttcaatctatcccacagaatcgttttggcaccactatttagagcaagatcttacaacaacgttgctcagccccatgctattctatattactctcaaagagctaccaagggaggtcttctaattactgaagccaatagtatttcacccacttgtcaataccatccaaacgcagttggtatatggtcaaaagagcaaattgaagcatggaaacccattgtggatgctgttcatgccaaaggtggtatattcttctgtcagattcttcatactggaagggtttcagatccagattttaagcccaatagacaaaccttaatatcatcaaccaacaagccattgacacataatggcatcgaaccaagggcactaaggacagatgaaattcctcatatcgtcaatgacttcaggcttgctgcaaggaatgctattgaagcagggtttgatggagttgagatacatggggcacatggttttctaattgatcagtttttgaaagatcaagttaacgacagaacagacaaatatggtggatccacggagaaccgttgtcgctttgcattagaagttgttgaagctgttgtagaagaaataggggcagatagagttggaataagactttcacccttttcagactacaatgaatgtaatgactctaatcctcaagcattgggtctctacatggccaaatcacttaacaaacatggtgtgctttattgtcacatggttgagccaagatgggacatttctggggagaataaggaaacccctcacactcttgcaccaatgaagaaggcctttaatggcactttcattgttgctgggggttatgatagaaaagaagggaacaaggctgtggctgaggagaaggcaaatcttgttgcttatggtcgtttgtttttggctaatccagatttgcctaagaggtttgaggttgatgcaccactcaacaagtacaatagggagaccttctacactcctgatccagttgtgggttatactgactatccatttctagaaggaagttcttaattaaggatcacatgaactagaagggtggatttactcttatgttttgcattatttgatgtttaaaagttgtttgatttgggtatatttgtatttttcactcaattatatattgtaagataacagcatattgttgcacttaataagaaaatatttagattgatttattgtattaattaatgagtattatagatattgtgttaatgatatatttttgttaattaatattaat

SEQ ID NO: 2836 - DNA, 2254 bp, Glycine max var. Williams 82
ctctctctctctctctctctctctctcacaattttaggaacagggttttcggttttcactgttccattcagtttccgagctcaattcagctatttagcgtcgcgtcctattcagagaagagagcatcattaaatactcggagtcagattttgctgaagtagaaactgggcagaagttatataatataagatgagacaaatgaagatagatattgaagatgaggtgcttcccaatgatatgagtgggacacaattgaatgatgagagttatgaaggaggtgctggcattgttctgaagaaagggccatggacatcaactgaagatgatattttggtggattatgtcaagaagcatggggaggggaactggaatgctgttcagaagcacaccgggttgttacgttgcggaaaaagttgtcggctgcggtgggctaatcacctaaggccgaatttaaagaaaggggcgtttaccgcagaagaggagcgggtgattgctgaacttcatgccaaaatgggaaacaaatgggcacgcatggcagcgcatttgcctggtcgcacagataatgagataaagaactactggaacacccggatcaaaaggtgtcaaagggctgggttgccactttatcctccagaagtgagtttgcaagctttgcaagagagccagcatagccaaagctctggtggacttaatggtggcgaaaaaatgcatcctgatttcttgcagaaaaacagttttgagatacatgatggtatatttgacagtctgaaggataatcagggaatcttaccttatgtgcacgagctttctgatatttctgtttatggcaatatgctaaaaggtcttgattcttctcagtattgtagttttgtgccaccaacattacctaagtgtaagcgtcttaaagagtcaacaataccatttatcgattcctgtgatatgaaaaaatatgatttatattcatttgatcaaattcgagacaataattctaataagattgcacaatcatttggaatgcaagcaccccttgatcctggtccctcctcgcacagctcaatgtgttacagccattcactttcaaatggcaattcctctacttctaagccttatgaggctgtgaagttggagctcccttcactccaatatccagaactcgatttaggtagctggggttcatcccccccaccttctttgctcgagtcagttgatgatttccttcagtctcctacaccaatcagtacactggagtcagattgttcttctccacaaaatagtggcctgctggatgctttactttatcaggcaaagactatgagcagttcaaagaaccattgttctgacaagagttcaaattcttctactgcaacccctggtgacagagctgacagctctgctttgaatgtgtacgagacagaatgggaagattatgctgatcctgtatctccctttggtgcaacttcaatattgaatgagtgcactggtcttagagccaatatgaattcattgaacgaacagctaccagttcagaccattactggcgaccttccaaatttagagtctgttgaccaggtttggacccctgacagtgaaaatcaaaccttgtccctgttgaataatacttgtccggacttcttgcttacttcagattggtatgacctaggttctgggcatggcaagaaccaggctatcagtactgatgctgcaacggcctttcttggagatgatttagccactgaccataaatatatgactgctggaacttctataactatgtttggaaatccattctagcccctctaaatgtacattcagggcaaaaataaaaaatgggttatttctctgaacgtacgttggagccctctccactggaaatccaaacactcgccaagtcaagtcaggtgtgggggtttggttgttgtgcaacggcagtgaataaaatgcttgctgtatttcagctgttcatccttggttaagaaaacttctatgagatgtgtgatttgaaactccattactaagtagacttgtgttgatttttttaatatgattgtccaatttcaatatttggtgggctgaaaaagattgagtaccaaaaaattggtcagagactaatgatttcttgtggctttgtcaattttgttttgggtgttgcatgtattgtaccatcatgaatcttgtgtacacgaatgcttttgcaaactcctgatttaattgttgaactacattgcagttgaaacattggactgcatggattaag

SEQ ID NO: 2837 - DNA, 150 bp, Glycine max var. Williams 82
atgacgccaccgcacgagatcgtgaaaaggagggtggctgcaaaaatggcgtttttggtgtgcacgggaaatgggaggacattgaagggacgtgatttgagtcaagtcaagaattcgatcctgaggttaactgggtttctggaagcatga

SEQ ID NO: 2838 - DNA, 1128 bp, Glycine max var. Williams 82
atggcaattagtgttatgaaggaggccaacatgaaagggcgtatggaacgagacgaggacctaactcttttcagggaattgcggaagcaccagaatgaacgtgtatccagcctcttccattgtgttaattctgaagagtttgaatgtggcactaatactgatagtggaaatttttcactgtatagaatttcgtcagggaaaaaagaatatggactagagtttctggaaacaaacaaaaatgattatgattggttgaaaacaccaccagcaactcccctatttccatctcttgaaatggaacccagttctcaacttgtcgttcaaaaggagctaccaatctctcaggtcatctcaagatttgcatggagtactagggatgtggaagcacagccaaaacccaaatcaattgatggaaaggcaactaccaaatcaactaaagcaaaacttccaacaagatcaatgactacaagtcacaacaagcaaagaccaagcatcatcaagaacacaaatgaactacaacaaacaagcacaactcctcctaccattattaacaacaaaggcagcaatgcaaaaattaaacatgatgcagccaacaacactagatccaccccccaaaagcaaaccaacaatgttgatttccatgctttgagtatccagaaaagcatagaaacaaatgaatcacagagaaagtcaagatcagctagagttgtttctccatcggtgaagtcaagggttgtaaatctaagtaacattgtagaactctcaaatgagacaccaccaaatctaaggacggatcagaggtcgagttccacaacacggggacgaagcacaactcgatcttctacgattgcagggtttcaaaatcgtgatcctactccgcgaacttgcagaccatcaagatcaccatcaccaagcatggctaatggtggcttgaaccagttagacagaacccagaaaaaattgagggaacaaaaagaaacattcactctagcagcaggcactaatgaaaatagaccacattttaagggaagtaagatggtagagaaagtagtgaatgctagaaaatcaggtgtgaatcaaatggacagagaaaccaaagcaaaagctttcaaatatagggaaaaatga

SEQ ID NO: 2839 - DNA, 369 bp, Glycine max var. Williams 82
atgaagaacaaaagggcaagcaacaaaagggacaaaaaggagatcaaagttacatatatttcgagccccgtgaaggtgaagactagtgcctcgaatttcagggcccttgtgcaagaactcactggccaatactccaatgttgctgaaacctccatccctatggaagaggataatggccactccgagagagtgcacagaactcatcatcatcatgaaagtgaaactcaacaatggagggtgaatgttgatgagggcaccaatttgatgaaacctcatgagtacagtgagtttctctcaagatccttgatggagccattcaaccaacaacaactccttcaatacgatttgatgagttttgacatgtcatag

SEQ ID NO: 2840 - DNA, 846 bp, Glycine max var. Williams 82
atgcttggagctgtagcagcttccacatcgctatacttttcaccatccacaaactccaccagaattgttgttcttaaaagaatctcaaattcaacacttccattcagcaatgaccactctttctcactcttatcagccacccctatgcatttctcttcacacaagagcagtagaaggcaaccccatttccttgcacaagctgcttcatcttctgctgcaaatgccgaatacgtggaggaaccagcaacaaatgtgaaattccagacatctttgaattttcctggttgctcaaattcattaactttgtttggaacaggatacagggagaaagtttttgcaattattggtgtcaaggtctatgctgcaggtttgtatctagatcaatctgtcacccaggaattgaatgcttggaaagggcaatcaaaagatgctattcaagggaattcttccttgttcgagaccattttccaatcttcctttgagaaatcattgcaaattgttcttgtcagagatgttgatggtaaaactttttgggatgccttaagtgatgccatatcaccaagaattccacaacccacaactacagatgaaactgctttgaccactttccgtggtgtctttctagatcgccctcttaagaaaggagctatcataattttgacttggttgaacccctccagattgcttgtttctgtctcctcaaatgggtttccatctactgtggatgctacaatcgaatctgcaaacgtggcttcggctctttttaatgtattccttggagatagtcctgtttctccctccttgaaagcttcagtggctgaaggcttgtcaaaagtactcaaataa

SEQ ID NO: 2841 - DNA, 2970 bp, Glycine max var. Williams 82
atgctcgaaccgcgagaatctgatatacccgtcctgtttctggtcttggttgtgcttcccttggtggcttacatcttacttggaaaatggagtgaaaccactaagaagagagataggataaatttgcttgcccatttggctgctgaagaagctctgagagctgaagaaatggctgtggctgatgtaattcctccagtgtctgcttcaaaaaatgaacatcatgtgtgtgctaggtgctctgctccagccagaactcgctgctccagatgcaaaattgttagatattgctctggaaattgtcaaataatccattggaggctaaatcacaagcaagaatgccagcaactggaacctcctaaatcaagctcatttcctctggctgtttcagttgaggaacttggtcatgggagttacttttatgaaaatttgaacagccagtacttaggtccctctttgaagcagactttaagggagagtgcacctttggacaatttggttcaccctctgacgggcactgctgctcctgctacagctgatttttccatatttaataattttcaaccttctgcttttgaaagaacttcccataaatccaacagagaaacattgagaagagataatgggtctatttatgaatcttctattgaatcttctgattgtaaagctaccagttctctctcaagtgtggtaccaaaggaggcgtttatgagacagaagtcaagaaatagcaatgattctgtgttggaggaagaaatttcaaatgtcaattctggtggctttgaagtttatattaacagatttgatgcatcaaaaaacacaacccatgaggatgacaaccatcaaagtcaatatggaaatgtatcagtaacaagacacaaatatggacgcccaagtgtgtcaagtgcttcaaacaatgataacactgtagatgaatttgaaacagagatcactgctagaggtgtaaatgtagtcaaagggggaaattatcattctgatgaagcagcaaaatacaaacgcccttctgaaacaacaatcaaaggaagcatgaaagctaaaaagatattacatactcccaagaccaaatcttctaaatcaccaaagtcaacatcaaagacatcagctgacttttgttgctcagaaatagaaaagaaagggaaaactgcagatgaactaaaagttgctggaaatagtgatactatccctttacatggtaatggtagcaatggggttgcaagcactggaattatgaaaatgatgggcttgaggaaatcgacaaaacctactcctcttgcctccacagaaggcattgatgtaaagtgcaagaaggtgacaaagataaagatgttgtttccttatgatgaatttgtaaagatttttcagagtgatgtctttggcatataccccaggggcctgttaaattgtgggaacagttgctatgccaatgctgtcttgcagtgcttaacttctacaaagcctctagtcatctatttgctttatagatcgcactcaaaagcttgttgtgctaaagattggtgtctcatgtgtgagttagagcaacacataatgattttaagagaaaatggggctcctctatctcctagtcggatactttggcatatgcggagcattaactgccatatgggtgaaggaagtcaggaagatgcccatgaatttttaaggcttctaattgcatcaatgcaatctatatgcttggagggacttggtggtgagaaaaaagttgatcctagaatacaagaaacaactttcatacaacatacttttggtggccgtcttcaatccaaggttaagtgtttgaattgtaatcatgaatcagaaaggtatgagaacattatggacctgaccttggagatattgggttgggttgagtcactggaagatgcgctgactcagtttacttcccctgaagatttggatggagagaatatgtacagatgtggaaggtgcacatcatatgttcgagctagaaagcaactgagcatacatgaggctcctaacatcttgactatagttctgaagagatttcaggaaggaagatatgggaaaattaacaagtgcataacttttcctgaaatgctggatatgattcctttcatgaccgggacgggtgatattccaccactttacatgctttatgctgttgttgtgcacctggacacactaaatgcatctttctctggacactatgtttcatatgtgaaagatctgcaaggcaattggttcagaatagatgatgctgaggtacagccagtgctaattaatcaggtcatgtcagaaggagcatatatcctattctacatgaggtcctgtccccgtcctccggtagaacatactatgaatgccatgcagcaatctgtttatgattcttcaaagcacaatccaatggaaatgcagaaacctaataaaccaggacatagtaggcatggcagtcgtcagttttttgtcccagagccatcacctaatactaggccagaaatcaccactcacattattgacaccaccaatggcttccttagaaaaagcaccaataggaatgccctgccggtgacccaaacttatgccgaaaacgtcaggcgtgagttttcagatgccacatcaagtgactggtcccttttcactagctcagatgaggcttctttcacaactgagagcaccagggactccttcagcactgtagactatggtgattcatgcaacatggatccaatttcatctatcttcaactacccctcagaaaagtcctacttgaagttttcacatagtaggccagttaccagggtcttccctgaaaagggtcatgttaaacaagtacagaggattgatcattccaaaagggtcagccattcttcttcaaatgaacatccaccaaatgggaattgtggcatgtatgtatattatgggagtaatcctgtgtgtggtactacccggacttctagtcagtgtgaattttag

SEQ ID NO: 2842 - DNA, 663 bp, Glycine max var. Williams 82
atgggagacgaggtgattctgttgaatttctggttaagcctttatgggatgagggtctggattgcactagaggaaaagggcatcaagtatgagaatagacaagagaatattagtaacaagagccagttactcttgcaaatgaacccagttcacaagaaaataccagttctcttccacaatagcagacacatctgtgattcactcattgctgttgagtatattgatgaggtttggaatgatcaatctcccttgttgccttctgatccttaccagagatcacaggctagattctggtctaactatgttgacaccaagatatatgagattgccgtgaggttttggaatactaaaggacaagagaaagaagctgccagggaagaatttttggagtgcatgaagttattggaagaacaactggtggatgagccatattttggtggaaagaactttggctttgtggatgttgcacttgtttctttgttcagttatttttataccttcactagtatatatggaaatttaatcaatgaggaacggtttcccaaaatcattgcttgggccaataggtgtattcaaaaagagtgtgtgttcaagtgttttcccgaggagctgaaggtcaaagagcatgtttcacagaagagaaaggattcgaacagtgaatag

SEQ ID NO: 2843 - DNA, 1916 bp, Glycine max var. Williams 82
aaataaataaaagacatgtctcaattgcggctggattaggtgctgtcatcaagagatgacacgcagactaaacaacaagcataaaaacatccgtgatagggactttccttttggtgaaatagtttattgtcatttcaaatatcatccaccttaacattctctacaagttgactttccaattcctgtgccactcacttttgcttccagacttagttttctctcattggagtcttctttctcagtaatgggagatgaggtgattctgttgaatttctgatgaagcccttatggaatgagggtccggattgcactagaggaaaagggcatcaagtatgagaatagagaagagaaccttagcaacaagagccctttactcatccaaatgaacccagttcataagaaaataccagttctcatccacaatggcagacccatctgagtcactcattgctgtggagtatatcaatgaggtttcctcttagtattattataactttaggctaaccataaaaaaacccttgttcttttaacatatatggcatgaattcaatgaaaaagatttatacagcttttttatgacagttacatatgacaagatcttctattctaatggatgatttctcatgcttcatcattctgtttcttgatcaatttcttagccactcaagcttctcatcattgaacatgataaccttagagctcaaatttgattatacaccagtaataaaggtgtacctttacatgacagtcagtactgcaagataaaattatgcgtagattttgaataagtgcttccgtttttttttaattgttattattagtgttattttttaagttctgtttttctgttccattagccttctggataataataaataaataaaagaaatgtctcagttgccgtctgaatcaggtgctgttatcaagaaatgacacagatgaaacaacatgcatagaaacatccgtgatagggacttttcttttagtttattgtcatttctgatatcatccaactccacattctattcaagactcaccaaacatatgtgccactcactttttgttccaacactagttttctttcattagtctttctcagcaatgggagacgaggtgattctgttgaatttctggttaagcctttatgggatgagggtctggattgcactagaggaaaagggcatcaagtatgagaatagacaagagaatattagtaacaagagccagttactcttgcaaatgaacccagttcacaagaaaataccagttctcttccacaatagcagacacatctgtgattcactcattgctgttgagtatattgatgaggtttggaatgatcaatctcccttgttgccttctgatccttaccagagatcacaggctagattctggtctaactatgttgacaccaagatatatgagattgccgtgaggttttggaatactaaaggacaagagaaagaagctgccagggaagaatttttggagtgcatgaagttattggaagaacaactggtggatgagccatattttggtggaaagaactttggctttgtggatgttgcacttgtttctttgttcagttatttttataccttcactagtatatatggaaatttaatcaatgaggaacggtttcccaaaatcattgcttgggccaataggtgtattcaaaaagagtgtgtgttcaagtgttttcccgaggagctgaaggtcaaagagcatgtttcacagaagagaaaggattcgaacagtgaatagactatagagggtacctataggaaaatattgcctctatttacgaaactgcactttgttgtgcctttggttttgctacttataatcttacaaataaatatttgtgacccaatgcaacatgcccttatattttaatcaaattgtatttagatgtc

SEQ ID NO: 2844 - DNA, 660 bp, Glycine max var. Williams 82
atgtcggacgaggtagttctgttggatacatgggctagcatgtatggtatgagggctaggattgcattggctgaaaagggtgttaggtatgaatacaaggaagagaatctcatgaacaggagtcctttgcttttgcagatgaacccaattcacaagaagattcctgttttgatccataatggcaaacccatttgtgaatctgcaataatagtgcagtacattgatgaggtctggaatgacaagtctccactcatgccctccgatccttacaagagatctcaagccagattctgggtggactacattgacaaaaagatttatgatacttggaagaaaatgtggctttctaaaggagaagagcatgaagaagggaagaaggagttgatctctatctttaagcaattagaagagacactaactgacaaacccttttatggggatgacacgtttggctttgttgatctttgtttgatcactttctctagttggttttatacttatgagacatatgggaacttcaaaatggaagaagagtgtcctaaactcatggcttgggtcaagagatgcatggagagagagactgtgtccaatactcttcctgatgctaagaaggtgtatggtcttattgtggaactgcagaagacacttgaatcgaaatag

SEQ ID NO: 2845 - DNA, 1152 bp, Glycine max var. Williams 82
atgacttgttttcctttattattcagtaagtcgtcttcttcagcgagacacgatccagaaattgatgaaggcattcataatgttaaactctactcctacaaacaactaagaaatgccactgaaaagtttagtccagccaataaaattggagagggtggttttggttctgtctacaagggacggcttaaagatggaaaagttgctgcaataaaagttctttcagctgaatcaagacaaggggtgaaggaattcttgacagagattaatgtgatctccgagatagagcatgaaaatttggtcaagttatatggttgctgtgtggaaaaaaataacagaatattagtctacaattaccttgagaacaacagcctatcacaaactcttctaggtggaggtcacaatagtctctactttgattggggaactcgatgtaaaatatgcattggggttgcacgtgggcttgcctatcttcatgaagaagtgaggcctcatattgttcatagggatataaaagcaagcaatatcctccttgacaaagatcttacacccaagatttcagattttggtcttgcaaagcttattccagcaaacatgactcatgtcagcacacgtgtagcaggaacattaggttatttggcaccagagtatgcgataggggggaagctaacaaggaaagcagacatttacagctttggcgtcctccttgcggaaattatcagtggaagatgtaacataaactcacgattaccaatagaagaacaatttcttctggagaggacatgggacctttatgagcgaaaggaattggttgaactggtggatatatcactaaacggggaattcgatgctgagcaggcttgtaagtttctgaagattagccttctttgcactcaagaatccccgaagctccggccatcgatgtcttctgtggtcaagatgctcactggaaaaatggatgttaatgacagtaagataacaaaacctgccttaatttctgattttatggaccttaaagttagaaggaacgaagaaagtagtattgatatgaagaattcatctatgtatacaacctcttcttcagacaaccatgatagtaccatgtcatttgccacaactactacctttgcagcaatatatgatgaaagcatgtaa

SEQ ID NO: 2846 - DNA, 912 bp, Glycine max var. Williams 82
atgagcaacataagcatggtagaggcaaagctgccaccagggttcaggtttcatccaagagatgaagaacttgtgtgtgattacttgatgaagaaggtggcacacaatgattcccttctcatgataaacgttgaccttaacaagtgtgagccatgggatattcctgaaacagcttgtgtgggagggaaggagtggtatttctatacacaaagagaccgtaagtatgcaacagggctacgcacaaatcgtgccactgcttcagggtattggaaggccacagggaaggacaggtctatcctccgcaagggcacccttgtagggatgaggaagactttggtgttctatcaagggagggcacccaaaggaaataaaactgagtgggtcatgcatgagtttcgaattgaaggacctcatggacctccaaaaatttcttcttccaaggaagattgggttttgtgtagggtgttctacaaaaacagagaagtttcagccaaacctagaatgggtagctgctatgaggacacaggatcttcatctcttcctgcattaatggactcttacataagttttgaccaaactcaaacccatgcagatgagtttgagcaagtgccctgcttctccattttctctcagaaccaaacaagccccattttcaaccacatggccactatggagcctaagttacctgccaaccatgcaactaatgcatatggaggagcaccaaatttgggttattgcttagaccctttatcatgtgacagaaaaatgttaaaagctgttttgaatcagatcacaaagatggaaaggaatccacttaaccaaagcctaaaagggtcaccaagcttaggagaaggaagttcagagagttacttatctgaagtggggatgccccacatgtggaacaattactga

SEQ ID NO: 2847 - DNA, 321 bp, Glycine max var. Williams 82
atgcatattcacttccatagtttccaatctcacatccccttattgttaaaccctttgtttgcacaagaaaagagttacttcatcatcatcatcaacatgagtcgcttcaacaatcagcaagaatcccctgcagtatcatatcctccagcactgtatgttagtgccccaccacctatgggttatccttccaaaggtgatcctacagctgtagggtacccccaacaaagagttccagaagaaaccacaagcaggggtgatggattttggaagggatgttgtgctgctttatgctgctgctgggtcctggattgttgcttctga

SEQ ID NO: 2848 - DNA, 957 bp, Glycine max var. Williams 82
atgggtgtgaacgaagatttcaaccaggatattgattatgatcatcatgagtatgtggatgatgatgatgttcctcttccggggtttcgattccaccctacagatgaagaacttgttagtttctatcttcaaaggaagcttgacaagaaacccatcagcatcgagctcatcaaacagattgatatttacaaatacgatccttgggatcttccgaaaaccagtgccactggaggagagaaagaagggtacttcttttgcagaagagggaggaagtataggaacagcataaggcctaacagagtcactggctcagggttctggaaagcaactggcatagacaagccagtgtactcacatggaggagaaggcaatgactgcattggcctcaaaaaaacactagtgtattaccgtggcagtgcaggcaaaggcatcaaaactgattggatgatgcacgagtttcgccttccttctaacacagacaacaacaacaccaaccttcgcagctccaagaattacgtagatgttccccaagaagccgaaatttggacattgtgtcgaattttcaagagaaatgtctcacagaggaagcacacgccagacttgaaacaaatatcagctaagcgccaatccattcatgacaagagttcaagaatgagcaatgtggagttcaatactactaatcaagaatcatatataaactttggtggccactatcacaatgagcagaaacctaccattaactacacaaacagtgatcaaaggaatcagtatcatgtgatgactcatcatcagttgtgtgctccggtggcacagcagcatcagcaacctcaacaactaacttcaccatcttctaacttttggattaacaacccacctgggaacgacttcttcacgtttgataactgggatgagcttggatctttagtgaagtttgcggttgattcgcctagcttgtag

SEQ ID NO: 2849 - DNA, 1314 bp, Glycine max var. Williams 82
atgcatcctctagtgttcatggtgttcatgttattagccttatactctccttcttctatatccactagagaagccggtgaaggcctaaggggtttcagcatcgaccttatccatcgtgactcaccattgtcacccttttacgacccttcactcactccatcagaacgcatcacaaacgctgcctttcgctccagctctcgattaaaccgagtatcacacttcctagatgaaaacaatctacccgaatctcttctaatcccagaaaatggtgaatatctcatgacattatacattggtacccctcccgtggaaaggcttgctattgcagacacaggaagtgatctcatttgggtacaatgttccccttgccaaaattgtttcccccaagacaccccattgtttgaacccctcaagtcttccacattcaaggctgcgacatgtgattcacaaccttgcacatcagttccacctagccaacgtcaatgtggaaaagtaggtcagtgcatatatagttacagttatggtgacaaatcattcaccgttggagtagtgggcactgaaaccctaagttttggttccacgggtgatgcacaaaccgtttcatttcctagctctattttcgggtgtggagtgtacaataatttcacatttcatacaagtgacaaagtcacaggtttagtgggtcttgggggaggaccattgtcactagtgtcacaactaggtcctcaaattggttacaaattctcgtattgtttgcttcctttttcttcaaattccactagcaaattgaaatttgggagtgaagcaatagtaaccacaaatggggttgtgtccacccccctcataatcaaacccttgtttccaagcttttacttcctcaacctcgaagccgtcaccattggacagaaggtggtgccaacgggtcgaaccgatggcaacataatcattgactcaggcacggtgttgacgtatcttgaacaaaccttttacaacaattttgtggcttcgttgcaagaagtccttagtgttgagtcagcgcaagatcttccatttccgttcaagttttgttttccatatcgtgacatgactattcctgttattgcgtttcaatttaccggagctagtgttgcactgcagcctaagaaccttctcattaagttgcaagataggaacatgctttgcttggcggtggtgccaagctcactaagtggaatttccatctttggaaatgttgcacagtttgattttcaagtggtgtacgatctcgaagggaagaaagtttcttttgctcctacggattgcactaaagtttaa

SEQ ID NO: 2850 - DNA, 543 bp, Glycine max var. Williams 82
atgtcaagaagaacaaggaaacaacaacaacaacaacgacaacaacaacaacaatttccagtgcaaggcaacgagaaaaccaaatcaacaatggatgatgatgaagcaacaccaaaggatgctgatgttcatgtcacagtggaaacaaaagctactcaaactgtttctgttgctggtgaggtgaaagagggtggtgagagtgaccacaaaagcttgaagcaactcatcataggagatgatgatcacaaagaagcaaagaagggtagtagtaataataatagtaataataataatagtgatcatgagagaggtggcaaaggaggatcaaggaactcacttggtgaacacttcacagaggaagagaagcagcataatcttcagctggttaggatgcaacagaataaggacaacctccaaggcttgaagttgaagaagttggtgcgtcgttacgccaaagttttggggcatttgatgaaggctaagcgtgatcctcatctaggtggtgatgctgggaaaaaacctgttttcaagttatcagcctag

SEQ ID NO: 2851 - DNA, 255 bp, Glycine max var. Williams 82
atggagagcagcttgggagacatgttgattaaggttgtggtgttcattctagttcaagccttggtgtaccttatcctctccaattcatcaaacatcttcaacaagaacatgaagaaatccaacagcttcaggccagcgaggtcggtgagcattcgccggatgctggctttgatctctgattttcctccagaaggggaaccctctccttcaccaaagggtcctaaaactccatcacttcatcaaagtgatcaataa

SEQ ID NO: 2852 - DNA, 1155 bp, Glycine max var. Williams 82
atggagcttggtttgagcttaggagactcttcaaggcctttgcttggtttcatggaaaagcctcgtgaagcctccaaccaacttggtttaggcttcaacacaacgttatcaattggtccaatcattactacacataaagatcatcaacaagatgaagatgaagaataccaagaagaagaagaagaagaaacaaagccaaagaacaacaacactcacagaatacaaggtcctgatggcctttcttccaatcccaacaacaacaacaatacagttctgcatcaacttgatcttctccctcaactcgctctcccatggcaccctccttctgaaaacggaagtttatcatctgagttgggaggctcttctcggggcttggacgtgaacgcgcagccgccggcggtggaggacgaggcggaggaagcggcggcgctgtcgtcgtctccgaacagcgccgcctcatcatttcaaatggatctctgcatatacagcagcagaggagggagctcctataagagggactttgagggtgaggcttatgatcaaaggacctcttcaagggccagtgacgatgacgacaataataatggtagtggtggtaatactaggaaaaaactcagactctccaaggaacaatctgcattccttgaagagagtttcaaggaacacaacactcttaatcctaaacaaaagcttgctcttgctaaacaactcaatcttcaacctcgtcaagtagaagtctggttccagaatcgtcgagcaaggactaagttgaagcaaacagaagtggattgtgagtacttgaagagatgttgtgagacactaacagaagagaatagaagacttcacaaggagcttcaggaattgagggctttgaagacttcaaaccccttctacatgcaattaccagccacaactttgaccatgtgcccttcttgtgagcgcgtggccacaaattctacatccacttccttatctattagtgccaccatcaatgctacaaattcaggagccatggccagtgtcaaaacaagtaataacaataacaacaatgactcaccctccaaagccattggattcccctttggaaaaccgaggtttcacccatttgttcacactagccaacaaccccatcaacaccaatccacagcatcttga

SEQ ID NO: 2853 - DNA, 168 bp, Glycine max var. Williams 82
atgactattctctcagccatattttgctgcttcaagtcaaaggaagaaaagagctctatggtggaagcaggttctttatctcggaaacccaaaggagatcctcagcgatcttcagctcctattgttgtttcttatttcccagttaactctcatccttctcgcttgtag

SEQ ID NO: 2854 - DNA, 315 bp, Glycine max var. Williams 82
atggcatcattcaccatgacagcttccatccttggcagcccagccgtcaccaaccggtcggcagtagcaacgcagaggagatcactcgtagtgaatgctgccaaagctgttgaagcagaaaaggtcagttatgacaatgacatggatggtagcaatggaaggaggaacttgatgttcgccgcggcggcggctgctgtttgctctgttgctgggatggcagtggcagatgagcctaaaccaggaaccccagaagccaagaaaaagtatgctccgatttgtgtcaccatgccaactgctaggatttgtcgcaattga

SEQ ID NO: 2855 - DNA, 402 bp, Glycine max var. Williams 82
atgtcctttttttttgtgatttacgttccatatattcatcctttggtccattctttggttcagtattcagattacattgcaaaaatggcatcattcaccatgacagcttccatccttggcggcccagccgtcaccaaccggttggcagtagcaacgcagaggagatcactcgtagtgaatgctgccaaagctgttgaagcggaaaaggtcagttatgacaatgacatggatggtagcaatggaaggaggaacttgatgttcgccgcggcggcggcggctgctgtttgctctgttgctgggatggcagtggcagatgagccaaaaccaggaaccccagcagccaagaaaaagtatgctccgatttgtgtcaccatgccaactgctaggatttgtcgcaattga

SEQ ID NO: 2856 - DNA, 1104 bp, Glycine max var. Williams 82
atggcggtgactctaacatcaaccctctttatggctttgctatttgctgcttcagcttttgctgctcttcagcctagagtacctgaagcttaccttcaaaatggaaactttgaggagcagccaaaccccaaaaacctccagaaaacaaagctcatggggaaatattctttgcccaaatgggaagtcaatggtctggttgagtatgtctctgggggtccccaacctggaggcatgttcttcccagtgactcatggaatccatgctgtgaggcttggcaatgaggcctcaatctcccaaaatatcaaggtcaaacccggtcaactgtatgctctaattcttggggcctcaaggacttgtgcacaggatgaagttttgaggatctctgtgcctgcacagactggtgatgttcctttgcagaccctttatagcctcaatggtgatgttattgcttgggggtttaaggccacttctagtgttgtcaaagtgactttccacaaccccggagttcaagaagatccatcttgtggccctcttttggatgccattgctatcagagagttctaccctccaatgcctacaagagttaacttggtaaaaaatcctggctttgaggagggtccattccccattttcaactcaaccaatggtgttttgctcccgcctcaacaacaagatggcttctccccactccctggttggattattgagtcactcaaggctgtgaagttcattgattcaaagcatttcaatgtcccatttgggctgggagcagtggagcttgtggcaggcagggaaagtgccattgcccaaatcatcagaacagttaccaacaaagtctacaacatcacattttcagttggagatgccaaaaatgggtgtcatggatcaatgatggttgaagcatttgccgctaaagataccttcaaagttcccttcaaatctgaagggaagggaacatccaagactgtaagcttcaagttcaaagcaattgcaccaagaaccagactcactttctacagttccttctaccataccagaattgatgactatggttctctttgtggccctgttattgatcaagttatagtgttccctgttgcctaa

SEQ ID NO: 2857 - DNA, 258 bp, Glycine max var. Williams 82
atgctcctccacggtttccacttgatatgctcgcttgacatttcttcaaacagcttccgttccctgctgcggcggcgcagtggggacattatcaattcctatttccttttcttcttcttcaggctcagttctcatatgcctgtggcggtgccggagaaggtaagtattatcataaaaccggaacctttcatcaaagctcctcagcctattaaacgatcgattatgaatctgagaataatcgttttggaaccatgctga

SEQ ID NO: 2858 - DNA, 783 bp, Glycine max var. Williams 82
atgaacgttgaaagcgagaggaaagatgaacaagaggtgaaagggtggagaaaagctttaaaaagtgtagggaattggctggcacataaggataaggatgaatggttgaaggacatgaggggagtgctgagtttggtgtctacggtgatcgcaacaatgacctttcaaagtgctttaaatccaccaggtggagttagacccggaaacgagagtggagttgttcaatgtccagaaaacagtgcagataataatccatgtcccggagaatctatcctagctgttctttaccctgatgaatataaaatattcctcatttggaacacaacatgtttcatttcatctttagcagtgtgtctcttgcttgtaagtgggttccctctcaatcacagattcttcacctggcttttgtcaatagggatgtgcatcaccatctccagcctcactcttacctacatgactggtgcgggaatggtcaccccggatcccctttggaatacaaccaactccatgtttaataaagttatttatatttggatttcactgctaggactcgtcgcatttgtcctttgcctacgcctaattgtttggattgtctttgcctgcaggattatgggaaatggctatggcagtttcattgtcaacaaaaatctgtgtactctccttctgctccatgttaagatcaatcaagatttttttaagccacaaaacttggttaacagcaacggcagcaacaataaattcggcttcagctgtagactgagcaattatatcttgtttttttga

SEQ ID NO: 2859 - DNA, 939 bp, Glycine max var. Williams 82
atggtgttggcatatgctgccatgctttcttccactttaccgtttcaaaagtctgttcctttgacttctcaacgttcaggaacagcatttggttcctctttccaattcaatagagagaatggtactgttgttacacctcttgtcgtgtgtcatgctaagaagaaactcagttttatggagcaaattctcgattacattgaagggggtcctaaattaaggaagtggtatggtgcacctgatatccttgaaaaagatggtactgcaatagaagataatgaggatgattatccggaagatgaagtcagggatgcagtgctggtaacagatggagatagtgagatgggtcagatggtgatattgtcattgattgtgaaaaaagctcgagtaaagacactggttaaggataaaagggttgcacttgaagcctttggaagttatgttgagtcaatggcaggagatacaagtgacaaacgatttgtcaagaaagctctgagaggagttcgcacaatcatatgcccaaatgagggatttctttctagcgttggtagccttcaaggggtacaacatgtaatcgtcttatctcggttgtcagtttatggtggtcaaagtggctttcaatccatgatgaaaagcaatgcaaagaaattggctgaacaagatgaatcagtattgaaaacctcaggaattccttacaccataattaggaccggtgcattacaagatacacctggtgggaagcaaggctttacctttgatgagggttgtgcagctagtggaagtattagcaaagaagatgctgcctttgtttgtgtagcagcttttgattgtgtcccacaaactggattcatttttgaggtggccaatggggataacaaagtttcagattggaaagaatgtttggccacattgatggagaaagcaagtcaaaaacttcagtga

SEQ ID NO: 2860 - DNA, 630 bp, Glycine max var. Williams 82
atgtttctccacattgttttcctcctttcccttctctcatccacttcccatgccactgtccaagacttctgtgtggcagaccttaagggtgcagacaccccttcaggctacccctgcaagccacctgcaaatgtaacttcagatgactttgtgtacacaggcttagctgaagctgcaaatgtcacaaacataatcaatgctgctgtgaccccagcttttgttgctcaattcccaggtctcaatggccttgacctctctgcagcaagattagaccttggtcctggtggtgttatcccactccacactcaccctggtgccaatgaactactcattgttctccaaggtcacatccttgctggattcatatcttcaggtaacatagtttatcagaaggtgctaaaaaagggagagctcatggttttcccacaagggttgttgcacttccaaattgctgttggtaagagaaaggcccttgcttttcctgtcttcagcagtgcttttcctggccttcaaatccttgactttgcactctttgccagcaatttctccactcctttggtgacacagaccactttccttgaccctgccatagtgaagaagcttaagggtgttcttgggggaagtggctag

SEQ ID NO: 2861 - DNA, 1202 bp, Glycine max var. Williams 82
cttatcagctgcaatgttctaaagaatccataaagtgttactctggctctcattttgcctttgtcgttattagctgaatgggcatatatgttcaaacctccaacttgcaacaaacctcaatatatatatatataacaccatattgtgtagagtatcctaccattcattcccatttttcacaccaccaagccaacagaagatgtttctccacattgttttcctcctttcccttctctcatccacttcccatgccactgtccaagacttctgtgtggcagaccttaagggtgcagacaccccttcaggctacccctgcaagccacctgcaaatgtaacttcagatgactttgtgtacacaggcttagctgaagctgcaaatgtcacaaacataatcaatgctgctgtgaccccagcttttgttgctcaattcccaggtctcaatggccttgacctctctgcagcaagattagaccttggtcctggtggtgttatcccactccacactcaccctggtgccaatgaactactcattgttctccaaggtcacatccttgctggattcatatcttcaggtaacatagtttatcagaaggtgctaaaaaagggagagctcatggttttcccacaagggttgttgcacttccaaattgctgttggtaagagaaaggcccttgcttttcctgtcttcagcagtgcttttcctggccttcaaatccttgactttgcactctttgccagcaatttctccactcctttggtgacacagaccactttccttgaccctgccatagtgaagaagcttaagggtgttcttgggggaagtggctagagtactacttatttgtgttcatggatagttttttattattttgctcaatttattattattccttgtgtttgtttcaattcgttagacttgtgcaggtctcatggtcattgaattattatgctcgtgtcaatgtagagcaattaataaatttgcatgctttatttgtcttccatcatttctctgttcaaaactaaaattgtgttgagatttgagtattgctatgttaagaagggttgtttgccaatgtcgctaaagaatcttatccacattttccctggttgttacatgtcgggctaaagatgatatttgtcctttactatcacgcatgttttaattaattacagttgtccacacggctcgtaatatgtttttt

SEQ ID NO: 2862 - DNA, 4548 bp, Glycine max var. Williams 82
atggctgctgattctttctcctttgagggtgactccttctcaagccaccagagaagacactatccaacaccagtgagttatcacactgtgtatggctctggctctggctctttcatatcatccagctctctaaccaatccaagagctcgccgccgcaacccagttcctgccacaccctttgcttcagatgatgaccattcatggcaaggagaagtttcgtggaagttcgaggccaccgggtggcgcgactatagcacaaactttggttctgttctcagtccatggccagagagctccccttctggtcacagccgggtatttcgtcgatcagccaatgattactacctttcaagaacaagtaggttcagaggtcttgcaaactcttcttatgaacaatctggctatggtagagttgaacttcagagctatgatgctagggacaatgattatagttactttgatcagcatagtcggccacaaggattatcaagatcggggttcatccaagagaagagtagtaaaaaatgtaagactagtccattggctgaggaagatgagcttagtatgatagattatagcataacacatgatcacgttatttcacctaataggaatggtcatggtcttgaattaccatattctaaacatggtcatggtggtgattatggtgggaattatcatgttggtcatgatggaccatcatcacacggtagccaaatttatagaagtggtggggattacacttatagtcaccatgacattgagaagctttcagcatatgatgaagagggtgaagaggatatggatgaggaagatgcaaggcctccaaagactgttgggatttttagcttgtttaagtactcaacaaagttggatttggtgcttgtgtttgtggggtgtttaggggctctcataaatggaggatcgcttccttggtattcttatctttttggagatgttgtcaataagatctcagaagctgaaaatgacaaagcacagatgatgaaggatgtagagaggatatgcaaatttatggccgggctagctgctgttgtggtatttggagcatatttgcagatcacatgttggaggttagtgggggagcgtgctgctcaaagaattagaacagagtatctaagagcggttcttcgacaggacattactttttttgatacagatatcaacactggtgatattatgcatggaattgctagtgatgttgcacagattcaagaagttatgggagagaagatggcccacttcattcatcatatatttacattcatatgtgggtatgcagttgggtttaaaagatcatggaaagtctctctggtggtattctcagtcactccattgacaatgttctgtggcatggcttacaaagcactttatggtggcctaacagcaaaagaggaagcttcttataggaaagctggtagcattgcggagcaggccatcagttcaattaggacagtgttttcatttgttgcagaaagcaaattggcaggaaaatatgctgagctactgcagaaatcagctccaataggggccagagttggttttgctaaaggtattggcatgggagtgatctacttaataacctattcaacatgggcactggctttctggtatggctctgtattaattgccaggaatgaacttgatggaggttcagctattgcttgtttctttggtgtcaatgtagggggaagagggttggcactggcactttcatattttgcacaatttggtcaagggactgttgcagcaagccgtgtattctatattatagagagaatccctgagattgattcctatagccctgagggtaggaagctttctggtgttcgtggaaggattgagttaaaaagtgttagctttgcatacccatctcgtcctgattctcttatacttcattcccttaacttggtgttaccatcttcaaaaactgtggcattggttggtgccagtggtgggggaaagtctactatctttgctctcatagagaggttttatgatcctattgaaggaattattaccttggatggtcatgatttgaggacattgcaagtaaagtggctacgagatcagattgggatggttggtcaggagccaattctctttgccacatctattctggaaaacgtgatgatggggaaagataatgccacaaagaaagaggcaattgctgcttgcattgctgccgatgctcacagcttcatctctagcctaccactaagctatgacactcaggtaggggacaggggtacaaaactctcagggggccaaaagcagagaattgctttggctcgagcaatggtcaaagatccaaaaatccttcttctagatgaacctactagtgctcttgatgccgagtcagagtctgcggtccaaagggccatcgacaagatatctgcaagccgaacaaccattgtaattgctcacaggatagcaacagtgaagaatgctcatgctattgtggttcttgagcatggttctgtcactgagatcggtgaccatcgccagcttatggcgaaagcaggagcatactacaaccttgtcaagcttgccaccgaagccatttcaaaacctctagctatagaaaatgaaatgcaaaaagctaatgatttatccatctatgataaacccatttctggtttatcaggatcaagatatttagttgatgatattgatatcccatggcctaaaggcttaaaatccacgcaggaggaggaggagaagaaacatcaagacatggaagacaagcaagacaaaatggcaagaaaatacagtctttctgaagtatggaaactgcaaaagcctgagtttgtgatgctattttcaggacttattctgggaatgtttgctggtgctattctgtcccttttcccattggttttaggcatatccttgggagtatattttggccacgacactcataagatgaaaagagatgtggggcgcctttgtttaacacttgttggccttggatttggttgcatactttccatgacaggacaacaaggtttgtgtggttgggcaggatcaaagctgacacaaagggttagagacctcttgtttcaatccattctgaaacaagaacctgggtggtttgactttgaagaaaactccacaggagtgttggtgtcaaggctctcattagactgtgttagttttcgatcggtgcttggcgacagattctcagtccttcttatgggattgagttctgctgctgttggccttggtgtgtcctttgcctttaactggagactaacccttgtagcagctgctgtaactcctttcgcgctcggtgcaagctacataagcttgatcataaacgttggaccgcgagtggataacgactcttatgcgaaagctagtaacattgcttctggtgcagtgtcaaacataaggacagttactacattttctgcacaggagcagatagttaagtcctttgatagagccctgtcagaacctaggagaaaatcattgagaagttcacaacttcaaggtcttatgtttgggttgtttcaaggttccatgtatggagcatacaccttaactctttggtttggtgcataccttgtagaacacgacaaggcaaaacttggagacgtgtttaagatctttctcattcttgttctgagctcattttcagtgggacaacttgccggtttggcaccagatactactatggcggcggcagcgattcctgcagttcaagatatcataaaacgtaggccactgattgacaatgatagaacaaaaggtaggatagtagaccgatcgaagcggttcaacatagaattcaagatggtgacatttgcatacccatctaggccagaggtgactgtgttgagggatttctgtttaaaggtcaaagctggaagcacagtggcattggtgggaccaagcggatcagggaagtcaacagtcatatggttgactcagaggttctatgatcctgatcaaggaaaggtgatgatgagtgggatcgatttgagggagattgatgtgaagtggttgaggaggcaaatggctttggtgggtcaagaaccttcattgtttgctgggagcataagggaaaatattgcatttggggacccaaatgcttcgtggactgaaattgaagaggctgcaaaggaggcttacatccacaagttcatcagtggccttcctcaaggttatgaaacccaggttggtgaaagtggggtccaattatcaggtggccagaaacaaagaattgctatagcaagggccatattgaagaaatcaagggtgcttttgcttgatgaagcaagcagtgccttggacttggaatcggagaagcacatccaagaagcccttaagaaggttaccaaagaggcaacaaccataatagttgctcaccgtctttccacaatcagagaagcggacaagattgcagttatgagagatggggaagtggtggagtatgggagccatgacaatctcatggcttcaaatcaaaatggcttgtatgcttgcctagttcgagcagagactgaagccaatgcctttgcttga

SEQ ID NO: 2863 - DNA, 705 bp, Glycine max var. Williams 82
atggccgatgaaggaaacaaaagcaataacttctattcgatcttggggttgaagaaggagtgcactgaattggagctaaagaatgcttataggaaacttgcaaagaaatggcacccagatcgttgttcagcgaccgggaattcagagttagtggaagaagctaagaaaaaatttcaggaaattcgggaagcctattcagttttatctgacgccaacaaaaggttaatgtacgacgtgggagtctacgacagtgatgacgacgagaacggcatgggggacttcttggacgaaatgctaacaatgatgagtcagaccaaatcgaatgaaaacggagaggagagctttgaggagttgcaacagttgtttgaagacatgtttgaagcagatattggattggacggaggcccttctcttgcttcttctgattgctcaacttcatctgcttacatgacttatagtgaaagttctagttcaaataaacacaattcctctgagatgaatttcgggaaggcagagaattcttctgtctttgatgctggttaccagaatttctgttttggggtgaaccaactccaagatataaagaagaaaaaggggggaattctaggaggaggtagaagtagacacagaaatggcagaaagcaaaatatgtcctatggccatgatgtttcatcgaatgactaccctggaatttccacaaagtaa

SEQ ID NO: 2864 - DNA, 1758 bp, Glycine max var. Williams 82
atgccatttttaagcttgacaatgatgtcaaacatagccttcagattaactcttgtctttcttttattttctgcggtgctctctactcctccagaggatccaatcaagtgcgccacttcagagaacacaacctgcactatcacaaactcctatggcgccttccctgatcgaagcatttgcaaagctgctcaagtgttgtaccccaccaccgagcaagagcttgtgtcagtggttgcatcagcaaccagaaacaaaaccaagatgaaagtagctacccgtttttcccacagcatccccaagctggtgtgcccagaaggcgaaaatgggttgttaataagcaccaaatatctcaacaaaatattgaaggttgatgtggaaacaagaacaatgactgtggagagtggtgtgactctgcagcaacttataaatgaggctgcaaaggtagggttggccttgccatatgcaccatattggtggggtttgaccattggagggcttatgggaactggtgctcatggaagcactttgcgggggaagggaagtgctgtccatgattatgtggtggggattaggattgtaaggcctgcaggttctgaagatggatatgctaaggttgagatcctaaatgaacagcatcaagatttaagtgcagccaaagtatcactcggtgtgctgggagttatttcacagattactctaaaactagaacccctcttcaagcgatccatcacttatgtggaaaaagatgattcagatttgggagaccaagctgctgcttttggagatgcacatgagtttggagatatactgtggtacccaagtcaacgcaaggttctctatcgtgttgatgatcgtgtcccaactaatacatcgggaaatggtctttacgacattatttctttccgtcccactccttcaaatacgtcggctttcataagaaccagagaggatattcaagaatccactaaagatgccaatggaaagtgcatagatgcaactaccacaacggacaccttcatcaccgaagcttatggtcttactaacaatggtataatcttcactggatacccagtaattggatttcaaaaccgccttcaatcatctgggtcatgcttggatagtcctcaagacgcattgaacacaacatgtgcctgggatccgagggtgaaaggcttgttcttttaccaaaccgcatttagcattaagttgtcctttgtaaaaagctttattgaagatgtgcaaaagctagttgaattggagccaaagggattatgtgtcttagggctttacaatggaatgttaatgcgctatgtcacggcttcaagtgcctacttggggcaccaagaggatgctttagacattgatatcacctactaccgtagcaaagacccaatggctcccaggctttatgaagacattcttgaagagattgaacaagttgggattttcaaatatggagggctacctcattggggtaagaatagaaacttggcgtttaaaggagtcatcaagaagtacaaagatgcaaagaaatttttgaaggttaaagagaagtatgattcgcatgggcttttctcaaatacgtggacagaccaagtgttggggctaaaagatggagtgacaatactgaaggatgggtgtgcattagaaggtttgtgtatttgctcccaggatagtcattgcaatccaagcaaaggttactattgcaggccaggcaaagtttacaagaaagcaagggtttgtactcatttgaaatga

SEQ ID NO: 2865 - DNA, 852 bp, Glycine max var. Williams 82
atgttcctcgtaatcctaagtgtcgtcgtaggtttcacggttcggtggttgctgttcaaaacgggattgatgcacaccataagaaaacgcttccgaagggtcgtggattggtgccacgtgtaccagttcctcaaagtccccgaattcaacgaaaccaataatatgcggcggaataaccttcaccgcaaagtttctctctatttgcattcccttccttccatagaggacgctgacttcaccaatctcataaccggaaatgaccaaactgacatcgttttgcgcctcgacccgaaccaaaccatcgaggaccgcttccttggtgccacactctattggttcaaccaaaaaaccgaaccgaaccggatttccaccttcgttctccaaatcagaaaaaccgataaacgtcgcatccttcgccagtacctccgccacatcaacactgtcgccgacgagatggagaaccaaagcaagcgcaatttacggttgttcatgaacgcctccgccgtcgaagacggcggcacacggtggagatccgttccgtttactcatccggcgatgtttgaaacgatggcgatggagaaggatctgaagaacaagatcaagtcagatctcgaatcgtttctcaaggcgaagcagtattaccggaaaatcggccgggcgtggaagcggagctacctcctgtacggtgccggaggcaccggaaaatccagcttcgtcgccgcgatggctaactttctccgctacgacgtgtacgacgtggatctctccaagattcgcggcgattcggatctgatgtttctgttaacggaaacgacggcgaaatcgtgtgtttgtggctcgtacttcgtgtag

SEQ ID NO: 2866 - DNA, 585 bp, Glycine max var. Williams 82
atggagcaagagcttcaacgcaacagtgtccacgacgacgaagccgccaccaccacgagctccggcgacaagcccgccacccctcgcggcggcggaacccgacaccccctcttccgcggcgttcgcaagcgccgctggggcaaatgggtctccgaaatccgggagccgaggaaaaagtcacgcatatggctcggctccttcccggcgccggagatggcggccaaggcctacgacgtcgccgcctactgcctcaagggccgcaaggcgcagctcaacttccccgacgaggtccaccgtcttccgctgctcccctccgcctgcaccgcccgcgacatccaggccgccgccgccaaggccgcccacatgatgatagtccaggccgcctctgtcaccgccgactcgccggagaaaagcagcagcattacctccgactgcggcgacggtggcggtggagacgacttctggggcgaaattgagctgccagagttgctcaacgccaagtggtgggcctccgaccacgacgtcacgccgtggcccgagtccgagctcccgccccagcagcccttcaccacggcgtgcttgtag

SEQ ID NO: 2867 - DNA, 1209 bp, Glycine max var. Williams 82
atggcaaatagtagatcttggactcaaacatggccatgttttgtcaagctaggtgttctgaatcttgtcttggttttcaaaatcacagcattgggggatgtcagtggaagtgttacagcagaaaacacttgcaagaacacaaattatcaaagttttctccctccaccgtaccagaatatgtcccaaatgatatgcacacctgtatggcacacctatgaattgaggtatttccagaatggtgatacaacaactatcatattatctgctccctacacaatagggtgggtaggaattggattttctagagatggaatgatggttggttccagtgcaatggtgggatggattaccaaacatggtcatgcaaacatgaagcaattttacctaaggggtaggaagtcatcagaagtcaaaatagacaaaggtgaactccccctcaataatatccttcggcttgtggcgactaatggagctgaaattcatatggcatttcagttgcagatgacaaccccatttcagaaacaaccaattttgttggcttttggtagcaaatatccacagaaccaccacctctccaagcatgaagacaaaacagctattgtgtttgacttctctgcaggttctacgggtcctgtatcccgtgaattgattcagatgaggacgaaccatggaattttggctataatagggtggggtctaatcctgcctgtaggggctattattgctagatatttcaggcacaaggatcccttatggttctatctccatgcaatcattcagtttgtaggattcacatttgggcttggtacagtaattcttggattacaactctattccaaaatgcaagtccatataccagctcacagaggcataggcatctttgctctggtactaagtattcttcaggtgttggcactcttcttgagaccaaacaaggattccaagattcgaaaattttggaattggtaccacagttggtttggaaggatggcacttgtatttgcagccattaacatagtgttggggatgcaagctgcgggggcaggaagtgattggaagataggctacggattcgtttttggcattatggttgttgcggctattgttcttgaaatattggcttatttgaaaagatcagagatgcgttctctacctcctaacttccaattggatcctgttggaggagctacatttccaaggggaatgtga

SEQ ID NO: 2868 - DNA, 1368 bp, Glycine max var. Williams 82
atggaggccctcaatgctgctggcttgacccctctatctgtgctctctgatgcaaaaacaacaagaactaaacacccttctgtttctgtatgcaaagtctcaaacttttccacctccaccaacaaaaaacaaaccttgctgcaaagttgcatatcaaaaactttgcatggggggctgattcttgcagcttccgttgtaaatggtggagctgccacagctttaacgtacgatgaagccctgggacaacctttgagcctccctggtgctggggactttgatgtgaacggttttgtggagagtgtcactggctttgcagctgaaaaccctgcaattcttgctgggggagtagctgttttggcagtgccattggttttgtctcaggttcttttcaagaagcctaaggcttggggtgttgagtctgccaagaatgcttatgcaaaacttggtgctgatgggaatgctcagttgcttgatataagggcactggtggagattaggcaagtggggtccccagatgttgggggtctgaagaagaaagcagtgtcaataccttataagggtgatgataagccagggttcttgaagaagcttgctttgaagtttaaggagccagagaataccacattgtttattctggacaaatttgatgggaactctgaactggttgcagagttggttaccgttaatgggtttaaagcagcttatgcgattaaggatggtgcagaaggaccgcgaggatggaagagtagtggtcttccttggatagaaccacggaaaacattgagttttgacaatctgacagatgctatatctgaagcaataggagataccactgatggcgtggcagttactcttggggttgctgcagctgctgctggacttagtctattagctttttctgagatagaatcaatcctccaggttgttggatcagctgcgctcattcagtttgcaagcaagaagcttttgtttgctgaggaccgagagcaaaccgtgaaacaacttggtgagttcttgaacaccaaggttgcccccaaagaacttgttgatgaaataaaggatattggaaaggctcttctaccatcctctaccgataataaggctcttcctgctccggcagagaaaagttcagagcttgctacagctgatagcactgtacagagagcagtagctactcccgagtccaaagctgaagcagtagcaactcccgagcccaaagtggatgcagtagctcctgaagtaaactctgtgcccaaaactgaagtcaaggcagaagaatcacttcctgtgcaaccaaggccactttcaccatacccatattatccagatttcaagcctccaacatctcctaccccttcacagccctag

SEQ ID NO: 2869 - DNA, 1689 bp, Glycine max var. Williams 82
atgttagagagacaaatgaagccatctccaagacttctcttgatactcacttttcttggttcattcttccttgcaagcccagaagcatactcgtgcaccagcaacctaagcctcaatgtttcaatcccttttgatacaacaaaccttcactgcctttctgtatgggatgctcaaagtttcatcctcagatatgttcagacttctgcaagcacttggagcttcattctctcaaccccggacacaaattcttacatagctattggattctcggccggcggcggcatggtgggttcaagtgccatggtggggtgggtagcatcaagaggagccagtggagggattaagcagtattatcttggtggggtcacaccaaatcaggtggttcctgataagggcaacctacaggttatagacaattcaaccttcatcactttacaatcctctcgtttgttcatggtgtttcagttagaaactaccgaacctttgtcctctctgatatttgccactggatccaccggcttgttccctgcaccaccaagttttgcactaacaaaacacctagacaaggtgtccacaagaatagactattcaaaagccaacattggaagttcacaaggggatggaaattcttcacaagtaaatggaagtacttcacaatcagcagactcttgcggctccaatctaaacctcagtgttcctctcctcttcgacacaaccaacctcaattgtcttcctgtttggaatgctcaaggatacatccttagatattctcagacatctcaaaacatatggagcttcattctctcagcaccaaacccaaattcatacatagcaattgggttctctcccaatggaggcatggtgggttcaagtgccatagtggggtggatctcatcaaatggggcaggtggaggcatgaaacagtactatctaacaggtctcacaccaaaccaagtggtgccagatagaggcaacttaaaagttctcaccaactcaaccttcatcacatcacagtcctcacgtttgtacatggcattccagttagagactaaccaacctctttccaagttgatttatgcctttggacctaacggtgtgttcccttcggcaccaagttttgcattagcgctgcaccaagacaaagtctccatcacgttgaattacgcaacaggttcaagtgcaacaacaggaaagtcatataacctgaaaagaagccatggattgttgaatatcttaggatggggcatcctaatcataatgggagcaatagttgctcgctacttcaaggaatgggatccattttggttttatttccacgcttcagttcagtctttgggttttgttctgggaatagttggtgtaattagtgggtttgtcttgaataatcaacttcataccgacgttagtcttcacaaggctcttggaatcatcattttcgttctaggttgcctccagataatggctttgcttggtcgaccgaagaaggaatcaaaagtgagaaagtattggaatgcataccatcacaacatggggagaattttgatcatactagccatagctaacattttctacggaatcaaattaggtaaggagggaagtggatggaacatcggttatggaattgtgcttgccgtattattcactatggcaattacttttgagactcaattgtgcagtagagacgattaa

SEQ ID NO: 2870 - DNA, 891 bp, Glycine max var. Williams 82
atggggctccatagatggtggcaagttaaattggtaacattgtctttgtttttgtcatgtttggtaggtggctcacagtcttatttttacgaccgtgaatcgttagatgactttcttcgcaagcaagcgaacaaagagacagaaaggcttagaaaaggtgtgctatccaatgtttaccttccttctaacttcacaggaatggaagtttcagttgttagattgcgcagtttctctttatggtcaagaggaatgaattatagttccttcaatcttccaccgcggattgtactgcagcctaatgcgaagaggatagctattttgtttgaaaacttgggcaattggtcttctaattattacaatgtgcctaaccacacaatggtggcttcagtttttggtgttatggcttatagttcttcagaaacagcatttgtagatgagaagattaactttaccacccatggtgaccctatcagaattcggtttcctcatgttgatcaacatggggaaaatgacacaccaatttgtgccaagtttagagctggcgggttggtgaaattcaaaaacatgactaagccatatgtatgtgaagtatatagccaagggcactacactcttgtagttccatcttttccttctccaaaagaacctaatacccggagtcatagcaagagatttaccaaatggtgggtgttgggatttgtaataggttttgctgggttggtcatattggttttaatcttgctagctttagttaaggaggccaagaagagaagaataagaaaaatggagaagaattcagaaggaggtgagctttttgatacattttggataggagaatctaaattgccatcagcttcaatgcttagaacccaaccaacccttgagaattaa

SEQ ID NO: 2871 - DNA, 459 bp, Glycine max var. Williams 82
atgtcgcagttgctggataaagccaagaacttcgtgtcggagaaggtaaatgatatggccaagccggaggcgagtgtcactgacgtggacttcaagcgcgtgagcaaagataatgtcgagtacttggccaaggtctctgttcgtaacccttattcaacttccatacccatttgtgagatcaactactctttcaaaagcgcatccagggagatagcatcagggaaaattccagacccaggatcgttgaaggcaaaggacacaacaatggtggatgtgccagttaaggttccatacagcatattgatgagcttggcaaaggacattggtgctgactgggacatagactatcaattggatcttggtctggttattgatgttcctgtcattggcatcttcaccattcctctctctcagaaaggagagatcaagctaccaaccctctctaccatgttcgcctaa

SEQ ID NO: 2872 - DNA, 1425 bp, Glycine max var. Williams 82
atggtgagccaacagcttctgtccaagattgccaccaatgacaaacatggagagaattctccatattttgatgggtggaaggcatatgatagaaacccttttcaccctacaaaaaatcctcagggtgttattcagatgggtcttgctgaaaaccagctttgctttgatttgattgaagagtggataaggaataaccccagggcttccatttgcactcctgaaggagtgcatcagttcagaaatattgctaattttcaggactatcatgggttgcgagagttcacaaatgaaatggcaaattttatgtcaaaagtgagaggaggtagggtcaaatttgatccagaccgtatattgatgagtggaggggcaacaggggcaaatgaactaatcatgttctgcttggctgatcctggagatgcttttatgattcccaccccattttatcccggattcgtccgtgacttgtgttggagaactggggtgcaaataattcctgtccactgtgatagctccaacaacttcaagataacaagagaagcacttgaagtagcctacaaaaaagccaaagaggacaacatcaacgtgaaggggttgatcataacaaacccgtctaaccctttaggcacaacattagacaaggacacgttgaagagcctagtgaatttcatcaacgaaaaaaacattcacttagtttgtgatgaaatctatgctgccactgttttcagctcccctagttatgtaagcgttgccgaagtgatccaagaaatggaacattgcaaacgtgacctaattcatgtgatttatagtttgtctaaggacatggggtttcctggcttcagggttggcatagtttactcattcaacgatgaagtggtgaattgtggaaggaaaatgtcgagtttcggattagtctctacgcaaactcaacacatgttggcttcgatgttttcggatgaaaagtttgtaactaggtttctttcggagaattctaggaggttggaacaaaggcacgaaaagttcatgaaggggcttgaagaggttaacatcactcgattcccaagcaatgcgggacttttttgttggatgaacttgaagagtttgttggaggagccatcttttgaagctgagttgaagctatggcgtgtgattattcatgaggtgaagctcaatgtttcaccgggatcttccttcaactgttctgagcctggttggtttagggtttgctttgccaacatggatgatgaaacagtggatgttgcactcaacagaattcgtgcattcgtaggtaaagaaactaagaaatcggtgggattcaaacgatggcaaccgaatcttaggctcagtttctcttcaaggatatttgatgagagtgtcatgtctcctcattcgcctattcctacttcaccacttgttggagccaattga

SEQ ID NO: 2873 - DNA, 1482 bp, Glycine max var. Williams 82
atggaaagagtagcatcagtatctcggccactgaaaatatacttcctcccattcttctcaccggggcacctaatccctctggtccagctggctcgcttggtggcggcacgaggccagcacgtgaccatcatcaccacccccgccaacgctcaactcttcgaccagaacatcgacaaggacaccgcctccggccaccacatccgcgtccacatcatcaagttccccaacgcccacgtagggctaccggaaggcatcgagcacctctccgccgccaccaacaatgaaaccgcctacaagatccacatggcggcgcatctcatcatgccccagctcgagtctctggtcaaacactctccaccggacgtcttcatccctgacatcctcttcacctggaccaaagacttctcccagaaactctccatctcgcggctagtcttcaaccctatttccatcttcgacgtctgcatgatccacgccattaaaacccaccctgaagccttcgcttccgactctgggccttttctaattcctgatctaccccaccctttaactctccccgtcaagccttcccccggtttcgccgccttaaccgaatctctcctcgacggggaacaggacagtcacggcgtcatcgtaaacagcttcgccgatctcgacgccgagtacactcaacactaccagaaacttacagggcgcaaggtgtggcatgttgggccaagctccctcatggtgcaaaagacggtgaaaagtagtactgttgatgagagtagacacgattgtctcacgtggcttgactcaaagaaagaatcttcggttctctacatttgtttcggaagcctttctctcatctccgacgagcagctttaccagattgctaccggactcgaagggtcagggcattgttttctttgggtggtgcatcgcaaaaacaaagacggagaagaaggagattcttcttcttcttccggaaagtggttgccggaagggtttgaggaaaagatagctaaggagaacagaggcatgctgattaagggatgggcgccgcagccgttgatcctgaaccaccctgcggtgggaggatttttaacgcactgcgggtggaacgcggtggcggaggcgatcagctccggggttccgatggtgacaatgccggctttcggggaccagtactataacgagaagctgataacggaggtgcacgggttcggggtggaggtgggggcggcggagtggagcatttcgccgtacgaggggaagaagaaggtggtgagtggggagaggatagagagtgccgtgaagaggttgatggatgatggagagaaagggaagagaatgagaagcaaggccaaagagatgcaggagaaggcttggaaagctgttcaagaaggtggttcttcttacgacagtctcacggctctgattcatcatttcaagactcttgtgcctaatcatgtgaatgggaatgggaatatcgatcactga

SEQ ID NO: 2874 - DNA, 552 bp, Glycine max var. Williams 82
atgtcttctccaagcaagcggcgagaaatggacttgatgaaactgatgatgagtgactacaaggtggagatgattaatgatggaatgcaagagttttatgtgcacttccatggacccaatgagagtccttatcatggaggtgtatggaaagtaagagttgagctgccagatgcttatccttataaatctccttccataggctttatcaataagatctatcacccaaatgttgatgagatgtcaggatcagtttgtcttgatgttatcaatcaaacctggagtcccatgtttgatcttgtcaatgtgtttgaggtgtttctaccacaacttcttctgtatcccaatccatcagaccccttgaacggagaagctgcagctttaatgatgcgtgatcgagccacttatgaacaaagggttaaagagtactgtgagaagtatgctaaacctgaagacataggagctgccacagaagagaactccagtgatgaagagctaagtgaagatgaatatgattctagtgatgaacaggttgctggtaaggcagacccctag

SEQ ID NO: 2875 - DNA, 1380 bp, Glycine max var. Williams 82
atggtaaccatccactgttcccacctggtggttccctccgagcccacgccatcttcaaccctctcactctccctctgcgaccaaatcaagctcccaaaccacggatctcagctctacctctacagcaacaccagcatcacccaccatcatctcatccacactctctcagcctccctcagtaaagcactcactcactactaccccttcgctggccgcctccgccgcatccccggcggccgcttccagctcctctgcaacgccagtggagctgtcctcatagaagccacatgttcaagtcaattcagtttcaaatattttcgcgatttcgctcccgtccacgctgtccccaaaatcaactacgatgatgtccccattgaggatgtccccttgctggtggcgcaggtcacgaggttccccaacggcttcatcacgctcggtctctccctctgtcgcgctctcctcgatggaaattcggctagcagcttcgttaactcgtgggccaagcttgctaaaggagagaacttagattccagcttgattcctttgcttgatcgaaccaagttagattcatttaaactcaataaaccaccacgttttgaacaccctgagtttttgccaccaccccttttgacacaacagcatacccagatggaaggacaacttggttcgaccatattggaactcacaaagggtcaagttgagaaactgaagaagaaagctagtgactttggaagtgggtatggtattaataacggtaatggttccgtacgaccttatactagttttgaggttataactggtcacttgtggaggtgtgtttgcaaggtgcgttacgcgggtggtgatttgggtcaaccaacgaggttgaccactttggttaactgtagaaaccgtttaaggccttctctccccacggcttattttgggaatgcaacgtttcccacggtgacaccaacttgttcctttgatgagatcatgcacaagcctctgagctatgctgtggggaaagtgagggaagcgattgggaagatgagtgatgagtatgtgaggtctgcgcttgattacatagcaagtgtggaggacttcgatttgttcagggacacgttttatggttctggtgatgggaaagggaagtttaagggagatcctaatttgtatatggttggttggacgaattttaagtattttgagacggattttgggtgggggaaaccggtttctttgattcccggaaacattaattctaatggcaaggcttttcttttggagaatgcaagtggtgatggcttcattgtagctgtttgtttgctggaatcgcatgtagatgctctgaggaagttgttttatgaggatatggaggatgctagttccaaattgtga

SEQ ID NO: 2876 - DNA, 1237 bp, Glycine max var. Williams 82
ctaaactttatggaaacctttaatatgtacaatgtatgtagacgctatttatgtcaaagaggtcatgcttctttttgacacaaacaagtgtgagtggtgagatcaccattctactgtatgaaattgaggcatgttgtcatgctttcaattctgtggcctgcactgctgttgtaatgcttgccctgatgaagcacttaccaagtttcttgcacgagaagacaagggaacttgcttgctatggcaactctgagcaattcaactaatatcttttggcaagattgtcaagtaggaaggcttgaaaggcagaagctacttaaccaaaagggatgtgttgtatggattactggactcagcggatcaggaaaaagcacattggcatgttccctaagcagagaactgcactcaaagggaaagttatcttatgtccttgatggagataaccttcgacatggactaaacaaggatcttggtttcaaagccgaagatcgcgctgaaaatattcgcagaactggagaagtggcaaaactgtttgctgatgctggcttaatatgtgttgctagtctgatatctccttacagaagagaccgagacacttgccgtgccatgttacctgatgcaaattttattgaggttttcatgaacatgcctctagaattgtgtgaggcacgagatccaaaaggcctctataagcttgctcgtgcggggaaaatcaaaggttttaccggcattgatgatccttatgaaccacccataaactgtgagattgaaataaagcaggaaaatggggattgtccaacacccactttgatggctggacaagtagttacttacttggagaataaaggatttcttgaatcctagggtttttaagtttaatcacatttgtaatgggattattctctcataatgatgtttcttctaaatgaagttaaaaaaggaatcctaggaagtgcaggtagcagagtggtgagaggataaatggactgataaagttcatcaatcataaataataattaataattgttgcaattcattctataggttggtcaagaatttcagcgtatttttcagcttttgatatgattgttttcttcgctttgctggtcattatggtcctaggaaattcagttacaaaggctgagacatatactcatgcttgtccgttaattgtaaattttcgtgcacctctaagaatgttagtgcgtttggataacacacaaaaatcaattttactcca

SEQ ID NO: 2877 - DNA, 1080 bp, Glycine max var. Williams 82
atggcttcttttctttccttatctcttcccaagttaaacttaataaaggcctcttcagcagctaacaccactacaacaacaacaaccactcttcccacagctgagacactcaatgagaaatttggcagaaaaggcatcaagttcttggagtctgataacactcccatagttgacttaacagtgagaaatggcagctccttgaggctgaggatacctgatgctcatgtgacatcatacaaaccaaaagttaattggaaagatgatggatttcaggaggttctttacacaattcctgcaactgaaactggcccttacaaggccaaaggtggtgttggtttggtcatgaatgaagtgctgcaacctggagccaaagggttactaccttccactttagagtggactgtaaatgatgttgactctgattccatagatgctctccaggttgaattgagctgcactagtagattctttgacatcacttacatagtgaccctctatcctgtgagtatggccacagcagttgtagccaagaacattggccccaagcctgccactctaaccaatgctattctaagccattttagattcaagaacagacgtgggacagcaattaaaggcctcagaagctgctcatatattccacatgctcctctttcttctccctttcaaatcttgactccatcagaagctaccatatctgagcctcctagatggctttcctttggtaatgagactgaagccaagcctggcacgtggggtcagcaggctttgtctattaccctccttgagaataagatgagtagagtttatgctgcacctccaaaagaaagattaaaggcattctataacacccctccttccaagtatgaaaccattgaccagggacgtgggctatgcttcagggtgataagaatgggttttgaggatatttatttatcaagccctggttccttgtcagagaaatatggaaaggactacttcatctgcactggccctgcttcaatactggtgcctgtgactgttaatcctggggaagaatggagaggtgcacaagttattgagcatgataatttgacatga

SEQ ID NO: 2878 - DNA, 1224 bp, Glycine max var. Williams 82
atggaagagcctattgtggtgaacaaaggtgaggagcctttagatttgcctccaggtttcaggttccaccctaccgatgaagagataatcacttattatctcactgagaaggtgaagaatagcattttcagtgcaattgctattggagaggctgatttgaacaagtgtgaaccttgggatttaccaaagaaagccaagataggggagaaagagtggtacttcttctgtcaaaaggataggaagtacccaactgggatgagaaccaatagagcaacagaatctgggtactggaaggccacaggaaaagataaggagatttacaaagggaaagggaaccttgtggggatgaagaagaccctcgtgttctataaagggagagctccaaagggtgagaagagcaattgggtcatgcatgaattcagattggaaggcaaatttgctagttacaatcttcctaaggcagcaaaggatgaatgggttgtctcaagggtttttcacaagaacacagatgtcaaaaagtcctcaattcctggccttttgaggataaactctattggggatgatcttcttgattattcttcactcccatctctcatggatcctccttatggcaacaacaccaacaccaccaacaacaacaacaacaatgctaacccactttcatcaactaaattatcacaatcagagggctattatcttcccagtttctccatcaacaacaaccaccaccagcttctcatcaagccagaagaccaccacaaccacagaatctatgaatttcccacaattaacttcacctccaaccaaaccaatctcagcagcaacaacgttaacccaatggggaacaacaacacactctcatcacagcccttaaacatgttctcagctgattactatgtacaccaaaacaggatcaaaagctccatcatgccaagtgttgcaggctcaggttttgttagcgacaacaataaccatgatgaagctatcctaagagcatttgcagccaagaacaacgagcacatacagtgcaagatggagcaattttcttctaaccactcacaagacacgggcttgagcaacgacagaaacacaactgacacatcctcggtggtttcgatgggaagaaataataataatagggcactgtacgaggatcttgaaggcccttcttcagttgcacctctctcagatttggaatgcctgcagtgggatgatgactactga

SEQ ID NO: 2879 - DNA, 774 bp, Glycine max var. Williams 82
atgggaggttccttcaaaaactacgacaaccagagtcatgaggttagtgaagaagaatctgagaattacccttatcaccaccatgcaccacttgttatgcatgtaaatgtgaacaacaattctcattccaacattgcaactactacttctgctctttctaacaaacgttccactgtgagaattctgtgcaaagcagcaccaaatttttctctttccattcgggacggcaaggtcattcttgcacctgcggatccaagcgacgcgtaccagcattggtataaggacgagaggtacagctctatggtgaaggatgaagaggggtaccgtgctttttgtctagtgaacaaagcaaccaatgaggtcatgaagcattccattgctgactctcacccagttcggttggtgccatacaatccagagtatttggatgagtctattatgtggactgaggccagtgacctgggtaatggctacagagccattaggatggcaaataatattcatttgaatatggatgctttaaaaggtataaaagaacttggaggggtccaagacggcacaattgttgcgctgtggaaatggaatgatggcgacaaccagaaatggaaggttgtaccatatggtgatgaggactctgctattgatgctgaccacagtctaatgcggaggctggatcgcttggagttgaacatgcaggcgatgttcgatgctcagcaaaagtaccttgagggcttgtctaaacgttttggtaatgaaaaattatctggttattaa

SEQ ID NO: 2880 - DNA, 1059 bp, Glycine max var. Williams 82
cacccttggctcgtacgcaattttttttattttgagcaaaacagcagttagtatgggaggttccttcaaaaactacgacaaccagagtcatgaggttagtgaagaagaatctgagaattacccttatcaccaccatgcaccacttgttatgcatgtaaatgtgaacaacaattctcattccaacattgcaactactacttctgctctttctaacaaacgttccactgtgagaattctgtgcaaagcagcaccaaatttttctctttccattcgggacggcaaggtcattcttgcacctgcggatccaagcgacgcgtaccagcattggtataaggacgagaggtacagctctatggtgaaggatgaagaggggtaccgtgctttttgtctagtgaacaaagcaaccaatgaggtcatgaagcattccattgctgactctcacccagttcggttggtgccatacaatccagagtatttggatgagtctattatgtggactgaggccagtgacctgggtaatggctacagagccattaggatggcaaataatattcatttgaatatggatgctttaaaaggtataaaagaacttggaggggtccaagacggcacaattgttgcgctgtggaaatggaatgatggcgacaaccagaaatggaaggttgtaccatatggtgatgaggactctgctattgatgctgaccacagtctaatgcggaggctggatcgcttggagttgaacatgcaggcgatgttcgatgctcagcaaaagtaccttgagggcttgtctaaacgttttggtaatgaaaaattatctggttattaagtatctgtatgttaagttatacactttttttaagtgattaaaattaaaagttcactttgcttttgggtttgtttggtgtttgatcaatgatcatgcatcatataccatgagacgcatcttggtgctgacaagataagggcattcacccgcttctaatcttttgctttgtttcttttactacacaaaaaaaatggactagaactagtgtgtattttttattccattcggtcttg

SEQ ID NO: 2881 - DNA, 792 bp, Glycine max var. Williams 82
atgtcgttccccttcaaccactctcaccgcagggacgacgacgacgacgacgacgacaaacgacccgccgtttaccctcctccgggtaacaccttcaacaaccctccaccacccttctacggcgtccatcagccagaaacccacgtgtcccatgtcttcaacaacagcaactactccgctcccccgcctccaccaccttcccataaccaccaccatgactccttcactcacggaggcggcagcaccgtgcaccacacccctcacaacaacgcgccacccaccacctctgttcatcacttgagccaccaggttaacaccggtgttctctcgagcaaacccactgtgagagttttcaccaaagccaatcccaatttctctctcaccattcgtggcggccaagtcattctcgctccctccgatcccaccaatgagtaccagcattggtataaggatgagaagtacagcactagggtgaaggatgaagaggggtgccctgctttctctttgatcaacaaggccactggtgaagccttgaagcactccatcggtgccactcatcctgttcggctgataccttacaagcccgactatcttgatgagtctattctatggactgaaagccgtgacttaggagatggccacagagctataaggatggtcaacaatgttcatcttaatgtggatgcttttcacggtgacaagaattctggaggtgttcgtgatggcactacaatagtcctctgggactggaacaaaggtgataaccagcagtggaagatcttaccttactga

SEQ ID NO: 2882 - DNA, 1392 bp, Glycine max var. Williams 82
atgagcaaggattatctaatcatactttctctccttctttccacggtgcttgcaactgcaagttcttcttcttcttcttcctccctctatcttgggaagggcttctcccatcgcaaattgtctcccagttatcacattcacaaaaccattgacgaatcctatgcagttatcttcgatgctggtagcacgggaagccgtgtacatgtctatcgttttaaccaacaattagatctccttcgcattggccaagaccttgagttgtttgtcaagactatgccaggtttaagtgcttacgctgagaatccacaagatgctgcagaatctcttattccacttttggaggaagcagaagctgctgttcctcaggagtttcaccccaggacgccagttaaacttggagcaactgcaggtttaaggcaattggaaggggatgcttctgataggatattgcaggcggtcagtgacatgctcaagaacagaagcacactgaacgttggggccgatgcagtttcagtgttgagtggaaaccaagaaggagcttatcaatgggtaacaattaactatctactgggaaacttgggaaagcattattcagaaactgttgcagtagttgatcttggaggtggatctgttcaaatggcttatgcagtctcagagacagatgctgcgaaggctccacgagcaccggacggagtggaatcatacataacggagatgttccttaggggaaagaaatattacctctatgtacacagttacttgcgatacggtatgctagcagctcgtgcagaggctttaaaggttcgtgattctgaaaatccttgtattttggctggctttgatgggtattacgtatatggaggagtgcagtataaggccaaagctcccccttctggctcaagcttcagccaatgccaaaatgttgttgttgaagcactccatgttaatgcaacatgctcttacaaggattgcactttcggagggatatggaatggtggtgggggagctggagaaaacaacttttttattgcctcatttttctttgaagttgccgatgaggctggttttgttgatccaaacgcccccaatgccaaagttcgtcctgtggattttgagaatgcagcaaaggttgcctgtaacacagaattaaaggatctcaaatccattttccctcgtgttaaggatggagacgttccttatatatgcttagatcttgtatacgaatatacattgctcgttgatggatttggcatagatccgcagcaagagattacgttggtgaggcaagttgagtatcaagattctctcgtggaagcagcatggccactaggcagtgccatagaagccatatcatcattacctaaatttgagaaattaatgtatttcatttaa

SEQ ID NO: 2883 - DNA, 1212 bp, Glycine max var. Williams 82
atggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttggaaggattggaaggaacttcttgaggtgctggcacggtcgcaaagactcccctcttgatgtcattgccatcaacgacaccggtggcgtgaaacaagcctctcaccttctcaagtacgattcgatcctcggaaccttcgatgctgatgtcaagcctgttggcagcgacatcatctctgtcgatggaaaggaaatcaaagttgtctctgaccgcaaccctgccaaccttccttggaaggatttggggatagacttggtgattgaaggaactggggtgtttgtagacagagaaggtgcagggaaacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaaggtccttgatcagaaattcggtatcatcaagggcaccatgaccaccactcactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggcaaactcaatggcattgcactccgtgtgccaacaccaaacgtctcagtggtggacctcgttgttcaggtctcaaagaagacctttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgcttggtatgacaatgagtggggctactcccaaagggttgtggatttggctgacattgttgccaacaagtggaagtga

SEQ ID NO: 2884 - DNA, 1074 bp, Glycine max var. Williams 82
atgtttgtattgtatgtgcgctatttctcaaacactgaaataccaaatcatttgctgagtccatttttttttcctttttcattgagataccaaatgggatttcgtagtctcttcttgtctaccattttgatagcatttatcagctttggtagtactactcagaacttcacaagtagccccaatgatttgaaagccttgattggattctctaggtgcttagaatcagctattccggactggaatagttctacctcctctgattactgcacttggtctggtgtcacatgtgttggcacgagggtggttcgcttggaacttggaagcacacaacttacagggaagatctgtgaatcattagcatgtttggatcaacttagagtcttgaagctttccaaaaatctcttcactggctctcttccacacagcttgtttcatcttccaaacttggagatcatggactttagcaataatcaatttgaaggctctatagatacaactatgtgttcctcttttactcagctccgagtatttaaactgtcaagtaactacttttctggtgagattccacgaaatttgggtgattgttcctctctgcagcatctgtctattaataaaaataatttgtcaggaagccttccagagagcatctttctgctacagaatttgaatgaactatacctgcaggataataagctatctcggccactgagtgagggagttggcaagctttcaaacctattggaatttgacatctccaacaatgaattttctggaattcttcctaatatctttggaggcctcaccaggcttaaggttttctatgctgggtcaaatagattcaccggtccattgcctgcatcgctggtgaattctgtatctcttcagatgcttaatttgaaaatcaattctttggctggttcagttaatttcaattgctctgcactgaaaaatattgttctcattaataatcaatccaattgttcggtcctttttagtctaatgaattgcttgagattggaaggaatatgtcttggttcttctgaccatttcaactacggagagaccacctgttaa

SEQ ID NO: 2885 - DNA, 411 bp, Glycine max var. Williams 82
atgccacaagcacagggtcaaaatctagaattcagcaatctcaaggtttttgtgctggccaacagtcagatcaaaggttcaattccgaaatggttaagtggatgcaagatgctgcagatgctggatctgtcatggaatcatctcagtggaggcattcccccgtggattggcaaattgaacaacctctattacttggatttgtcaaataactctttcactggccgcataccacagagcttcacaatgttcttgagcctccagcccaataattcttcattggaaggaactctttttgcctttccctttgataccgttgagactggaactttaaagaggatgaagtatgaaaaactttcaaatttacgaccatctttgctactcagttacaaaggctttatccttaatgaataa

SEQ ID NO: 2886 - DNA, 2253 bp, Glycine max var. Williams 82
atgacggggcgaaaggcacttacaattgatggcaaaggaagaatcttattctctggttccattcattatcctcgcaggactcctgaaatgtggccatatttgattcgtaaagcaaaagaaggaggacttaatgtaattgaaatatattatgatttttccggaaatctagatcttgttagattcattcgaaccattcaaaatgaagggatttatgcgatgattcgaattggtccatatataagcagcgaatggaactatggaggtctcccagtttggttgcacaatattcccaacatggaatttaggacacataatcgtgcatttatggaggagatgaaaaccttcacctctaagatagtggacatgatgcaggatgagacactatttgccatacaaggaggacccattattattgctcagatcgaaaatgagtatggaaatgttatgcatgcatacggtaacacaatatctcaaatgattgactcgtctaacggttattattgtgatcaatttcaacctaacgacaaccacaaacccaagatatggactgagaattggactggcgggtataagaattggggtatgcaaaatcctcatagacccgctgaagatgtagcttatgcagtttccaatttgtaccatggtggtaccaactttaaacgaactgccggaggcccatatgtcactacttcgtatgactatgacgctcctttggaagaatatggaattaacatatactttaacatactcctaacttgttctgtgacttccataaaacgatattatgctatatcaaaagagaatatcttaactcaaggttcctcgcaaaatatagattatggcaacatggttacagccatagtgtacacttatgatggaaaatcagtttgcttcattggaaatgcacatcaatcaaaggatgctacaattaatttccgaaacaatgaatacaccattcatgcctggtctgtttctatccttccaaattgttcttcagaagcttataacactgcaaaggttaatactcagacaactataaagctgtttgtccaaattaaagatggactaatcaccggcatcattgacttgactgctcgaaaactcttggatcaaaaggttgtcacaaatgattctagtgattacttatggtacatcaccagcattgacatcaaaggagatgatgaccctagttggaccaaagaatataggctaagagtgcacaccagtgggcatgtactccatgtatttgtcaatggaaaacatgttggtacccaacatgctaaaaatggacaattcaagtttgtttccgagtccaagatcaaattgactaccgggaagaatgagatatctctacttagtaccactgttggattacccaactatggtcctttctttgacaacatcgaggtcggtgttcttggtccggttcagttggtggcagcagttggtgattatgattatgatgatgacgagatagtcaaagatctcagcaaaaataaagggagttataaagttggactgcatggggagcatgagatgcattacagctacgagaatagcctcaaaatatggtatacagatgctattccgaccgaaagaatttttgtttggtataagaccacattcaaaagtcccattggagatgatcctgttgtggttgatttgagtggattaggaaagggtcatgcttgggtaaacggtaacagcattggtaggtattggtcaagctaccttgcagatgagaatggttgctctccaaaatgtgattatcgtggtgcatacacttctaacaagtgcttgtcaatgtgtgcacaaccttctcaaagatggtaccatgttccatgctcatttcttcgtgacgatgatcaaaacgcattggtcttgtttgaggaattgggaggtcacccctatgatgtcaactttctcacggtaactgttggaaaagtttgtgcaaatgcttatgaagggaatacgttggaattagcatgcaacaaaaatcaagtcatctctgaaattaaatttgctaactttggcttaccaaagggtgaatgtgaatcttttcagaagggaaattgtgaatcttcggaggctttatcggtcatcaaagcgcaatgcattggaaaggataaatgttctattcaagtttctgagaaaacacttggacctacgaggtgtagagttgctgaaaatagaagattagcagttgaagcggtttgtgatataaacgtaagcggcgaagggaggaaacactag

SEQ ID NO: 2887 - DNA, 2253 bp, Glycine max var. Williams 82; identical to SEQ ID NO: 2886

SEQ ID NO: 2888 - DNA, 2034 bp, Glycine max var. Williams 82
atggcggccaccggagcccgtctcttctccgctgcactcttccgccgttatccgccgtcgccggacggaaaaacgaactcccgccggactccgattgcgactccgcgcctcgccgtgtcggtggaccaggttccgccggcgacggtggagaaagagaagcgtagggaagagaagaagaagcgacgcatgaacggttggaatgagtatttggagcggtcgaaggagttgatcaaaccggacggtggaccgccgcggtggttttcgccgttggagtgcgcttcgcgattggacaactcccctcttctgctctttttgccagggattgatggcgtgggacttggacttattttacatcatcagaaactgggaaggatttttgatatatggtgcttgcatattccagtcgctgatcggacaccatttacagacctagtgaaaatagttgagagaacagttaggtcagaatatcaacgttcaccaaacagacccatatatcttgttggagaatctttaggagcttgccttgcactggctgttgcagcacttagctctgatattgatcttgtactgattttggcgaacccagctacttcgatcagaaggtcacacctgcaacttctaacaccattattggaagctttgcccgatccattctctcctgccctgcctaacattctcagatcaacaacaggtgaatctctgaggatggtgttagataatgtggtccaagggctccctctacaaaatacagctggagagctagtgaaggattttactactttctcattatctttgcacgttcttgctgacatattaccaaaagaaacacttgtgtggaaactgaagatgcttaagtcagcttctgcttatgccctttcacgcctttatgctatcaaagctcagactttgatactttgcagtggaaatgatcagttactgcctagtcaacaggaaggtgaaagactactggagttactgcctagatctaaaagccaacttcgtaaatttaatgacagtggccatttcctattcctggaggacagcattgacctggtaactatagtcaagggcacttcatactaccgccgcggcaagtctcatgactatatatcagattatataccaccaacacctgaagaagccagaaaagtaacagaatcatacagtttgtataaccttgtctcaactgtaatgctctcaactttggaggatgggactattgtaaaaggccttgctggaattccttcagaggggcctgttttgtttgttggggaccacatgctactgggattagacaaagttcccctgtggtgtagaattttttctgaaagaaatatcgttgttagagggatagcacatcccttgttttttatgagaactaaaaaaggaaaattgccagatgtatcttattttgacggtctcagaatcatgggtgctgtgcctgtagcaccaaccaacctctacaagcttttttcttccaagtctcatgtcctattatatcctggagggatacgcgaggcttttcataggaagggtgaagaatacaagttattctggcctgaacaatccgagtttgtaaggatggcagcaagatttggagccaaaatagtaccttttggtgtagttggagaagatgacattggtcaagtagtttttgattatgacgacttggtgaaaattccttactttaggtctgaaatagaaagcctcacaaaggagactgcgcacttgaggaatgatgctggtggtgaggtggcaaatcaacaagtgcatttgcctttgattttgcctaaagttcctggccggttctacttttattttggaaaaccattggaaacgaaaggaagggaacaagaactgagagacaagcagaaatctcaagagttatatttacaagtgaaatctgaggttgagaaatgtattgcttatttaaaggagaaaagagaaagcgacccctacagaggtttagggcctcgcctattataccaggccagtcatggctttgagtctgatgttccaacatttgaaatttaa

SEQ ID NO: 2889 - DNA, 2061 bp, Glycine max var. Williams 82
atgaattcattgtgtggaagctcagtgtccctcaagagtgagaacaacaactctagaaccaaagtccaacaacccaccactccttcaaatgactcagttatgcaatccaagaaaaacaatgccactcaatcctctggtgatctagaccaaaccagcctaaccccaccaagcttaaaccttccatcactcaaatttgaccttgatggagatgtggaagttcagtcaccagatagttcaatgtgggaatctttttttgctgaccacaatttagatggtgatttcatgatctcttccccagtgaggaccccacaagcctcttcctacaattgcaactacaactatgctcagggaatgcaaggccagagtctttcagggtgttccccacctcgtttctcatcatcacaaattggagccttcaacagcaacaaaggcaaaggacttagccccctccacagggttttcaactcacccaacaatcaatacatgcagcatgttgagaacctctcactgccagcaatagagttcttggaggactaccaattagggtactcttcatcaacaaccaacaagatgtgttgctctgatcacaacaacattgcaagttcatctgagtgctttgacttgtcaatgtctcatcaaatcccttcgtccatgttggatggcttggcactgcacaattcctcctcgaggtaccatcgtggatcggttgtcgtcgacgaagaatcgtcggtgcacggtggtggtgctggtggcttttctcagctatcagaagagagtgacatctatcaccagatggggtccatggctagtgcttctctttcacaggctctacaacaagaacactaccaagagaagcagcaagcacaacaactgcaacaacaacaacaacagcagcagcagcaccagcaagagaatctgatggtgcctattccaataggagtcgagcaggagcaagacagcgggcttcaactggtgcacctgctcctggcatgcgcggaggcagtagccaaagaagaatacatgctggcaagaaggtacctccaccacctcaaccgcgtcgtcacccccttaggcgactccatgcagcgcgtcgccgcctgcttcaccgactccctaagcgtcaggctcaactccaccctcactcccaaacctacaacaccttccaaacccttaaccccttcaaactccctcgaggtcctcaagatctaccagatcgtctaccaggcctgtccctacgtcaagttcgcccacttcaccgccaaccaggccatcttcgaggctttcgagaccgaagaacgcgtccacgtcatcgatctcgacatcctccagggctaccagtggcctgccttcatgcaggccctggcagcccgcccagcaggcgcaccttttttaaggatcacgggagtgggcccctcgatagacactgtccgagaaaccggacggtgtcttaccgagctggcccactccctacggatccccttcgagttccacgcggtcggggaacaacttgaggatctcaagccacacatgttaaaccgccgtgtcggggaggcgctggcggttaatgcggttaaccgcctccaccgcgtccccggcaaccacttgggcaatttgctgaccatgctacgtgaccaggcacctagcatagtaactctggtggagcaagaagcgagccataacggaccttactttctagggcgttttcttgaggcattgcattactactccgccattttcgactcgttggacgccacttttccggcggagtcggcgcagcgggcgaaggtggagcagtacatattcgcgccggagatacgaaacatcgtggcgtgcgaggggccggagaggttcgagaggcacgagaggttagagaagtggcggaagatgatggaggggaaggggttcaagggagtggtgctgagtccgaacgcggtgactcagtcgaagatattgttggggttgtattcatgtgaggggtataggttgacggaggataagggttgcttgttgcttgggtggcaggatagggccatcgttgctgcgtctgcatggcgttgttga

SEQ ID NO: 2890 - DNA, 2262 bp, Glycine max var. Williams 82
atgaattcattgtgtggaagctcagtgtccctcaagagtgagaacaacaactctagaaccaaagtccaacaacccaccactccttcaaatgactcagttatgcaatccaagaaaaacaatgccactcaatcctctggtgatctagaccaaaccagcctaaccccaccaagcttaaaccttccatcactcaaatttgaccttgatggagatgtggaagttcagtcaccagatagttcaatgtgggaatctttttttgctgaccacaatttagatggtgatttcatgatctcttccccagtgaggaccccacaagcctcttcctacaattgcaactacaactatgctcagggaatgcaaggccagagtctttcagggtgttccccacctcgtttctcatcatcacaaattggagccttcaacagcaacaaaggcaaaggacttagccccctccacagggttttcaactcacccaacaatcaatacatgcagcatgttgagaacctctcactgccagcaatagagttcttggaggactaccaattagggtactcttcatcaacaaccaacaagatgtgttgctctgatcacaacaacattgcaagttcatctgagtgctttgacttgtcaatgtctcatcaaatcccttcgtccatgttggatggcttggcactgcacaattcctcctcgaggtaccatcgtggatcggttgtcgtcgacgaagaatcgtcggtgcacggtggtggtgctggtggcttttctcagctatcagaagagagtgacatctatcaccagatggggtccatggctagtgcttctctttcacaggctctacaacaagaacactaccaagagaagcagcaagcacaacaactgcaacaacaacaacaacagcagcagcagcaccagcaagagaatctgatggtgcctattccaataggagtcgagcaggagcaagacagcgggcttcaactggtgcacctgctcctggcatgcgcggaggcagtagccaaagaagaatacatgctggcaagaaggtacctccaccacctcaaccgcgtcgtcacccccttaggcgactccatgcagcgcgtcgccgcctgcttcaccgactccctaagcgtcaggctcaactccaccctcactcccaaacctacaacaccttccaaacccttaaccccttcaaactccctcgaggtcctcaagatctaccagatcgtctaccaggcctgtccctacgtcaagttcgcccacttcaccgccaaccaggccatcttcgaggctttcgagaccgaagaacgcgtccacgtcatcgatctcgacatcctccagggctaccagtggcctgccttcatgcaggccctggcagcccgcccagcaggcgcaccttttttaaggatcacgggagtgggcccctcgatagacactgtccgagaaaccggacggtgtcttaccgagctggcccactccctacggatccccttcgagttccacgcggtcggggaacaacttgaggatctcaagccacacatgttaaaccgccgtgtcggggaggcgctggcggttaatgcggttaaccgcctccaccgcgtccccggcaaccacttgggcaatttgctgaccatgctacgtgaccaggcacctagcatagtaactctggtggagcaagaagcgagccataacggaccttactttctagggcgttttcttgaggcattgcattactactccgccattttcgactcgttggacgccacttttccggcggagtcggcgcagcgggcgaaggtggagcagtacatattcgcgccggagatacgaaacatcgtggcgtgcgaggggccggagaggttcgagaggcacgagaggttagagaagtggcggaagatgatggaggggaaggggttcaagggagtggtgctgagtccgaacgcggtgactcagtcgaagatattgttggggttgtattcatgtgaggggtataggttgacggaggataagggttgcttgttgcttgggtggcaggatagggccatcgttgctgcgtctgcatggcgttgttgatgctaattaatgctactgcatactcttgcaatgagttaattaatgtcctctttgttttgattattattattatgttgctaattagttgttatacttctttactttggtacgtgttagtttatatgatatgttagggagaagaaattataaagaaaaaaaaaaagaaatattagtgatatactttttaacactttttattgg

SEQ ID NO: 2891 - DNA, 1362 bp, Glycine max var. Williams 82
atgtttctattgttcttcttttttgtggtacaggttaattatactaaggagtttgagatggaaatggctaatggaaacggtttccaacttagtgtgaagaagctaagtgaaccaactctagttcctcctgctgaagaaacaaagaagggtttgtatttcctatctaaccttgaccagaacattgctgtgattgtgagaaccgtttactgcttcaaaactgatgagagggggaatgagaaggctggggaagtgatgaagaatgctttgaggaaggttcttgtccactattaccctcttgctgggaggcttactataagctcagagggtaaactcatagtggattgcacaggtgaaggtgccttgtttgtggaggctgaggcaaactgttccatggaagagattggtgacatcacaaagcctgaccctgggactcttggtatgcttgtttatgacattcctgaagcaaaacacattcttcagatgcctcctttggttgctcaggtgaccaagttcaaatgtggaggctttgcacttgggctgtgcatgaaccactgcatgtttgatggaattggtgcaatggaatttgtgaactcttggggagaagcagccagagacttgccactctcaatccctccagtgctagacagaagcatgctcaaggcaagaaaccctccaaagatagagcacctgcaccaagaatttgctgacattgaagacaagtccagcactaacagcttatatgtagaagatgagatggtctacagatccttctgctttgaacctgagaggctaaagcagctgaagatgaaggccatggaagatggagcactagagaaatgcacaacatttgaagtcctctcagcatttgtgtggatagcaagaaccaaggcacttaagttgctgccagaccaacaaacaaagcttctttttgctgttgatgggagggccaagttcaatccccctctcccaaaagggtactttgggaatggaattgtgctaacaaattctgtgtgccaagctggtgagctaacagaaaagcccttctcatttggtgtgaggctcatccaagatgcaatcaagatggtcacagacagttacatgagatcagctattgattactttgaggtgacaagagcaaggccttctcttgcttgcacccttctcatcacaacttggtctaggctttcctttcacaccactgattttggatggggtgaccctgttctgtcagggccagtgtcactgccagagaaggaagtgattctgttcctctctcatggacaagagaggaggaacatcaatgtgcttcttggtttgcctgctcctgtcatgaagattttccaagatttgatgcagatgtaa

SEQ ID NO: 2892 - DNA, 588 bp, Glycine max var. Williams 82
atggagaattattctatgttgttccctatttccaattcctcgagctacccaatttcaacgagtggtgttggaagctctcaaatcggctataatggtcaaagctccaatgcgtttcttggtctaaggcctagtaatgaattattaggtagtgatgatcatgacaacggaggcgaaggtggtggtgatggagatggcaacatgttaatgtctcagataagtggtggtagtaatactaatgtgagtgatgagttaggtggttccggaaatagtaacaataaaaagaaaggagagaagaaggttaaaaagcctagatatgcttttcaaactaggagccaggttgatattcttgatgatggttatcgatggaggaagtatggccaaaaagctgttaaaaacaacaaatttccaaggagctactacaggtgcacgcatcaagggtgcaatgtgaagaagcaagtgcaacggctaaccaaagacgaaggggtagtggtgaccacttatgagggagtgcacacacacccaattgaaaagacaacagataactttgagcacattttgagtcagatgaaaatatacactcccttttaa

SEQ ID NO: 2893 - DNA, 2238 bp, Glycine max var. Williams 82
atgggagaggattctagggagtttggaaaaagcacaaaaatcaatcacaaaatggaagaagttcaaagagaagaagaaatagacccagaaagcaatcccctgaatgagccactactgctcaagaggactcggacactgtcttccaaccctcttgctctggttggagaaaaagtttcctacatagaaagcttggactatgagataaatgagaatgatctattcaagcatgactggaggagcagatcaagagttcaagtgttacaatacatattcttgaaatggttactagcattccttgttggacttctcactggtattatagccactctcatcaatcttgctgttgagaatattgctgggtataagcttctggctgttcttaaatacatccacaaagaaaggtacttgacgggtttcctatatttcacgggcattaatttcgttttgacatttgttgctgctattctctgtgtgtgttttgcacccacagcagcaggacctggaattcctgagatcaaagcttatcttaatggtgttgatactcccaacatgtttggtgccacaacattgattgtcaagataattggaagcattggagctgtctctgcaggtctagatttgggaaaagaaggaccgttggtgcatataggaagctgcattgcttccttactaggccagggaggccctgacaattacaggaccaaatggcactggcttcgatattttaacaatgatcgtgaccgtcgggatcttatcacctgtggttcatcttcaggagtttgtgcagctttccgggctccagtcggtggagttctctttgctcttgaagaggtggcaacctggtggagaagtgctctcctatggagaacttttttcagcacagctgtggtggtagtggtgctcagggccttcattgaaatctgtcatactgggaaatgcggcctttttggtgaaggaggattgatcatgtttgacgtaagcaatgtcacagtgaggtaccatgttatggatatcgtccttgttgtagtcattggaatcattggtggtgtattgggaagcctttacaatcatgtgctacacaaggtcctcagactctacaatctcatcaatcaaaaaggaagaacacataaactcctcctcagtcttgcagttgcactattcacatcaatgtgccaatatggtctcccattcttagcaaaatgcaccccatgtgatccatcacttccagagtcagcctgccccaccaacggacggtctggaaatttcaaacaattcaactgcccccctggctactacaatgatcttgctactctgctgcttaccactaatgatgatgccgttcgaaacatattctcaaccaacactcctcaagaatatcaaccattgtccctcgtaattttctttctactctattgcatattaggactaattacttttggaattgcagtgccatctgggctcttcctcccaatcattctgatgggctcaggttatggccgccttctcggcatctacatgggacctcatacaaacattgaccaagggctgtttgcagtacttggtgcagcctccctcatggctggttccatgaggatgactgtatccctttgtgtgatcttccttgaactcaccaacaatcttctcctactaccaataacaatgattgttctcctaatagccaaaactgttggagacagtttcaacccaagcatctatgagattatactgcacttgaaaggccttcctttcattgatgcaaatcctgagccatggatgagaaatctcactgtgggtgagcttgttgatgtaaagccaccagtggttaccctccatggagtagaaaaagtagccaaaatagtagatgtcttgaaaaacacaacacataatgctttccctgttatggacaatggggtagtaccaccagtagtaggacaggccaatgggggaacagaacttcatggactgattctaagagcacatctcatccaggcaataaagaagaagtggttccttaaagaaagaaggagaacagaggaatgggaagtgagagagaaatttacctgggtagagctggctgagagagaaggaagtattgaagaggtggctgtgaccagtgaggaaatggaaatgtttgttgatctacatcctcttaccaatacaagtccctttacagtgctagagagcatgtcagtagcaaaagcaatgccctctcagccagtgacatggacatccgtgtag

SEQ ID NO: 2894 - DNA, 258 bp, Glycine max var. Williams 82
atgtgccttttttgtcttctttattgcaagttttgtttcttcaatgtagtgtcacggcatattaagttaacaactaaaggtattgtaataagcataagaaaatcaatttatgcatataaatttatgtactatcaagacgttgatgtaataaaaaaaattacacgaaatcagaatggaagaagattgtaccaatgcgggagaggaattgaagaagagggcttgagaaacatccatttcaatttccacttagacaattaa

SEQ ID NO: 2895 - DNA, 423 bp, Glycine max var. Williams 82
atggacaagctaagccagtataaacgtgtgttcaaccaatttgatgagaatggagacagcaagatatcgccgtcagagctccggcaatgcgtggaggccattggcggggagttgtcagagaaggacgcggaggtggcagtgacattgctcgacagggacggcgatggactggtggggtttgaagattttgtgaggtttttggaggaagggaaagaggaagagaaagaggatgacttgaaggaggcttttaagaggtatgagatggatgggagtggttgcatcacacccaggagtcttaagaggatgcttagtaggttaggtgaatctagaagcttagatgagtgtaaagttatgattgctagatttgatcttgatggagatggggtgctcactttcgatgaatttaaggtcatgatgttgtaa

SEQ ID NO: 2896 - DNA, 3132 bp, Glycine max var. Williams 82
atgaaaggaaagaacaggagaagtggtggtgctatccatatggagtacctcattcacattcaggagattaagccttggcccccatcacagtctctcagatcacttcgttctgtgttgatacaatgggagaatggtgaacgctcttcggggtctaccggtgtagtttcaccttcgcttggtcctaattctgctgccggtgagggaaaactcgagtttaacgagtcgtttaggcttcctgtaactctgtcaagggatatgtctattcgaaatagtactgctgctgtgttccagaagaattgcttggagtttcacttgcatgaaactcgaagagataagaccactaaagggcagttactggggactgccatcatagacttggcagattgtggcgtgcttagagagaccttgagcattcgtacgccattgaactgccagaggaactacagaaacacagatcagccacttttgttcattcaaattgagcctgttgaaaagagctgccctaagtcctccttgaaggacagcttgtcaaaggaggtgacaaagggaaataatggcagtgaatctatatcagaattgatgaatggagagtatgctgaggaagctgagattgcctcatctactgatgatgatgtttcatctcattcatctgcggccgcagtcactacttcctctgagtctagcgcgtgtatgccccccgaacatgaagagaatgcaccaaatggaccagctcaaaacagtggtaggaatgacaaggagcatgagcatcccttggcctcagagacaagagttgagaagttgaatgagatggaacaagatgcatatgagagactggagaggagttcatcctatgtgtcctccaaaattgggagtccagtaaatggtcatacctctattacaagtactccaaatcatagatcagcaacaaccccaaagcaggctgcttctttgaatgctgattcttcgtccccaatcttggaggaaaattctaagagcaggtccataagcagtgatgatgaaaatttggatcaggagggttgtgaaaaagtttccaatggtagaaatatgagtacaggtgttcaaataaacaatgacgaaagtgattttgacatctattctagcaacactacatctctagacagtaattacctcgtggacaagaatccaagctttggtttgggaaccaaagacaacttaagtgaaatgtttcattctgataagcaatatcatgtagaagatgaatcggtggcacaaggtgtgaaagatcaagttaatttgagtagcaattcatattctttaggtgggttagataatggtatgaaaggcaatgttctgaaaaatgaaagattaaagcatgtgaggtctgtaagatcatcagccgactcagttaggtctattgggtcacttggtaacaatcatctcgctgaggtaaaggaaaatggtgttaatggagatacccaaaataatggagggaacattagaagcagtgacagaaaagatgccaaggtttatccaagggaagccagaaatgccattttagatcgcaagattgagcacttggaaaacaagataaagatgcttgaaggagagttaagagaagctgctggtattgaggctgctttatattcagtagttgctgagcatggaagctccacgagtaaggttcatgccccagctcgacgcctttcgaggctgtaccttcatgcttgtaaagaaaatcttcaagcaagaagggctggggcagctaaaagtgctgtttcaggattagcccttgttgcaaaggcatgtggaaatgatgtcccaaggttaacattttggttgtctaattctattgtgctgagaacaattataagcaaaactaccaaaggcatgacaccatctaatccttctggatctagtacaagtaggaggaatggagaagggaatgacaaggtaacacaaccattactatggagggggttctctcatagaaaaactgaaaatacagcttttgaatatggaggtataggtaactgggatgacccaaatgtgttcacatcagcattggaaaaggttgaagcttggatcttctctcgcattgtggaatctatttggtggcagtctttgactccacatatgcagcttgctgatgcaaagatcactcataaggattcagcaaaaaactatacaaatatgtctagttcatgcgatcaagagtggggaaatttatcactagatatttggaagaatgcttttagagaagcctgtgaaaggctttgccctatccgagctggagggcacgagtgtggctgtttgtctgtgctacctaaattgataatggagcagtgtgtggctagattagatgttgctatgttcaatgccattcttcgggaatctgatgatgatattcctactgatcctgtatctgatcccattagtgatcccaaggttctccccattccacctggtcaatcaagctttggggctggtgcacagctaaaaactgcgattggtaactggtctagatggctgactggtctatttggtatggatgatgacgacccacttgaggatatagatgataatgaccttgatagcaatgatgaaagtcaaaataccttcaagtccttccatcttcttaatgctttaagcgacctcctgatgcttcctaaggatatgctcttaaatgcatccatcaggaaagaggtgtgtccaatgtttagtgcatcgctaatcaagaagattctagacaattttgtcccggatgagttttgccctgatccaattcccactgatgtttttgaagctctggactcacaggatgatcttgaggatgaaaatgagtctatcagcaacttcccctgcaatgcagctcccactgcatattcccctccaccagcagctaccattacaaacattactggggagtttggaagtgaatctcagctaagaagaagcaaatcttctgttgttaggaagtcatacaccagtgatgatgagctcgatgaactaaactatccattatcttccatattgaatattggctcatcctcatcagcatcaacaaactccaaccggaaggggaaagacagtcgcgatgaatctgccatcagatatgaactcctcagggatgtttggatgaacagtgaatga

SEQ ID NO: 2897 - DNA, 474 bp, Glycine max var. Williams 82
atgattaagttgaggtcaatgaggtttagccgaagcagctccaagcttggaaatggtgggcacaaagcaacaacacccactgaaaaggattgcagaagcattggtgaaatccaatgggaacttaggcctggtggcatgcttgttcagaaaagggagagcaaccaaagcgcaggggagggaatgatcacaattatagtgtcaactgtttcacaatcgcatgaaatttctatcgaggccacatcaacttttggagaattgaaaatgattctgtcactggcaacaagttttgagccccgagagcaaaggcttctcttcaagggtaaagagagagaggatgatgaatatctacatatggttggggttagagacaaggacaaggttcttctgtttgaggatccagctataaaggagaagaaactgcttggcttaagaaaccaacccattaacaatcctagtcgtaccatcagtgtatga

SEQ ID NO: 2898 - DNA, 1164 bp, Glycine max var. Williams 82
atggggttcctcgtgcaatttgttgtttttatgttattcccttggtttctgagtgtgagagctgaggaaaattactcatcacagcattgtgatttcccagccatattcaactttggtgactccaattcggatactggttgcatggctgcagcattttaccctgaggttttgccatatggtgaaactttcttccatgagccagttggtagagcttctgatggtcgccttatcatagatttcattgcccagcatctaggtttcccattcttgagtgcatacataaattcaattgggacaagttataggcacggtgcaaactttgctgcaggatcatcaaccattaggcgccaaaaaaggacagtctttgagggtggcactcctttcacttttgaaatacaggttgctcagttcaaccagtttaaggcacgcaccagaaagttcttcaaccaagatgcacaagggaaaaactccttcagaggacactttcctaggccagaggactttgccaaggctatctacacatttgatattggacaaaatgatattgctgctgctattaacaaagtggacacagaagattctcacgcagtgatctcagacattgtggattattttgaaaaccaagttcaaactttacttggactaggagcaaggacattttggatacataacacaggccccattggttgcttgccagttgccatgcccgtgcacaatgccatgaacactactccaggggcaggttaccttgatcaaaacggctgtataaattatcaaaacgacatggcaagagagtttaataaaaagctcaagaataccgtggttaaactaagggtacagttcccagatgcctcattaatttatgtggacatgttctcagctaagtatgagctaatcagtaatgctaataaagaaggatttgtggacccttctggaatctgttgtgggtatcatcaggatggttaccacttgtactgtgggaacaaagcaataattaatggtaaagaaattttcgcagatacttgtgatgatccttccaagtacattagttgggatggagtgcactacacagaagctgcaaatcactggattgcaaatcgaatacttaatggttccttttcagatccaccactttccattgcacactcgtgccgtgcccaataa

SEQ ID NO: 2899 - DNA, 1441 bp, Glycine max var. Williams 82
gagattcttggtttagtgtcatcacaatggggttcctcgtgcaatttgttgtttttatgttattcccttggtttctgagtgtgagagctgaggaaaattactcatcacagcattgtgatttcccagccatattcaactttggtgactccaattcggatactggttgcatggctgcagcattttaccctgaggttttgccatatggtgaaactttcttccatgagccagttggtagagcttctgatggtcgccttatcatagatttcattgcccagcatctaggtttcccattcttgagtgcatacataaattcaattgggacaagttataggcacggtgcaaactttgctgcaggatcatcaaccattaggcgccaaaaaaggacagtctttgagggtggcactcctttcacttttgaaatacaggttgctcagttcaaccagtttaaggcacgcaccagaaagttcttcaaccaagatgcacaagggaaaaactccttcagaggacactttcctaggccagaggactttgccaaggctatctacacatttgatattggacaaaatgatattgctgctgctattaacaaagtggacacagaagattctcacgcagtgatctcagacattgtggattattttgaaaaccaagttcaaactttacttggactaggagcaaggacattttggatacataacacaggccccattggttgcttgccagttgccatgcccgtgcacaatgccatgaacactactccaggggcaggttaccttgatcaaaacggctgtataaattatcaaaacgacatggcaagagagtttaataaaaagctcaagaataccgtggttaaactaagggtacagttcccagatgcctcattaatttatgtggacatgttctcagctaagtatgagctaatcagtaatgctaataaagaaggatttgtggacccttctggaatctgttgtgggtatcatcaggatggttaccacttgtactgtgggaacaaagcaataattaatggtaaagaaattttcgcagatacttgtgatgatccttccaagtacattagttgggatggagtgcactacacagaagctgcaaatcactggattgcaaatcgaatacttaatggttccttttcagatccaccactttccattgcacactcgtgccgtgcccaataactctcactagtactgttcaattaccacctttacaaaatctaatgcttggtgtttgcttaatcataaataatttaattcttttgcatttggcttttaccttggaccaattgagtcactttcgcccaagatttgttattgtgttcactatttaatgagaaaaaaaatatattaaatataagttcagaacacttttgttctttttacctttgtgtgactttttattaaaattataattgtacaatgtttcttat

SEQ ID NO: 2900 - DNA, 999 bp, Glycine max var. Williams 82
atggaacagcaggatatggctgatacaaccacccttagttattggttaaattggaggttctatctgtgtgcagtttgtgttttgctgtctattgtcctttcatttcttgtaatatggaaggataagggttcaaggaaattcagatctggaaaaggagaaaatcaggaagatgggactttgtctggtgatgaagcatggaaaccattccttaaagaaattcacccagtttgtttgctagcttttcgtgttattgcattctcttccctgttggcatctctagttgccaaaattcatattaatggcagagccatatttttttattacactcagtggaccttcactctggttacaatttattttgggtttgcatctacgctatcagcgtatgggtgttatcggcataacaaatcaagcaccatcaataatgttaatgttgctagaatagatgtagagcaagggccatacatgcctttcttacaccaagatacatccaacctgtctagaatggaacaccttgctgatccccttgccgaaatacagaagaatcaagttgcacccatctggagttatattcttcaaattttattccagatgaatgcaggggcagtgatgcttacagattgcatttattggctcattatatttccatttcttactctgagggattatgattttaactttatgacagtgaacatgcatactctaaatgttgttttcctccttggagatgcagctctaaattgtctgaaaatacactggtttggaatgtctttctttgtgttatggacaagtttatatgtcatttttcagtggactattcatgctttcatctggatttggtggccatacccattccttgatgtgtcattgccctcctctccattatggtacttgttggttgcattgttacatattccatgttatggcctgtttaaactgattgtggatgtgaaatattatttcttgtcgaaatggttcccttcctcttgtcagtcctaa

SEQ ID NO: 2901 - DNA, 795 bp, Glycine max var. Williams 82
atgcagaaagaagaacaagaaaaagagtatttagaatcgttgacgtgtccaagcttcaactgctactccaccgatgaactcccaggtatcgctcaaagcaggattcaaaaggacgacgcgtcgttttcggcctctcaaaatgacgaccctgacttcgagttcgccgcgtttcgagacgacgccttcgagttctccaacgacgacgccgttttccctctcttcaacagcgacgttgcgagggaccgccggaacagtgtctccggcggtctcgattccgacgcggcggtgctccggtttccgataaccggcgaggagcttcgaaggggtgagcacgatccgtcactgtcgccgtcgtcggagtcgtcgtcggaggcggatgagttggaggttgttccggcggggacgtactgcttgtggaggtcgaattcgcctcaggcttcgccgagaaagtgcaagaagagcaattcgacgggatcgtcgtcgtcgttgaagaaatggaagcttctggatttgcttcgccggagcaacagcgaggggaaggagtcgttgatgatcctgacgccggcgccggagaagaaaaatgtgaacgagcggtggagcattgaggtcgccggaaaatcgaaggggaatggtttcgccggcgagaagaaggtggcggtgtcgccgcacgaggctttgtatcttagaaacagagaattgagaatggttgataagaaaaagtcgtttttgccctataagcctggcttggttgggttctgcactaatcgtttgggcaaggcattcccttcattctga

SEQ ID NO: 2902 - DNA, 498 bp, Glycine max var. Williams 82
atggacaatggtgatgagcctctgttgcatggcaaaatcggtaccatactaatagccatgggttcagccagtttcctggtcacaatattccatctcgtaatcctttgccgcacccaccgccaggtggcgaacaaccaaaattcagaacaagaagaagccctagggcggcgcacgggagagaacgctcgggtgccgcacctgattccagcccagaagtacgaaaagaagaagaaaagtgatggtaacgagggtgatgaaacatgtgctgtgtgcttggaagagttcgaagagggtgaagagttgaggaggcttccggaatgcatgcactttttccacgtggcgtgcatagacgcgtggctctactcccattccaactgtcccgtttgcagggtccacgccacgccctcgccggcgttgaatgcgcaacacaccatagatatcatgcaaatagctcgcgttcaaaatggctctgcacgacttgaaataatattgacctga

SEQ ID NO: 2903 - DNA, 2478 bp, Glycine max var. Williams 82
atgaacagaaaaaacatggagagcaatggggagagccatagcagtagaagtggtagcttcagggaggggttcgggttggctccgaacgaggcaaaagttcacactttggttgagcttggtagtgttgattatacacacactactactactactagtcttcttcaagatggtgatgatgatgatgttggtgaggagagagagaaagagcaaagaaaacctcttacaaactctctatctcctaggcagatgaagtcccttgttgctctttgtgacaccctcttaccttccatcaacaacaacaacgttgtttggggctctgatgatgaatctgttgccaacttctacaagacttcggcttccatggctggaacacctgagcatcttgggatattgataagtgagaagctgaagcacccaagtacatggctgttgttgctgacactatggctactatccacatggtttggcacattcatactgtgtggtacgttgagcctctcaacaaagtttcctttcttccatagctacccagaattgtctcttctcaaacggcaaaaagttatgcagtcttggtctctcagttaccttcgaccccttaggatgttctttagaaccatcaagcttctcactctccttgtcttcttcactcagctagatgaagcagaagacaacccatcatggaaggcaattgggtattgtggacctgatccagagttcaaatcacagttgaagaaccacttctttacaaagcaaagaggacaagaagaaaaagaagatgatggcactgaagatgttagaggacctctttacaaaggtcttatccgcataaataacccacgagacatcattacagattctctaagacgagttggattctctgtctctgctactcccaaaaagaccaaggcttctaccctatcatctccttctctagttataaaatgtgatgcagtggttgttggttctggctctggaggaggggtagtagctggagttcttgcaaatgctggttacaaagttctggtcttggagaaaggaagctattctgctaggaacaatctttcccttcttgaaggaccaagcatggatcaaatgtacctctccaatggtttggttgctacaaacgacatgtctgtgctaatactagcaggctccacagttggtggagggtctgcaatcaactggtcggccagcattagaactcctcaacatgtgtgcaaggagtggtgcgatcgccacgagctcgaactattcgagagtatgttgtacaaagaagccttggatgttgtgtgtgagaaaatgggagtgcaatctgagattgatgatgaagggttcaacaatgctgttttaagaagagggtgtgtagaaatggggtatcctgtgtgcaacattcccaggaatgctacatctgatcactactgtggctggtgttgcttggggtgcaaggatggaaggaagaaaggtacattggaaacatggcttgtggacttggtgaaatcagggaatggtgcaatcattccaagttgtgaggctattcaagtcttgcataagaaaaagaaaggaagacacagaaaaatagcaaggggtgtggcttttgcaattgaatacaaggggaaaaaggacatttgtgtagtggagtcaaaggtcacaattgttgcttgtggagcacttagtactccagcattgcttaaaagaagtggattgaagaatgaaaacatagggagaaacttgcaccttcatccagtggcaatggcttggggctacttccctgattcaccttcacctgagttgtggcctgagaaacataagaagagctatgaaggagggattatgacagcaatgtccacagttgttgcacagtttgacaaatctggatatggtacagtgatccagacacctgcattgcatcctggtatgttctcaattctaatgccatggacttctggtgcggatataaaagatcgaatgcgcaagttctctagaacggctcatgtgtttgcgctggcaagggatcaaggatcaggaactgtgaattcgccttcgtgtataagttatcagttgaaagacattgacaaagagaatttaaaggttggacttgagaaggtactgaggattcttgcagcagctggagctgaagaaattgggacacacaacaacaagggaaggagaataaatgtgaagcaagtgagctatcatgagtttgagaaatttgtgaaagaggaaagttcaatgtctttgacagacatttcaaccccattgtgttcagcacatcaaatgggaagctgtaaaatgggtactaatccaagggaatcagttgtgaaccaaatgggagagacatgggaagtggagggtctttatttggcagactcaagtgtgtttcccacagctttgggtgtgaatccaatggtcactgttcaggctatttcttactgcacagcacaatatgttcttgaagttcttagaaggaaaagaaagtga

SEQ ID NO: 2904 - DNA, 996 bp, Glycine max var. Williams 82
atgggaaaacagagcacagaattctctgccctcaactgcatcgacctctccaaccctgacatcaaccaatccgtcaatttactcaaacaggcatgtttggattccggttttttctacgttgtcaatcatggaataagccaggaattcatggaagaggtttttgcacagagcaagaaattcttctctcttcctcacaaggagaagatgaagattctcaggaatgaaaaacacaggggatacacccctgttcttgatgagttgcttgatcctgaaaaccaagtgcatgtaggagactacaaagaggggtattatattggagttgaaaaaggtgaagatgacccagaatcgaataaacctttttatggaccgaataactggcccgcaccaggtgttcttccagggtggagggagaccatggaaaagttccatagagagacattagaagtagggaaagcagttgcaaagataatagcccttgcacttgatttggatgctaatttttttgatcagccagaaatgcttggagagcccattgcaactctgcgtttgctgcactatgaaggtcaagtttcggatcccttgaaaggattatatggagctggagctcatactgactatggtttaattacactgttagcaacagatgatgtctcgggtcttcaaatatgcaaagatagggatgctaaacctcagaaatgggaggatgtagcaccattgaagggagcattcatagtgaatcttggtgacatgctggagcgctggagcaactgcgtttttaagtccacactgcacagagttctaggaaacggtcaaggaagatattctattgcatacttcttggagcccagtcatgattgtctagtggagtgcttgcctacctgcaaatcagacagtaatccgcccaaatttcctcccatcttatgccatgactacctaactcagcgctacaacgacactcatgctgacttgaatgtttataagaaacaacaagcttga

SEQ ID NO: 2905 - DNA, 3042 bp, Glycine max var. Williams 82
atggaattattcactccaccatgtcttaaattgttatttcactctcttgtgatcttattcttgctctttaaccatgcaaacactcagtctcagtctcagttgcatgatcaagaacgtgcaaccttactgaagataaaggaataccttgaaaaccccgaattcctcagtcactggactacttcatcaagctcctctcactgctcatggcaagagataaaatgcagcaatggctcagtaactggattgactttgtccaacagcagcatcactcaaaccataccctctttcgtatgtgacctcaaaaacctcacaattgttgatttctacaacaatttgattcctggggagttcccaacatctctctacaattgctccaagttggagtacctagacctgtctcagaacaactttgttggcagcattcctcatgacattggaaacctctctaattatttgaagtatctcaaccttggttacacgaatttctctggtgacattcctgctagcattggaaggcttaaggaacttagaaatcttcaacttcaaaataatctattgaatggaacattccctgctgagattggcaacttgtccaatcttgacaccttggacttgtcctctaacaacatgcttcctccttcgaagttgcacggtgactggacccggttgaacaagttgaaggtttttttcatgtttcagtccaacttggttggggagatcccacaaaccattggaaacatggtggctttggagagattagatctatcgcaaaacaatttgagtggaccaattcctagcggtttgttcatgctggagaatctgagcataatgtttctatctagaaacaatctttctggggaaatacctgatgtggttgaagcattgaatttgaccatcattgatctcacacggaatgttatctcaggaaaaataccagatggttttggaaagctccaaaagctaaccggtttggctttgtctatgaataacttgcaaggggagataccagcaagcataggacttcttccatctctggtagattttaaagtatttttcaacaatttatcaggtattctccctcctgattttggtcgctactcaaagcttgaaacatttttggttgcaaataatagttttagaggaaacctaccagagaacttatgctataatggtcaccttcttaacatctctgcctatataaattatctgagtggggagttgccacaatcacttgggaattgtagtagcctgatggaactgaaaatctatagcaatgagttttctggtagcattcctagtggtctttggactttaagcttgtcaaatttcatggtgagttataataagttcactggtgagcttcctgagagattgtccccaagtatttcgcgcttggagataagtcacaatcggttttttggtaggattccaactgatgtatcttcatggactaatgtggttgtttttatagcaagtgagaacaaccttaatgggagtgttccaaaaggtttaacatctcttcccaagctaacaactctattgcttgatcataaccagctcacagggccacttccatcagatatcatatcatggcaatcccttgtaactctaaatttgagccaaaacaaactctctggacatatcccagattcaattggtctgttacccgtccttggcgtactcgacctgtcagaaaatcaattctctggtgaagttccttctaaacttcccagaatcaccaatctcaatctatcctccaattatttgacagggagggttccaagtcaatttgaaaatcttgcttataacacaagctttttggacaattctggcctatgtgctgataccccagcactgaacctcaggttgtgtaattctagccctcaaaggcaaagcaaggactcatctttgtctcttgctttgattataagccttgtggcagtggcctgcttcctggctttgttgacatcactcttgatcatcagattttatagaaaaagaaagcaaggattggatagatcatggaagctcatttccttccaaaggctgagtttcactgaatcaaacatagtgtcatcactgacagaaaatagtattattggcagtggtggatatggcacagtataccgtgttgcagttgatggtttaggctatgttgctgtgaagaagatttgggaacacaagaagttggacaagaatcttgagagctcatttcatacagaagttaagatattgagcaacattcgtcacaaaaacattgtcaaattgatgtgctgtatctctaatgaggactctatgctccttgtctatgagtatgtggaaaaccatagccttgacaggtggctgcaccggaaaaataagtcatcaaccgtgtcaggttcagtccatcatattgtccttgattggccaaagagattgcatatagccattggagctgcacaaggtttgagctacatgcatcatgattgctcaccgcctattgttcatcgagatgtgaaaacaagcaacattcttttggattctcaattcaatgcaaaagttgctgattttggtctggctaggatgttaatgaagccaggggaacttgccaccatgtcatccgtgattggctcatttggctatatggctccagaatatgttcaaacaactcgagtcagtgaaaagattgatgtcttcagctttggagttatgctattggaactgacaactggtaaggaagctaattatggtgatgagcactcatctcttgcagagtgggcgtggcgacatcagcagttaggaagcaacatagaagagctgctagataaggatgtcatggaaaccagttacttggatggaatgtgtaaggttttcaaactcgggatcatgtgcaccgcaacacttccttctagtagaccttccatgaaggaggttctacgagtattgctttcttgtgaagattcattttctaaaggagagagtattattggccactatgatgatgttccccttcttaaaaattcaaaaagagagcataagttggatattgataatgatagctag

SEQ ID NO: 2906 - DNA, 312 bp, Glycine max var. Williams 82
atgtgggtggttgtgactcttgattttattgagactgtgaagaaagcagttggagatggaaggagactccgttttggttggagccatgggttgggagagaggctttggaggttcattatagatgacttttttcatcttacttgcttatctgattctaaggtggttgaaactcgggtgagaggagatggagactggtgttggaattggtggaagagggatcttttgaggtgggcaaaagatttgttacatgatttggaggttgaggctggtcatgaggggtttagggagggttttggagattctcggagatag

SEQ ID NO: 2907 - DNA, 93 bp, Glycine max var. Williams 82
atggctcctcttactggccgagaacgccgtcttcattccaaggaactagcagatgctagaaaaaaagaagagaaagcgacatttcattcttga

SEQ ID NO: 2908 - DNA, 1044 bp, Glycine max var. Williams 82
atgaagctatccactctattcctattcctattccacctggctcatgctgctctgtctgacgaagctactttcattagagatggcctcaaatcctattcccagcttgatctccctcactcggtttttggttctgaaagtgtagccttcgattgccatggtaaaggaccatatgttggcgtgtctgatggtagaatcctcaagtggcacgagacaaagagagagtggattgactttgcagttacctcgccacacaggaacaagaaattatgtgatgggttaacaaatgacaagatggaatcaatgtgtggaagacccttgggcctcaaattcaacactttaacttgtgaactgtacattgccgatgcatactttgggcttctggtggtaggaccaggtggtggtgtggcaaagcagttagccacttctgcggaaggggtaccatttaggttcacaaatgccttggacatcgacaccaaaacaggtgaagtatatttcacagatagcagcatcatgttccaaagaagggtatacatatcaataattctgagcggggatagaactggaaggttactaaaatacgttccaagtacccaaagtgtacatgttttggtcaaaggtttagcattccctaacggcgtggcgcttagcaaggacaattccttcattatagtagcagaatcaaccacttttaaaattctcaagattcaagttagagactccaagaccaacaacaacaatatagaaccttttgcacaggttccacgctccccagataacataaagaggaacgccaaaggagaattttgggtagcgctgaacagtggcaggggattgattcagaaattggaaaatgaaatcgaaaccacacttccttggaatgcagatcctgtggcaattaaatttgatgaaaaggggagggccattgaggtattagatggagaatatggacgacaactggactctgttagtgaagtggaagaacatgaaggaagtttgtggataggctctgcggtgcaaccatacattggtcttataaaagcttag

SEQ ID NO: 2909 - DNA, 2820 bp, Glycine max var. Williams 82
atgacctcatggacttcagggatgcatgggctggcttctttctgttttgcagcttctggcttgtcactttctgtgaacaagatggcattattctccatttggtttcatatatgttccagaagtgaaaatgatgagcatgattttagctttgtggcagtacttaaaagtaggacattacctggtttcttgagtctttcttgtggtggaagaaccagtttcagggatacatctaatatttcatgggtaccagacacctcctacataaccacaggcaagactaccaccatcacttacagtgatgactcctccgcattgaacatctcagctcgcttcttcctgaattccagaaggcgaaaatgctacagaataccagtaaacaattcaacaactttggttctggttagagcaacatttttgtacaagaactatgatggacttgggaaaccccctaagttctctgcttctattgggacagctattgctgcaaccataaatcttgctgaatctgatccatggagtgaagagtttctatggactgtcaacaaggatacactgtcattctgcttaaatgcaattccaaaaggtggttcacctgttatttcttcccttgaaatcagaccacttcctcaaggagcctacacaaatggcatggcagattttcctaataagttgcttaggaagagttatagaattgattgtggacactccaatggttctataaggtatcccttggatccatttgataggatatgggatgctgatagaagtttcacaccatttcatgttgcaactgggtttaagattcaacttagcttcaaacagtctagtcttgaggaaaaaccaccaccagctattcttcaaactgggagagttttggctcgaagaaatacgctgacatacagcctccctcttgatgcattaggggactactacatcatcctctactttgctggaattcttcctgtctttccctcatttgatgtccttataaatggagaactggtaaaatcaaactacacaataaatagctcagaaaccagtgctttatacctaacacgaaagggaattggcagcttgaatataacattaaagagtatcagcttttgccctcagatcaatgcatttgaggtttataagatggttgatgttccatctgatgcctcctcaaccacagtttcagcattgcaggttattcagcaatccactggattggatcttggatggcaggatgatccatgccttccttccccatgggagaaaattgaatgtgaaggaagccttattgcatcattggatctttcagacataaatttgagatcgattagtcctacattcggtgacttgttagaccttaaaacattggatttgcacaacacattgcttactggtgaaattcagaatttggatggcttgcaacatcttgagaaactgaacctgagtttcaatcaactaacatccattggtgcagatctacagaacttgattaaccttcaaatactagacttgcagaacaataatctaatgggagtagtgcctgatagcttgggagagttagaggacctccacttactgaatctggaaaacaacaaactacaaggtccactaccacagtctttgaacaaagaaacgctagagatcaggacatctggtaatttgtgtcttaccttttccacaacatcatgtgatgatgcatcattcagtcctccaattgaggcaccacaagtcactgtagttcctcagaagaagcacaatgtacataaccatctagcaatcatattaggcatagttggaggagccacactggcctttatcttgatgtgtatttcggtattgatatacaagactaaacagcaatatgaagcctcccacacatcaagggcagaaatgcatatgaggaactggggtgctgcaaaagtcttttcctacaaagaaatcaaagtagctacaagaaacttcaaagaagtcataggaaggggcagttttggatctgtttatcttggaaaacttccagatggaaaattggtggctgtcaaagttcggtttgacaaatctcaattgggtgctgattctttcatcaatgaggttaatcttttgtcaaaaatccggcatcaaaatcttgtgtctttggaaggattttgtcatgaaagaaagcatcagatattggtttacgagtacttgccaggtggatccctggctgatcacctctatggtacaaacaatcaaaaaacttccttaagctgggttcgaaggttgaaaattgccgttgatgcagcaaaaggattggactatttgcacaatggaagtgaaccacgaatcatacaccgtgatgtcaagtgcagtaacatcctcttggatatggatatgaatgccaaggtctgtgacttaggtctctctaagcaagtaactcaggcagatgcaactcatgtcaccactgttgtcaagggcactgctggttacctcgatccagagtattattccactcaacaattgacagagaaaagtgatgtatatagctttggagttgttcttttggaactcatttgtggaagagagccattgactcactctggaactcctgattctttcaatttggtgttatgggccaagccatacttgcaggctggtgcatttgagattgtggatgaggacataagaggaagctttgatcccttgagtatgaggaaggcagctttcattgctataaagtcagtcgagagagatgcatcacagaggccatctattgcagaggtactagcagagctaaaggaaacctacaatattcagctcagattccttgaatcttgtcaaaatgagaactga

SEQ ID NO: 2910 - DNA, 6779 bp, Glycine max var. Williams 82
cagcccacaacaactcgcatagtccctcgccacccacacgcgcaagaagaacaacgaacgtgcaaaatatagcggacgaaacgaattagagaggaacaaaatcaccatcacgattacccaaattggcgacgtttgattctccgatattgcttccatggctgacatttgctgctacatgttggtttccatgggcaaatcgtgatcgaagtggtgccccttttccaaaaccctaggagagagaaactttgcgctgaaacggcctcttggggctctcacgttgtgccttggctcccaattacgccacccttttgtggattcagactctttaaaagatgggaagtgaagctttaagatattaaaggttgggaatgaatggatataaatcaggatctgctctccttgtaaatgctgaggttgattctatgggtggagttgttgacggtggaattggtataggtttgaagatctctccgcgcagagcagcaattgagaaggcgcaagcagagctcagagaggagtatgatgttcgtgaagaaagaagaagagagcttgaatttcttgaaaaaggtgggaatcctctggactttaagtctgggaatgctgcttcagttagtgttcagtctacttcactcactgatcagcttcatgagcagtttgtgaccagtgaagcaaaaggtagttttgcattgactgcctcccctcatggtgactctgttgacagtagtgctagacccggggctcctttggccagtgagcctaatactgctgataatctcctactttttgatggtgagaatgagttgcctgaaactgaaaggaggtgcttgcattcaaacagaaggaataatattgctctgtcagaacagtcttcccaaattgatgggagtcaaaatgctaaggagactgaagattctgctattttccggccatatgcacgaaggaaccgatctagatcaggtcatggtcctcggggagcttcaagggaagtgaaggggttaacgtctgaaacaaatagccaaaagaaccttaatttgtcaactgtatctaagccaaagccttcctgtttaaatggtgatgttggccccaaatatttgactactaataatactctgaataatgaattggttgggatccgagatcatcaatccactagtggcaatgctagtgttcccgaagacaaattggatattacggtgaatagaaacttaaaagaaaatcatggaactctaccttctgaagataatactgttcaagacccagttctcatggcttctggagaagataacatagttgaattaagggagccagtagctgttgtcaatcatgagcctccacctcatgtacctactacaaaacctgaaaatgggccttattgtcagccaaatgggtttggcaatgtagaagtagacaggaaaagtgtactaaatgaaggccaaaatagcattgctacattaggcaagaatttcaatttagagtcctcgtgcacaaaaactagcttagttagagatgtaaatattgatagtgatatgtgtactaatacaaagaatgttgatgctaatggaaataccatggaacaaacatttgcattagagaataaactgaacttcgctggctgcaaagttgtgaaagataggcataagaccaaaaatgcaaatggtgctactgttagcaatgagcatgatgctggttatcaaaatcattctggttgtggtaatattgtcaaagctgaggaagatgtccatattaagagttcttgcatgtcaaatgtcaaaggagtacctcataatgacagtaacatatcaaaagttgataaagataccatcttagtggatcagtccaattttgtcaaggaaaacagctgtgaaagacatcaggttcctgtggatgtgtcactttcagaacctcctaagactgctccagatgtaaagggtacaagcgccgcctctgatgatcaaccatgtcctatgcacaatatgaagttagcagacaaggctcatgaagattcaattttggaagaggctaaaattatagaggccaagcggaagagaattgcagaattatctcttcactccttatccacacagaaccacagaaagtcacactggggttttgttctagaggaaatggcatggctagcaaatgattttgctcaggagcgcctttggaagatagctgctgctgcacaattgggccatcaaacagcttttacttgtcgctcaagatttgaaaaactgaacagacaattagagacaaaaattttgtctcacaggatagcaaaggctgtcatgcagttttggcattcagctaagctgcttctagacaatgatcttggtattaactgcattgttggttgtgttgaatctgggaaagttgatgcaaatgaagctttgagggatcaaagaagaaatagcaatatggagacaagcaaatttttggagggacaaaatcctgaaaaacatgctgcacttaaagtgcatgcatatgctttgagatttttaaaggctaatagatctcatggaatttcctctcaagcagaagcaccaacaacacctgaaaagatatttgactcaagcactgtagatatgtcatgggatgagcatcttaatgaagaaaatcttttttatgaagttcctcctactgcaatggaaacatatagaaaagctatcgaatctcatttcctacagttcgagaaaactgggagtagcattcaagaggaagttgcaacatctgtgtatgatactgcagcagagtttgggtctcaagagaatgcatatgatgaggaagaaggagaaaccagaacttattacttgcccagtgtctacgagggcaacagatcatcaaaatctgcgcagaagaaacataaaaatttgaaggcttacactcctagatttggtgatgctggtgctgattttccttatgtacactatgcaactggaaatcaaccatccatgctgtttgaaaaaagacctgctagtttaaatgttgggtcaataccaacaaagcgcatgcgcactgctactaggcatagagttgtaagtcctttcactgtcaacattgggactgtacaggctcaagctaaggcggatgcttcaagtggtgataccaattcctttcatgatgaccagagtactttacatgttggacccctgatccagaaaagtactgaagttgagtcagttgcagattatgaaaaacagttatctcaggactgtgcagaaacatttgttaaaacaaagaagaagaagaaggcaaagactctgggtactacatatgatcagggatgggagttggactctgttgtttctaatgaacagagggatcagtccaagaagagaggggaaagtcatcactttgaatctaatggaagtagtggtttctgtgggcaacccaattctaagaaaccaaagataatgaggcagtcacttgataatcctttggacaatattgtgtccatgactaattctattccttccccagttgcgtcacaaatgagtaacatgtcaaatcctaataaatttattaagatcattagtgggcgagacaggggccggaaagctaaagctctgaagatttcagctggacagcctggttctggaagtccttggtcactatttgaagatcaggctcttgtggtcctggtgcatgatatgggtccaaactgggagctcataagtgatgctatcaatagtgctcttcaaattaagtgcgtctttcggaaaccaaaagaatgcaaggagcgtcataaaaatttaatggatagaactaccggggatggtgcagatagtgctgaagattcagggtcttcacattcttatccttctacattacctggaattcctaagggtagtgcaaggcagttgtttcaacgtttgcaggggccattggaggaggatacactgaagtctcattttgagaaaattataaagattgggcagaagcagcattaccctcagaatcaggttgataacctggattcaaaacaattagcgcctgtccataattcacacgtgattgctctttccctaaccatccccaacaacctgaatggatgtattttaacgccacttgatctctgtgaagctgaagaaataaatccagatgtcccagcccttgggtatcaaagttctcatcctggtggtttgacattaccgaatcaaggttttgtaccatcaatgcttcctacatccggggtgaattcttcactaccagggtcttcttctggtatggttcttggccataacttgtcatcatctcctggtgcatctgtcagatatgggattccaagaaattcaccttcatcagtggatgagcaacagagaatacaatacaatcaaatgctatctggaagaaacattcagcagagtatgtcagttacagggactctttctggaagtgatcatggtgttcgcatacttcctggtggaaatggtatgggcttaatgggtggaattaacaaaaacatggcaatgaggccagggtttcaaggaatggcatcaccatcaatgcttaattctggaagcatgctttcctctagtatggttggtatgccaagccctgtaaatatgcactctggagttggtcctggacaaggcaactcaatcttaagacctcatgagaatctacatatgatgaggcctggtcataacccagaacatcagagacaaatgatggttccagagcttcagaggcaggtcacccaaggcaacagtcaaggtattcctgctctttgtgggctgagttctgcctttagcaatcagacaacaccaccagttcagccttacccaggacatgcccaacagccacaccaactgtcccagcagcagtcccatctcagtaatcctcgtcctcatcttcaaggtccgagtcatgccactaattcacagcaacaagcatatgctgtccggttggcaaaggaaagacaactgcagcaacgatacctgcagcaccagcagcagcttgttgcatcaaatgcattaataccacatgtccaggcaaagtctcaacttcccatctcatcattaccattgcagaacagttctcaggttcaatcacaaaattctcctcagcaagtgcctctttcacctttaacgccatcatcccctttgactcccatgtcatcccagctccaacagcaaaaacttcaccatatacagcctgggttcagcaggaatcccactgctagtgggttgactaatcaagcagcaaagcaacgcccacgacatccgccgcagcagcagtatcagcaacctagtaggcaacatcctagtcaacggcatgatgtacagtctcaacagcagacaaaacttctgaagggaatgggaagaggaaatatgttggtccatcagaacctctctgtggatacttctcaaagtggactctctctgcctgcgggaagccaaactggtgaaaaaggggaccaaatcttgcacatgatgcaaggtcaaaatttatatcctggatctggtttaaacccaaatcaaccatcaaagcctttgggtcatgctcattcttcaaaccattcacagttgcagcagaagctacattctgggtcaccaaccacttcatcaaagcaacttcatatttcttcagatactagtggtcaaggacaggtttcaccagtttcatcaggtcagttgttgtcacctcctcacccagctgttattgcttcgaaccaccatcagctgctgccacagattcagtctaagaaaattaatcaaactcaaataaatgttcagagaatgttgcctcaaaaccatctcgtgcattctgtgtcatcaagcaagtctcagtctgatccaactcaatctgatcaacagcctgcaaacagtgcttcccaggttagtgcaatgactcagggttgtgtggattctgctagtgtggtaccaggtgtttctactgtatcttctcagtggaaagtatcagaaccaccatttgattccactatgaacaatcaaacaactcaagtgagctccttggggagtgctcctgttgaaaattccactggaaatgagcaaccagcaattagtcaagggttggggccaagatcagttagcttgatttctcaggcacataattctgatacacagtggcagcaacagcagtcgcaatctctccaacagtcatcacaacccatcctatctcagcagccatatcaggctgagtcgcagcagcaacaggagcaagatcaacattctcctagagatcttgctttacaacatcaacctcagcaacatatgcaacatctacaatcagggcagagcagtttgtttatccagccacctaattctaatgtggaatgatgcattctaactgatggagcagccaagtgcgcttgttctgtcaggatgggagtttctatgccttaacagcagtgtacagataagctgattattcatggggactgtggaatatggaaacaggtattcattgtttctgcacgtgtcctgttgaagtactaaccgaagttatattggcaggcatcattgcttatcgtttgcaaatcttgtatattaccactgtttttagaaggttgacccccccctcctccgcattttgcttttttgaaaagagacgagtatagagttatttttgtacagggtcgtctcttgtttcctttgtactttctccctccttttccttttgtcttgaccttctcatgtgtagaggaacagttgccttttgttttactagattatcgggatatagaaatcatttttatgggcaaaagccaataaaaatttcctggtgttccaactacccattgatgtctatattatctt

SEQ ID NO: 2911 - DNA, 786 bp, Glycine max var. Williams 82
atgcagattcttcaatggatctccaaagggacaaatgatcatgaaataggccggagttctcccaacgactggaaagcaattagagataaaaaagctgaaggacaagatataattacagttaggcatcatagggcgcatcaaggaacaaagacaatcgaagggaggaagcttggcagcaagaacttgaaactgtttatttttatatgcggaaaagacattccgaaggcttgtttttacagaaccctcgacttaaacagaataagaaacttgaatagaagaaggcattttatccactctatgaatatgaagagagaagaattatcaggagtaggaaagaaggttttgcctataagtgaagcatcattgtccaaaacaactgaaagaaatagtgaacaatattgtgtcaccgctgaaacaaaggatcgaactaaaggtgatagaaataagctaatttcaagaatgaaagagctacttagaagggttgctgcaacaaaaacagacgaaagagaaagtttctatgatcaaaaggttttacattttagaagacaaggaaacatagaagcatttcctgaagatgatcaacgcatcagtgaatcacccaagatcagtttgacgtgggatgtggaaacctcttctgtccactcactggctacttggtctgaaaatgttcaaaccaagatttcacattcacatacttacatccctcgtagagagagtagtggcatcacttgtagaaaagaaaactggatcaccacagattctgaatttgtggtgctggaactatga

SEQ ID NO: 2912 - DNA, 1518 bp, Glycine max var. Williams 82
atggcaatggccaacaaggagagggagaagaagttcttctttgtagggtcactagtaaactacgcagctgaactaaagcttcttctcgcaactctcttccttctttgtggtgttgccactctccttcaattcctcccttcgcgtttcaccatttcctcctccgatctccgcttctgcatctcaagggtgtccctaacacccccaccaccctctacacccccaccaccctttacatcactttctacacccccaacaccactctcttccacccaaaaacaccttcccaatggcaccatcaagcgtgtcttcaaccctcacggctccgcggcctacaacttcatcaccatgggagcatacagaggaggactcaacaccttcgccatcgttggcctttcttccaagccactccacgtttatggcaaacccacctacgtgtgtgaatggatccctgatctcccttcactgcaaaactcttcaaaacccatcatcacaaaaggcctcaagtacctccctgactggggctatggccacgtctacaccgtggtggtagttaactgcaccttcaacggcaccgctgtcaatggtgacaacaccggtggcaagttggtgctccatgcttccacctcaggagccggtgacactggcttcaacgtcaccgacagaatagaggtcctccatgaagcaccgggagctttaaacgcttcacttttcatgtcaaagcctaagtatgactacttctactgtggctcttctctctatgggaacttaaaccctcagagggtgagggagtggatcgcttaccacgtgaggttcttcgggccaaagtcgcatttcgtgattcatgatgctggtggggtgcatgaggaggtgcttgaggtgctgaagccgtggatggaactagggtttgtgacattgcaggatattagggaccaagagaggtttgatggatactatcataaccagttcatggtggtcaatgattgtcttcatagatacaagttcatggccaagtggatgttctttttcgatgttgatgagtacatttatgtgcctcctaagactactatcaagtccgtgcttcactcactttcggaatacgaccagttcaccattgaacagatgcctatgagcagcaagatttgcctctctgaggattacggcaaaacttacaggaaatggggttttgaaaagcttgtgtatagagactcaattacaggaattcgtagagatcgaaaatatgcagtgcaaccacggagtttgtatgcaacaggggtgcacatgtcaatggatctatcaggaaagacaacacacaaaactgaaggtaggatcaaatacttccactatcatggaaccatatcagaaaggagagaaacatgtaaaatactcgtcaacacaacacaagtcacccagaacaaaattccttatgtgatggacaccacaatgagggacactgctggggtaatcaagaaatttgagctcaagatgattggaacaaggttgcagaagacaaggcaataa

SEQ ID NO: 2913 - DNA, 3179 bp, Glycine max var. Williams 82
tcgttcacgccgtgctcgtcgccgccgttcgcgccgtgggtcgtcgctgccgtgctcgtcgccgccgttcacgccgtgggtcgtcgctgctggctgctgtgtgcagcgggtaacgcgtggctgctgtcgtggctggttgcaggggtcgtggctgggttccgaggtcgcgctgtgtgttggagcttcgaggggttgcagctgcgttctaaagccaacaacaactcagcttttgcttctgcttttttcagtttcattattagtgcaagatgcctcgttctaaagccaacaagaactcaaagaaacagaagggcattgacttcaagaaaataaggcgaaaggttgggaggaaactgccaccacctaagaatacaacagatactgaaattaaatctaaagcaattgttcttccggaacagagtcttgcggcagagaaggcaggtttggctgtaaacaagaaaggtttgactttaaaagaacttctccagcaaacatctcatcacaatccaaaagttcgtagagatgcattgattggtattaaggatttattcaccagatatccagctgaacagaagttgcacaaatatgctgctgtagaaaaacttcgtgagcgcattggtgatgatgataaagtggttcgaaaatcattatatgatctttttaaagtagtgattttaccttgctgtaaagaggacaatcaagagctgatcgtttctttattggtgccttacatttttaatgcaatgactcatttggtggttgatgttcggatgatggcatttgattttttagacctcattcttgagttttatcctccttccttttcaccatcttatgcagaaaagatttttcagaattatgaggatattctagtgaggaaccagtactatttacaggacaaaggaaaactaaaggatgctcttgctgggctggttcgctgcttgtcactcctgccatggaataaagaagaaactgatttgcacaataaggatgctactggacaaagggtattgcatgcctttgaagttgatgtgtctatgagctctaatggtttttcttatatcataaagaatttgaaggatctagtgccagtattaataaatagtttcctggaatttattccattggttcatgctatggaaagtcttgaagggaagtcttttggttgtatgatatccattcttcatagcatatatcttatagtcaggtctattgcttatgggactgataaggattcagaatccccaagttctcaaggtggacctgatgcagctgtatgggatgttaacatctcttctacattcttgaagaaattatttcctcgtttccccctcaacccggttgatcatctttctgaaaaggattgtgataggttgtttgacttgaacatgatcgttgccaaaatattttttgaattaaatgaatggacgagtcttcctcctaatttgttggagacatttctagaattttttgaaaatgctttgcttgggaagttctgcagggctacacagtctggtaaggctgtctgggaagagtgtttagttcagctcctttcatttattcctaaatttctttcacgtggggcaagctcttggacatcacgtcttcttcaggcttttacccagacatttagggaaagcaagccaggttccttgatgaaattggcatgtgtttctgctattgaagatatgctaactcctattgaaagcatgctttccatagagacaagcaatccagaaaatttagaacttcaagatgccttactcgcatggattagagagctccctctgttgcttatccagcttggagataaacacccaacctgctcccaggttgtgttacgccttcaacttcgtattggacaatgttctttgttgaattcatcacttgtttgtatgtatgacaacacacagtactcattgctagatttttattgtacatgtcaaggaggacagatatgttatggtccttttctcaggcttcctagagaatctcaagagctctctttatgttccctttactatttctcttatttggacctgcctattttaaagtcaatagcttgttgttgcctaagtgcagatctagatccctatgtgttatttaggatcatagaggttctccattcagcctatagagatggacatataaaaattgcagattacttgagtgttttcatcaccttggtcttgcgtttcaaagtttcccctgaaatcggttctgctggttttaagagtgatccactctgccaaactttgaagtcaatgacaactgttctttgctcatacatggcacagatgggtgacaattctcttgttctgcagatagtagagaaagtggtaattgatcagataccacaaatgccttctttggataatagttgctctctcctgagaatgcttgttacagtggattccaagcccacaagactttctgaacaaagcattatcattctaggccagcatctttctgaatatctgatggatgctgtgcagtgcattccagaagatggtgatgaacaggggactccctccattcaattaagtactcagcattattatctcctaccttgttttttcttgtttgatcggtgccataaacttatgaatcttgtgttgaagagaatgggatcagctataactgaaagtagtttgtcaccaatatctgataaatgcactcaacatacaaggaactgtttggatagagtgaatgctgtcacttctgtactttttttgatgcacaaggatgctaaattgcaaccgattatgtctttattcaaggaagatattgataacgtcatacataaagttttttctttaaagacatcagggcggatcagtacgacaattgaagaaaggcatgaaatacaatgtgcatttgaacgactgaaaatcttaacgggataacaattgtcaagaaggatgttctgaattgagaaactggttcatgatatttgcaggcatcgttggcatagaagggagttttttttgtcaaattgacagacagaggacatggactgagctctggggtgtaatttgatctctctccatatgtgtgtgccctttttgtcttagattgcttccgagttgtaactttttctctctaacttgcggcgaagtctggatcaaaactgcaagatagtggtgaaggagatgttgaaaaacaagcagagtggaaccaag

SEQ ID NO: 2914 - DNA, 1860 bp, Glycine max var. Williams 82
atgtcaggggtggtggaagaagggggtgttgaattggtggagaattcggaagaggagagaagaaggtcgagaattggaagcttgaaaaagaaggccataagcgcgtcttctagatttacgcactcgctcaagaagagagggaagaggaaaatagactttagggttcccattgaggatgtgagagacgctgaggaggaattcgcggtgcaggaattgcgtcagaggctgcttctgagggatttggttcctaccaggcatgatgattatcatgcattcttaaggtttcttaaagcgagggactttaacatcgagaagacgattcagatgtgggaagagatgctaacttggagaaaagaatatggaactgacgctatccttcaggattttgaatttgaagagctggaagaagtgttgcagcattaccctcaagggtatcatggagttgacaaggaaggtaggccagtttacattgaaaggcttgggaaagctcatccaagccgcttgatgcgtataaccacaatagataggtatttgaaataccatgtccaagagttcgagagggctctgcaggagaagtttccagcatgtaccattgcagccaagagacgaatttcttcaaccacaacagtattggatgtacagggcttgggaatgaaaaatttctctcctactgctgcaagtctattggctgccatctcaaaaatagataacagttactatcctgagactttacatcgaatgtatatcatcaatgctggtcctggatttaagaggatgctttggcctgcagcacagaagtttcttgatgccaaaactattgcaaagatacaggttcttgaacctaaatctttatgtaaattactggatatcattgactctagtcagttgccagactttttgggtggaacatgtacatgtcctggagaaggtggatgtctaaggtctagcaaaggtccatggaatgatcctgatatcatgaaaatggttcatagtgtggaggcaacgtttgagagacaaatcgcccgaatgtccaatgaacaacagaatttagactctttttggatatgcccacagaaggggcaatgcagtgatacgtcaacagccgaatctgggtcagatcttgatgattctttttcgtccatcggacaaagtagattcacttttcctcgtttagctgcagttcatgaagaagtcagagtatcagacaactactatagttgtgatgatagtgctcctgcagccgagaaagtgcttgaaagtgatgaatttcacataacccaggaacaatcattgcaaaatgatgatacagggaatattgcttgtatggaaaattccacaggcacttcagtcaacaattggttcagctttgttaaggaaaaagtggagaaaacaaatttattatatgtgtcgagagtggtgatatattttatggaaagattagtaatgttctttcgcagtttaagattagaattttggagaacacagaacaatatttacccatctgttgccatggaacacaacaataaccctgcagcagctagtgaaatactttctgaaagggatcatattcttcgatgtatgcaacgtcttgagagactagaaaaaacgtttggggaacttagccacaaacctgcaggcatacctttggagaaggagcacatgcttacaaattccttggataggattaaatctgttgagtttgaccttgaaaagactaagagggtgctacatgctacagtgatgaagcagcttgagattgctgagctgctggagaatttgcaggcatcgaagagtcaagtaaattgcatctcgcaaagaaggctgttccgtcgaaagattcaagtttcggcaacaagttag

SEQ ID NO: 2915 - DNA, 1197 bp, Glycine max var. Williams 82
atggagagtgcaagaatcagccaatggttaaatcttcttgtttgtgtactgctattgctcaaggcagaaggatctttagttccattgattttggtcgagaatgcagaatcaaaaggagctgtttgtttggatggaagtcccccagcttaccactttgataagggatttggggaaggtattaatagctggattgttcacattgagggaggaggatggtgcaacaatatcgagagttgccttgaccgtaaggacactcgcttaggttcatctaagcaaatggaggatatttacttttctggaattttaagcaatgagcaacagtttaatccagatttctacaattggaatagagtcaaggttaggtactgtgatggttcatcgtttactggtgatgtggaagaagttgatccaacaaccaatttgcacttcagaggagcaaggattttttcagctgtaatagaagaattactagcaaaaggattggaaagggctgaaaatgctattctctctggctgttcagctggaggattgacaactatattacactgtgatagctttaaaacttttttgccctctagagctaatgtgaaatgtgttccagatgctggttattttgtcaatgtagaggatatctcgggagcacatttcattcaacagtactacagtgaagttgtttcaacacatggttctgcaaagaatttgcccacatcctgcacttcaaaactcagcccaacactatgcttttttccacaatatgtggcatcacatatcagtaccccaatcttcgttgttaattcagcctatgactcgtggcagattcgatacatctttgtacctggctctgctgatcccagtgatagttggaatagctgcaaggttaatatgagcaactgctcgcctgatcaactaagtaaattgcaaggcttcaagagtgaattcgaaagggcattgagtgaggtaggagattctccatctaaaggaatgtttattgactcttgctatgcccactgccaaacagaaccacaggagacatggtttaagactgactctccaaagcttgccaatacaactattgccaaggcagtggcagactggttttatggtcgaagttctttccgccatgtggattgcaattatccttgcaacccttcttgccagaaccgtgtttttgatctaaaagacctccctggaatatag

SEQ ID NO: 2916 - DNA, 1398 bp, Glycine max var. Williams 82
atggaactcagcacgatgttgttcttgtttgtttctttcctaaccattcttttctctaaatcactcattaaatttttcttctcttccaaaggtagacaattgccacttcctcctgggaccatgggttggccttacataggagaaaccttccaaatgtattctcaagacccaaatgttttctttgccacaaaaatcaagaggtatggctctatattcaagtcacacattttgggttatccttgtgtgatgatttctgacccggaagcagcaaagtttgtactgaacaaagctcaactcttcaaaccaacatttcctgctagcaaagagaggatgttggggaagcaagcaattttctttcaccaaggagcataccatgctaatcttagaaggcttgttcttcgcaccttcaggcctgaggtcatcaaagacaaagtctcatacattgaatccattgcccaaagttgcctcaaatcatgggaaggaaaaatgatcacaactttccttgaaatgaaaacctttaccttcaatgtggccctgctttcaatttttggaaaagatgagaatctctatggggaggatctgaagcgatgctactacaccctcgagagagggtacaattcaatgcctataaaccttccaggaacactgttccacaaggccatgaaggcaaggaaagagcttgcacagatcttggctcaaatcatctcaacaaggaggaatatgaagcaagatcacaatgacttgttgggctcgttcatgagtgaagaagcaggactcagtgatgagcaaatagcagataacatcattggtcttatttttgctgctcgcgacaccactgccaccgtacttacgtggattgttaagtaccttggtgaaaacaccagtgtcctagaagcagtaactgaagagcaagagtcgatattaagggccaaggaagaaagtggagaagaaatgggtttgaattggtcagacacaaaaaatatgccagtgacatccagggtcatacaagagactctaagaattgcatcaattttatcttttacattcagagaagctgtagaggatgttgaatttcaagggtatctcataccaaaagggtggaaagtattaccactttttagaaacatccaccatagtcctgacaacttcaaagagccagagaagtttgatccttcaagatttgaggttgctctaaaacccaatacttttatgccatttggcaatgggacccatgcatgtcctggcaatgaattagctaagttggagattttggtgtttctacatcacctcaccacagaatacaggtggtctttgatcggagcaaaaaatggggttcaatatggcccttttgcgcttccacaaaatggattgcgcatcacactatatcccaagaaataa

SEQ ID NO: 2917 - DNA, 1983 bp, Glycine max var. Williams 82
agagattccgtgcgtggaaatatttgagctgtaattgaaaatctccctctctttcctccttctttcttgcttcacatcttttcactctaaagagcctataaatacctcaaatgttcaactttttttgtcacacaacgcataccaccttattcatctttcttcttctttcaccattcacctacaactacaactacacaagccagaagaacctactcacactaaaccaaaccattagacatggaactcagcacgatgttgttcttgtttgtttctttcctaaccattcttttctctaaatcactcattaaatttttcttctcttccaaaggtagacaattgccacttcctcctgggaccatgggttggccttacataggagaaaccttccaaatgtattctcaagacccaaatgttttctttgccacaaaaatcaagaggtatggctctatattcaagtcacacattttgggttatccttgtgtgatgatttctgacccggaagcagcaaagtttgtactgaacaaagctcaactcttcaaaccaacatttcctgctagcaaagagaggatgttggggaagcaagcaattttctttcaccaaggagcataccatgctaatcttagaaggcttgttcttcgcaccttcaggcctgaggtcatcaaagacaaagtctcatacattgaatccattgcccaaagttgcctcaaatcatgggaaggaaaaatgatcacaactttccttgaaatgaaaacctttaccttcaatgtggccctgctttcaatttttggaaaagatgagaatctctatggggaggatctgaagcgatgctactacaccctcgagagagggtacaattcaatgcctataaaccttccaggaacactgttccacaaggccatgaaggcaaggaaagagcttgcacagatcttggctcaaatcatctcaacaaggaggaatatgaagcaagatcacaatgacttgttgggctcgttcatgagtgaagaagcaggactcagtgatgagcaaatagcagataacatcattggtcttatttttgctgctcgcgacaccactgccaccgtacttacgtggattgttaagtaccttggtgaaaacaccagtgtcctagaagcagtaactgaagagcaagagtcgatattaagggccaaggaagaaagtggagaagaaatgggtttgaattggtcagacacaaaaaatatgccagtgacatccagggtcatacaagagactctaagaattgcatcaattttatcttttacattcagagaagctgtagaggatgttgaatttcaagggtatctcataccaaaagggtggaaagtattaccactttttagaaacatccaccatagtcctgacaacttcaaagagccagagaagtttgatccttcaagatttgaggttgctctaaaacccaatacttttatgccatttggcaatgggacccatgcatgtcctggcaatgaattagctaagttggagattttggtgtttctacatcacctcaccacagaatacaggtggtctttgatcggagcaaaaaatggggttcaatatggcccttttgcgcttccacaaaatggattgcgcatcacactatatcccaagaaataaatatgatgaagataaaaagtggaggcacactaactatggcatggaagcaacttgctaaatggaaataatgcttccaaagatatttgaatttgttaacctagagaaggtgatgaatgagaccatatattaaaaaagggagagcaattttttcctttattttttggccaggagacaatcaaagaggaattcttgagattatcatacacagagggagggaaggcaattgtacaaatgaggtctcagccagatattcatcatatttttcacttaaatatatttttatccttttgataaatattcgattttttatttgtttcttaataaatttttgttttgaattgagtcctt

SEQ ID NO: 2918 - DNA, 2130 bp, Glycine max var. Williams 82
agagattccgtgcgtggaaatatttgagctgtaattgaaaatctccctctctttcctccttctttcttgcttcacatcttttcactctaaagagcctataaatacctcaaatgttcaactttttttgtcacacaacgcataccaccttattcatctttcttcttctttcaccattcacctacaactacaactacacaagccagaagaacctactcacactaaaccaaaccattagacatggaactcagcacgatgttgttcttgtttgtttctttcctaaccattcttttctctaaatcactcattaaatttttcttctcttccaaaggtagacaattgccacttcctcctgggaccatgggttggccttacataggagaaaccttccaaatgtattctcaagacccaaatgttttctttgccacaaaaatcaagaggtatggctctatattcaagtcacacattttgggttatccttgtgtgatgatttctgacccggaagcagcaaagtttgtactgaacaaagctcaactcttcaaaccaacatttcctgctagcaaagagaggatgttggggaagcaagcaattttctttcaccaaggagcataccatgctaatcttagaaggcttgttcttcgcaccttcaggcctgaggtcatcaaagacaaagtctcatacattgaatccattgcccaaagttgcctcaaatcatgggaaggaaaaatgatcacaactttccttgaaatgaaaacctttaccttcaatgtggccctgctttcaatttttggaaaagatgagaatctctatggggaggatctgaagcgatgctactacaccctcgagagagggtacaattcaatgcctataaaccttccaggaacactgttccacaaggccatgaaggcaaggaaagagcttgcacagatcttggctcaaatcatctcaacaaggaggaatatgaagcaagatcacaatgacttgttgggctcgttcatgagtgaagaagcaggactcagtgatgagcaaatagcagataacatcattggtcttatttttgctgctcgcgacaccactgccaccgtacttacgtggattgttaagtaccttggtgaaaacaccagtgtcctagaagcagtaactgaagagcaagagtcgatattaagggccaaggaagaaagtggagaagaaatgggtttgaattggtcagacacaaaaaatatgccagtgacatccagggtcatacaagagactctaagaattgcatcaattttatcttttacattcagagaagctgtagaggatgttgaatttcaaggtcaataaccaaatctgataaagataccctcttttcattattaataatatgccagaaggattcctctcttttccttgtttgtgattttgtgttggggactacttttttattttttttattcagggtatctcataccaaaagggtggaaagtattaccactttttagaaacatccaccatagtcctgacaacttcaaagagccagagaagtttgatccttcaagatttgaggttgctctaaaacccaatacttttatgccatttggcaatgggacccatgcatgtcctggcaatgaattagctaagttggagattttggtgtttctacatcacctcaccacagaatacaggtggtctttgatcggagcaaaaaatggggttcaatatggcccttttgcgcttccacaaaatggattgcgcatcacactatatcccaagaaataaatatgatgaagataaaaagtggaggcacactaactatggcatggaagcaacttgctaaatggaaataatgcttccaaagatatttgaatttgttaacctagagaaggtgatgaatgagaccatatattaaaaaagggagagcaattttttcctttattttttggccaggagacaatcaaagaggaattcttgagattatcatacacagagggagggaaggcaattgtacaaatgaggtctcagccagatattcatcatatttttcacttaaatatatttttatccttttgataaatattcgattttttatttgtttcttaataaatttttgttttgaattgagtccttaataaaataacacttttatttttt

SEQ ID NO: 2919 - DNA, 1860 bp, Glycine max var. Williams 82
atgcaaaccaaaatagggaagctagcggtgaaccaaacttcgaaaccactgcacagagtggtggaagacaagttcatttccctgttacggacatgcggaacctgcgtgcggctgcaccagatccaagcccagatagtgacccacggactcgagggaaacgattacgtcaccccgagtttcatcacagcatgcgcgcgcctcggtggaattcgccgcgcgcgaagagtgttcgacaaaacggcgcaaccaaacggcgccacgtggaacgccatgttccgagggtacgcccaagccaattgccacctcgacgtcgtcgttttgttcgcgcgaatgcaccgcgctggcgcgtcccccaactgcttcacgttccccatggtagtgaagtcttgtgccactgcgaacgctgccaaagaaggagaagaggttcattgcgttgtagccaaacgcggctttaagtcgaacacgtttgtggggtgcgcgttgattcacatgtattcattgagagggggagtgtttgttgctgatgcttacaaggtgtttgctgaaatgcgcgacaagaacgtgttcgcttggacagctattgttgcagcacacgtggcgtgccgcgacatggtttccgcgcggaggctcttcgacctcgcgccgcagcgtgacgtggtgctgtggaacgtggtcgtttcggggtatatcgagttgggggacatggtggctgcgagggagctgtttgatagaatgccggaccgcgacgtgatgtcgtggaacaccgtgttgagcggttacgcgacaaatggcgaggttgaatcgttcgtgaagttgttcgaggaaatgcctgtgaggaatgtttattcttggaatgggttgattggagggtacgttcggaatggactatttaaggaggctttggagtgttttaaacggatgttggtgctggttgaaggtgaaggtaaagaaggtagtgatggtgtggttgttcctaatgattacaccgttgtggcggttttgacagcgtgttcgagattgggggaccttgagatgggtaagtgggtgcatgtttatgcggagagtattgggtataaggggaacttgtttgttggaaatgctttgattgacatgtatgcgaaatgtggggttatagagaaagctcttgatgtgtttgatggcttggatgtgaaggatataataacttggaacactataattaacggccttgccatgcacggccacgtggccgatgctttgagtttgtttgagcggatgaagagggcgggagagaggccggacggtgttacttttgttgggattttgtcggcctgcacgcatatggggttggtgagaaacgggcttttgcatttccaatcgatggttgatgattactcgattgtgcctcagattgagcattatggatgcatggtggatttgttgggaagagctggtcttatagacaaggctgtggatatcgtgaggaagatgcctatggagccagatgcggttatttgggcagcgctgcttggggcgtgtaggatgtacaagaatgtggaaatggcagagctggcacttcagcggctcattgaacttgaacccaataaccctggaaactttgtcatggtctcgaacatttacaaggatctaggaagatcgcaagatgtcgcccggttgaaggtcgcgatgagagataccgggttccgaaaagtgccgggatgtagtgttattgggtgcaatgatagtatggtggagttctactccttggatgagagacatcctgagacagatagtatatatagggcattgcagggattgactattttgttaagatcccatggatacgttccaaatcttgtggatgttgctcatgcaaactga

SEQ ID NO: 2920 - DNA, 585 bp, Glycine max var. Williams 82
atggagtttgtgccaaatcaatgccctttgatgggttcctttgggaatttcgttgagagggtcaaaagggttggtaccctcttcgtctctgccatcattgggaacatattctctgcgatcttgaccttctgctttgcgttagttggcactttgttgggtgctatgactggtgccttgataggccaagagacagagagtggtttcattcgaggggctgctataggtgccatatcaggagctgttttttccattgaagtttttgaatcttcccttgttctttggaaatctgacgaatctggaattgggtgtgtcttatacttgattgatgttcttggtagcctattgagtggaagactagtgcgtgaaaggataggtccagccatgttgagtgctgtccaaagtcagatgggtgctgttgaaataagctttgatgaggtacaaaacctctttgacattggtggcgccaaaggtttatcgagagattcagttgaaaagatcccaaagatcacaattactagtgacaacaatgttgatgcttctggggagaaagattcatgttcagtttgccttcaggtttgtttatga

SEQ ID NO: 2921 - DNA, 994 bp, Glycine max var. Williams 82
atgacttataaaattttaaatataataaatatttttacgaatagtgtttaaaattcttatcacgtacttataaacacaaaaaagaaaacctttttttagaggaaaaaaaacctactaataataatacaactttattaaccatagtaagttttttctttctttcttagcaaaatggatactaaaatgagtgtgccactgtagcattaagggacaccagctataaatgcgagtgggttgaagacattgctgttgttatatttatatatataactcttccttaaacccgaatctgtgacattgaacaaacggcactggaatttctgagataaccacatggagtttgtgccaaatcaatgccctttgatgggttcctttgggaatttcgttgagagggtcaaaagggttggtaccctcttcgtctctgccatcattgggaacatattctctgcgatcttgaccttctgctttgcgttagttggcactttgttgggtgctatgactggtgccttgataggccaagagacagagagtggtttcattcgaggggctgctataggtgccatatcaggagctgttttttccattgaagtttttgaatcttcccttgttctttggaaatctgacgaatctggaattgggtgtgtcttatacttgattgatgttcttggtagcctattgagtggaagactagtgcgtgaaaggataggtccagccatgttgagtgctgtccaaagtcagatgggtgctgttgaaataagctttgatgaggtacaaaacctctttgacattggtggcgccaaaggtttatcgagagattcagttgaaaagatcccaaagatcacaattactagtgacaacaatgttgatgcttctggggagaaagattcatgttcagtttgccttcaggtttgtttatgatgataccatttttcttgaagcgttattaatgttaagtaggtacagatacagagggggtgggcggggacatctgtta

SEQ ID NO: 2922 - DNA, 204 bp, Glycine max var. Williams 82
atggacaatgaaattgtgaattgtattgatgtggaatctgcaaaccaatgtatccaaactccatgtgattgccagcacaaatatatttttttgtttaaagtgattgctgttcttggcatgccaagaaccattgctgcatgtccttccccgttggtgcagccggatattatgagagtgaattatttcttgtcggaattcttatag

SEQ ID NO: 2923 - DNA, 1506 bp, Glycine max var. Williams 82
atgttgcaagacatgtggaatgctcctcccggtttcagaccctccaagtctgcaccttcttctccggcgaagcctcttgggatggttcccagaacgcgttctgagaccttccacgtggctcacaaggtccccatcggtgacactccttatgtgagagcaaaaaacgttcagttggtgaataaggacccggagagagcgattccgctgttctgggcagccattaatgcgggagatagagtggacagtgctttgaaagatatggctattgttatgaagcagcaaaatcgggccgaagaagccattgaggccattaaatcgcttcgaagtagatgttcagatcaagcccaggaatctctcgataatatcctcttggatctctacaagaggtgtgggagacttgatgaccaaattgctctattgaagcacaagttgtatttgattcaacaaggtttggctttcaatggcaagagaacaaagactgccagatctcaaggaaaaaagtttcaagtctctgtggagcaagaagccactagattgctgggaaacttgggatgggcactgatgcagcagaacaactacattgaagcagaagaggcctatcgccgcgcacttttgatagctccagacaacaacaagatgtgcaatctgggcatttgcttgatgaagcaaggaagaattggtgaggcgaaggagacgctgtaccgcgtaaagcctgcggtgatggatggccctagaggctcagattctcacctgaaagcctatgaaagggcacagcaaatgctgaaggacctcgagtctgagatgatgaacaagggaggagttgataggattgaacaaagcaggctctttgaggcctttttgggttcttcatcaatttggcaaccacagccttgcaaggatcatcaccacacaaccttgccagcagcagcaacaacaacaaattcagccaaaattcatgatgagtttgctgatgagaacatcaattccaacataatttcaacaaatcacacagcacttccaccaactaagggtagcaacaacaacaaacaacttggtgccattttggggaactcactcaatgttgcagcccctccattctatgcatcatcaaaatcatctatgttgagggaaccaattgagaaccatctctctgagacacttaagagaacaaggtctggaaatgctgcagggtccatgagagtagtgagtgatgtgagggatgccaacaacaacaacaacaacaagaagttgcatgtggaattaggtgtgccagtgccgcagaacaaaacaagaaggctctcatcagaagatgctgagaagaacaagttaacagacttagacttgttgcccgacgacgacgaattcgaagaggccattcttgcagcaattttgggacccccaaacgaatcagataaagctaattatgacacaagcagcaccacctccaggatgttgaggcttaaggtttttcaggatatcacattatctttgagtccaagggcctga

SEQ ID NO: 2924 - DNA, 3039 bp, Glycine max var. Williams 82
atgggaaacttagctgcagagtctctctgtgctttattgttgctatgtttctatggcaaacttatagttagtgctaaatacatgaagtataatactggggccagtattgtgccaggaaaattgaatgttcacttggttccacactcccatgacgatgttggttggctgaaaaccattgatcagtactatgttgggtcaaacaatagtatccagggggcatgtgttgagaatgtgttggactcggtggttgtatctcttcagaaagacccaaatagaaagtttgtgtttgccgaaatggcatttttccatcgatggtgggtagaacaaagtccagaaacacaagaacaagtgagaaagcttgtggatgcggggcagctagaattcataaatggtggttggtgtatgcacgatgaagctgcaacacactacatagacatgattgatcaaaccactttgggccatcgctttatcaaggaccagtttaacaagactcctactgttggatggcagattgatccatttggtcactctgctgtgcaggcttacctgctgggagctgagcttggttttgattctatacatttcgcaaggattgattatcaagacagagctaagcgcaaagctgataagtctcttgaagttgtttggcgtggctccaaaacattcggttcttcagctcagatttttgccaatactttccctgttcattatagtgctccaaatggtttcaactttgaagtcaataatcctgatgttgatgttggtcccgtacaggatgatcctcttattttcgattacaatgttaaacaacgtgtcaaagaatttattgatgctgctactacccaagcaaacgtgacgaggacaaatcatataatgtggacaatgggtgatgatttccagtaccaatatgcagagtcttggttcaagcaaatggataagttaattcactatgttaataaggatggaagagtaaatgctttgtattccactccatctatttacaccaatgccaaaaatgctgctaatcaactttggccactgaaaacagatgattacttcccgtatgctgatagtccaaatgcttattggacgggctatttcactagtcgcccagccttaaaacgatatgttaggatgctaagtggatactatttggcagcacgtcaacttgaattcttggttggaaagcaatcaactaaatacaatacttatgaccttggagatgctctaggaattgcacaacatcatgatgctgtcagtggcactgccaagcagcatacaaccaatgactatgccaaaagattggctattggagcctatgaggctgaagcggttgttagttcttctttggcttgtcttactagaaaacaatcaggtgataagtgttcaacacctgcatcggcatttgcccagtgtcaattgttaaatattagttactgccctccggcagaagacaacattccagaggctaagagtttggtagtagtggtgtataacccacttgggtggaatcgtactgacattgtcaaaataccggttaatgatgctaatcttgttgtcaaagattcatcgggcaataaactagaagtacaatatgtggatgtggatgatgttacgacaaatttaagaaaattctatgtgaaggcctacgtgggggtgtcaccaaaacaatccccaaagtactggcttttgtttcaggtttcagtacctccacttggatggagtacatacttcatttctaaagcaactagaaaagggactaggagaaaagatttatctcacaccaacagtcagaaaggtgacaccataaacattgggtcgggaaatttaaagatgtccttttcctcaacatctggacaactcaaaaggatgtataattccagaactggagttgatatacctattcagcaaagctacctttggtatggatctagtgagggcgatagtgatcctcaggcttctggtgcatatatatttcggccaaacggatcccccccaaatatcgtttcaagatcagtgcctacaaaggtaattcgtggaccactagttgatgaagttcatcagaaatttagctcttggatttaccaggttactaggctttacaaagacaaagaacatgctgaaatcgaattcactattggtccaattcctactgatgatggagttggaaaagaggtgatcacacgaatgacagcaaatatggccacaaacaaggagttttatgcggattccaatggaagagattttctaaaacgagttcgagatcatagggaagattggcctctgcaagtaactcaaccagtagcaggaaactattacccacttaatcttggaatttatactaaggatgaaaaatctgagttctcagtgttagttgatcgtgccactggtggagccagcatcaaagatggtgaggtggaattgatgcttcacaggcgtattctccatgatgatagtcgaggagttggggaaccacttgatgaacaagtttgcgtgaacaataataatacttgcgaaggactaacagtcagaggaaattattatatcagcatccacaagcttggagttggttcacgctggcgtcgtacaactggtcaggaaatttattctccattcttagtggcttttacacatgagatctcggaaaattggaagtcctctcatttgacgaaaggaactatcatggatccaaattacagcttgcctcccaatattgctttgataactcttgaggagttggatggtggaattgtgcttctccgtttggcacatctatatgaacgaagtgaagatgctgagtattcgactctaacgaaagttgaactaaagaagttgtttgccatgaaaacgataagggagttgaaggaggtaagtttgtcatcaaaccaagagaaatcagaaatgaagaggatgacatggaaggttgaaggggacaaaggacaagaacctcaggcagttaggggtggccctgtcagctatcacaatttggttgttgagcttggccccatggaaatacgaactttccttttgaaattttaa

SEQ ID NO: 2925 - DNA, 474 bp, Glycine max var. Williams 82
atgttcacagcaccttttcctacatccactgttactctctccggtgaaagcgtaacctcaccgccgcgccacgtcagattccggtcagtagtatcgttcgccaccgccactttcacggaggagcaacaacataaggcagctccgtatctgagacctcatcacgggatggctttgagcgcgacgctgtacgacattctggggatccgcgccacggcgtccggcgaggaaatcagggcggcgtaccggcgactggcgagggtgtgccaccctgacgtggcgccggtggagcgaaaggaatcctctgcgggcgagttcatgaagatccatgctgcgtactgcacgctctcggatcccgagaagcgcgacagctacgatagaagcttgttccggcgccagcagcgaccggtcaagacgacgtcgtcgggggcttccggctacggtgggcggaactgggaaacggaccagtgttggtag

SEQ ID NO: 2926 - DNA, 462 bp, Glycine max var. Williams 82
atggtgccaaggcttcttgtggaggggttatttgtgataattttggtaccttcatttatgggttttccgcaaagctgggatcatgtaccattctcatggctgcgctttgggctattttccatggccttaagcttgcttgggaaagagggttttgtagtttcaactatcaagttgcaatcggattctttaggggctattaatcttttgattaaaggctgtagccactgccattctcatccttgttatatgttggtgaagaatattcatggcattcataaatttgaaggtaatattttacgggtgcatgttcgttgcgaggcaaatcaagttgctgacaagctagctgagaatgacatgttttcattaagtgattattatctttttgatatactgccaaattttatttgtaactctattttagcggatgctacttgtatatctttccctagaggttctaggtga

SEQ ID NO: 2927 - DNA, 2547 bp, Glycine max var. Williams 82
atggaaacaacctcgttttccaaattgttgttcttgttcttctgcttcttcgcttcgtgtttgtcttctcacgcttctgtcacctacgacagaaaggccattctcatcaatggacaaaggagaatcctcttctccgggtccatacattaccccagaagcacccctgatatgtgggaggatctgattctgaaggccaaagagggagggcttgatgtggttgaaacctacgtcttctggaacgttcatgagccttctcctggcaattacaatttcgaagggaggtatgatctggtgagattcgtgaagacaatacagaaagcagggctctacgctcatctccgcattggaccttatgtctgtgcagaatggaatttcggtggatttcctgtttggcttaagtatgttccggggataagctttagaacagacaatgaacctttcaagacggcgatgcaagggttcactgagaagattgtgggaatgatgaagagtgagcggctatttgagtctcagggtggccccatcatactctctcagattgagaatgaatatggggctcagagtaagttgcaaggagatgctggtcaaaactatgtgaattgggctgcaaaaatggctgtggagatgggaactggagtcccttgggtgatgtgcaaggaagatgatgcaccagatccagttataaacacttgtaatggcttctattgtgataagtttactccaaatagaccctataagcctatgatttggacagaagcttggagtggctggtttacagaatttggaggtccaattcacaaaagacctgtccaggatttggcatttgcagttgctcgatttataataagaggagggtcctttgtaaactactacatgtatcatggaggaaccaattttggacgaacagctggaggccctttcatcgctaccagctatgactatgatgctccactggatgaatatggtttgattaggcaaccaaaatatggtcatctaaaggaacttcatagggctatcaagatgtgtgagcgagctttggtttcaactgacccaattattacttcattgggggaatcccaacaggcacatgtatacactacggaatctggagattgtgctgcttttctctccaactatgattcaaaatcctctgctagagtgatgttcaacaatatgcactataacttgcctccttggtctgtcagcatcctcccagattgtagaaatgttgtcttcaatacagcaaaagttggagtgcaaacgtctcagatgcaaatgttgccaacaaatactcagttgttctcatgggaaagttttgatgaagatgtttattctgtggatgacagctcagcaatcatggctcctggtctcctggaacagataaatgtaacaaaggatgcaagtgattatctttggtatataactagcgttgatataggttcgtccgaatcctttctacgtggaggtgaactccccactctcattgttcagtctagaggccatgctgtgcatgttttcatcaatggtcaactttctggttctgcctatggaacaagggagtataggagattcatgtatactggcaaggtaaaccttcgtgctggaataaacagaatcgctctgctcagtgttgccattggacttcctaatgtgggagaacattttgagtcatggagcacaggaatccttggtccagttgcactccatggacttgaccagggaaaatgggacttgtcagggcagaaatggacttatcaggttgggttgaaaggagaggccatggatcttgcctctccaaatggtatctccagtgtcgcgtggatgcaatcagcaatagttgtacaaagaaatcaaccattgacatggcacaagactcatttcgatgctcccgaaggagacgaaccattggcattggatatggagggtatgggcaaaggtcaaatatggattaatggacagagtattggaagatactggactacttttgctaccggtaattgcaatgactgtaactatgctggctcatttagacctccaaagtgccaacttggttgtggccaaccaactcagagatggtaccatgtccctagatcttggttgaagccaactcagaatcttttggtaattttcgaggaacttggggggaatccttcaaaaatttcacttgtgaagagatcagtaagcagtgtttgtgctgatgtgtcagagtaccacccaaatattaagaactggcacattgagagctatggtaagtcagaagagttccatccgccgaaggttcacttgcattgcagccctggtcaaaccatctcttccattaaatttgccagctttggaactcctttgggtacttgtgggaactatgagcaaggagcttgccattccccagcatcttatgccatattagagaagagatgtataggaaaaccaagatgcacagtcactgtatcaaacagcaacttcgggcaagacccgtgtccaaaggtgttgaagcggttatcagttgaagctgtttgtgctccaactgctgcaaattggaggggttga

SEQ ID NO: 2928 - DNA, 984 bp, Glycine max var. Williams 82
atggagcacttagacattgtgagtgaagtgaagcatcaaagaatcaaaaccaacgggatatggctacacgtggcagagaaaggaacaggtccactagttctgctgcttcatggcttcccagaaacatggtatgcctggcgccaccagatcaatttcttggcccatcatggctaccatgtggttgcacctgatcttagaggatatggtgactctgattctcctattgaccccagttcctacactattcaccaccttgtaggtgacatcataggtttccttgatcattttggtcaacatcaggcatttattgttggatctgattggggagcagtcattggatggcatctgagtctgtttaggcctgaaagagtcaaaggatttgtttgtctgggttttccttactacccaagatctccaactgctaaaacggttgaaactatcaggaaattaattggagatgagagtcatgtttgccagttccaggaacctggtagagcagagagggcttttgctagatatgattatttgacagtgatgaagaagtttttgctgataacacggacagattttctagcatctccaccgggcatggagcttgttgatttcttgccaacaccttcggttgtgccatcatggataaccgaggaagaactcatggtctttgcagacaaattccaagagtctggtttcactggtccactcaattattaccgtgcaatggacttaaactgggagcttcttgcaccatggcaaggatcaaagctaacagttccaacgaagttcgtagcaggagacaaagacatcggttttgaaacagcgggtacaaaggcttttgtggaaagtgatattttcaagagcctagttcccaaccttgaagtggttatactagacggccaccattttattcatcaagaaaaagcccaacaagtttcacatgaaatcctttccttcatccgtaaattatcccccaatgcttccatataa

SEQ ID NO: 2929 - DNA, 222 bp, Glycine max var. Williams 82
atggcatcatcttggaccccaaggcaaaataaacaatttgaaagagccctggctaaatatgatagagaaaccccagatagatggcagaatgttgctaacgaggtgggaaaatcggttgaggaggttaaaaggcactatgagatcctcaaagaagatatcagacgcattgagcgtggtcaagtggcattcccctacagaacaaacaattctaacagtaattaa

SEQ ID NO: 2930 - DNA, 1488 bp, Glycine max var. Williams 82
atggagcatggtggcaaagaagaccagacgacgacgttcaacaaatatgcctttgcttgtgctgttgttgcttcaatggtatccatcatatctggctatgacactggcgttatgagtggagcaatgatattcatcaaggatgacattggaatcagcgacacccaacaagaggttctagcaggaatcttgaacctatgcgcattggtggggtctttggccgcaggaagaacctccgattacattggtcgccgctacacaatcttgttggcctcactcctcttcatggttggtgcaattctcatggggtatggtccaaactacgcaattctaatgcttggaaggtgtgttggtggtgttggtgtaggctttgctctcatgatagcaccggtttattcagcagagatctcctctgcatcgtcaagggggtttctaacctcgttacccgagctttgcatcggcattgggatcttacttgggtacatatcaaactacttcttggggaaattgactttgaggctaggatggagattgatgcttggtgtagcagcacttccctcgctcgctttggccttggggattctggcaatgccagagtccccaaggtggttggcgatgcagggaaggcttgcggacgcaaagaacgtgttcttgcgtgtctccaacaccgaacaggaggccgaactccgattcggtgaaataaaagttgtgatggggtttaatgattgtgaagtcgaggagaaaaatgtgaagccctcttacaagtctcaaggggaaggggtttggaaagagttgctggtgagaccgacgccaaaagtgcgttggatgctgattgcagccgtggggattcatttcttcgagcatgcaacgggcattgaggctgtgatgttgtatagtccaagaatcttcaagaaagctggtgtcactagtaaagataagcttcttcttgcaacggttggtattggcctcacaaagatcattttcttggtcttggctttgtttttgcttgacaaagttggtagaaggcgtcttttgcaaatcagcactgggggaatggtttgtgggctcacacttttgggttttagtttgactatggtggatagttctagtgaaaagctcttgtgggctttgagccttagcattggggccacttatggttatgttgctttctttaatgttgggcttgggcctgttacttgggtctatgcgtcggagatatttcctttgaagttgagggcgcaaggggctagtataggagttgcagtgaatagaaccatgaatgcagtggtttccatgagttttatttcggtgtacaaagcgatcactataggtgggagctttttcatgtttgctggaatatctatagtggcttgggtgttcttctactttttccttcctgaaaccaaaggcgtgcccttggaagagatggagatggttttcagcaaaaaatccagtgggaaaaatgtagcaatagaaaatggtccaagatag

SEQ ID NO: 2931 - DNA, 996 bp, Glycine max var. Williams 82
atggcagcgtcactacaagcagcagctactttcatgcaacccaccaagttgagcaggagcaacactttgcagcaaaagtctactcagtccatttccaaggcttttggtttggaacctgttggagctaaaaaggtcacatgctcccttcaggctgatcttaaggacttggctcacaagtgtgttgatgctaccaaaattgcaggattcgcccttgccacctctgccctcgttgtctctggggcaagtgctgaaggtgttccaaagaggctaaccttcgacgaaatccagagcaagacctacttggaagtgaaggggacaggaacagcaaaccagtgcccaacaattgatggtggattggactcatttgccttcaagccggggaaatacaatgccaagaagttgtgccttgagccaacttcattcacagtgaaggccgagggtgtggccaagaatgctccccttgagttccaaaacacaaagctcatgacacgtttgacctacactctggatgagattgagggaccctttgaggtgtcttctgatggcactgtcaagtttgaggagaaggatggcattgactacgccgccgtgacagttcagctaccgggaggcgaacgtgtgccctttctcttcaccatcaagcagttggtggcatcagggaagccagatagctttagtggggagtttctagtcccatcctaccgtggaagctctttcttggaccccaagggaagaggtgcttccacaggttatgacaatgcagttgctttgcctgctggtggaagaggagatgaggaagaacttgccaaggaaaacaataaaagtgcctcatcatccaagggcaaaatcaccttgagtgtcaccaagaccaagcctgagacgggtgaggttatcggtgtgttcgagagtgttcaaccatctgacactgatttgggagcaaaggctccaaaggatgtcaagatccagggcatctggtatgctcagcttgagtcatag

SEQ ID NO: 2932 - DNA, 1947 bp, Glycine max var. Williams 82
atgtcatcagcagaaaaacccagctccaaaggacaagcatggttctgcacaacaggattgcccagtgacattgtggtggaagttgatgacatgacattccatctccacaagtttcctctgatgtcaaaaagccgaaagctccaccttctaattacgcagcaagaggcagcgtctaactccactgtcccacagcagcagcagcagcagcaagaaacagaagatgaagacgaaatcgtcgaagagcagtgtcacgtgaccttcacgggcttccccggtggctccgaggcgttcgagatggccgcaaaattctgttacggcgtcaagatcgacctgacgccgtccaatgtggcggcgctccggtgcgctggggagtttctcgaaatgaccgaggattactccgaggacaacctcgtttccaagacggagggctttctatcgcagcacgtgctcaagaacctcaaggactctgtcaagacgctgaaatcgtgtgactccttgatgcctatggcggaaaatctcggaatcacgcagaggtgcgttgattctgttgtttccagagcttcctcagcggatcctgcattgttcggctggccggtcagcgacgctacttctgtgtccaaacaggttctctggaatggactcgacggtgacggaagaagaaaggttggcgccggtgccggtgagtcttggtttgaagatctggcgcttctgcgtttgcctctgtttaaacgattgattcttgcgatgagaagtgcggagctgagtcctgagattattgagacttgcttgatgtattatgctaagaagtacattcctggagtttcgagatcgaataggaaaccgttaccgtcgtcgtcttcttcctcctccgttgcgacggaggcggagcagaaggagcttctggagacggtggtttcgaatcttccgctggagaagacctcgaaggccgcgacggcgacgaggtttctcttcggattgttgcgagcggcgaacatactgaacgcttccgtagcctgcagagacgcgctggagaagaagatagggctgcaactcgaagaagccacgctcgacgaccttctcgtgccgagttactcgtacctgaacgaaacgctttacgacgtcgattgcgtggagaggattttgagtcactttttggaaggtatggaagcaagaaacgccacgaagacggaggatgcggcggcgacgaggtcgccggcgctgatgctcgtcggaaagctcatcgacggatacctctccgagatagcttcagacgcgaatctgaagccggagaagttctacaatttcgccatctcacttcccgacgaggccagactcttcgacgacggtctctaccgcgccgtcgatgtgtatctcaaggcacatccgtgggttttggaagaggagagagagaagatttgcggattgttggactgtcagaagctgacgctggaggcgtgcacgcacgcggcgcaaaacgagaggcttccgctgcgcgcggtggttcaggtgctgttcttcgagcagcttcagctgcgacaagccatcgccggaactttgatggcggcggaggccgccgcggaaccgggaaggcaatcagcggcgctggagcgggaagcggaggacggaagaggagaaggattagggttagagcacgtgcaggaacggaacggcacgtggcgcgtggcggtgagggagaatcaggtgctgcgcttggacatggatagcatgaggacgcgcgtgcatcaactggaacgcgagtgttcctctatgaagagagtcatttccaagtttgacaagtttgccgcctccggcggcggttggagggcgtcgctgggccggaaattcggttgcaagtttaagactcaggtttgtgattcgcacgagtcaacggccgttgatacccgcaaaggacgccatcaccagcagcatcatccccatcatgattag

SEQ ID NO: 2933 - DNA, 3272 bp, Glycine max var. Williams 82
ggcaagcaatgagagagatactataaggaccaataggtgattattgtcttttcaagggttttaagtagaaaagctcatggaagacacttccttttaagtcatgagagagagagagagagagagaaacattatgtgagaatgaaattctgatctgattcatagaaaagaaaaagaaagagggtttggtaaaggagggaaaaacgacccaatatgatcccctttttaggaatttgatcaaggtccatttgtccgctttgagtttgtggattccattctgtttcacctattttattatttattttcttttgttagagtttcatctgttgttgttttctttcaacaaaaaaaagatcctcaacaaaaagcacaaacaaacaatttctttcattctcatcttccctttctttttttccaattggtagtgcaagtcaagtccatttcaccacccttcaacactaccacaacaactctgggtattatcccccccacattctgcatccgtccaatctttcagtcgcaaaattttcagtgtttcccactctcccttaaatcattcccacccttctcacactcatggatctgtctgtccagtaacccacacagaaaaaaccctgaagaaaaacaaaaccatatcatacatttcatttacagagaaaaaaatgtcatcagcagaaaaacccagctccaaaggacaagcatggttctgcacaacaggattgcccagtgacattgtggtggaagttgatgacatgacattccatctccacaagtttcctctgatgtcaaaaagccgaaagctccaccttctaattacgcagcaagaggcagcgtctaactccactgtcccacagcagcagcagcagcagcaagaaacagaagatgaagacgaaatcgtcgaagagcagtgtcacgtgaccttcacgggcttccccggtggctccgaggcgttcgagatggccgcaaaattctgttacggcgtcaagatcgacctgacgccgtccaatgtggcggcgctccggtgcgctggggagtttctcgaaatgaccgaggattactccgaggacaacctcgtttccaagacggagggctttctatcgcagcacgtgctcaagaacctcaaggactctgtcaagacgctgaaatcgtgtgactccttgatgcctatggcggaaaatctcggaatcacgcagaggtgcgttgattctgttgtttccagagcttcctcagcggatcctgcattgttcggctggccggtcagcgacgctacttctgtgtccaaacaggttctctggaatggactcgacggtgacggaagaagaaaggttggcgccggtgccggtgagtcttggtttgaagatctggcgcttctgcgtttgcctctgtttaaacgattgattcttgcgatgagaagtgcggagctgagtcctgagattattgagacttgcttgatgtattatgctaagaagtacattcctggagtttcgagatcgaataggaaaccgttaccgtcgtcgtcttcttcctcctccgttgcgacggaggcggagcagaaggagcttctggagacggtggtttcgaatcttccgctggagaagacctcgaaggccgcgacggcgacgaggtttctcttcggattgttgcgagcggcgaacatactgaacgcttccgtagcctgcagagacgcgctggagaagaagatagggctgcaactcgaagaagccacgctcgacgaccttctcgtgccgagttactcgtacctgaacgaaacgctttacgacgtcgattgcgtggagaggattttgagtcactttttggaaggtatggaagcaagaaacgccacgaagacggaggatgcggcggcgacgaggtcgccggcgctgatgctcgtcggaaagctcatcgacggatacctctccgagatagcttcagacgcgaatctgaagccggagaagttctacaatttcgccatctcacttcccgacgaggccagactcttcgacgacggtctctaccgcgccgtcgatgtgtatctcaaggcacatccgtgggttttggaagaggagagagagaagatttgcggattgttggactgtcagaagctgacgctggaggcgtgcacgcacgcggcgcaaaacgagaggcttccgctgcgcgcggtggttcaggtgctgttcttcgagcagcttcagctgcgacaagccatcgccggaactttgatggcggcggaggccgccgcggaaccgggaaggcaatcagcggcgctggagcgggaagcggaggacggaagaggagaaggattagggttagagcacgtgcaggaacggaacggcacgtggcgcgtggcggtgagggagaatcaggtgctgcgcttggacatggatagcatgaggacgcgcgtgcatcaactggaacgcgagtgttcctctatgaagagagtcatttccaagtttgacaagtttgccgcctccggcggcggttggagggcgtcgctgggccggaaattcggttgcaagtttaagactcaggtttgtgattcgcacgagtcaacggccgttgatacccgcaaaggacgccatcaccagcagcatcatccccatcatgattagttaccatgctcaacttcctccccctcacgtgagaatcattgttggagtaaatttcatatgggccccactttgcaccaattattgggaataaatttatttgaggtggccgagttttgaggtgatggcgatgtgcggagaagcataagacatgaaattctgaggtatgacagtatgaatggtagtgggtggcatggtggagacagcaaataggtattggaaaaatcttcgaagtttgtgtgattattattgttggttacagtactcaatcacactcataattgcttctaataaaagatggggttatgctaaagtgcttttccgaagctgaaagtactcgtgatcattatccgcagaaacagctgcaaaggcttcttcactttctgggtatgccgctggactcattattgccttaatgcgtttgcttccatttctcgttcagcaacagtaaagtagcctttctttgattgggtttggatagaaggggtagaaatagtcaaacttattatttcatgtgttccttaattctataaccatcatcattatgtggggatgttcatagtcggaaactttgagctttcacttcttggtgtcttcttttattattgttgttgacttgagaacatggaattggaaactaaaaacaatgggcaagttgacatccatcaa

SEQ ID NO: 2934 - DNA, 741 bp, Glycine max var. Williams 82
atggctgccaacacattgatgagttctgccatctcagccttcccatctctcctttcctcctcaaaatccagatttgccgcagcagttcctctttccagctttgttgtcaccaatgcctcttcttctcgcttttccatgagtgctgactggatgcctggccagcctagacccccctaccttgatggttcagcacctggtgactttggattcgaccctcttcgtcttggtgaagtaccagagaatcttgagaggttcaaagagtcagaactcattcactgcagatgggccatgcttgctgttccagggattttggttccagaggcattgggcttaggcaactgggtaaaggctcaggaatgggctgcagttcctggtggccaagcaacctacctaggcaacccagttccatggggcaccctacccaccattctggccattgaattccttgctatttccttcgtggagcaccaaaggagcatggagaaggaccctgaaaagaagaaataccctggtggtgcttttgatcctttgggatactctaaggaccctaaaacattccacgaatacaaagtcaaagaaattaaaaatggacgtcttgctttgttggcttttgtgggattctgtgttcaacaatcagcttatcccggcactggacctttggagaacttggctgctcacttggctgacccatggcacaacaacattggaaacgtcattattccacaatcgattttgccttga

SEQ ID NO: 2935 - DNA, 1053 bp, Glycine max var. Williams 82
atggctcccgtggactctgacactttggggcgccattctctgattccgagctacctctattcctctccctcgccgcagaagaagaagatggaggcttcgagtttcgccattcattctccgagagagaatcgaaatatagagatgttttcgccgtcgttctatgctgcttgcaccgttggtggaagcctcagctgtggccccactcacaccggcatcacacctcttgacgttgtcaaatgtaacatacagattgaccctgtcaagtacaagaacaccagcactggatttggagttatgtttgaggagcagggactaaggggctttttccgcgggtggggacctacccttgttggttacagtgctcagggtgccttcaaatatggattctatgagttcttcaagaagtactattctgacatagctggtccagagtatgcaaccaagtacaagacattgatctacctagctggatccgcatctgccgagttgattgcaggtgttgctctttgcccatttgaggcagtgaaggtcagagttcaaactcagcctggtttcgctagaggcctggctgatgggctaccaaagttggtcagaactgaaggagtctcagggttgtacaagggaattgttcctctatggggaagacaagttccatatacaatgatgaaatttgcttcatatgagaacatagttgagatgatttataagcatgccatccccaaaccaaaatatgaatgcagcaattccctgcaactaggtgtgagcattgtcagtggatacatggctggtatattgtgtgccactgtctctcatcccgctgataacctcgtctctttcctgaacaattccaaaggggcaacggttggtgatgctgtaaagaagcttggattatggggtctgtttacccgtggtcttcctcttcgtattcttatggttggaactctcactggagcacaatggggaatatatgattcattcaaagtttttgtggggctgccaaccactggtggtgttgctcctgctgctgttcttgctcccgcttctgctgcttag

SEQ ID NO: 2936 - DNA, 2478 bp, Glycine max var. Williams 82
tccaccctctcgtccaagcacgttacttattgctactgttcccgaagcattcggaattcaacttcaatttcagttttgttccacattttctaacctttgagcaattgaattcaagcattgcgcacagcttcaaaggggcactctctattttttcataaccctaacgtagattaaccgaacccctcatcttttaatctgcatccgtttccaccatgactgattctgacgccaatcacaatgacccatctctcgataccgatgctgaggcacccaatgtttggagtgcaaacaagcactgctttgcaggattgccaaatcgttgtctccaccacctaaaacgattcctgcagctgatgagtgcttttatgttagagattctgatttcaaatcagggactgtatctatgggtagtgatcttagaaagaaacttgatattcgtgtgaagggtgatgtagtggcaccagttttgtcattctctgcctgtaacctccctgacaagcttctccacaacatagaagcagcaggatatgaaatgcctacacctgtccagatgcaagcaatcccggctgctttgacgggaaaaagcatgcttgttttggctgatacaggatctggaaagtctgcttcgtttcttattccgatagtttctcgttgtgtgattcatcgtcgacaatatttttcaggtaagaagaagcctttagctatggtgttaacccccaccagagagctctgcatacaggttgaagagcatgctaaattgcttggaaaggggttacctttcaaaaccgctcttgtggttggtggtgatgccatggcaggacaactccatcgcattcaacaaggggtggaattgattgtaggaaccccgggaaggctggttgatcttttaatgaagcatgagattgacttagatgatgtgatgacttttgttgtggatgaggtggactgtatgctgcaaaggggctttagagatcaggtcatgcagatatatagggctctgtcacaacctcaggtcttgatgtattctgcaacaatgtctaacgatttagagaaaatgattaacactctagcaaaaggtatggtggttatgtctattggagaacctaatacgccgaataaggctgtgaagcagctagctatttgggttgagtcaaagcaaaagaagcagaagctgtttgaaattttggcaagtaagaagcattttaagccacctgttgtagtatatgttggctccagacttggggcagatctcctggctaatgcaattacagttgccacaggaattaaagcagtttccattcatggggagaagtctatgaaggaaaggagagaaacaatgcagtcctttttggtgggtgaggtccccgtggttgtggctactggagttttgggtaggggggttgatctacttggtgtaagacaggtgattgtatttgacatgcctaataacattaaggagtatgtacatcagattggaagggcatctagaatgggggaggaaggtcaaggcatagtttttgtgaatgaggagaataagaatgtctttgcagaattaattgatgttctgaaatctggtggggcagctgtgcctcgggagcttgccaattcacggtatgccacaagagttttctctggtggcaagggttcaaagaagagaaagcatacaggatgaagtttcttattacttgcttaaatccaatcttaatcttgatgcagtcaacttagaaaattgcactagaaaatacatgtatgtgttgtacttttgaagggtaaaacaaattttcatactaaaatatatcacacattcaaatctggaggttttgtgacatcactcactatagatcttggtatgctttcgggattggtaaaatgtctcagctgttttagcctataatcaataacattaaagttaagattggatagaaggatgagatataagttcttgggattatattgtctctgttgttcaaagcttgagaagaaaaacggcaaaaagagtgggagtgggagtggcctcttgtctgtcctttcttgttaaagttggcttcaacaatgaaatgttttttggcagtggtctcgatatatggccagctcccttagcagtaaattatcatagacttcaatctgcactcacattcaaagcagcatgaatgtaactattcttctctttacattattttttgtctaacagataggctttcagttgcagttatatttcctaggaggcagcactttagagaggtgaattttgagagaaagaactcagaatgaaacagcttcgtattcaagagaatgtagtagtgcattggttttgcatgtcatccatattatagtctcgtattagacttggaggagatcatttcgcaagctactattaattaagtacagcttcctagatgctaatacttgtgctcattaaatgtatataaacatgagatatgagatagatgaacatactattactcccttcggtcggtc

SEQ ID NO: 2937 - DNA, 597 bp, Glycine max var. Williams 82
atggcaaatgaagtggacttcaagattgaattgaaagtgtcagctaattgctgcgaaggaagcaagaggaaagtcaagaaggctttaagaaacccagaagtgttaggaaacgttaatccacacattttgattaaaaagcttcaaaaggtcggaaagcacgccgaactgtggagctatgaggaatttgaatctgaagaaaaagaagaactattggcaaatgagaaagaaaaacagaatgtgtgggaacaagagaaacagcctcatccatgtgacattaaaattgataaaactaaggatgtcacaaggaagaaaaaagcctcaaaagaaagaagaacattatatgcctcattaagaagtgaatttcatggttcatgggtcttggatccgtcactgagtagcatcaaaactcatcatcagtattgttacattgctcagccttgtgcagttgcagtaccctattatgcaatttcttcttcatattcagcttgtgttgaagagcacatgccaagatttgagcctccaccattcttgagaccaacagagcgagtaggggactatttcagtgatgaaaacaccacgggatgccatgtcatgtga

SEQ ID NO: 2938 - DNA, 1374 bp, Glycine max var. Williams 82
atggaaacctctaataacaaccatgatgctcctcctccacctctacttaaagacctgaaggtgaccatccacaatgcctccatgatttttccatccaaagagattgagagaaagtcccttttcttgtcaaacattgacaaggtcctcaactttgatgtggaaacggttcacttctttggtgcccacaaagattttcctcctcatgttgtgaatgagaggctcaagaatgccctagaggatgcccttgtggtttatgacttcttgggtggaagattgaagctaaactatgacaccaaaagattggagatggattgtaatccagagggagctggattcgtggtggcttccagcgagtacaatttggatcagataggggacttggattatccaaatccagcttttgcacaattggtacatcagaataaggattttcttaaagatggtgatgttccactctgtgttgcccaggtgacatccttcaagtgtggtggttttgcaattggcatctctactagccacaccacctttgatggcctcagcttcaaaaccttcctagacaacattgcttcaatagctgctaagaagcccttggctgtcacgccctgccatgacaggcacctcctagccgctcgatccccaccacgtgtcaccttcccacatcctgagatgctcaagctaagtgaccagctcccaacatgccccgagtccaacatctttgaggcctccaccgaacaacttgatttcaaggtcttcaaactaacatcaaacgacatcacaaaattgaaggaagaggctaggaattcttcaattagtggtggcctaagtactaaatgtgtcactggctttaacgttatcactgcctacatatggagatgcaaggcactttcgtgctacaatgatgagaaccctaataggtcatcaactatactatatgctgtagatatacgttcaagattgaaccctccattgcctaaatcatacgcgggtaacgcagtgttaactgcttatgccacggcaaagtgtaaggagctagaagaatggccttttatgaagctagttgaaatggtgcgtgagggagcaactaggatgacaaatgagtatgcaagatctatcatagattggggagagataaacaatgggtttcccaatggggaggttttggtgtcttcatggtggagattagggtttgaggaagtggagtatccgtgggggaagccaaagtattgttgcccagtggtgtatcataagaaggatattattttgttgtttcctccggttggtggaggtgaaggggtgagtattattgtggctcttcctcctaaggaaatggaaaaattccatgggctcttcaacaagttcttgacttcacattga

SEQ ID NO: 2939 - DNA, 531 bp, Glycine max var. Williams 82
atgcctcgtggaagtagggaccctctagttgttgggcgtgtgattggggatgtattggacccttttgaatgttctattcctatgagggtcacctacaataacaaagatgtcagcaatggatgtgaattcaaaccctcacaagttgtcaaccaaccaagaataaatatcggtggtgatgatttcaggaacttctacactttgatcgcggttgatcctgatgcacctagcccaagtgatcccaatttcagagaatacctccattggttagtaactgacattccagcaacaacggggcctactttcggtcatgaggttgtaacatatgaaaatccacgacccatgatggggatccatcgtatagtctttgtgttatttcgtcaacagggtagagagacagtgtatgcaccaggatggcgccaaaatttcattactagagaatttgctgaactttacaatcttggattgccagttgctgctgtctattttaacatccagagagaatctggttgtggtggaagaaggctatgttaa

SEQ ID NO: 2940 - DNA, 531 bp, Glycine max var. Williams 82; identical to SEQ ID NO: 2939

SEQ ID NO: 2941 - DNA, 969 bp, Glycine max var. Williams 82
atgaacgatcttatgaccaaatccttcaccagctacgtggacctgaagaaggctgcaatgaaagaagatgttgatttggaagctggtgttgttgtttcttctgctactcctcgcaacgtggaacttacctcttccacaacacacttggacaccgacatgggtctcttcctcgaagaggctgagaaggtgaaggctgagatggggtccctccgtgacatcctcggccgcctccagcaggccaacgaggagagcaagtccttgcacaagcccgaggccctcaaggtgctccgggcccggatcaatgcggacattgtcgctgtgctcaagaaggcccgggcgatccgggcccagctagaggagatggaccgcgccaatgctgccaacaggcgcctctccggcctcaaggaggggacgcccgcgatctaccggacccggattgcagtcaccaatgggctcaggaagaagctgaaagagctcatgatggagtttcaggggctgaggcagaggatgatgagtgagtacaaggatactgtggggagaaggtacttcacagtgactggggagcacccagatgaggaagtgattgagaagatcatcgccaacgggaacgaggaagaggttctggggaaggccatacaggaacacgggagagggaaggttctggaaacagtggttgagattcaggacaggcatgatgctgccaaggaggtggagaagagtctactggagctgcaccaggtgtttcttgacatggctgtgatggtggaggcacagggtgagaagatggatgacattgagcatcacgtgctgcatgcttctcactatgtcaaggatgggaccaagaatctccagagtgcaaaggagtaccagaagaagagcaggaagtggatgtgcattgggatcattctgttgctcattcttattctgtttattgttattcctgttgtcaccagtttaagcagttcttga

SEQ ID NO: 2942 - DNA, 2170 bp, Glycine max var. Williams 82
gagctttgaccacgacaagaactaaagcctctccctccctccacctcacatcacaacacaagaaagttcctatttcccaccactttctctctctcatctcttcaaagcctccaaaagctgcaacctttctttgttttttccctcgctctccgttgaaccttccaagtttcctaacccctttcgattgttttccattctggggtttttgaaatcacaccacagtggagctagaatcagtttttttattattttattttctgtttatagttatagtggcttttttctaaggaagttctaatggctgtgttcatgattttttacatgcttgttattatagctttgcctgctcatggagatgctttcattggtgtcaacattggtacagatgtcaccaacatgccaagtccaacagaggttgttgcccttcttaaggctcaaggtatccaacatgttagactctatgatgctgacagagccatgcttcgtgcactcgctaacacaggaatccgtgtaattgtttctgttcccaatgatcagatactaggcattggccagtccaatgccacagccgcaaattgggttgcacgcaatgtcatagcacatgttcctgctaccaacatcactgcaatagctgttggatccgaagtcctaacttccctccctaatgcagctcctgtcctagtctcagcactaaaattcattcaagctgcgctagttgcggccaatcttgaccagcaaatcaaagtctctactccacactcttcttctgtcatccttgactctttcccgccatctcaagcatttttcaataaaacttgggaccctgtcatggttcccttgcttaactttttgcaatcaacaggttcatatcttatgctcaatgtgtacccttattatgattacatgcaatccaatggtgtagtccctctagactacgctttgttccggcccttgcctccgaataaggaagctattgattccaacaccctcctgcattatactaatgtctttgatgcaattgttgatgctgcttattttgctatgtcatatttgaagtttaccaacatccctattttagtcacagagtcaggatggccctccaaaggcgactcatctgagccggatgcaaccgttgacaatgctaacacttacaatagtaacttgatcaggcatgtccttaacaatagtgggactcccaagcaacctggaattgcagttagcacttatatttatgagctttataatgaagacttgaaatcaggtccagtgtctgagaataattgggggctgttttatgctagtggagctcaagtgtataccttacacttgactaattctggtactgtatttgcaaatgatacaacaaaccaaactttttgtgttgccaagagtaatgccgattcaaagatgcttcaggcagcactcgattgggcttgtggaccggggaaggtggattgttcgcctttgctgcagggtcaatcgtgttacgaaccaaatagtgtagcttcacatgctacatatgctatcaattcatattatcagcagatggctaaatctgcggggacctgtgatttcaaaggagttgcctctatcaccactacaaacccaagtcacggttcctgtatattttcaggaagtggtggtaaaaatgttaccagcgtaaatggcacagcattggctccatcaacaaattccacaaattcagggtgcttgtcccaatattacaatggtggattttttacaagcactgtgattcttactttaattttgagtgtagttgtcttgtaaaactacgcactaacatgttcagcattagaatcctatttaatggtgacacactcttcaactaccatttaagagattgctgcatacccatttttgtgttcctcatttagaggatttgaaggatggcgaggttggtcaaaatgtatattggcaattgtaacgtgagttgtccattggatttttgtacaaacgaaccagaagaatttatttaaaatcgttgatgtaattaccttgttaggtctaatcttttcttataacaatttaatcagaaaatccattgatgtgcttggcatgtcattaaatctgtgtaacaaaaaaaaagtttattaaatctgtaattttgatcgtgatgccttgacgttttaatcagaaagccttgatttta

SEQ ID NO: 2943 - DNA, 1254 bp, Glycine max var. Williams 82
atgatgatgggaaaaggttggtttttgagattggttatggtgattggtgtgatgggttggtgttggtggtgtgtggaagggcttggagtgaattgggggactcaagccacacaccagttgaaggcagacacagtggttgagatgctgaaggacaatgggatccaaaaggtgaaactgtttgatgcagatgagtctagcatgagtgctctatctggctctggcattgaagtcatggttgccattcccaataaccagcttgctgagatgaatgactatgatcgtgccttgcagtgggtcaagaagaatgtcactcgttacaacttcaggggtggaattaacatcaagtatgtagcagttgggaacgagccatttttaaaatcctacaatggttcattcttgaacatcaccctccctgcattacagaacattcaaaatgccctcaatgacgcaggcctaggggactccataaaggccacagtgcccttaaatgctgatgtgtatgagtctccaccaaacaaccctgtgccgtcagcaggaatatttaggccagatataagtgacctaatgacccaaatagtgcaatttttggcaaagaacaatgcaccattcacagtaaacatttaccctttcttgagcctctatgggaatgataatttcccctttgactatgccttctttgatggtgtggccaatcccataaatgataatggggtttcatacacaaatgtttttgatgcaaattttgataccttggtctctgccctcgaaaaagtaggatatgggaacatgccaattttggtaggagaggtggggtggcccacagatggtgacaaaaatgctaatgtaggcaatgcatttaggttctataatgggcttttaccgaggcttgcaataaacaaagggaccccacttaggcctggatttattgaagtttacctatttgggctcattgatgaggatgccaagaccattgccccagggaactttgagagacattggggcatttttgggtatgatgggaagcccaagtttccaatggacctttctggaaaaggccaaaacaagctactagttggtgcacaaaatgtgcactatcttgagccaaactggtgcatgtttaaccctgatgcacaggacctaagcaaacttgctgataatataaactatgcatgcacctttgctgattgcactgcaattggatatggttctctgcaacaacttggatgccaatggaaatgcctcatatgcatttaa

SEQ ID NO: 2944 - DNA, 840 bp, Glycine max var. Williams 82
atggacatggatgtttgccgaaatatatcagtttcttcaagtgagtgtcagcaagagcttcccacccttgatgaccttttctgtcatcagaacacggaagtggattttggcatggaatggttatcagtgtttgtggaagactgtttctctagtaggccaagttgcctcttgccaccctctggtggtggtgttcaaaccacaagcactagcaccaagccttcttcaggcacaataatgccaagaccccaacaaagtcatcactgtcctttgcagaattttgctgtgccagggaaagcaaggagcaagagaaagagactttcagcccctagaacaacaaaacacaccctaagcacatggtcacaacatttcagctcacagaatgatggggtgagttctgaccctcctctcttgaaacaagcatattggttggctgatagtgaactcatagtccccaagaagaaggatgttgagcaagaagagggggttgttgtggtggtgaagaaggagaaattgggggattattatgatgatgatgagggtgatgaagttaacaacaataataccaacaataataataatgataatgtgcagcacccaattccaagaaggtgcacacattgtctagctcagaggaccccacagtggagggcaggaccattgggtccaaagacactatgcaatgcatgtggggtgaggtacaagtctggaaggttgttgccagagtataggccagccaagagccctacttttgtaagctatttgcattccaattcacacaagaaagtcatggagatgagaatgggtgttggtgttgctgttctttctacagacaagaagtag

SEQ ID NO: 2945 - DNA, 1236 bp, Glycine max var. Williams 82
atgaatgcactagcagccaccaacaggaactttaggctggcctctaggctccttggattggattccaagcttgagaaaagtttgctgattccatttagagaaatcaaggttgaatgtaccatccccaaagatgatggcagcttggccacttttgttggattcaggattcaacatgataatgctagaggccccatgaaaggagggatcagataccatcctgaggttgaaccagatgaagtgaatgctttggcacaactaatgacatggaagacagctgtagcaaatataccatatggtggtgccaaaggaggaatagggtgtgaccctgcagatttaactgtgtcagagttagaaagactcactagagtttttacccagaaaattcatgatctgattggagttcagacagatgtgcctgcacctgatatgggaacaggaccacagactatggcatggattctagatgagtattccaaatttcatggccactctcctgcagtagtgactgggaaacctgtagaactcggtggatctctaggcagagatgcagctactggacgaggagtcctctttgcaacggaggctttgcttaaggagcatgggatgagtgtatccggacagcggtttatcatacagggatttggaaatgtggggtcttgggctgcccaattgatcagtgagaaaggtggaaaagttgttgcagtgagtgacataactggggccataaagaataccaatggccttgacataccaagcttgctcaaacattctagagaacacaggggagtcaaaggattccatggtggtgatgcaattgaccccaactcaatattggttgaagactgtgatgttcttgtcccagcagctcttggtggagtcatcaatagggaaaacgcaaatgagattaaggccaaatttattgttgaagcagccaatcacccaactgacccggaggctgatgagattctgaaaaagaaaggggttgtgatcctcccagatatatttgcaaattcaggaggagtcacagttagctactttgagtgggtgcagaacattcaagggttcatgtgggatgaggagaaggtgaacaacgagctaaagacatacatgactaaagggttcaaagatgtgaaggagatgtgcaaaacccataattgtgatcttcgtatgggagcattcacccttgcagttaaccgtgtggcaagggccactgtacttaggggttgggaagcttga

SEQ ID NO: 2946 - DNA, 354 bp, Glycine max var. Williams 82
atggaatccataatttccaggccaaaaggtaacttgttccatgatgaaatcttgggggaaatccttcacagacttccagcaaaaacccttttgaaatgcacaactgtatgcaagtcatggaagtccctcatcacacacccttccttcatctccaccatatccactccccctcccttctcctccttcgctattttctccgccacgacgacccgtttctcacctacccatctatcctccgccttccctccatccccagtcaccaattctccgaggttgctatttgcgatggcctctttgcattgctaccctggagtgtgcaaatatctaataatcatctgcaacccttctgtttaa

SEQ ID NO: 2947 - DNA, 1038 bp, Glycine max var. Williams 82
atggctaggtctagtgcttatcctttgttcttgatttcttccattctgtttatttcacacatttatgcctcccaagtagaagccaagcccccagtagtgaagggactatcatattctttctattccaaaacatgccccaagcttgagtccattgtgaggaaacatctcaagaaggtgttcaaggatgacaatggccaagctcctgccttactccgcattttcttccatgattgttttgttcagggatgtgatggatcattgctgctagatgggagtccaagtgaaagagaccaaccagccaacggaggcatcagaactgaggccttgcaaaccattgatgacatcagagctattatccataaggagtgtggaaggatcgtttcttgcgcagatatcactgttttggcagcacgtgattcagttttccttacaggaggtcccgattatgcagtgccactaggaagacgagatggcctgagcttcagcacatcaggaacaagtgatctccccaaacccttcaacaccaccggcgtgacccttgacgctttcgccgccaaaaactttgatgtcaccgacgttgtcgccttatccggcgcacacacctttggtcgtgcccattgcggcacattcttcaacaggctctcccctctcgaccccaacatggacaaaaccctagccaagcaactacaatccacttgccccgacgcaaactccggcaacaccgtcaacttggacatcagaaccccgactgtgttcgacaacaaatactaccttgacctaatgaaccgccaaggggtgttcacctctgaccaggacttgctcaatgataagaggactaaggggttggtcaatgcatttgcgttgaaccaaacgttgttctttgagaagtttgtggatgctactataaagttgagtcaattggatgtgctcactggaaatcaaggtgaaattcgtggcaagtgcaatgtggtgaatgctaggaagtctttgttgacgtctgtggtggaagaggtggtgcaattggttgatcagttttga

SEQ ID NO: 2948 - DNA, 1362 bp, Glycine max var. Williams 82
atgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaatggacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacattggtgacttcatggtgccttctcaaggagactcatcatcagtgacagaagaagcccccacctccacaactacaactgtaaccgccgtcactgaaaacccaccaggaggtggggaaaggaggagaaagtacagaggagtgaggcagaggccatggggaaaatgggcagcagaaatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttga

SEQ ID NO: 2949 - DNA, 2257 bp, Glycine max var. Williams 82
ttcacgcgcatggtagaagctagagcatacagcacagagcatgggacataccatatatacatatattatagtttagtttgcactattttaatggtggctggctaccttaattccacatgctaaaattttgcacccctttattatataaccgtttcattctctatagcatctcaaagggtgtccaaagaaggaatcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaatggacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacattggtgacttcatggtgccttctcaaggagactcatcatcagtgacagaagaagcccccacctccacaactacaactgtaaccgccgtcactgaaaacccaccaggaggtggggaaaggaggagaaagtacagaggagtgaggcagaggccatggggaaaatgggcagcagaaatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgtaaattaaaatgtgaaactttaattctttcttttatatatatatatatatagtaccaaaaagatcttactaactttatttaagtttggtactttttaaatgatggtaaattccttgaacatgtagttttgttcctattcatgtaaagaagattatttgaaaacagaaaaggtgggagtgattgaagattgatgatggatgagaaagagtggcaggtaaagacaaagcagcatttaggatttagggttagtttatttccaattctcaatggatttgatgttaacattctctcagttatccatggaaagacgtagaaatccatagtttttacataccctctgtctgctatctgctatacagccattgattttatcaaaatgttcctatactttagttcttttttaata

SEQ ID NO: 2950 - DNA, 795 bp, Glycine max var. Williams 82
atggctgcttcaacaatggctctctcttcatcatcattggctggccaagctatcaagcttgccccctccacccctcagcttggtgttggaagggttagcatgagaaaaacagcctccaagactgttacctcaggaagcccatggtacggcccagatcgtgtcaagtacttgggcccattctctggtgagcccccatcctacctcactggtgaattcccaggtgactatggttgggacactgctgggctttctgctgacccagagacctttgccaaaaaccgtgaactggaagtcatccactccagatgggccatgttgggagccttgggctgtgttttccctgaactcttgtcccgcaacggagtcaagtttggtgaggccgtgtggttcaaggccgggtctcagatattcagtgagggcgggcttgactacttgggcaacccaagcctgatccatgcacaaagcattcttgccatctgggccacccaagttatcttgatgggtgcagttgagggttaccgtattgctggtgggcctcttggtgaggtgactgatccaatctatccaggtggcagctttgacccattgggtcttgctgatgacccagaggcttttgctgagctgaaggtgaaggagctcaagaatggtaggttggccatgttctccatgtttggattctttgttcaggcaattgtgacaggaaagggacccttagaaaaccttgctgatcaccttgctgacccagtgaacaacaatgcttgggcctatgccacaaactttgtccccggaaagtga

SEQ ID NO: 2951 - DNA, 1499 bp, Glycine max var. Williams 82
acaagcaacattgctaaccattctctgcacttttcagttacaaagcatttcattgttttacaatatacaacactacaatggctgcttcaacaatggctctctcttcatcatcattggctggccaagctatcaagcttgccccctccacccctcagcttggtgttggaagggttagcatgagaaaaacagcctccaagactgttacctcaggaagcccatggtacggcccagatcgtgtcaagtacttgggcccattctctggtgagcccccatcctacctcactggtgaattcccaggtgactatggttgggacactgctgggctttctgctgacccagagacctttgccaaaaaccgtgaactggaagtcatccactccagatgggccatgttgggagccttgggctgtgttttccctgaactcttgtcccgcaacggagtcaagtttggtgaggccgtgtggttcaaggccgggtctcagatattcagtgagggcgggcttgactacttgggcaacccaagcctgatccatgcacaaagcattcttgccatctgggccacccaagttatcttgatgggtgcagttgagggttaccgtattgctggtgggcctcttggtgaggtgactgatccaatctatccaggtggcagctttgacccattgggtcttgctgatgacccagaggcttttgctgagctgaaggtgaaggagctcaagaatggtaggttggccatgttctccatgtttggattctttgttcaggcaattgtgacaggaaagggacccttagaaaaccttgctgatcaccttgctgacccagtgaacaacaatgcttgggcctatgccacaaactttgtccccggaaagtgagggaaaaaaaaaaaacctgaaacgatgagaaactatgacttgagtgtgaatttcatgttgttatttaatgaaatatatattggatgtgtgccttatatatctttttggaacgttttgattggtcattcttcaagtttgtatcgtttattcactttattcgccaatttaattaataatcactgaatgtatttagcaaattaataacataagatacaaatagttagtcattttgtgctgccagctttagaacttgcaaaggacattgtctaaattgcaagcgagcaaaaacctgtgcagaagacccgaaatagttagaatatggaagtgatagtgtgatcaagcaacccactgagatgttccgtgacatatagatttcccaaactcaacggcacgcaaatactaaatgtgtgcaccaacaataatatgaaatacatgtttatagagtggggttagagtttaggagatgagattgaggatttacttgtagcagtagttgtatttcagatagtggaaattgattacgaagttagaaattggtccagatagcagttagttcacttatgctattatagtttgacagaaaagtgaaaccaataaagaaagatttctatttatttttttacaaaa

SEQ ID NO: 2952 - DNA, 795 bp, Glycine max var. Williams 82
atggctgcttcaacaatggctctctcttcatcatcattggctggccaagctatcaagcttgccccctccacccctcagcttggtgttggaagggttagcatgaggaaaacagcctccaagactgtttcttctggaagcccatggtacggcccagaccgtgtcaagtacttgggcccattctctggtgagcccccatcctacctcactggtgaattcccaggtgactatggttgggacactgctgggctttctgctgacccagagacctttgccaagaaccgtgaacttgaagtcatccactccagatgggccatgttgggagccctgggctgtgttttccccgaactcttggcccgcaacggtgtcaagttcggtgaagccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctatccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacctttggaaaatcttgctgaccacctagctgacccagtaaacaataatgcctgggcctatgctacaaactttgtccccggaaagtga

SEQ ID NO: 2953 - DNA, 1003 bp, Glycine max var. Williams 82
aacaattaccattctcttcacttttaagttaaatagtttttcattgtttcatttaatctacaatggctgcttcaacaatggctctctcttcatcatcattggctggccaagctatcaagcttgccccctccacccctcagcttggtgttggaagggttagcatgaggaaaacagcctccaagactgtttcttctggaagcccatggtacggcccagaccgtgtcaagtacttgggcccattctctggtgagcccccatcctacctcactggtgaattcccaggtgactatggttgggacactgctgggctttctgctgacccagagacctttgccaagaaccgtgaacttgaagtcatccactccagatgggccatgttgggagccctgggctgtgttttccccgaactcttggcccgcaacggtgtcaagttcggtgaagccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctatccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacctttggaaaatcttgctgaccacctagctgacccagtaaacaataatgcctgggcctatgctacaaactttgtccccggaaagtgagcatagcaatagtgaaacaaagagaaacacagtgacttgaaaattagagtgagagtttcattgttatttggagaaatacatattgaatgttttcttttaagaagaatatgaattatatatcttattgtgcattgagatctttattt

SEQ ID NO: 2954 - DNA, 795 bp, Glycine max var. Williams 82
atggctgcttcaacaatggctctctcttcatcatcattggctggccaagctatcaagcttgccccctccacccctgagcttggtgttggaagggttagcatgaggaaaacagcctccaaaactgtttcctcaggaagcccatggtacggcccagaccgtgtcaagtacttgggcccattctcaggtgagcccccatcctatctcactggtgaattcccaggtgactatggttgggacactgctgggctttctgctgacccagagacttttgccaaaaaccgtgaactggaagtcatccactccagatgggccatgttgggagccttgggctgtgttttccctgaactcttgtcccgcaacggagtcaagtttggcgaggccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctatccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacccttggaaaaccttgctgatcaccttgctgacccagtcaacaacaatgcttgggcttatgccacaaactttgttcccggaaagtga

SEQ ID NO: 2955 - DNA, 1884 bp, Glycine max var. Williams 82
aatcaccatcttattccatctcctccacgtcgtgctgccactggttcccagtatcattttacactcttctatcataaagaaatcacattttgcatggataattggcagtatggaatcatgattttgttaatgatattttttatcacaacataattgcattttgcatggatatttttttaagtgatcatttatctatttgtaattactaaaaacatatttaacttatttattccgtacgtctgaccacatgccaaatcaatttgtttcccacagacacccaccaccacaattcatgtggatatgatgtgaaagcgtgacattattattttcaattatgattacctatttaaatcaactagccaagtgatcaataatattgcactatggtccctcctcttgggtaagacctggtaatcttacggaagtgtctcacttcatacatctatttattacacatagcctatcctaaatcatacgtggcaagttcttactggacagaataggtacttaatgatattttttgagatattcgatctatgttggtaagggaaggaaaacaaacaactcataagcgaaataaaatggacaaaatggatgccccaagccaatagaaattcagatatagatctcgtaaagataagtacccctctcttctttaagctatatattgtgctaaaaaaaaatatataggcatcaccagtagccattctcttcagttttaagttacatagtttttcattgttttacttaatctacaatggctgcttcaacaatggctctctcttcatcatcattggctggccaagctatcaagcttgccccctccacccctgagcttggtgttggaagggttagcatgaggaaaacagcctccaaaactgtttcctcaggaagcccatggtacggcccagaccgtgtcaagtacttgggcccattctcaggtgagcccccatcctatctcactggtgaattcccaggtgactatggttgggacactgctgggctttctgctgacccagagacttttgccaaaaaccgtgaactggaagtcatccactccagatgggccatgttgggagccttgggctgtgttttccctgaactcttgtcccgcaacggagtcaagtttggcgaggccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctatccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacccttggaaaaccttgctgatcaccttgctgacccagtcaacaacaatgcttgggcttatgccacaaactttgttcccggaaagtgaaatgacttgtgaattttatgttatttagttaaatatgtattggatctatcaagtgagaatgtgaattatattattatattttatatatctctttttagttcatttggatgtatctccaaggttctaagtttatatatatatgcactttattaaccaaactaattaaagctcaaatgacaagtcttaaacattagaagcgagttaggttctaaaatttaaagcagtgggatgaagaaggagaagtagaaatcaccaagacataaatacaagtgctttaaattttgcatttgattctcctcatgtggaccacaaataattttcatcataagctt

SEQ ID NO: 2956 - DNA, 3237 bp, Glycine max var. Williams 82
atggacaccaaagggagactagttgcagggtctcataacaggaatgagtttgttcttatcaatgctgatgaaactgcaagagtagctgtcacagaattaagtggtcaaatttgtcagatctgtggggatgagctggaagttactgtgaatggggagccatttgttgcttgcaatgaatgtgcattccctgtgtgcagaccttgttatgagtatgaaagaagagagggcaaccaagtttgtcctcagtgtaaaaccagatataagcgcatcaaaggtagtcctagagttgagggtgatgaagaagaggatgatactgatgatttagaaagtgagtttgatattgggagtgtgttctctgctcgccttaactatggttcacaggtgaatggttcagtgatccacgcaccatcagagtttgatgcagcttcggtggcttctgagatccctctcctaacatatggtcaagaggatgtcggcatttctgctgataaacatgctcttattcttcctccattcacggctcgagggaaacgggtttatcccatgccttttcctgattcatctgtacctgttcaaccaagacctatggatcctaaaaaggatattgctgtttatggatatggaagtgttgcatggaaggaacggatggaggattggaagaaaaaacaaagtgaaaaacttcaggttgttagacatgaaggggataaagatagtgatgagctggatgatcctgacttgccaaaaatggatgaaggcagacagccactttggagaaagttgcctattagttcaagcaggataaatccatacagaatcataatagtacttcggattgccattctttgcctcttttttcattatagaatcctccatccagtcaatgatgcatatgcattgtggctcacatcagtaatatgtgaaatctggtttgctgtgtcatggatttttgatcagtttccaaaatggagcccaattctgcgagaaacataccttgatcgtttatctcttcggtatgagaaagaaggaaagccatctcagttatctgatatagacgtgttcgttagtacagtggaccctatgaaggaacctccactcattactgcaaacacagttctgtctatccttgctgtggattatccggtggacaaggttgcatgctatgtttcagatgatggtgctgccatgcttacatttgaagcactctccgagacttctgagtttgcaaggaaatgggttccattctgtaagaagttctgcattgaaccacgagctcctgaatggtattttgctcagaaggttgactacttgaaggataaggtggatgccacatttataagagaacgtcgtgccattaagagggagtatgaagagttcaaagtgaggattaatgcattggtggctttggcacaaaaggttcctgaggatggttggacaatgcaggatggtactccatggcccgggaacaatgtcagagatcatcccggaatgatacaagttttccttggtcagaatggtgttcgtgacattgaaggaaatgaattacctcgtcttgtctatgtgtctcgtgagaaaagacctggatatgatcaccacaaaaaagctggggctatgaatgctttggtgagagtctcagcaataatcaccaatgctccctatgtactgaatgttgattgtgatcactacataaataacagtaaggcccttcgtgaagccatgtgcttcatgatggatcctacatcagggaaaaaaatatgctatgtacagtttcctcaaagatttgatgggattgatcgtcatgatagatactcgaatcgcaatgttgtattctttgatatcaatatgaaaggtttagatggcatccaaggaccaatatatgtgggaactgggtgtgtcttcaggaggcaggcattttatggatgtgatgcccctacttcgaagaaagcaccaaggaagacatgtaactgttggcctaaatggtgctgctgtctgtgttgtggatctaggaagaaaaagattaaagcaaagtccagtgtgaaaaagaagataaagaataaggatgatttaaagcaaatgcatgcactagaaaatattgaagagggaattgaaggaattgacaatgagaaatcatcattaatgtctcaatcgaagtttgagaagaagtttgggcaatcatctgttttcatagcttcaacactcttggaagatgggggtgttccaaaagcagcaagttccgcaacactcttgaaagaggccatccatgtaattagttgtggttatgaagataagacagaatgggggaaagaggttgggtggatatatggctcagttacagaagatattttaacaggtttcaagatgcattgtcatggttggagatctgtgtactgcatgccaaaaaggcctgcttttaagggttcagctcctataaatctctcagatcgtctgcatcaagttcttcggtgggcacttggatctgttgagatctttttcagtaggcattgtcccatatggtatggttatggtggtggcttgaaatcgctggaacgattctcttacataaactcagtagtttatcctctgacttcaattcccttaatcgcctactgcgcattgccagcggtctgtctgctcactgggaagttcattgtccccgagataagtaactatgccagtatcattttcatggccctcttcatctctatagctgcaactggcatcctggaaatgcagtggggaggtgtcggtatacacgactggtggaggaatgagcagttctgggtcattggtggtgcctcctcacatctctttgctctctttcagggtttgctcaaagttctggcaggagtcaacacaaacttcacagtcacatccaaagcagcagatgatggagagtttgctgaactctacatcttcaagtggacatccttgttgatccctcccttgaccctactaatcttaaacatcattggagtcattgttggtgtctcagatgccataaacaatggctatgattcatggggtcctttgtttgggaggctattttttgccctttgggtcattgtccacctttaccctttcctcaagggtgtcatgggaaaacaagaaggtgttcctaccatcattttggtttgggctattcttctggcttccatattgacactactttgggtgagaatcaacccattcttggccaaaaatgatgtggtgctggaaatttgtggattgaattgtgactaa

SEQ ID NO: 2957 - DNA, 237 bp, Glycine max var. Williams 82
atgaaggaaagaaatgggtgcatattatgctttttctccttgactcctctagctgtaactccactaccttgtagaccacatcatacttctgactactctccatcttttctgacaccaaactgtagttgggggaagccccttcatcttcttcttcaaggctccataaccatgccaggcaccaaaatcatgtgcactcagatcaagtgcaacaacaagcaccaccaccaagcaccatga

SEQ ID NO: 2958 - DNA, 1341 bp, Glycine max var. Williams 82
atggagctgatcattttgctgctctcgttgatcctttcctcgttagtgttaatggttctcttcttgttgtgtgttactcgttctcctaaagcaatggaaggcatccctggcagccttggttggcctattgtgggagagagtttctcattcctctctgatttttcaagtccctccggaatctttagcttcatgaacaagaggcaaaagagatatggaaaggttttcaagagctttgtgctggggagattcactgtcttcatgactgggagagaagcaagtaagattttgttaactggaaaagatgggattgtgagtttgaatctgttttacactggccagcaagttctgggccccaccagtttgctgcaaaccactggagaggcacacaaaaggctaagaaggctgattggtgaacctttatcaatagatggactgaaaaaatatttccattttatcaatactcaggcaatggaaacattagatcaatggcaaggaaggaaagtcctggttcttgaagaggcttctacatttactctaaaagtgattggacatatgatcatgagtttagagccttctggtgaggaacaggaaaagttcaggtcaaattttaagattatctcttcctcatttgcctctttgccatttaaacttccagggacagcatttcatcgtggtatcaaggctcgggataggatgtatgagatgttggattctacaatttcgcggaggagaagtggccaagaatttcaacaggatttcttaggatccttagttatgaaacatagcaaagaggatggagaagaagatgaaaataaactcacagataagcaattgaaggataatatattaactctgctggttgcaggccatgataccacaacagctgctcttacatggctcatcaaatttcttggtgaaaatccaattgttttggaacaattgagagtgatcagcgaaactcttcgaagagccacaatactaccttggttttcaagaaaggcatcccaggattttgaaattgatggttataaaattaagaaaggttggtctgtcaacctagatgttgtttctatacaccatgaccccgaagttttctcagatcctgaaaagtttgatccctctagatttgatgaaaccctgaggcctttcagttttcttggatttggtagtggaccacgtatgtgtcctggaatgaaccttgccaagctagaaatttgtgttttcatccatcaccttgtcaacagatacaattggagacctctggaggaagacaattctgtgcaaccaacgcttgtaagaatgccaaagaacaagtatcctattatagttgaagctctataa

SEQ ID NO: 2959 - DNA, 1341 bp, Glycine max var. Williams 82; identical to SEQ ID NO: 2958

SEQ ID NO: 2960 - DNA, 4446 bp, Glycine max var. Williams 82
atggaggatttttggagcatgttttgcggagaatctgattgtcctggaaccggaggaaagccacctttctgttatgatttcaagtttttgaaagatccttctacatgcaccaaccagttcttgatcatttgctttgatttgctactactgatcatgctggcattcattttgatccagaattctttgttcagaccatttcggggtcatcagtttgggctggcaagattttcaaacttgcagctaatttctgccataatcaatggatctttggggttgttgcatttgtgcttaggcatttgggttttagaggagaagttaaggaagagtctcactcttattcctcttgatttgtggttgctcgaactttttcaaggattcagatggttgttagtaggcttgagtgtaagtcttcagtttaaacagcttccaaggtcatggttgtggttgttttctcttcttacattatttttttctactgttttctgtgttctatccatgtcctatgcaataagtagcagagaattgtcctttaaggaagctttaggtgttctgtcttttccagggtcagttttactactcttgtgcacttataaagcgtataaatgtgaagacactgacggggaaattgatgaaggcctttatgaccctttaaatggtcactttaatgaagttgatcctgataactacgtaactccttttgccaaagctggattctttagtaggatgtcgttttggtggttgaatccattgatgaaaaggggcaaagagaaaacacttcaggacaaggatatcccaaagttgcgtgaatcagatcgagcagaaagttgctatttgtcatttttagaacaattgaacagagaaaagggaaaagaaccattatcacaatcatcagttttgtggactattgttttctgccacaggagagagattttgatgactggattgtttgcattgctcaaggtactcaccttgtctactggtcctgtacttctgaatgcatttatattggtttctgagggtaatgaaagtttcaaatatgagggttatgtattggtcatatcacttttcattataaagatcatagagtctctgtcacaaaggcagtggtatttccgcagtaggcttgttgggatgaaagttaggtcactacttacagcagcaatttataaaaaactattgaggttatctagtgcagctagattgacacattctggtggtgagataatgaattatgtgactgtggatgcttatagaattggagaattcccatattggtttcaccagtcgtggacgacaagccttcaaatatgtattgcattgttgatactttttaatgctattggggtggcaacaattgcctcattggtggtgatagttctcacagtgctttgcaatgctccactggcaaagttgcagcataagtttcagagtgaactcatggtggcacaagatgagagattgaaggccagtactgaggctcttacgaatatgaaagtcctgaagctgtatgcatgggaaacccattttaaaaatgctatagaaagactaagaaatttggaactgaaattgctaagttccgtgcaattgagaaaggcatacaacatctttctattttggacctcacctattttggtctctgctgcttcttttggaacatgttacttcttgaacattcctttgcgtgcaaataaccttttcacatttgtggcaactatacgccttgtgcaggagccaattacagccatcccagatgttattggggtggtcattcaagcaaaagtggcatttgcccggatcgttaaattccttgaggcacctgaattgcaaagtgaaaatttccggaatagaagttttgatgaaagtaataaaagcccaatttcaatcaaatctgctgacttttcatgggaaggtaatgcatcaaagtccacactgaggaacataaacttggagattagacacgggcaaaagttggctatttgtggagaagttggctcaggaaaatcaaccctcttagctacaattcttggagaagttccaatgataaagggaactattgaagtttatggaaagtttgcgtatgtttctcaaacagcatggatacagactggtactatacaggaaaatattttgtttggatctgatttggatgctcatagatatcaagaaacacttcgtagatcttcgctactgaaggacctggagctgtttccccatggagatctcactgaaataggtgagaggggagttaacttgagtggaggtcagaagcagcgaattcaacttgctcgtgcactttatcagaatgctgatgtatatctcttggatgatccatttagtgctgttgatgcacatactgccactaatctgtttaatgaatacatcatggatggtcttaaagagaaaactgttttactcgtaactcatcaagttgactttcttccagcgtttgattctgttttgttgatgtcaaatgggaaaatcctagaagctgctccttatcatcatttgttgtcctcaagccaagaattccaagatcttgttaatgctcacaagaaaactgccggttctgacaagcctatgaatgttacttcttccaagagacgttcgacatctgttagagagattacacaagctttcaaggagaaacatttaaaagaagcaaatggagatcagttaataaaggaagaagagagagagataggagacacagggttgaagccttacatgcagtatttgaatcagacgaaaggctacatatacttctttgtggcttctctttgtcatctcttgtttgtcatttgccagatattgcaaaactcatggatggctgctaatgttgacaattcccaagtcagcacattgaggttgattgtagtttacttcttgatcggggctatttctacaatattcttgttgatcagaactctacttattgttgccttgggtattcaatcatcaacaaatttatttttactgttaatgaactccctttttcgtgctccgatgtccttttatgactctacaccattgggaaggatacttagtagagtctcatcagatctaagcattatggatcttgatgtcccatttatcatcgcttatactgtgggaggtactacaaacttctattctaatctcgcagttttagcaattatcacttggcaaatcttgcttgtctgtgtaccaatggtttacattacaatacgcttgcagaggtactatttttccactgcaaaagaagtgatgcgcatgaatggcacaacaaaatccatcgtagctaatcatgtagctgaaactactgctggagttgtgacaataagagcctttgaagaagaagatcgtttctttgagaagaatcttgatctaattgacatcaatgctagtcctttcttccatagttttgcctcaaatgagtggctgatccaaagattagaaataattagtgcaatacttctttcttccacagcactatgcatggttatgcttccacccgggactttcagctctggattcattggcatggctctctcttatggtctttcactaaatgctcagctagtattttcaattcaaagtcaatgcaatcttgcaaattacataatctctgtagagaggctaaatcaatatatgcatataccaagtgaggccaaagaagtaattgaaggaaatcgtcctccttcaaattggccagttgctggtaaagtagagctaaatgacttgaagatacgatacaggctcgatggaccacttatactccatggaatcacatgcacattcaaagcaggacacaagattggaattgttggaaggacaggcagtggaaagtccactcttatcagtgctttatttcgtctagtggagccggcaggtggaaaaattgtagtcgatggcgtagacatatcttctatcggccttcatgatttgaggtcacgttttggtgttatacctcaggatcctaccctttttaatgggactgttaggtataatttggaccctttagctcaacactctgatcacgagatatgggaggttcttgggaagtgtcagttgcgagaagccgtccaagagaaacaagagggcctgaactcctcagttgttgaagatggatcaaactggagcatgggacaaaggcaattgttttgtttggggcgtgctcttttaaggagaagtaggatattggtgctggatgaagcaactgcatcaattgacaatgcaactgatttgattctgcagaaaaccattaggactgagtttgcagattgcacagtgatcacagtagcacacaggataccaaccgtgatggattgcactatggttctctcaatcagcgatggaaagttggtggagtatgatgaaccaacgagcttgatgaagaaagaaggatcgctattcaagcagcttgtcaaggagtactggtctcattttcaatctgcagaatcacattga

SEQ ID NO: 2961 - DNA, 894 bp, Glycine max var. Williams 82
atgaaaacccttaacaaagcctcacttattttattccctctcttgttcctttccctattcaagcattcccatgctgcaggaatcgctatctactggggccaaaacggtggagaaggcaccttagcagaagcttgcaacactagaaactaccaatatgtgaacatagccttcttgtccacttttggcaacggccaaactccacaactcaaccttgcaggtcattgtgaccccaacaacaatggctgcactgggttgagcagtgacatcaaaacttgccaagaccttggcatcaaagtgttgctctcccttggtggtggtgctggaagctactccctcagctcagctgatgatgccactcaacttgcaaactacctctggcagaatttccttggaggtcaaaccggatcagggccattaggtaatgttatattggatggcattgactttgacattgaatctggtgggagtgaccattatgatgacctagccagggcattaaatagcttcagctcacaaaggaaggtgtacttgtctgcagccccacagtgcataatccctgatgctcacttggatagagccatccaaactgggctttttgactatgtgtgggttcaattctacaacaacccttcatgccaatactccagtggaaacaccaacaatttgatcaattcatggaaccaatggatcacagtgccagcttctcaaatcttcatggggcttcctgcatctgaggcagctgctccaagtggtggctttgtgcccgctgatgtgttgacttctcaggttcttcctgtgattaaacagtcttcaaagtatggtggagtcatgctctggaacagattcaatgatgtccaaaatggttatagtaatgctattattggaagtgtttaa

SEQ ID NO: 2962 - DNA, 1755 bp, Glycine max var. Williams 82
atggagaaaaacatcataaacactgaaattgcagaacaaggctcccctgaagttccatcgcttattaggtatatatcatcaaatgaaattgctggctttgatacttcagacactcaacttcccaggccaactgcaaaaggaagtgaagcaatctcaccagaaagagaacatgatgaatctgcagtcatccatcatcaaaggaagttatctatttctatcagcatgccactttgttctgaagaagctcagcttcaaccactggacaccattatagatgatggtattcccatttcctcttctcaatcaggaactgctagctctagtcatccacagccatcaaaatgttactctcaaccaatgccagaaggccatgagcaccaagaggcagataatcatcctggcatcaaagcattcaaggacaagaggtttgactctttcaaaacatggtcagggagtctaaacagaaaactatcaattctacgaagaaagcgacaaagagaaactccacaagatgttaacaacaactccaggagcactgataggcctttacctgttcatcggtattatgatgcattggaaggtccagagttagaaacactcagggcctcagaagagacagttcttcctcaggacaggaaatggccatttcttcttcggtttcctgtttcatcttttggtatttgccttggagttggcagccaagcaattctatggaaagcaattgccacatctccttccactaaatttcttcacataagcctcaaaatcaacttaatattctggttcatatccgttgctcttactgccacagttttcaccacctatcttctcaaaatcattctctactttgaagcagttcgtcgtgagtactaccatcctatccgtgttaactacttctttgcaccatgggtatctctcttgttcttggctcatggtgttccaccatcagttacaaaagacttgcccaatgctctttggtacattcttatgacaccaatattgtgtcttgaactcaaaatctatggacagtggatgtctgggggcacaaggaggctctcaaaggtggccaatccaacaaaccatttatcagttgttggaaattttgttggagcattacttggggcttccatgggcctcaaagaagggcccattttcttctatgctattgggctggcccactacatagttgtgtttgtaactctctaccagagacttccaacaaatgagaccctcccaaaagagctacatcctgtgttctttatgtttgttgcaccacctgttgttgcttccatggcatgggccagcattcaggattcttttgattatggatcacggatttcctatttcattggcctcttcctatatttctctttggctgtccgggtcaattttttcagaggattcacattctcgcttgcatggtgggcctatacttttccaatggctagtacagcatctgcaaccgtaagatacgcaaatgaggtcacaaatgtagttacaaagacgctaagtgttatactcagtctcatgtccacactcataatagcagcagtgcttgtatcaactatattgcatgccttagtcttcaaagacctcttccccaatgaccatgccattgccataagtcatggaaaaagaaggccagaaaagaagtgtctagctcttggatacacgagccatgactccgtagagattgatttagaagcttctaccccactaccaaatggcagagagatcaatttacactctatctga

SEQ ID NO: 2963 - DNA, 2124 bp, Glycine max var. Williams 82
gtcatttgttttaagcatgtggtgcattttgtctcgtgaattctaattttgttcatattcaaattctatctttttgttcatattcaaattctagcgatctttttgttaactaacaaaaggacgttatccaagctttctacaaccagtcctctggaagataagagaaaaggctaaaggtctagcatggagaaaaacatcataaacactgaaattgcagaacaaggctcccctgaagttccatcgcttattaggtatatatcatcaaatgaaattgctggctttgatacttcagacactcaacttcccaggccaactgcaaaaggaagtgaagcaatctcaccagaaagagaacatgatgaatctgcagtcatccatcatcaaaggaagttatctatttctatcagcatgccactttgttctgaagaagctcagcttcaaccactggacaccattatagatgatggtattcccatttcctcttctcaatcaggaactgctagctctagtcatccacagccatcaaaatgttactctcaaccaatgccagaaggccatgagcaccaagaggcagataatcatcctggcatcaaagcattcaaggacaagaggtttgactctttcaaaacatggtcagggagtctaaacagaaaactatcaattctacgaagaaagcgacaaagagaaactccacaagatgttaacaacaactccaggagcactgataggcctttacctgttcatcggtattatgatgcattggaaggtccagagttagaaacactcagggcctcagaagagacagttcttcctcaggacaggaaatggccatttcttcttcggtttcctgtttcatcttttggtatttgccttggagttggcagccaagcaattctatggaaagcaattgccacatctccttccactaaatttcttcacataagcctcaaaatcaacttaatattctggttcatatccgttgctcttactgccacagttttcaccacctatcttctcaaaatcattctctactttgaagcagttcgtcgtgagtactaccatcctatccgtgttaactacttctttgcaccatgggtatctctcttgttcttggctcatggtgttccaccatcagttacaaaagacttgcccaatgctctttggtacattcttatgacaccaatattgtgtcttgaactcaaaatctatggacagtggatgtctgggggcacaaggaggctctcaaaggtggccaatccaacaaaccatttatcagttgttggaaattttgttggagcattacttggggcttccatgggcctcaaagaagggcccattttcttctatgctattgggctggcccactacatagttgtgtttgtaactctctaccagagacttccaacaaatgagaccctcccaaaagagctacatcctgtgttctttatgtttgttgcaccacctgttgttgcttccatggcatgggccagcattcaggattcttttgattatggatcacggatttcctatttcattggcctcttcctatatttctctttggctgtccgggtcaattttttcagaggattcacattctcgcttgcatggtgggcctatacttttccaatggctagtacagcatctgcaaccgtaagatacgcaaatgaggtcacaaatgtagttacaaagacgctaagtgttatactcagtctcatgtccacactcataatagcagcagtgcttgtatcaactatattgcatgccttagtcttcaaagacctcttccccaatgaccatgccattgccataagtcatggaaaaagaaggccagaaaagaagtgtctagctcttggatacacgagccatgactccgtagagattgatttagaagcttctaccccactaccaaatggcagagagatcaatttacactctatctgaggatatttgttatatattatagaaatgtgtccttcaaaacacaatattatgagtttgcttgcctaataatcttccattagttaaacataaacagaagagtttgactgttccggtgaccatgcattctaaaactagtgggatacctgtgccattcacctgttgatttccatgcatgttttaaaatga

SEQ ID NO: 2964 - DNA, 1425 bp, Glycine max var. Williams 82
atgaaagacaccattgttctataccctaatgttctaaggggacacctagtttccatggtggagctaggcaaactcatactaactcaccacccttcactttccatcactatcctcatcctcactccaaccaccacctcttccaccaccagcgtctcctgcaactctaatgctcgatacatcgccaccgtcaccgccacgacccccgccatcacattccaccacgcccccttcgccacactccccccctccactccttccctcccctctcacatcctctccatcgaactcacccgccacagcacgcaaaacctcgccgttgccctccaaaccctcgccaaagcctcgaacctcaaagccctcgtcattgacttcatgaacttcaacgaccccaaagccctcactgaaaatctcaacaacaacgtccccacttacttctacttcgcttcatgcgcgtcctttctctctctactccttcgtttaccaaccattcaccaaaccgttactagagagaaggtcaaagaccaaccgctgcagattcaaatccctggattacccacaatctccaccgacgattttccaaacgaggccaaagacccttcgagtgaaagctaccagtccttgcttcaggtagcggaaaacatgaggtgcagtgttggcattatagcaaacacgtttgaagcccttgaagagaaatccatcagggcgttatgcaaagatgggacgttgccgcctttgttttttatcggaccgttgatctctgcaccgtatgaagaagacaaagggtgcctgagttggctagactcgcaaccgagtcagagcgtcgtgttgctgagtttcggaagcctcggaaggttttctagggctcagttgaaggagatagccattgggttggagaagagtgagcaaaggttcttgtgggttgtgaggtccaggttggatgatgctgactcgatggaggaactgagtctggacgagttgatgccagaagggtttctggagaggaccaaagagaaggggctgataatgagaaactgggccccacaggttcagttactgagtcatgactcggtgggtgggttcgtgactcactgcgggtggaactcggtgttggaagcagtgtgtgaaggggtgccgatggtggcgtggcccctctacgcggagcagaagatgaatagggtgattatggtgaaggaaatgaaggtggctttggaggtgaacgagaacaaagatgggttggtgagtgcaacagagttgggggaccgagtcagggaactgatggactcggtaaagggaaaagagattagacaaagggttttcgagatgaaaaaaagggctgaggaagcaatggctgaaggtggaacctcgtgcgtcacgttagataagttggctatcaagttgtggaaaggaaacatgattgacatctaa

SEQ ID NO: 2965 - DNA, 642 bp, Glycine max var. Williams 82
atgttttatgcttccaactcattttttgactatgccaagaacagaaggatattatggggatggtcaaaggagtgtgaaaccacacaagatgattatgagaaaggatgggctggtctacagagtattccaaggcaagtttggcttcataaaagtgggaagtggttgatgcagtggccaattgaagaggtagaaaaactacatgacaaacaagttagcataatgggagagaaactggttagtgaatcaactattgaagtctctggtatccctgcatcacaagtcgatgtagaagtgtggtttgagctacctgaactagagaatatggagtggctaaatgaaagtgaagttgatccccacttgctgtgtagtgaagagtatgcatcaagaagtggcataataggtatgtggccgctggttgatctcttgcattggatacaactattggtatgtggccgctggttgatcattggtgccagttcttgcaggctcggcataacaaagcaatatctagggacacatggtctcagcttttggagtttgcaaagaatgatacataatattaaacatagcggccgccaaagtggcttgttgttcaggacctgtaggggccagttatattcagagggcggtggtgggccgtga

SEQ ID NO: 2966 - DNA, 324 bp, Glycine max var. Williams 82
atgttgtcgtggttgtggcacagtagtggcttgcgatggtttgtggtgttggttagtggtgggtttcttggcaagttgcggtggtttccttcgatgacgttggtgtggccacaacggtgtcgtcgtcgttggctcagtgctggaaacgaatcgaggtctgaagaggagactagaaggagggaagactttgacatcgaggtcgtcatcggtgttggctccggtggcgccgacgattggaggaggattgtgaaagagaaagcggtggtgtttgttgactgtttttttgtttttgtttttgtgtttaaatttggctgccattgttga

SEQ ID NO: 2967 - DNA, 342 bp, Glycine max var. Williams 82
atgctagcaaaggcaattgctaatgaagctagtgttcaagtttcattaatgtctcaatgtcaaccatcattcacatcaaaatggtttggagaggatgaaaagaacattcgagctctgttcacactgcctgctaaggtttatagtatgattggacagaggactagaataggagagcatgaggccatgaggaagagaatgaaagacatggaaaagaagcaaagagaagaagaaggccagagctccgaagatgcttcaaacaataaagacaaggaagaacaagaaattaaagcgaggtctttaaacatggaagacatgagacaggctaagagtcaggtagggtga

SEQ ID NO: 2968 - DNA, 1955 bp, Glycine max var. Williams 82
tttgttgctacaataaaataagatgagttcaactcaatccaaaccttcatccgtcaatgcccgtggcatggctctgccgtccgagcctcaccgccgtcgccgccacaaccacaaccacatctccaccttcctccaatccaccgcctccaacttcgcctctctcttcaaccccccaaaccctccctccctgactctcccgcacccgcccacctccgtctccctccctctcttcttcgcgcctccgctctccggttcctccaccgtggactcagccacttccaagcccgcccatcccccagcaaagtcagtccgcatcgcgcggcttggtgccaatggaaaaggcggcggcgggccagtcttcttgggggaggtgttcagcttgtgcgacctctccggaacggggctcattgccgcttccaagcacttcggcattcccttcatttcggaaagaacccctgagtggctgaaaaaaatatttgcaccgatcaccaagagtgagaggaatggtcctgtatttcgcttttttattgatctagaagatgcagtttcatatgttgaaaagctgaatattccaagttgcgtggtgggtgcctttcgtcttgatctagcatataaacaattcaaggaaaaacctcacttgttccagtttgttccaaatgagaagcaggtcaaggcagccaataaactgctgaagacaatatcagagcatggtgacaagaaaaaggttgatggggtgcctgtgtttggtgcccagaacttagatattgcaatagcaactacagatggtattaaatgtagtggtagtaaattttctaccaaagcatggaaagtgaatatattatgcttacattattgctctttgttcaatcagcggcggcgggatgtggttgatgacaacttagctgcagaagtgattgaggaaatgagcgataggttaggggagcctccagaggttcaggaattgctagacgaaatgggccaccctagtataccattaagtgttatttcaaaagctgcagggcttcagtttcagtatactgtcgacaaagtattactgggtaataggtggttgcggaaagcaacaggcatacaaccaaaatttccatatatggttgactcatttgagagaagaagtgaagcttctcttctgagagctacagagtcaagcagctgccttgagaactctaaagtggaagatgataggcaaatttctgaatgcttagactcttctaattgcagtttggatggtaatactgaagcaatcaaacaacctagtccaagcttaagtctaccatttggtaattggtttcatcacctatggccgaaacagtgtcgtgaaaaagcaagctcatctagaaaaggtgtaaataaggaagaaatgaaaccaagacccattcttccaaaagttacaatggttggtctctctacagaagaagcaggccaaacgagcaaagctaatttaaagaagacaatggacgatttgacaagagagttggagaagacagaactagatattatgacagatggtggcagtaaagagtgcaaagtagaagatagggatccactatttgtggcaaatgggggaaattactattctagtatgaggagaaaaccaggatctggtcgctagtttagagtaggatccaactaaaacctttttgtcacagaatttttcatttgcaggttgttgcggatatttattgatctccgaataaggttcagaatatcgggttatctattaacactcatgttatttagtgttggagctggaaataacctcatttgcggtgtataccgaaagtggatgaataaagctttagattattatttacgatcaatgttgtaaatgattatatatgtaattcatcactgatgcccgttttgattttgctttgggaagtttaataaaactgtgatacataatgcttagtaactatgcataaacttgattctgg

SEQ ID NO: 2969 - DNA, 1467 bp, Glycine max var. Williams 82
atggagacacctttagtgatccagaagttcacttcagaatctgactacttgccggtgaaaagcttgaaggatttgaagtttgttttgtggacagagacagtgaagatatggagaatagcattccctatggcactgtctgcactgcttcagtttctcacaatctcctcaacttccatctatgctggccatcttggagacattgaactttcttctatctctgtttaccaaggtgtcatcagtgccatctattttgacttgttgtttggtatgtcatctgcattggtaacactttgtggccaagcttttggagcaggacaaattcaatcaacttgtatttatgttcaaaggtcatggattatacttactgccacttgtataatcctcttgcctatttatgtatgtgccactccaatcttaaagtttattggccaagaccacgaaatagctgatcttgctggaagatattccatacaagtaattccctacatgttttcctgtgctataacttttcccttccagacatttcttcaggcccagatcaaggttaaagttattacgtgcatagcacttgcagttttggtcatacaaaatgtgctgctttacatcttcataaatgtatttggttggggtacaactggcttagccatggtgactaatatcacagggtgggtttatgctatggctttggttgtgtataccattggttggtgtaaggaagaatggactggattttcatggatggcattcagggatttgtggtcatttgctaagttaagccttgcatcatctgttatgagttgcttagagcaatggtatggaacatgcattatactacttgctggtctactagacaatcctgtgattgatgttggttcctattctatttgcttcaatgttcagggttggcacacgatgctgctccttggaataagtgttgccataagtattcgtgtctccaatacacttggcatgtcgcatccaagagcagccatatactctttctgcgtgacaatgtttcagtctctcctccttggcattgttttcatgattgccattttcttgagtaaagatgagtttgccaagatctttaccgacagtgaggatatgatacgagctgttgctgatttagcataccttcttggtgtatcgatggttatcaatagcgcttcacaagtgatgtcaggtgtggccgttgggagtggatggcaagttatggttggttacataaacctggcatgttattacgttgttggactccctattggaatttttcttggtttcaatcaacatttaggggtcaagggtctctggggaggcaccatgtgtggtaggattcttcaaatgttagtcctcttaatcattatttggaagaccaactggtccaaggaggtggagcaaacagctcatcgcatgagaatatggagcatcaacaacctccactcgaatgacatgggaaatgttacatga

SEQ ID NO: 2970 - DNA, 720 bp, Glycine max var. Williams 82
atgggttctcggtacgaagtggaagtgaagcccttatcagcacgcgcgctcaagaacgtgaactggcgccacggccccaacctcccctacgtcgtcgtttgggccgaccgaagctacttactctccacgtccgtggacgagaacggcaacaccgacgcgaattggaatgaaacgctcacaattccgttgccggctaagcccctcgaggatcaaaatttgttcatccacgtggtccacgccggctcgggggaggacaccaagtcgctgatcggcaaggcttggctccggctggtggatattgtcaacgacttcggaatcggtgagcgcgtgagatgcacgctctcgctgaagcgtccctcggggaggccgcaagggaaggctgaggttagcgtgaccatcagggagtcgagctatggtgcgcagggtgggtacaacgcacctcccaacggggcaccaccacaaaaggcgaattgttacgctacgccaagtgggtatccttataatgcgacggcgaagggatgggctacgctcgctgcggtttttggtggaatatctgtggaagatgctgagtatgttgatgacaagaatcaagatgatgcggaagaaaaaagagtggaggatgatcttggtgctgaggacaagattcaagataacgtggaagcaagagtggaggatgatcttggtgaccatgctgatgatgatgacgacttctggcgatga

SEQ ID NO: 2971 - DNA, 1602 bp, Glycine max var. Williams 82
ccactagatatatgaatataattttgatatataaataagaagactaaataaaacatgccccaccgacacgcgacgccatgcacgccaacgccggagtacaaaccaaaatatgagacctaaacgattctctttggaaaacacgaagcgacaaaactcaaatgaattttattactttagacaaaatagaatcaaagtcactatcaactcaccatgcacgtagcaatgaacctttccatatgtcaaattcaccaccaatgctaaacccgtaattctcccccaaaccccatgcacctataaaaccatgaacaacgagtgaacgaaacggcgaacagaacaacagcaacgttaacaatgggttctcggtacgaagtggaagtgaagcccttatcagcacgcgcgctcaagaacgtgaactggcgccacggccccaacctcccctacgtcgtcgtttgggccgaccgaagctacttactctccacgtccgtggacgagaacggcaacaccgacgcgaattggaatgaaacgctcacaattccgttgccggctaagcccctcgaggatcaaaatttgttcatccacgtggtccacgccggctcgggggaggacaccaagtcgctgatcggcaaggcttggctccggctggtggatattgtcaacgacttcggaatcggtgagcgcgtgagatgcacgctctcgctgaagcgtccctcggggaggccgcaagggaaggctgaggttagcgtgaccatcagggagtcgagctatggtgcgcagggtgggtacaacgcacctcccaacggggcaccaccacaaaaggcgaattgttacgctacgccaagtgggtatccttataatgcgacggcgaagggatgggctacgctcgctgcggtttttggtggaatatctgtggaagatgctgagtatgttgatgacaagaatcaagatgatgcggaagaaaaaagagtggaggatgatcttggtgctgaggacaagattcaagataacgtggaagcaagagtggaggatgatcttggtgaccatgctgatgatgatgacgacttctggcgatgacttctgtgatgtttcaggaggagggaaataaatggaacaataatatttcaagtttttttttttttattttcagttgaaaatatttattatatatatatcctttttattaatgatatcaaaataatcttatcaatgcttatcttcgttgtctttttctagcgttgaaaattcaacaattaatttgttgataagaaaaacctcgaatgttttgtagtaactcttgaaattattgatagcatttgatgaaactaaaaacattaggataaaattttggtttctaattgcgagacttgatgagaaggaagatttcatatctgttgaacctgaagccttggctattttagaggctgttaatatgcttggtgatttaggatactatagagccattatagaaactgactataaataaagaggtggatgataggattaaaggaaagtgtacgaccctttctgaattagcagtcattactagtatttgcaaacattaattggctttcttagttttcaaacttagaggtaagacaagttaat

SEQ ID NO: 2972 - DNA, 945 bp, Glycine max var. Williams 82
atgtggtggcctttctggagaaaagggggttctgcattttcatcttcttccactgctgatgaagttacagaaggaatcgatggcactggcctcactgctattgttactggggctaccagtggtattggtgctgagactactcgtgtacttgccatgcgtggagtccatgtaattatgggtgtgagaaatatgaatgccgcaaaagatgttaaaggagcaatacttaaggagattcctgctgctaaagttgatgctatggaattagatcttagttcaatggcatctgttcgaaaatttgcatcagagttcatttcatctggtcttccattaaacattctcataaacaatgcaggagtttttggaacccctttcacactgtctacagacgccattgaactacaatttgccacaaatcatatgggtcatttcctattaacaaatctgttgttagatactatgaagaaaacaacacaagaaagcaagaagcaaggaagaattgttaatatctcttcaatacttcatcagttaacatttcgtggaggaatcccttttgataaaattaatgacccatcaagctaccacaattggcttgcatatggacaatcaaagcttgctaacattttacatgccaatgaacttgccagacgtcttaagcaagatggggtagatattacggctaattctcttcatccgggagctattgtcaccaatatttttcgtcacactagtgtactggctggtataattaatacgctgggtagatttgtgtttaaaaatgtccaacagggagctgcaacaacatgctatgtagcattgcatccacaagtgagggaaatcagtggcaaatatttttcagattgtaatattgccccaacaatctcaaagggaagggacattgatttggccaagaagctttgggattttagcttgaatttgattgagtaa

SEQ ID NO: 2973 - DNA, 951 bp, Glycine max var. Williams 82
atgggttcttctgggttttcatcatcttccactgcagaggaagttactcaaggaatcgatgggagtggcctcactgcaattgtcacaggaacaacccatggtattggcactgagacggcaagagttcttgttttgcgtggtgtacatgtgattatggcagccagagatgtgattgcagcaaaaactatcaaagaggtaatacttgaagagattcccacagccaaagttgatgccatggagttagatcttagctcaatggcatccgttaggaagtttgcatcggagttcatttcatttggtcttccattgaacatcttgataaacaatgcaggaataagcgcattccctttcacgctgtccaaagacaacatcgaactactatttgctacaaatcacttaggtcatttttttttaacaaatcttttgttggatactatgaagaaaactgcaagtgaaagcaagaaagaaggaagaattattaatgtttcctctgatggtcaccaatatacatatcctgaaggaatcctttttgataaaattaatgacgaatcaagttaccagaagtggcgtgcatatgggcaatcaaagcttgctaacattttacatgccaacgaacttgcaagacttcttaaagaagatgggatagatattactgcaaattctcttcatccaggagctattatcaccaatatttataaaccagagcttagtggcccagtgccaactgatctaatgaatatgcttggagattatctgcttaaaagtatcccgcagggagcagcaacaacatgctatgtagcattgcacccacaagtgaaggggattagtggcgagtatttttcagatagtaatctggctaaagcaagctcactggcaacagacactgatttggctaagaaactttgggatttcagcatgaaaataattgactacaatgcccatgattcatga

SEQ ID NO: 2974 - DNA, 1222 bp, Glycine max var. Williams 82
aacacggtcgcacaaagagacaggtaaagatagagtgagctgttagtcatgggttcttctgggttttcatcatcttccactgcagaggaagttactcaaggaatcgatgggagtggcctcactgcaattgtcacaggaacaacccatggtattggcactgagacggcaagagttcttgttttgcgtggtgtacatgtgattatggcagccagagatgtgattgcagcaaaaactatcaaagaggtaatacttgaagagattcccacagccaaagttgatgccatggagttagatcttagctcaatggcatccgttaggaagtttgcatcggagttcatttcatttggtcttccattgaacatcttgataaacaatgcaggaataagcgcattccctttcacgctgtccaaagacaacatcgaactactatttgctacaaatcacttaggtcatttttttttaacaaatcttttgttggatactatgaagaaaactgcaagtgaaagcaagaaagaaggaagaattattaatgtttcctctgatggtcaccaatatacatatcctgaaggaatcctttttgataaaattaatgacgaatcaagttaccagaagtggcgtgcatatgggcaatcaaagcttgctaacattttacatgccaacgaacttgcaagacttcttaaagaagatgggatagatattactgcaaattctcttcatccaggagctattatcaccaatatttataaaccagagcttagtggcccagtgccaactgatctaatgaatatgcttggagattatctgcttaaaagtatcccgcagggagcagcaacaacatgctatgtagcattgcacccacaagtgaaggggattagtggcgagtatttttcagatagtaatctggctaaagcaagctcactggcaacagacactgatttggctaagaaactttgggatttcagcatgaaaataattgactacaatgcccatgattcatgagcagatgtgaatgctgatggcatatacttccttagtgactaaataataactactgtgaacatttgtagtttttaataataaatttccatcgatcctttgtgccctatgcctctctatagcttagtgtttttatttataatggacagattggtgaggcaagtcaaccataattaagagtccacaaaactttcaattttagcatttgagggtttgtaattaggta

SEQ ID NO: 2975 - DNA, 756 bp, Glycine max var. Williams 82
atgtcaggtggtattgggccaacagggtgtgacattagcctcccaaaagaacaagaactaggtttcaaagagcaacatgaccaacaatcactcaagaatctcaacaagcccaccacaccacaagataaagtgggttttctctccttcaaccagctcaatgccctggctgtggtaattgtcctctcagccagtggcttggtcagccctgaagactttgcctttgtgttcttctccctaatttacatgtacttcatagccaaggtggctttcccttctcttcagccatcaagggacccccaagttttcaacccccaaaacaagctcctccaactttatgccctcataggtgccaccattggccttttcactccaatagcctacattctagagggtgtttttgagggtgaccaggaagggatcaaagcagcagcaccccatgtttttctcttggccagccaagttttcatggaaggagtggcatcatctcaaaggttctcggctcctattagagcttttctgggggcattctacaacgccaggaggattttcacgattgtggattggcttaggagtgaggtctacaagatgaatgacgagcacagtgggtctgcttggaggattcatgttgggaaagcacttgcaatggctaatatggcttactggtgtttcaacctatttggattcctattgccagtgtatcttccaaaagttttaaaggtgtattactcctctgagtacaatgagaaaaaccgatga

SEQ ID NO: 2976 - DNA, 2596 bp, Glycine max var. Williams 82
tcatatactctgtctctttccctctctctctaaaccttctttgctgatcgctttctcgccttttctcgccgattttccttcccgccaaacactccgtgttccccttcgccgccgcttcgccgatcctcgttattctcggagctctctctcgtttctcattcctattcgatgccaattgcaaaactcaaagcctctggcactccagatgtgatgaaaaccgaagacagaatagataccttaatcagacaggcaattggcaaagaacctttcattccttttccaagggccagtgaaagccctgtacagtggattcaattactccatgctttagatccgcaaggtgtcagcaatactttttcagaatttcctgggtggcctttgttctctcctctgaaggttcagttgcagaagtgtgacaaatgttctcgagagttttgctcccccgttaactatagaagacatatacgtgtacatcatcggttgaaaaagcttgataaggattttacaaaaactaaggatcttttaggagcatattgggataagctctccgtagaagaggcaaaggaagttgtatcattcgaaaatgtgctgctggaggaagttccagcttcttcaattttaaaatctctgacaacttttattcaaaaccaaggattttattcttttcctcagtattatctgatggctggtgctgcccttttggatattgttcaatctaaaccttcctgctttcctatatcttcccaggagttgttcagtatccttgatgatgctagtgaaaatacttgtttatgtgggacagcagaatcaatgcaaagatatgtatttgatggagaggctggaaaaattggtcttgaaccaaaaaacctagttgcttgcacaagtttcttgctagaacagaaattggtgaaggcatggcttgctgacaaggatgctgaagcactaaggtgccaaaagcaattggtggaggaggaagaagctgctcagaaaagacaagctgagattttggagaggaaacgccagaagaagcttagacaaaaagagcagaaagctagggaacaaagacaccaagctgaggcagaaattaaaggcgatattgacagtactgtaaaggctttatcaccggcagaagcatctttagatacatacaattttgaagctcataatccaagtacattttcagataacgcagcttcacctgtacctttccaatgtcctgacaccagtgaagaaataaatggggatattcattcagagtctgaaactatcactgatcaggatattgtgagacagtcagcacatggacataaacataagcgccaagcagttgccagacaacaggggctgccaaaattacaatgggctgtagccaatggtttgcatacaaagcagaattctccagtgtcaaaacttgaaatcaatcagaaatatggaacccactgtgatcaaaaggcatcttctatagttaatggtagcaaagtatggactcggaagtctaaaacagaaattgacaaggtggttttaaaaaccataaaagagaaggaaccagaccaagttaagaatcaagaagtcttaataggatctatatctgttaatcttagcaattgcagccaatcagagggtaatatggtggcttctcaaaaggacttcattgttgagaatatgggaaagcagaatatttctcgggataagccaatgaaaactgatcttgccatgggtgacaacaatcgctcaacagtcaagttttggaggccagttagccggcttgaaactaaagatccacttccagttcaaagtggcgggacaaaagttgatgcagttcatgaaaatggtcaaaacttgtcaggtccaagttctttaagggtgtgtactgctgccggtggtgatattggttttgctaagtatttctcccatacagaggataaagcagatccaggaagcttctggttcgacatccaggctgcaaaagctttccttgcacaaaggtggaaggaagctatctcatcagaacatgtgacattggttatttgccccgactcggaacctcctgggtgcgaggagatacaggatttgaaaacagcagcatgtcaatcttctgatatggatggatgtgacattgtggcaaatgcagataaaagattgcctgcaacctccaaagttgcgaaatccaaacccaggttgaagaagtctgaaaagggaaccaagataaagtatattccaaaacagaagacaaatacctagtgtgaaagaataaattggagttgttagttatacagatatacagagtttgactttgttgccaatttatgttagcagaggtccaagttttaccggatggtcttctgtcagaatgttgaaagtaggtttttgccggaaaatctttacattccgcccctgttgtccgaaagatttcatatgggattttggctagttagattctttttacttgttgaattattaccttttttttttgtaataaacttgtttgatttccgtacaggttgactttttatgatgcatttgtcatcattaggcaagattttttcttccattcttttttggcataattgtctaaattttgcttgtagtaattcta

SEQ ID NO: 2977 - DNA, 2157 bp, Glycine max var. Williams 82
atggattcaaagcgattcgatcgcgcgagtcgcaaggttcgggtcgtcaccaggatccgcgggtttgcgggtcccgaggctaattccgaacctgccgcttccagaacggtggagtgggtttcggtgaaccgcgaaaatttggaggatgtcaccatctccttcggagaccaatcttccagtcggtattcggtggactattgctataaggaagatgaagataatgaattgatatattcaagggaggtgaagcctcttgtgtctgcagcttttgatggtcataacagcactgttattgcacatggtgctaggggtagtggaaagacgcacgcaattcagggctctgctgagagaccaggtttggcagtgcttgctatcgctgagtttctttcagtggctgagaaaaatgggaaaaacatagctgtttctttctatgaggttgatcatcaggagcgggccatggatttattaaatccagagaagccaccaattttggtttttgaagatcatggcagaattcagtttaaaggactaactcaggttcttgtgaaatccattgctgaatttcagaatttgtactcctctgcatgttttgcactgaagggagctcccaaaaaaggaggatgtgaacatgttcatagaagccacatgggattaatcgtccatgtcttttcccagaatggaagtcttgtaagcaaagtgaattttgttgacttggcaggttatgaagatgctagaaagaaaagtggtgatggatcctaccttgctgagattaacaaaattaacaagtcaatttatgccttattgaatgtttgtcatgctttgagtacaaatgaaagtcgtgttgcctaccgggaaagcaaaattacacgcatgctgcaggattcgttgagggggactagcaaaattttattggtttcatgcttgaacccatcattttgccaagacactatttacatggttagcttggcatcacggtcatgtcattggattcatcgggcattcttagattccaccaagagaaatgcaagttcagcaaaacaaatggtgaattctcataagaaccagatacccaaaagtgtttcaggaacagcaaagaaattacatgtttcttctaaattacttgataaaaaagttgttgttgctaagaagtctgcaataaaaggaaggaaattgtttgatgaagccagtcactctgttactaaagctgagaaggaaattgctgttgcccaagttactcaagcatcaaagtctttattggacaattcattgttggaaactggaagtgatgtcgtactcaactctggaatggaaaagaagactggaaatcatgttgtactcaactctggaatggaaaagaagaccagaaatcatgttgtactcaactctggaatggaaaagaagaccagaaatcatgttgtactcaactctggagtggaaaaggatgactcattttcaaaagctagagagaacgtgaaacttgatctgatggtgcaaaatgatgattcatcttttaatgctaacattgaagtggaacttaatcccctagcagatcagggtatttcggtggatgaggaggatcatcaaaaggagcatactccttatgctagtaattactctgaagtattggcaaaaatagttcaggaagaccatagcataaacaaggagaacaacaattcaagggcaatcagagatgattcattggctattaattcaccacctatcagttctcagttgcaggatctttctaatagtcttaaaatgctatattcttcaaccccatcatgcatgcagataccaaaaacggaacccattccacttgatattgttgaaccaaaaactccaacaattgaacaaaacatgagcattaacagatgggatgcaatgaatgccaaaagtccctgggagacattcagcatgcgaggttctggaatgaagagttctcttgttcaagaatacctcaggtttttaaatacagctaacaaggaggaattaaaaaaattgaagggaatcggggagaagagagctaccttcatacttgaactccgagaagaatctccagagcctttcaagagtctggatgatttgaaggatattgggctttcggcaaagcaggttaaaggaataatgaagaaggaagtcggagagcttttcagttag

SEQ ID NO: 2978 - DNA, 2864 bp, Glycine max var. Williams 82
cagtgtacaaacaatttcctattcattcaatcatggattcaagagcagttcaaactcattcgcatgaacatcaccataattctcacaatgttgggtcacacgcagtggcacatggtgaagaacaacaccaccatgaccatgagaagaagtcggttctgaagaaagtcaagcaaaaggctaagaaaattaaggacacaatcacaaagcatggccatcatgaccatgaacatgaacatggtcatgagtatcaccttgatgatcaacatatccctgatgatcatgacttggaagaggaagatgagatggatgaatacccagaagtccatggagcaccgatttatgacagtgccgctgttagaggtgcagcaccagggcatgccaatactttagggaggcctggagttaattttggaggcacaacagttatgggagtagaacctcttcacgagctaagagttgtagttgtttctccaactactgaaattaatcaaaacagaaccactgacccaactagaacatttgttgagggagagaaagcagtgcatcgtaaggtcaatttggagagaccaatgtacttggaggaagatccacatgcgccaagaagtacatctcaagcatatgctccagccaattatcaaaccaaagtcactgatcctaccggggcaggtggggcagaaattgacattacccctgttgagaaatctttctctaggatggctgttcacaatgagccaaaaccatacccagaaccaaaactcttttcaactgttcctgaaactcactacccttctgctggaagccactcccaacttgcaccagagctatcttctgcaactaactacccaactaactacccatctgctcaaagctatggtcagtacatgccagaactatctagtgaagttaaaactcagtaccccaaaagccataatcagtttatgccagagttatctacaccaaccaaaactccctacccttccaccaatatccatgaccaacacttaccacaacaatctagtgcaacaaaaactcaataccctttatctggaagtcatgacaagtttgcaccagtgttatctactgaacctaacattcagtacccttcaaccaaaatccatgaccaagacttgcctcagcagtttactgcaacaaaaactcaatacccttcatctggaagccatgatcagttaacaccagaattatctttctctactgaacctaaccttcagtacacttcaacaaaaatccatgaccaacacttgccacaacaatttagtacaaatgcaacacatactatatgtccttcagctggaagtcatgatcaatttctaccagaatatccaactcaaaccaaaaccccacaaacctataccaccacccaagttgaggaaccacactatgaaccatcaaacgagagcagttacacagataaaatctcctccgcaaccacagcaatagctgacaaagccatcactgccaaaaatgttgtagcttcaaagctcggatacggtgatgacaccaccgaaaaaactcaaacaaatcataaagaagagaacacaagcaatgaaaaaccgtcaacaatcacatcagcaacctcagccaaaaacactgtctcttcggatcaccaagagaacacaggcagtgcaaagccatcaacaatctcttcagcaacctctgcaatagctgataaagccatatcagccaaaaacacagtctcttccaagctcggatacgctgacaacaacaccgaaacaactcaagcaagccatcaagagaacacacaaccatcaacaatctctttagcaacagctgcaatagccgataaagccgtctcagcaaaaaacaccgtagcttccaagctcggatatggcgacaacactgaaacaaaaacaactcaaaccactcaaacaaggaatcaattaaagaacacaggcaatgagaaaccttcaacaatctcatcagcaacctctgcaatagctgataaagctgtctcagccaaaaacaccgtagcttcgaagcttggttttggcgacacagcaacaacaacacaacaagagaagagaactgaccatgctgctgctcctacagaatatggaaaaagtgttgctcagtccctgacagagaaactagctccagtttctggaaaagatgctggtgtaggaagtggtgtgaagtccaaagtttctggaactcaaactagtagtatgggtgtggaacaggacaagggggtttctgtgaaggactatttggtggacaaactgaggcgtggtgatgaagacagggctctctctgaagtgatatcagagactctgcacaagaaggaactgccctcagtggaagttactgaagaaggtgtgagaaaggtggtttctgatgctgtgcataagagagaggatgatcctgagagaagaatggaacatcaaagaatactgggaaaggtaactgagtcagaggaagtgaagagaaggttaggaggtgaaagtgtggtgacagagaaaaagtaccaagagatgtatgtgaatagtccaggtaaaggtgtggttgataaggttaaaggtgtggttgggacatggtttaccaacccagcagagaatcaatcttcacaagattcatctatgaattatgaggcaggaagggcagaagtggaacaagctaaccaaggtgcagcaggtgaaagaaggctgcaggagtcatctaattgaagaggtgctttgaaggagtctttgctttgggtgattgtgtagattttcttaaaagctgtttctatatctgtgtgtcttcttctttgttggaagaaagttaggatgctcaagtcacagtaaaataaaaaatttgtgttttttttaatgtttatgtaaatatcc

SEQ ID NO: 2979 - DNA, 549 bp, Glycine max var. Williams 82
atgcttactggaaaggtaatccagctgttgctcaaaccagacaagatctcaagaaatgcaatgtttatgaaaatcaagattggaatgctcgtttatttgcccaggattggtttcgagaatcacaagaggggttcaacaaatcagacttgccaagtcaatgcacttatagatataaggtgtacattgaaggttctgtttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagaaaagttattgggataatcaaaccataacatcttaa

SEQ ID NO: 2980 - DNA, 519 bp, Glycine max var. Williams 82
atgtctaggctcatggaaccacttgttgtgggaagagtgataggagaagtggtcgacattttcagcccaagtgtaaaaatgaatgtgacatattccaccaagcaagttgccaatggtcatgagttaatgccttctactattatggccaagccacgcgttgagattggtggtgatgacatgaggactgcttataccttgatcatgactgacccagatgctccaagtcctagtgacccatgtctaagggaacatctccactggatggttacagatatccctggcaccacagatgtctcttttggaaaagagattgtaggctatgagagtccaaagccagtaataggaatccacaggtatgtgttcatcttgttcaagcagagaggaagacaaacagtgaggcctccatcttcaagagaccacttcaacacaaggaggttctcagaagagaatggccttggcctaccagttgctgcagtttacttcaatgctcaaagagagactgctgcaagaaggaggtga

SEQ ID NO: 2981 - DNA, 870 bp, Glycine max var. Williams 82
atgggggccggtgtttctacaactgcaatagaaaatgatgatgggggcactttttctttgtcaacaaagactacccttgatgatatccctgagaattgcatctcttcaatgatgatgagttttgatccacaagagatttgcacattggcaagagtgaataaggcctttcacagagcttcctctgctgactttgtgtgggaatcaaagttgcccccaagctataaattccttctaaataaagtacttggtgaacaaaatcttggttccatgaccaagaaagagatctatgccaaactgtgtagaccaaatttctttgatggtgccaacaaagaagtttggctggacagaagcagaggacaagtttgtatgttcatttcatcaaaatccttcaagattacaggaatagatgatagaagatattggaataatattccaactgaggaatccaggttcaagagtgttgcatatcttcaacaaatgtggtgggttgaagtaataggggagctagagtttgagtttccaaaagggaactatagtgtatttttcaagcttcaattgggcaagccctcaaagagattgggccggcgagtgtgcaaccttgatcaagtgcatggatgggacatcaagcccgttagatttcaactatctacatcggacggccagcgttcactctcccagtgctatttgcgtgggtccggagagtgggcccactaccatgttggtgactttgcaatcgataagcccaatgggccaaccaacatcaacttctccttggcccaaattgattgcactcacaccaaaggtggtctttgcatagatggggtagtgatttgcccgaaggagttcacagaaagattgaaacaattttag

SEQ ID NO: 2982 - DNA, 1941 bp, Glycine max var. Williams 82
atgcagacccttaatgaggcctcacaaacagactctcaatgttgttgcagctgcacaaccccatttttcaactcaccaacatcactacacaacacaacatcaaaaatcaggaacagttctgccgagtggcgccacagcttcgcggttacaacaacatcctctatattcccaaacactcaattcaccaaccatgagtctcttccatcacttcatgaatcattcaatgagttcaccaaagtgtaccctcagtattctgagactgaacaagttgaccatgttagagccaagcactatttccacctctcactctccaaccaaacttgccttgattacattggcattggcctcttctcctactctcaacttgaacaccatgaaacatcaaaaagccaagtaccctcatcttcaattcctcaaacaccccaattaccaccacctaattactcagatattccattctttagcttatcttgcaagactgggagtctaaagactttgttgcttcatggtgggcaagactcagaatttgaggctgcaatgaggaagagaatcatgtgtttccttaacatatctgaaaatgattacttcatggttttcacagccaacagaacctcagctttcaaacttgtggcagattcataccaattccaaactagtaggaggcttttgacagtttatgactacgagagtgaggcggtggaagcgatgattagttcctcaaagaagagaggagccagggccatttcagctgagttctcatggccaaggctgaggattcagactacaaagttgaggaagatgattgagcgtaagagaaagaagaagaagagaaagggtctatttgttttgccacttagttcaagagtgacaggagcaagatatccttatctttggatgagcatagcacaggagaatggatggcatgtattggttgatgcatgtgcattggggccaaaagacatggactgttttggcctctctctctttcaaccagactttcttatttgctctttctataaggtctttggggaaaacccttctggatttggatgccttttcatcaagaaatccgctatttccagcttggaatcttcctcttctgcaggaattgtcaaccttgtaccagaaaagcagcctcatcaattatcagatgattcttctggcactgacttagaaattaaaaacaaatcattaccaacatgcctacatgaagagaaaccatttcctttgtcatctttctcaggtccaatgcaaactaaacaatctgaaactgttgaagaaggagaaccacctgactcaaaactaaaagctcctcaatgttctgaaattgaggaggtacaacaagagccagttcagactcctaagacaagcaatgtccaagaaagtgacattcaatttaggtgcttagaccaagtggattctttaggattgattctcatcactaacaggtcaaggtacctgataaactggctggtgaactcaatgttgaagcttaagcatcccaacacacaaggggttcctttggtcaaggtttatggtccaaaggtgaaatttgatagagggcctgctttggcattcaatatatttgattggaaaggtgaaagggttgagcctgctcttgtccagaaacttgctgataggagcaacatatctatcagctatgcatttctgcatcatatttggtttgcagataagtatgcagaagagaaaggaagagtcctacataccaaagtggttggagaccaagaagtggtgacaacaaccaacaagaagaaagatagtgttggaatcagtgtggttactgctgcattaggcttcctggctaattttgaagatgtctataagctttgggcttttgttgcaaggttccttgatgctgactttgtggagaaggagaggtggaggtacattgctatcaatcagaaaacagtcgaagtttag

SEQ ID NO: 2983 - DNA, 2408 bp, Glycine max var. Williams 82
ggtcaactgggctaggcaaactaactatgcaagaccaagtccaaattgtattacaatgaccctttcgatagtttcaactttcaccatacattgccgtatcagccagctaaatccaaacacaaaaatatattataaacaaaaggagagagattccgttgttatctttttgtgcttttcctatatgccgaatggcacaaagcatcaaccaatccaataggcaatatataccaaacttgtcttagagtgcaacaaacaaggaggataagaaaaaacaatgcagacccttaatgaggcctcacaaacagactctcaatgttgttgcagctgcacaaccccatttttcaactcaccaacatcactacacaacacaacatcaaaaatcaggaacagttctgccgagtggcgccacagcttcgcggttacaacaacatcctctatattcccaaacactcaattcaccaaccatgagtctcttccatcacttcatgaatcattcaatgagttcaccaaagtgtaccctcagtattctgagactgaacaagttgaccatgttagagccaagcactatttccacctctcactctccaaccaaacttgccttgattacattggcattggcctcttctcctactctcaacttgaacaccatgaaacatcaaaaagccaagtaccctcatcttcaattcctcaaacaccccaattaccaccacctaattactcagatattccattctttagcttatcttgcaagactgggagtctaaagactttgttgcttcatggtgggcaagactcagaatttgaggctgcaatgaggaagagaatcatgtgtttccttaacatatctgaaaatgattacttcatggttttcacagccaacagaacctcagctttcaaacttgtggcagattcataccaattccaaactagtaggaggcttttgacagtttatgactacgagagtgaggcggtggaagcgatgattagttcctcaaagaagagaggagccagggccatttcagctgagttctcatggccaaggctgaggattcagactacaaagttgaggaagatgattgagcgtaagagaaagaagaagaagagaaagggtctatttgttttgccacttagttcaagagtgacaggagcaagatatccttatctttggatgagcatagcacaggagaatggatggcatgtattggttgatgcatgtgcattggggccaaaagacatggactgttttggcctctctctctttcaaccagactttcttatttgctctttctataaggtctttggggaaaacccttctggatttggatgccttttcatcaagaaatccgctatttccagcttggaatcttcctcttctgcaggaattgtcaaccttgtaccagaaaagcagcctcatcaattatcagatgattcttctggcactgacttagaaattaaaaacaaatcattaccaacatgcctacatgaagagaaaccatttcctttgtcatctttctcaggtccaatgcaaactaaacaatctgaaactgttgaagaaggagaaccacctgactcaaaactaaaagctcctcaatgttctgaaattgaggaggtacaacaagagccagttcagactcctaagacaagcaatgtccaagaaagtgacattcaatttaggtgcttagaccaagtggattctttaggattgattctcatcactaacaggtcaaggtacctgataaactggctggtgaactcaatgttgaagcttaagcatcccaacacacaaggggttcctttggtcaaggtttatggtccaaaggtgaaatttgatagagggcctgctttggcattcaatatatttgattggaaaggtgaaagggttgagcctgctcttgtccagaaacttgctgataggagcaacatatctatcagctatgcatttctgcatcatatttggtttgcagataagtatgcagaagagaaaggaagagtcctacataccaaagtggttggagaccaagaagtggtgacaacaaccaacaagaagaaagatagtgttggaatcagtgtggttactgctgcattaggcttcctggctaattttgaagatgtctataagctttgggcttttgttgcaaggttccttgatgctgactttgtggagaaggagaggtggaggtacattgctatcaatcagaaaacagtcgaagtttagtttattccattgagtttcatttattcttatggattgtaagtcatggaagaatccatgaagtgtgaattctgctgaaaatttaatgtaaatgcaaatatgattctcgaaagaaacaaggattacttaccctattcattcatttgtatgatggattcaaaaactatggaattcattatgtcaaatatactttgtt

SEQ ID NO: 2984 - DNA, 915 bp, Glycine max var. Williams 82
atggccatagagtgcataacaaatatacaatctatgtctcaaccacaaaagcatcaccaagaccacaaagaagatgaagcaccattggtttttgatgcctcacttctcaggcacgaactcaacctaccaaagcagttcatttggccagatgaggagaagccatgcatgaatgtgcctgaacttgctgtccctctcattgacttgggagggtttatctctggtgaccctgttgcgacaatggaggctgcaaggatggttggtgaggcatgccaaaagcatggtttctttcttgtggtgaaccatgggattgatgccaagttaatctctcatgctcatagctacatggatgacttctttgagattcccctgtctcagaaacagagggcgcagagaaaaacaggggaacactgtggttatgctagtagcttcacgggcaggagggtttaccaggactattgtgatgccatgagtaatctttctttggggataatggaacttttgggaatgagtcttggagttggtaaagcatgttttagtgagttctttgaagagaataactcaataatgaggctcaattactatcctccttgtcaaaaacctgacctcactttgggcactggacctcactgtgacccaacatctttgaccattcttcaccaagaccaagtgggaggcctccaagtttttgttgacaatgagtggcattccgttagcccaaatttcaatgcttttgttgtcaacataggtgataaggtagttagtccaccaagtgaattggtggatgatttgaccccaagggtctacccagattttacatggcctatgctgcttgagtttactcagaaacattatagagctgacatcaaaacccttgaggcattcaccaactggcttcttcaacggaaaacgaactga

SEQ ID NO: 2985 - DNA, 957 bp, Glycine max var. Williams 82
atgtctaaacaacccattgatccctttcgccacatcaacatagttctcaaccctaacggaaccctaaatcgcttgcgccatattcccagcaccgcaccctcttccgaccccactctcccagttctcaccaaagacatcaccatcaaccaacaaaacaacacatggctccgcttattcctcccccgaatagcactatccccaaaccctaagaagctacctctcatcgttttcttccacggcagcggcttcatcgtaaccagcgccgcctccactatgttccacgacttctgcgccgccatgtccgccgccgtccccgccgtggtggcctctgtcgaataccgcctcgcgccggagcaccgtctcccggcggcgtatgacgacgcggcggaagccttggagtttatccgagacagcagcgaggaagaagaatggttgaccaaacacgccgacatgtctaattgctatctcatggggagcagtgcgggggccacaatcgcctacttcgcgggtctacgcgcgaccgacacggcgagcgatctctcgccgttgaagatcagagggctgatattgcggcaggtgtttttcggtgggacccagaggagcaaatccgaggttaggctggagaacgacgaggttcttccgctgtgtgtgacggatttgttgtgggagctggcgctgccggttggcgttgaccgtgatcacgagtattgcaatccgagggctgagaagtgggttgggaaaatggggaagatgagggagctagggtggagggtgttggtgagtgggaatggaggggaccctgtgattgatcgtgagaaggacttggtgttgttgttggaggagaagggtgtggttgtggtgagtgattttgatgaagaagggtgccatggggtggagtttggtgatgaatccaaagcaaaccaactcattcaggtagtcaaacgttttgtttcatga

SEQ ID NO: 2986 - DNA, 2055 bp, Glycine max var. Williams 82
atggcttgttcagtgcatctacttcttcttcttctcacttcacttctggctttgttctttaacccaacatgtgtctatggcaatgatgagcttagagcacttttggacttgaaatcaagtttggatccagaagggcactttctatcctcatggaccatgggtggtaacccatgtgatggttcctttgagggagtggcttgcaatgagaagggtcaggtggcaaatgtgtctttgcagggaaaaggcctctctgggaagctctcaccagctattgctggactcaaacacttgacaggactctacttgcactacaactctttgtatggagagattccgagggaagttgctaacttgactgagcttagtgacttgtacttgaatgtgaatcacttgtctggtgaaatcccacctgagattggcaagatggagaatctgcaagttttgcagctttgctataatcagttaaccggaagcatacctacacagcttggtgatttgaagaagcttagtgttcttgctcttcagtcaaacctgctgggtggagctatccctgctagtctaggtgatttgggaatgttgatgaggctagatttgagctccaataatctctttggttccattcccattaaactagctgatcttccttcactgcaagttctggatgttcacaataatactctctcggggaatgtacctcctgctctaaagagactagaggaaggatttgtgtttgaacataatatggggttatgtggcgttgggttttcatccttgaaagcttgcactgcttcagatcatgtcaatctcactcgaccagaaccttatggagctggagttggtggtctttctagagatatcccagaaactgctaatgtaaagttgccttgcaatacaactcattgccaaaattcatcaaaatccaaacaagcgacatctatcacagttggcattgttctactaacaattgcagtatcagcaattggtattttgaccttcactgtgtatcgtcggcggaaacaaaagcttggaagcacatttgatatctctgaaggctgtctaagtacagatcaagccaagagtatatacaggaaaaatggatctcctttggtcagccttgagtactctaatggatgggaccctttggctgacagcaagaatttcagcggggataggcaagacatgttccagagtttcaggttcaacttggaagaaatggagtcagctactcagtatttctccgagttgaatttgttggggaagagcaactttagtgcaacgtataaaggagttctaagagatggatctgttgttgctgtcaagagtatcagtaaaactagttgcaaatcggatgaagctgaatttttgaagggattgaacatcttgacctcactgaggaatgagaatttagtgaggctgagaggattttgttgttcaaggggacgaggtgaatgcttcctggtttatgattttgtttctaatggaaatctgacacgctaccttgatgtgaaggaaggtgatggagaagtccttgaatggtcaacaagagtttctattgtgaaagggattgctaaaggtatagcatatttacatgcatacaaagcaaacaaaccagctcttgttcaccaaagcatctcagctgagaaagtgctcattgatcagcggtacaacccattgctttcagattccggcctgtacaagcttcttaccaatgatgttgtcttctccgcgctaaagggtagcgcagcaaagggctacctagctccagaatacaccactaccggccggttcactgagaaaagtgatgtttatgcatttggagtccttcttttccagatcctcacggggaagcagaagatcacaagtgcaatgcgccttgctgctgagtccttcaaattcccagaatttattgatcctaacttgcgtggcaagttcttcgaatacgaggcggctaaactagcaagaatggccttactttgctcccatgagtctccatttgaaaggccgagcatggaagccattgttcaagaactgggaaattgtagtagctgtctttaa

SEQ ID NO: 2987 - DNA, 870 bp, Glycine max var. Williams 82
atggcttcccttgcagcatccactgctgctgcttcccttggcatgtcagaaatgcttggaaaccccatcaacctcagtggtgccacaaggccagctccatctgcctctagccctgcctccttcaagactgtggctcttttctccaaaaagaaggctgcacctccaaaaaaagctgcagctgctgctcctgccaatgatgagcttgccaagtggtatggtcctgacagaaggatcttcttgcctgagggtctcttggaccgatctgagatcccagagtacttgaccggagaagtccccggagactatggttatgacccatttggtcttagcaagaagccagaagatttttccaaatatcaggcatttgaattgattcacgccagatgggcaatgcttggtgctgctggattcatcattcccgaggccttcaacaaatatggagcaaactgcggtcctgaggctgtttggttcaagactggagctctgcttcttgatgggggtaccttgaactacttcgggaaacccatccccatcaatcttattgtggctgtcattgctgagattgttcttgtgggaggtgcagagtactacagaattattaatggcctgaatttcgaagacaaacttcatccaggtggtccatttgacccattggggcttgcaaatgatccagaccaagctgcactgctaaaggtgaaggaaattaaaaatggaagacttgctatgtttgccatgcttggtttctacttccaagcttatgtcactggagaaggtcctgttgagaaccttgcaaaacatctcagtgacccttttggcaacaacttgctcactgtcatttctggatctgctgagagagctccaactctctaa

SEQ ID NO: 2988 - DNA, 933 bp, Glycine max var. Williams 82
atggctaatttgctgacaatgttttttgttatggaaatgatagtagtgagtggtttcagttttggagcaagtggcttgagcatgaattactacttgttgagttgccctattgctgaacctgttgttaagaacactgtcaacacagctctgcaggatgatcccaccctagcagcaggtcttgttagaatgcacttccatgactgtttcatagagggatgtgatggttcagttctgattgactccactaaggacaacacagcagaaaaggattcaccagcaaacttgagcttgagaggctatgaagtcatagatgacatcaaggaagagcttgaaaaacaatgcccgggagtggtttcatgcgctgatattgtcgctatggctgctagagatgcagttttctttgcagggggtcctgtatatgacataccaaaaggaaggaaggatggaacaaggtccaaaattgaggatactatcaatctacctgcacccattttcaatgcttctgagctcatcaagatgttcggacaacgtgggttttctacaagagacatggtggctctatcaggagctcacacattaggagtggcaaggtgttcttcattcaagaacagactgacccaagtggactcagaatttgcgaagacactctccaagacatgcagtgcgggtgacactgctgagcaaccctttgactccacgaggagcgattttgacaaccaatacttcaacgctttggtctcaaacaacggggttctcacatcggaccaaacgttgtacaacagcccacaaaccaggaacattgtgaacgcttatgcaatgaatcaagccttgtttttcttggatttccaacaggcaatggtgaagatgagcatgctcgatgccaaacaagggtccaagggggaagtacgaaaaaattgtcatcaaataaattaa

SEQ ID NO: 2989 - DNA, 996 bp, Glycine max var. Williams 82
atggcttctgaactcaccaaactgatccttccatggaaagttcgcttactcatttccctcctttccaccctcgccgacacctctcgccgctccaacgccaccatcaaccgccgcctctttaacctcgctgaccgccagtcactgccaaaccccacccccgtcgacggcgtttcctcctccgacgtcaccgtcgatcccgcccgcaacctctggttccgcctcttcgtcccctcctcttcctccgccaccaccctcccggtcttcgtctacttccatggcggcgccttcgctttcttctccgcagcttcaaccccttacgacgccgtttgtcgtctctactgtcgctcccttaacgccgtcgttatctccgtcaactaccgcctcgcccctgaacaccgctacccctcccaatacgacgacggtttcgacgtcttaaaattcatcgaccgaaacggcagcgttttacccgacgttgctgacgtcaccaaatgttttttagcgggtgatagcgcgggtgcgaacctggcccaccacgtggcggttcgggtttctaaagagaagctacaaagaaccaacattatcggcttagtttcggttcaaccgtatttcggaggagaagagagaaccaaatccgaaatccaattaaaccgggcacccattatttcggtggacagaaccgattggcactggaaggtgttcttgccaaatggatcggaccgggatcatgaagcggttaacgtgagtgggcccaatgccgtggatatttcgggtttggattatccgaatacgattgtgtttatgggtgggtttgacccgttgcgtgattggcaaaggaagtattatgagtggttgagggaatcgggaaaagaggtggagttagtcgattatccaaacacgtttcatgctttttactttttttctgaattgcccgaaacttctctgtttgtttatgatgtcaaggagtttatggccaagcaaatggccaatgtgaattga

SEQ ID NO: 2990 - DNA, 1573 bp, Glycine max var. Williams 82
ctatttgatatcatgaatgatattgacatacaccataatccccgagaatgtttttgcttcagtgtattttctatacaaacacgtaagaaaaaaaaaaaaacagttggaagctgtagtagggtaatgtaagttgtttatctgcttttctcatctcataaaactatatatacaacacatcctcagtcttattactcactttcattctccgagccaaccgagttaactcactaacaatcacatggcttctgaactcaccaaactgatccttccatggaaagttcgcttactcatttccctcctttccaccctcgccgacacctctcgccgctccaacgccaccatcaaccgccgcctctttaacctcgctgaccgccagtcactgccaaaccccacccccgtcgacggcgtttcctcctccgacgtcaccgtcgatcccgcccgcaacctctggttccgcctcttcgtcccctcctcttcctccgccaccaccctcccggtcttcgtctacttccatggcggcgccttcgctttcttctccgcagcttcaaccccttacgacgccgtttgtcgtctctactgtcgctcccttaacgccgtcgttatctccgtcaactaccgcctcgcccctgaacaccgctacccctcccaatacgacgacggtttcgacgtcttaaaattcatcgaccgaaacggcagcgttttacccgacgttgctgacgtcaccaaatgttttttagcgggtgatagcgcgggtgcgaacctggcccaccacgtggcggttcgggtttctaaagagaagctacaaagaaccaacattatcggcttagtttcggttcaaccgtatttcggaggagaagagagaaccaaatccgaaatccaattaaaccgggcacccattatttcggtggacagaaccgattggcactggaaggtgttcttgccaaatggatcggaccgggatcatgaagcggttaacgtgagtgggcccaatgccgtggatatttcgggtttggattatccgaatacgattgtgtttatgggtgggtttgacccgttgcgtgattggcaaaggaagtattatgagtggttgagggaatcgggaaaagaggtggagttagtcgattatccaaacacgtttcatgctttttactttttttctgaattgcccgaaacttctctgtttgtttatgatgtcaaggagtttatggccaagcaaatggccaatgtgaattgaagggtattttagtacgttaattatttgtctatgttgtatatgaaggttggaggaaaaaagggaaggacatgtaacatgtattgtatgcaaatagagtattgctatgatggttgcgtgatgatatcagtttgataaatgataattgctatgcataagaaaaaagagataatttattattcaacttcccatagagagaatacactctagggcactttcattgaacgaactcattcattttggagtgatcctttcacttcttttttatttttctccattctcttttatcacctttacttctttttgtaattctaagttttttttgacaatgacaaactaaat

SEQ ID NO: 2991 - DNA, 645 bp, Glycine max var. Williams 82
atgaaggtttccattgccaagttccactcccttcccctatgttttttccttctcttggccttcaacacaaaacccctcctagcagcagaaccagagccagtggttgataagcaagggaaccctttggagccaggagtagggtactacgtgtggccactttgggctgatgaaggaggcctcacactaggccaaacaaggaacaagacatgccctctttatgttatccgtgacccttcattcattggcaccccagtttcattcttagcaccaggccttgaccatgttccaacactcactgatctaaccattgatttccctgtggtgacagtgtgtaaccagccaacagtgtggaggctcaacaaggtagggtcagggttctggtttgtgagcaccagtggtgaccctaatgatatcactagcaagttcaagattgagaggcttgaaggggatcatgcttatgagatctacagcttcaagttctgccccagtgtgcctggtgcgctgtgtgctcctgtggggacttttgaagatgctgatggaaccaaagtcatggctgtgggggatgatattgagccttactatgtgaggtttcaaaaagtctccatctttggtcaagacaagaaacaaccttttagcattttgtag

SEQ ID NO: 2992 - DNA, 615 bp, Glycine max var. Williams 82
atgaagaaggtttcacccttggcattttccattctctttttggccttcaccatagaaccctttattggcattgctgcagcagcaccagaagcagtgcttgacacctcaggccagaagctgagaacaggtgtcaagtactacattctgccagtgttcagaggcaaaggtggaggcctaacagtttcaagcagtggcaacaacacatgccccctctttgtggtgcaagagaagcttgaagtctcaaagggcaccccagttaccttcacaccctacaatgccaaaagtggtgtcatactaacctcaaccgatctcaacatcaagtcttatgggaaaaccaccacttgtgacaaacccccagtgtggaagctcctcaaggtgctaactggggtgtggtttttgagcactggtggtgttgaagggaatccaggggttaacactgttgtcaattggttcaagattgagaaggctgagaaagactatgtgctttctttctgtccctcgtttgcacagactttgtgcagggaacttgggttgtatgttggtgatgatgggaacaagcatttgtctttgagtgataaagttccatccttcaaggttatgttcaagagggcttaa

SEQ ID NO: 2993 - DNA, 1623 bp, Glycine max var. Williams 82
atggaagaggagcaaaaactggttaaagggaccacaaatttggagggaagtgaaagtgaggccaaacttgagctcacagtggatgaagtggtggaggagtatgtggggtccttagggttctctcagatggtgcatgtgttcttggtgtcattggcatggatatttgatgctcagagtactttggccacaatcttcagtgatgctcaaccacctgcttggaggtgcaaaactggattgtgtcatggtaacaacaatagcactgggtctgtctgtgggttggtgcctggtacttgggaatgggttggtggcaacacaagttccatcatagctgagtggaatcttgtatgtgatagaaggtttctggctgctgttcctgcttctgtctacttccttggctcgctcataggttctggtgtctatggccacctctctgattcatggctaggcagaaaaaaaacagtgcaactttcctgcatcttaacctccataacagcctttgccacatctctctctccaaacatttggacctatgtcttcttccgttttgccaatggctttacaaggtcaggaattggcatatgctgccttgtcctaaccacagaatcagtaggtcgcaagtggcgtggccaagttggccaatacggcttctttttcttcacaatagggttcctcacactcccccttgtggcctatccaacaagaacatgttggagaaacttgtacaaactcttgtcacttcttcccctagcatattctctcctattactccctttggtctcagagtccccacgttggcttctaataagaggcagagacaaagaagcccttcaagttttggacagatttgctaggctcaatggcaagaaaaaactccccaataacctcactttggttaacccttgtggatcatcatgtgatgaaacaagtcctaataacaacaaagagaacctttggaccacaaaatgggcagctattaggatggtcactgttatgttagctggctttggagttggttttgtttactatggagttcaactcaatgttgaaaacttgaacttcaacctctatgtctcagtggcaatcaatgcacttatggagattcctgctgtggtgattggtacctttctattgggatttactaatagacgtttgttgttatctgtgtcctcttatatagctgcagtgtcctctatattatgcacatttttttcacacaaaggaggcacatcaaaagtgcataacaacaatagttatggtggtaactggggtcaattgattattgaggcaattggattcatgggtgcttccacagcatttgacattttgtacatctattgtgtggagctttttcctactaatgttaggaactttgctgtgtcaatgctgcgccaggccattatgttgggggcttctgtggcacctttacttgttgtcttgggccgtttgagcccatctctctctttcctagtgtttggtgtctttgcaatttcaagtggtgttttgagcatttggctacctgagactagaaatgctcctctctatgagaccctgaagcagcaagaggaggaggagaaacacagttggatgtctcaaaatgattgtgccctagagatgggaaaataa

SEQ ID NO: 2994 - DNA, 2301 bp, Glycine max var. Williams 82
atggctaatttagaaaatgacaagctgccgatgctgtcagatatagatgcacaaccatatgatgaacccttggactctaaattcaaaaggacagtaaccaggacacatagcgcatcagtttctatttctatgagttccttggagtcatatgagaaagaaactagccttgtaggacatactggtccacttcagagcaagaggaaaacaccctttatgcagatgagtggtccattgtatgctaccactggaactggaaatcttctgcagaagcatattgtatcaggaaacaaagcaaaggaaagaacaacagataattttgctacacaccatgacacaggttcaaattactggaataacgactatgatagaaaaaatgaacacttactaaagtctgggcaactgggaatgtgcaatgatccttattgtactacttgccctacttacttcaacgcttctcagcagagaaatccaaaaccttcaactagatgggatccaaagttccataatgctctttatggggatgccaagagttttgtcagaaaacttctttctttctgctattcgtatgttcctggagttatgaaccctcatgctaaagttgtacaaaaatggaacaaatgtttggccattttttgcttgattgctatttttgtggacccactatttttcttcttactctatgtggagaaggataataaatgtattgttatcaactggcctttgacaacagcacttgttttatttagatgcgtgaatgattttgtttatttccttaacattcttctccagtttaggttagcttatgtttctcgtgaatcgagggtggttggtgctggagatttggttgaccatccaaagaagattgctcttcattacctaaagggttatttccttattgacttatttgttgtatttcctcttcctcagataatgatattgtttgtcctaccaaattccttggagggagcaaattatgccaagaatcttctgcgtgcagcaatcttagtgcaatatatccccaagttgttcaggtttctgccactgctaattggccaatctccaatgggattcatatttgagtcagcctgggcaaatttcgtcataaaccttctcatttttgtgcttgctagtcatgttgttggctcttgctggtacctcttcggtcttcagagggttaatcagtgtttgcgggatgcctgccatagttctaatatacctgaatgcatgaagttcattgattgtggacgtggccatggaaacaatcagcctggcttaagatcagatcagtggatcaacaatacccaagctgtcgcttgtttggatccctctcctgatggtttctcttacggaatttatgagaatgctgtaccacttactatagaaactaatgttgtcaagaaatacgtgtattctcttttttggggattccagcaaatcagtactctagctggtaatctagaacctagctattttgtgtgggaagtcctttttactatggccatcataggaatgggactcttgctttttgcaattcttattggaaacatacagaactttctgcaggctcttggacggaggaagctggaaatgcaacttagaggccgggatgttgagcaatggatgagccatcggcgcttaccagaagatctaagaaggagagtaagacgggctgaacgatacaattgggctgcaacaaggggggtgaatgaagaaatgcttatggagaatttgccagaagatctccagagagacataagacgtcatctcttcaaatttgttaagaaaattcggctttttgctctgatggatgaacctatcttagatgccatttgtgagagactaagacaaaagacatacatcaaaggaagtaaaattctaagtcagggtggtctagtagagaagatggtattcgtggtgcgtggcaaattggaaagcattggagaagatggaactagaattcctctatctgaaggggattcttgtggtgaagagcttctgacatggtatcttgaacattcttcagttagcacagatggtagaaaagtaagacttccaggacagagattggttagcaacaggacagtaaggtgcttaacaaatgtggagtcattttcactctctgcttcagacattgaagaagttacaatccttttcacaagattcttgcggagtccatgcgttcaaggagccctaaggtacgagtcaccttattggagatcccttgctgcgacccgcattcaagttgcttggagatacaggaagaaacgtctaagtcgtgttaattcctcaccgtcagattaa

SEQ ID NO: 2995 - DNA, 1500 bp, Glycine max var. Williams 82
atggttctcacatccactgccacacacccagatgaacaagaccagagcctaaactatacttttgcttccagatatgtgcgtgaacctattccaaagttcaagatgccggagaaatccataccaaaagatgctgcttatcagataataaacgatgagttgatgttggatggtgcaccaaggctcaacttggcctcgtttgtgaccacttggatggagcctgagtgtgacaagctcataatggcttcacttaacaagaactacgttgacatggatgagtatcctgtcaccactgagctccagaaccggtgtgttaatatcatagcaaatctattccatgctcctataagtgatgatgagactgcagtaggtgtgggaactgtggggtcatcggaggcaataatgttggcaggtctagcttttaaaaggaaatggcagacaaagagaaaagcagaaggcaaaccatatgataagcccaacatagtaactggggctaatgtgcaggtttgttgggaaaaatttgcaaggtactttgaggtagagctcaaggaagtgaaactcaaagaaggatactatgtgatggaccctgcgaaagcagttgaaatggtagatgagaacaccatctgtgttgcagccattttggggtcaactatgaccggagagtttgaggatgtgaagcttctcgatgaacttcttactaaaaagaacaatgagacaggttgggataccccaattcatgtagatgctgccagtggggggtttattgccccatttctatatcctgatttagagtgggacttccgtttgccgttggtgaaaagcatcaatgttagtggtcacaagtatggtcttgtctaccctggtgttggttgggttgtatggaggagcaaagatgacttgccagatgaacttgtttttcacataaattatcttggatctgatcagcccactttcacattgaatttctccaaaggatctagtcaaattattgctcaatattatcaattgattcggcttggctttgagggttacaaaaatatcatggaaaattgctgggagaatgcaagagttctgaaggaaggaatcgagagaacaggtcggtttaacatcatctccaaggatatcggtgtgccacttgtagccttctccttgaaagacagtagtcaacacacagtgtttgagatagcagaccatctgagaaaattcgggtggatagttcctgcctatacaatgccaccagatgctcaacacattgctgtccttcgggtggtgatcagggaggatttcagccgcggcttggccgagagactcgccgctgacatagagaaagttgtgaagctcttggacacacttcctagccccctcactaccaaagctgttcatatcacagctatcactagtgagactggtgagaagattaagaaagctgcaatagagactcagaaagagattgctttctactggaagcgacttgtggatggcaagagacttggagcatgctag

SEQ ID NO: 2996 - DNA, 1488 bp, Glycine max var. Williams 82
atgaacagcaggaatgtgaatgtgaatcagcatcatcaccgcagaggtcacagcttcaatggctctgccaacatccatcccatctccaacacaattaattcttcccatggaaaactggggaaactctcgtttgaatcagcaaaactggccacaagtgggattgatgatctattgtcatccacagaaggaggaaagcatgactatgattggctccttactcccccggggacccctcatttaccatcatcagaaggtgaatcccaaccaactttggtgcctccaagaagcagtttgggtagattaaagtcaaacattagtgtctcaaggctttcagtctcacaatcagagaacaacaatcattctcattctcactctagaccatcaagaagtggttcagtgactcgcagtccaaacagatcctcttccatccttaacacaaggccatcctcccccataactgcggcaaggctttccactccaacctctcgcacaacatcaacatcaacaccccccagagtactactaccacgctcatttccaagtccaatcaacacatcatcaactgacaccaacaaaactagaacatcacaaggctcaaggccatccactccaagctcaacttcaaagccatccattcctgccactttgcggccctctacccccactcgacgccattcactgccatctccatcgccttcagtcacacgtgtggggcgtaatccagctacaccgcgtctccagccagttgtccctcctgattttccccttgaaacaccaccaaacctcagaacaacattgcctgctgataggcctgtctctgcaggcaggtctcgtcctggtgctgttgttactcttccttcgaagccaaactcagaaatgcaagccccagttaacatgtcaaggagacagccatctcctattgccaataggggcagactgtcagagtacacagcaaaaagccgcggccatgccaatgctgctgatgcctctgaggtagttgctagaagatctgctaagtcttcaactactgcctcagaaaacaatgtattgggaaggaccatctcaaagaaatcattggatatggctattagacacatggatgtgaggaacagctcaggaactcttcgttcagttccaagcgccacactctatcctcagagcattcgaacttcaactcccaagacacaccacactagaggtttgagtgttccagtgtcaatgaacattaacggaagcctccaaagcagaaataataataataacaataataggaaaaatggaagagagataggtgaaaggcaaaagcaatacttgggaaaattgagtgaagtagtggatgtgtacgagagttatcgttatgattcactgttgcttaaagaagacttaaacaacacaaactggctgcgtagtgttgatgataaatgtgatcaaggacccatctttgacaatggatttgagtacctgcctgaaccttttggactcttttag

SEQ ID NO: 2997 - DNA, 963 bp, Glycine max var. Williams 82
atggcaatggcagcccaagccatggctcaattccgtttctctcctctatcttctcattaccgttaccattaccagtacaattaccattccaccccttctttcccgtccccgcgacgtcacccccgcaaccaaaggctccacctttccttctccggcggagacagaggcggaagcggcggcggcggaggaggaggagattccgatggaggaggaggcgacaacgagaagaacgtgggattgggagttgtgggaatggtgttaaacggatggagatcgagagtagcagcggacccacaattcccattcaaggtgttaatggaggaactggtgggagtgagtgcggcggtggctggtgacatggccacgcggcccaagttcggtctgaacgaactggacttggttttctcaactcttgttgtggggtccattctgaatttcatcctcatgtatctgctggcaccaacgtcttgttcttcttctagctccacactaccatggatcttcgccaggtgtcccagcagccacatgttcgaagcggggccttacgggagcgtggagcgtttggggactctgttgtacaaggggggcgtgttcgcgctggtggggcttggcgccgggcttgtaggaacagcgatatcgaatgggctgatcgcgacgaggaagaaggtggacccgacgttccagagcccgaacaagtctccccctatggttctgaacgccttcacttgggcggcgcacatgggtgtgagcagcaatgtgaggtaccagactctgaacggtgtggagtttcttttggacaaatggcttcctcctttgctcttcaagttctctgttttggctcttagattcatcaacaacgttgctggagggatgacctttgtcatgctcgctaggttcaccggctctcaggctgctgctgctgctgctgttcctgttcctgttcctgttcctaaacactcttaa

SEQ ID NO: 2998 - DNA, 1725 bp, Glycine max var. Williams 82
atgaatggccacaaaaagttgaattctccaaggggagaggttggagagatagacactagggcaccattccaatctgtcaaagctgctgttagtttatttggcgaagtagccatcactagagacagattttctgtcaagagaagatcatcagagaatgtatttgaaaaggagacgcagcttatcttggcccaaaaggaattaaacaagataaagaaacaggtggataatgctgaggccatcaaagccaaagcactttctgagcttgagaatgccaaggagatccttcagagtttgacaagcaagctggccaacgtgagagaatgcaaacaatctgcaatgcaagcagctgaattggtgaggaaccagagcaagcgatttgaaaagacactatcgctaaaagccgtgggatatgaagcttggagaaaagaactagaacatgcaagaaaagcgtacactacgactataactgaactagattcttccaagcaagaactcaccaaaataaggcaggattttgatgcagttttggaggcaaagctggcagcacttcaagcagcaggagaggctcagcgttcagcaaaattaaactcggaaagaatcagtgaactctcaaatgaaattgcaaccatgaaagcatcaattgaacaagtgagacttgcctctgaacaatcccaagaagaaagtgaagcccaacttgttggttattacaaaactgccaaggaagaagcacagaaaaacttggagtccttaaagaatgaatacgacactgaactcatgcaaagtctagatgccaaacttgctcaaacaagtgctgagattgagtttcttcaagagcagattaagaagctgcatgcttctaagatggattctgtgaggcttctaacttcagagcttaaagaagccacaaagacacttgaggaggttgctgaagaaaagaactcccttaagaaactggtgttttctcttaggacagaattaaagcaagttaagaaggagcaagatgaagtgaaggagaagggacatatagcagaagctcttgctgctaacctcactggtaaactacaagggagcatgagagatgcaaggcctaagccaggcactgttgatgacttagaagcaaatatgttctatgtgcagagtgcgaagattcggaagctacaattggaaactgaaggtgcaataagagaagcagaagagacgaggagaaaagttcaagagctgaagcaagaagttgaaaaatcaagggctgtggctgaagaagcagaggaaaaacttgagctcgttctggtggaggctaaagaggcaaaagcagcagaacaaagagccgttaaagagatgaagattttgtctgaagtgggtagagtcccgtactcaaaattcaatggcaagatcaagatgtcaaatgaagagtttgaggcactgagagcaaaggccaaggagtgtgaggatttggttgaaaagaaagaggcaattgtgatggcagagctgcaggaaatctatgcaagaaagaatgaagtggacagaaaggtggaaactaatctgaaggcaattgaggaaacaaaggctgcagaggagacggctttgtggagtgcagagatggcagattctgcaaaagtggcaattgaaagtgaactgaggaggtggcatcaacaacaacaaaaggtgataccaggtgctgcttctcagaaattggagcattctgcagcaccaatcttgaccatctag

SEQ ID NO: 2999 - DNA, 1281 bp, Glycine max var. Williams 82
ctgctcagcccaacattgctccgatggacagaaaggcagggagagagagagagagagagtgcgtgttgggttgtgttgtgagtgcataaataaataaataaaaacaattgtttcaacattcaaattggcatcattaagatctgtgttaaccactaaaatctctgaagcagagggcattgtctactgtcacaggcatgggtgaaaaagacgaaggaaacaaagaagaagccaaagaggaaaagaaggaagaagagaagaaagaggagccaccaccggaaatagtgctcaaagttgatatgcattgtgaggcctgtgcaaggaaagttgcaaaagcattgaaaggattccaaggagtggaagaggtgagtgcggatagcaggacaagcaaagtggtagtgaaaggaaaggcagcagaccccataaaggtgtgtgagaggctacaaaagaaaagtggtaagaaagtggagctgatttcacccttgccaaaacctccagaggagaaagaagaaccacccaaagaagaaccaccaaaagaggagaaaaaatatgagcctcctcctgtggtaacagttgtcctaaaagttcgaatgcattgtgaagcatgtgctcaagttatacagaagcgaatccgcaagattaaaggagtagaatcagtggaaacagacttggcaaatgatcaagttatagtaaaaggtgtggtcgaccctgccaagcttgttgatcatgtatataagaggaccaaaaagcaagcctctattgtgaaggacggagaaaagaaggaagaagaaaagaaagaagaggagaaaaaggaagagaaagaagaagagaaaagaggtgaagaagaaaacaagggaggagaagataacaaaactgaaatcaaacgaagtgaatactggccatccaaaaactacatcgactatgcttatgaccccgagattttcagcgacgagaacccaaatgcctgctctgttatgtaaaccagcaagtaattccgtatttcagttggaacagtaattagctgaagtagttttcttttcaatgtttttctaagaatatgtaccagtgtgagtatgttaagggtacattggttcctttacatagcgtccctcaaagttagatgtcttatttcttgtgcttttgaggtttcaagtagtatattcgttgccatatcagtttgtgtaagtgttaacatgcttcagtgaattttggcctaaaatctctttgcccatgaatgttgacgttgaaaattgcatgcaatggtctctctttaagaattttccg

SEQ ID NO: 3000 - DNA, 504 bp, Glycine max var. Williams 82
atgaaaagtgttagcctgagaccagagcttcacattccaatttgttcttcaaaccctccatcatgtgtcaaaccaataaaactagtggtagtatcatcgtatgggaaaaagttgaaacatccagcttcgaaattggcaatgactcatagagagcacacaacaactttgccattactgaaacatgattctagcattgtgatgatgggagcggtgtgtgtgggaattttggtggtggttctgagcgaggaaaaggccttggctttgggcccagaaggcccacttgtggaagagttctgggacaacgtgaggagatatggactctacgctctcaccgtcagcacaggtgccctttacaccatcttccgccctatagtggaacttctcaagaatcccatttctgcaattttcatccttcttcttttcggggcttccttcttcattgtttctcaagttctctctgccatggttggtgtttctgaattttcttacgactttggatactag

SEQ ID NO: 3001 - DNA, 1521 bp, Glycine max var. Williams 82
atggcagtcctatcttccttggcagtcatcaccttcttcctttcactcttggtgctttttcttgcaaagaactacaagcaaaagagtctccataaactgccaccagggccatggaagctacctattatagggaacctgcttcaactagcagcagcaagttcacttcctcatcatgctatcagagaattagctaaaaaatatggacccttgatgcacttgcaactaggtgagatttctgcagtgattgtatcatctcccaacatggccaaggaaataatgaaaacacatgatcttgcttttgcacagaggccaaaatttcttgcttctgatatcatgggctatggatcagttgacattgccttcgctccatatggagattattggagacaaatgaggaaaatatgtacgttggagcttctaagtgcaaagaaggttcagtctttctccaatattagagaacaggagatagctaagctcattgaaaaaattcagtcatctgcaggtgcaccaatcaatctcaccagcatgattaactctttcataagtacctttgtttctagaacaacattcggtaacataactgacgaccatgaagaatttttattgatcacaagggaagcaatagaagtggcagatggctttgatcttgcagatatgtttccttctttcaaacctatgcatctcataaccgggttgaaagccaaaatggataagatgcataagaaggttgacaagatcttagacaagatcataaaggagaatcaagcaaataaaggcatgggagaagaaaagaacgaaaatcttgttgaggttcttttaagagtccaacacagtggcaaccttgataccccaattacaaccaacaacatcaaagctgtgatttgggacatatttgctgctggaacggatacatcagcaaaagtaatagattgggcaatgtcagaaatgatgagaaacccaagagtaagggagaaggcacaagctgagatgagaggaaaggaaacaatccatgagagcaacctaggagaacttagctacctcaaggcagtaataaaagaaaccatgaggttacacccacctcttcctttgttgcttccaagagaatgcatagaagcatgcaggattgatggatatgatttacccaccaagaccaaagtcatagtgaacgcatgggcaattggaagagatcctgagaactggcatgatgcagacagctttataccagaaagattccacggtgcatctattgatttcaaaggaatagactttgagtacatcccttttggggcaggaaggagaatgtgcccgggcatttcatttggtatagccaatgtggagtttgctctagccaaattactctatcacttcaattgggaactccaacaaggaacgaaaccagaggagtttgacatggatgaatcatttggagctgtggttggaaggaaaaacaaccttcacttgattcccattccatatgatccttcaatccatgataatggcaaaggaggcaccttcatttaa

SEQ ID NO: 3002 - DNA, 624 bp, Glycine max var. Williams 82
atgggtagtagactctgcgttctgctgtgttaccatatatcagatggcaacaatttgaagaaagagaagcaaggaatgtattgcaagatatcgaaaagaaagaaggagatggagacagaagagaagaaggtggttccaaatctgactctagaagattggatattagcttctcctggtttgaagccagactacattaatataagatcaggagaattctcttcttcatgttcatctaagtctaagaaaaaggtgcacccttgtgtgagtcaagttcctagatcattgatagctgaagctaaagacagtttatgcctggacagacccatgaaccgtaatgaagaaatgttaagttccacatcaattggtagaagcataagtgagaaatcacagaaaaaagtgagctttaaactccctcataatgtcatattttactcacctgatgagcctcgctccccagaggagaaagagccttattattgctattattataatagcagtgaaagtgaagactcattctactcatcaatctgcagagaatattcatttgactcttctgcagaggaaaccttgatcaaactcgcagtggatgttcttcctcatgtttctgtctcttccaaaatttga

SEQ ID NO: 3003 - DNA, 1224 bp, Glycine max var. Williams 82
atgagggggggcttgtggcaacttgggcaatcgatcactcgccgtcttgcccatggagataagaaggctgttgctcgtcgatgttttgcctcagaagctgagctgaaaaagacagtgtttcatgacttccatgttgctcatggtgggaagatggttccatttgctgggtggagcatgccaatccaatacaaggactcaatcatggactctaccatcaactgtagggagaatggtagcctctttgatgtttcccatatgtgtgggctgagcctcaaagggaaggacgctgccccattccttgaaaagctggtcattgccgatgttgctgggcttgcccctggaactgggacgttgactgttttcacaaatgaaaagggaggtgcaattgatgattcagtaattactaaggtgacggatgaccacatatatttggttgtgaatgctggctgcagggataaagatctggctcatattgaggaacacatgaaagcattcaaggccaaaggtggtgatgtgtcttggcacatccacgatgagagatccctacttgctctgcagggtcctcttgctgcccccgttcttcaacacctgacaaaagaggatttgagcaagctctactttggggagttccgtgtgttggacatcaatggctcagagtgttttcttaccaggacagggtatactggggaagatggatttgagatctcagttccttcagagcatggagtagatcttgccaaagcaatactggaaaaatctgaagggaaggtaagattgacaggattgggagctagagatagtctgcgacttgaagctggattgtgcttatatggaaatgacatggaacagcacattacacctattgaggcaggactaacatgggctatagggaagaggaggagagcagaaggtggttttctaggagctgatgttatcctgaaacagcttgaagaaggtcctaaaatcaggcgtgttggtttcttttcttctggtccacctcccagaagccacagtgagattcaagatgaaggaggcaacaacattggggaaatcaccagtggtggattcagtccttgcctccagaagaacatagccatgggatatgtgaaatctggattgcacaaggcagccaccaaagtaaagattattattcggggaaaacccaatgaaggagtcgttacaaaaatgccatttgtaccaacaaaatactataagccttcctga

SEQ ID NO: 3004 - DNA, 1650 bp, Glycine max var. Williams 82
atgagaccatgcaaatgcaaatgcaatgttctctctgctctcattcttcttgtcacattcctttttattgcttcttccgtccactgtgaagacccatatcggtacctcacttggaaggtcacctatggtgacatctatcctcttggtgtcaagcaacaagggatcttaattaatgggcagtttccagggcctcaaatagatgctgttacaaatgacaacttgattatcaatgtctataactacctcagagaaccgttcctcatttcatggaatggcttacagcataggaggaactcatggcaggatggagtgtatggcacaaactgtccaatcccacctgggaggaacctcacatatgctatccaggtaaaagaccagattggtagctatttctacttcccatctcttggaatgcacaaagctgctggagcatttggtggcatcagaatttggagccggcctcaaattcctgtcccttttccttctcctgccggggacattaccatacttgctggagattggttcaagcttgaccaccgaagactgagacgactcctagagaatggtcataatctccccttccctgatggccttcttatcaatggacgtggttggaatggaaacaccttcactgttgatcaaggtaagacttatagattcaggatatcaaatgtggggctcacaacatcaatcaacttcagaatccaggggcacagtttgaaacttgtggaggtagaaggatctcataccctccaaaacacctattcttcccttgatgtccatctcggacagtcctattccgtgctggtcacagctgatcaacctgtcaaggattactatatggttgtctctacaagatttaccagacggatactcacaacaacttccgttcttcattatagctattcaaaaacaggggtatctggtcctgttcctccagggcctacccttgatattgcatcgtctgtctatcaggctagaactatccggtggaacctgacagcaagtggaccaagaccaaaccctcagggatcataccactatggattgatcaaaccgagtcgaaccatcatgcttgcaaattctgctccttatatcaatggcaagcagaggtatgcggtcaacggtgtctcatacaatgaaccagataccccattgaaacttgccgactacttcaacatccctggagttttctacgttggaagcattcctacctatcctaacgggggcaacaatgcctacctccaaacttctgtcatgggggctaatttccatgaattggtggagattgtattccaaaattgggaggattctgtgcagtcatggcacattgacggctattccttctttgttgtagggtatggtagcgggcagtggacagcagacagtagagtacaatacaatctgagagacacagttgctagatgcaccactcaggtgtatccaaggtcatggactgcaatctacatggctcttgacaacgtgggaatgtggaacataaggtccgagaattggggaaggcagtacttaggacaacaattgtatctgagggtgtatacaccttccaaatcatggagggatgaatatccggtgccaaagaatgcgcttctatgtggcagagcaagtggtcgtcgcacaaggcctttctaa

SEQ ID NO: 3005 - DNA, 1689 bp, Glycine max var. Williams 82
atggccaagtccaccgctcctccggataattatggtcacagtccagttcactacgccgtcgcattgggcgaccacaccaccctctccagaatcatatcctcactccctcgtctccccgatccctctcttattcaaacagaatccgattccctcgctcaagaaaaaatcgccgatcagatctccctcgtcctcgaccgccgcgacgttccttatggagaaacccctctccacctcgccgtccgactcaacgaccttttttccgcccgcgccctcgccaccgccggcgccgacgtctccctccagaactccgccggctggaacgctttgcaggaggcgctatgccgccgcgcctccgacatcgcgctcgtcctcctccgccttcaccatcgcaacgcctggtccaagtggcgccgtcgcctcccgcgggtcatcgccgcgctacgccgcatgcgtgacttctacatggagatctccttccacttcgagagctccctcattcccttcgtcggaaagatcgctccctccgacacctacaaaatctggaagcgagacggcaacctccgcgctgacacctctctcgccggcttcgacggcctcaagatccagcgcgccgaccagagcttcctcttccttggagacggcgatcacacgcacgacgtcccctccggttcgctcctcgtcctcaaccgcgacgaccgcaaaatcttcgacgccttcgagaacgccggaggaccgatgaacgagtccgacctcgccggattctgctcgcagactagcgtgtaccgtcctggcatggacgtgacgaaggcagagcttgtaggcagaatgaattggcgaaggcaagagaaaacagagagcgtgggagagtggaaggcgaaggtgtacgaaatgcacaacgtggttttcagtttccggtcacggaaagtggccggcagcgagtctgacgtggcagggagcgagcaggtgctgccgttggaactggacgaagacgacgacggttttctcgttgcggagaatccgaatttcgggttcccaatgccagacaagagaagacacagtagcttcgttcgagaagagacagagtgggtcccaatgggaaggaaaagcctcgacctaacgtccgtaacggccccacagccgcgaagcgtgaccatgcctactcagaccaaggaaaaggagtacgttagaagcttacggccgtcagtgtggctaacggagcagtttccgttaaagaccgaggagcttctgccgttactcgacatactcgccaataaggtcaaagcagtgaggaggcttagagagttactcactaccacgttcccgccgggaactttccccgttaaggtggctataccggtggtccctacagtgagggtggtgattacgttcacaaagttcgtggagctgcaacctctggagcaattctacactccattctccagtccaaggcatttgctcagtgccgcaggggcaggcagaggagatgaggaacagagcaaagcagaaaacaggtgctcttcttcgagctcatcaacgtggctgagacgaaataatagcgtgtcgaataaacaacgatgtatggcatttgattcagacccttttaagattcctgcgggatacacatggaccagtgtggatgataaatctcgtaaaatgaagaaatccaagtccgtcagaaagcctaagtaa

SEQ ID NO: 3006 - DNA, 1353 bp, Glycine max var. Williams 82
atggttacttgtcctggttccataataatccatttcttcctcttctcagcgcctctcctttcagtcttatggtcttgttcatcagtttctgcattgaaaccccgtgccttcatcctccccatcgagaaagacccaaccacccttcagtactcaacttccatcgacatgggtacccctccactcacactagatctagtcatcgacatcagagaacgcttcctatggttcgagtgcggcaacgactacaactcctcaacctactaccctgtccgatgtgggactaagaaatgcaagaaagccaagggcacggcttgcattacatgcaccaaccaccctcttaaaacaggatgcaccaacaacacgtgtggtgtagatccattcaaccccttcggcgagttcttcgtgagtggagacgtgggtgaagacatcttgtcctcgctgcactcaacaagcggtgcacgagcaccttccactttgcacgtgccacgcttcgtttctacatgtgtgtacccagataaatttggggttgagggctttctccagggcctggctaagggcaagaaaggagttttaggccttgcaaggactgctatttccttaccaacacaactcgcagccaaatacaaccttgaacctaagtttgcactttgtttaccttcaacttcaaagtataataagcttggtgatctctttgttggtggtgggccttactatttgccacctcatgatgcttccaaatttctttcctacactccaattctcaccaacccccaaagcacaggtccaatctttgatgctgatccttccagcgagtactttattgacgtgaagtcaatcaagcttgacggtaaaattgttaacgttaacacctccctgctttctattgacagacagggaaatgggggctgcaaacttagtaccgtagttccttacaccaaattccacacttcaatataccagccacttgtgaatgactttgtaaagcaagcagcgcttaggaaaataaagagagtgacttcggtggcaccatttggggcgtgctttgattcaagaaccattggcaagaccgttactggacccaatgtgccgacaattgatctggttctcaaggggggagttcaatggagaatctatggtgccaattcaatggtcaaggtttctaagaatgtgctgtgccttggatttgtggatggaggtttggagccaggaagtcccattgcaacttcgattgtgattggtgggtatcagatggaggacaatcttttggagtttgatcttgtttcctcaaaacttggttttagctcctcccttttactccacatggctagctgttcccacttcagacttgtttga

SEQ ID NO: 3007 - DNA, 582 bp, Glycine max var. Williams 82
atggcttctacagacaagcatggcgacactgaatacagaacatcatcttcaactccagctcctgcgggtgttgattactttaaatttgatgttatcctaaggtttgtgttatttgcagcatcactggtagctgttgtggtgatcgtcactggtaatcaaacagaggttattcttgtgccacagcctgtgccatggccagccaagttcagatacacaccagcctttgtgtattttgtagctgcattgtccgttactggcctctacagtatcattacaacacttgcatcactctttgccagtaacaagccagccctcaaaaccaagttgctcctctactttatcttatgggatgcgctgatattggggataatagcctcagcaacaggcacagctgggggtgtagcatatttgggtttgaagggaaacagccatgtggtgggttggaataaaatttgccatgtttacgataagttctgtaggcatgttggtgcctccatagcagtggctttgtttggaagcattgtcacagtcttgctcatttggctttcagcatacagcattcatagccgagtccccaagtag

SEQ ID NO: 3008 - DNA, 309 bp, Glycine max var. Williams 82
atggagagggtgacaaagatggtatcagagaggccagtggtgatattcagcaagagctcgtgctgcatgagccacaccataaagaccctcttgtgtgactttggggtgaatccagcggttcatgagctggatgagatcccaagaggcagagacattgagcaagctctttcaaggcttggttgttctccatctgttcctgctgtcttcatttctggtgagcttgttggtggagccaatgaagtcatgagccttcaccttaatcgctccttaattccaatgcttaagaaagcaggagccctttgggtttaa

SEQ ID NO: 3009 - DNA, 1047 bp, Glycine max var. Williams 82
atggataagaatcagacgaagctggaatactttgatgagatgtggaggctccaatgcactgccacactattatctcacttgaaggaggatgatgatggtcggcatgttttgatattggatcgtacaatattctatccgcaaggaggtggtcaaccaccagatactggctttctactcattcatggctttgacaacaacaaatttctggtctttcactatggtttctttgagaacctaggtgggaaatttgagcctacactcgagaaagggaaggaggtttcactgtttgttgatgagttcagacgaaaactgaactccagattgcattcagcagggcatttgcttaaaatttgtttgccaagaataggattgggaaatttagagtctggcaaagcctaccattttcctgatggtttgctccgtacttgctattgtattgtaactattgtttcctggccttgggttgaatataaaggtacaatttcacaaaatcagatgcagagtaagcaaaaggatttagagctggaggccaatgcattaatttccgtgggaggaaaagtttccgttgatatattaccgtatgatgaagctgctaagctttgcggtgggtgtcttcctgattatgttcccaagcatccggaatattccagcttatacagtctcttccattggtctctgatgctgaaattctctgtgggacagaagattcacgcttatggtgttctatccactttgaactttgtagaagtcctcataagtcataaatatgaaatttttttcttgaaaatggaagaaattctctttccagtcattgtgaaagtgataaaatcatttcaagccttaatatcagtatcagttaaggaatacaactgttttccctttgctgccttcttggtgtgtcaatgtgtgtttgtgtcgtgtcagataggagataatcctcgcatcaactctcatgttgctgacatttcagacatcaaacaaattaaggtttatcaaattcgctcaaagaaggggctgacaaaagtcttttacaatgttgaatcctag

SEQ ID NO: 3010 - DNA, 636 bp, Glycine max var. Williams 82
atgggtgatttaagagttaagaaaaagaaaggaagcaacaagaagaagcatgggtctgtgtctgtcaccgccatcaaatttcttcctaaggagttgcaagtggagatttttgccaaggtggccactcgctccgtatttgaccactgcatgattaaactatgttgcaaagaatttcttcgcgcagcggaggataattacgtgtaccgtcacgcctccatggagaattttgcgttggtgccgctaccatggttcaaaggcaataataaagaattcccgtttctgaaacgttgcagggagagcggtaactcggagattttgtaccgtgaaggaatggttcaatatttcacttcttcaatgatggaattgggtctcaagaatttgaaagaggcggcgctggagggtcaccatgatgccaaatatgtttattgcatgcttttgatgtgcggtgaagatgaattaggagaaagaaagcaaggttttgatctcttttgttccttgaaagcgtcgtccacgtctcttattagatgcagaaaaagggttaaatcttttgtccaaaatatctgggtcaataataaccctgcgattaaagatcacaagtcatcatctttctgctgttctggcacgtgtgatagttag

SEQ ID NO: 3011 - DNA, 402 bp, Glycine max var. Williams 82
atggtgggtcttagtgtagtcctggaagcccagaagagttgcatcaacaaaaagacacctcaagtcattaacaaaaccaccatgctgatgcttagcagcatccacaacaaaccctcccctcaaccttcttctctttttcagccacccacttttcttgaccaatgctttctttgtgggaagagactcttgccagggaaagacatctacatgtacaaaggggacagggcattttgtagcgtggattgcaggtgcaagcagattttcagcgacgaggaagaagctattcagaaagagaagtgttctttggctgccatgaggcccacatcgtctagttcttccacctcaacggcacgtcatcaccggaaaggaacaagaaaccgagggggtggtgcttatttttag

SEQ ID NO: 3012 - DNA, 1517 bp, Glycine max var. Williams 82
ccaaaaaaagaaaaagagaacattgttcaacgaagcaagatgcttagcaaccgcatatggcagaggagagctttgatctccgcccggaccttattttctggctctgcttctcactcttcatcatcttcccatgcgatctcgcttcgcttcgccaaagctaatgctccttcttcttcacatgtcattttcaattttgcacgtgtggacagatattggttttctactcaacccgccctagagcttcccgcgagcaagatcgtggacgtgccgttggcacaaactggtgaaggcatcgcagaatgtgagcttctcaaatggtatgtacaagagggggattatgttgaagactttcaaccactttgcgaagtccaaagtgataaagctaccatagaaattactagtcgttacaaaggaaaaatttctaacattctctatgttcctggtgatattgtcaaggttggagaaactctgttaaagatattagttgacgagtctacatttccttctgggattccttgtgattccgaaaatgcaaagtcacctgatactgatcagacattagttaatgagtctgtgtttactacagtaattgatgattcagacaatggcaagttgatagattctgatcctggaaaagggagacaaactggagtatcatcaacacctgctgtaagaagtctagcaaagcaacatggtatagatataactgaaatctgtggaactggaaaagatggaaggattttaaaagaagacgtgctcaatttttctgtcaagaaaggaatcattaaaaatccatctactgtcttgcaatctgattctggagaacagcttcagggagctgaaggatacaactgcaatgttgcaactaaatcttataggccatctgaggacaggacacttccccttaggggattccaaagagcaatggtaaagtcaatgtccctggctgctaaagtcccacattttcattacgtagatgagataaattgtgatgcccttgtggagcttaaaacatcttttcagaaaaataatccttatccagatgttaagtacactttccttccaatattaatcaaatcactatctatggccctcagtaagtacccctttatgaacagttgcttcaaagaggatgcattggaggtcatcctcaaaggttcacacaatgttggaattgccatggcgacatcacatggtttagttgtgccaaacattaaaaatgttcagtctctttccataatggagataaccaaagagctggcaaggttacaacaattggcttcaaataacaagttaacttctgaggatatatgtggtggtactatcactttaagcaacattggagcaataggtggaaagtttggttccccacttatcaatctgcctgaagtctccattattgccgttggtagaattcagaaagttccacggtttgctgataatggaaatgtgtatcctgcatcactcgtgaatgtaagtcttgcatgtttgcattggtaaactgtgaacaattaaaa

SEQ ID NO: 3013 - DNA, 207 bp, Glycine max var. Williams 82
atggtgaatacattgccctctctcgatctcacccaccactccgatttcgacgcattagcttcatctccatctgcggctacggttccctcctctccgagacaagtgccagaatcactttcccccgtctcttcaactccgtcggacgcatcttttcactcaccgtgttgccaatatcaaaactcaggaaattgccggactttctgttga

SEQ ID NO: 3014 - DNA, 477 bp, Glycine max var. Williams 82
atgggtattttcacattcgaggacgaaatcacctcccctgtggctcctgctactctttacaaagctctagttacagatgccgacaacatcatcccaaaggctcttgattccttcaagagtgttgaaaacgttgagggaaatggtggccctggaacaatcaagaagataactttcgttgaggatggagaaaccaagtttgtactgcacaagatagaagcagttgatgaggcaaacttgggatatagctacagcgtagtgggtggtgctgcgttgccagacacagcggagaagatcacattccactccaaattggctgctggtcccaatggaggctctgctggcaagctcactgtcgaataccaaaccaaaggagatgctcagcccaaccaagaccaactcaaaactggaaaagccaaggctgatgctctcttcaaggccattgaggcttaccttttggccaatcccgattacaactaa

SEQ ID NO: 3015 - DNA, 690 bp, Glycine max var. Williams 82
atggaggaaaaggcaaaagctgagcagaagaagataggtatgaccgagacttggttgaagaagcaccgtcttctttacaatggagccactagacaccctcttattattagcattcgcgatggcaccatcaacactgcttccttcaaaacatggctcgcacaggattacttgttcgttcgggcgtttgtcccatttgtggctagtgtgctgataaaagcgtggaaggaatcagattgcagtggtgacatggaagtcatattggggggcatggcttctctggaggatgagatttcatggttcaagacagaagccaacaagtggggtatttcactttctgacgttgttcctcagcaggctaacaaaaactattgtgggttgctggaaagtttaatgagtccagacgcggaatatactgtggctattacagcattttgggctattgaaacggtgtatcaagagagctttgcccactgcattgaagaaggctccaaaaccccaccagaactgaaggagacttgtgtaagatggggcaatgaggcctttggtaagtattgccaatctctgcagaacattgccaatagatgcttgcaaaaggcttctgatgaagaactcaaaaaggctgaagttatgttgctaagtgtccttgagcatgaagttgaattctggaacatgagccgtggaaatgtctga

SEQ ID NO: 3016 - DNA, 1209 bp, Glycine max var. Williams 82
atggttgacactttcagtatagagagcaggcttcttataagagagtttgatgaagatagagatgttaaggtggtggggaagcttgagaagaactgtgagattgggactaaaaagggggtctccattttcaccaacatgatgggtgaccctttatctaggattaggttctatccccttcatgttatgttggtggctgagctgcttgaaagcaaggagcttgtcggtgtggttcgagggtgcattaagagtatgcgaactccttctgaatcattgctgaagataggttgcatactaggccttagggtctctcctacacacaggagaaaggggataggactaaaacttgtcaactcagtcgaagaatggatgctgagaaatggggctgaatatgcattcctagcaacagaaaagaacaatgatgcctctataaacctatttaccaacaaatgcaaatacgtgagcctcagctcacttgtcatatttgtccatccaattattagtttccctgcaaagcacattcctaaggatataaaaattgagaaggtgaacatggagcaggcaatttccttatacagaagaacccttagggccaaagagttgtacccattagacatggattctattttgaaggagaagctcagcttgggaacctgggtgagttattacaaagatgaagggtgcaggctcaacttgcagaggaatatggtagagagtgtcgatgaagacataattaccaatgaaatcacaagctcatggatcatctttagcatatggaatacttgtgaggcttataggcttcaacttaaaaagtctcagccacttaggtttctccatacaacattaaatcatgcaagagacaaaatcttcccttgtctgagaatgtcggtgagtgaatcactctgcacaccctttgggtttctcttcctctatggactccatggagagggagagaaccttggggagttaatggaatccatatggaggttcacatcaaggttgggagaaagcttgaaggactgcagagtggttataactgagttagggtttggggatgcacttgtaaaccatgtccctctaacagcttctatgtcatgtatcgatgatatctggtacactaagagaatttcaagccacagtgatgaaaacgatgatgaactgctgatgaagagacaaatcgggaacgtgttcgttgaccctagagatttttag

SEQ ID NO: 3017 - DNA, 1588 bp, Glycine max var. Williams 82
taacaaccaatgatttttcaccatatataaggatgccacatgaatcggatggtcgggagtgaacccaatcaagaaagatccaatctgaaaaatctttcctttcccagatatcacaccttatatagtactgcatcactttgcttcttttaggtaagcaaggagagaagaaaaatggttgacactttcagtatagagagcaggcttcttataagagagtttgatgaagatagagatgttaaggtggtggggaagcttgagaagaactgtgagattgggactaaaaagggggtctccattttcaccaacatgatgggtgaccctttatctaggattaggttctatccccttcatgttatgttggtggctgagctgcttgaaagcaaggagcttgtcggtgtggttcgagggtgcattaagagtatgcgaactccttctgaatcattgctgaagataggttgcatactaggccttagggtctctcctacacacaggagaaaggggataggactaaaacttgtcaactcagtcgaagaatggatgctgagaaatggggctgaatatgcattcctagcaacagaaaagaacaatgatgcctctataaacctatttaccaacaaatgcaaatacgtgagcctcagctcacttgtcatatttgtccatccaattattagtttccctgcaaagcacattcctaaggatataaaaattgagaaggtgaacatggagcaggcaatttccttatacagaagaacccttagggccaaagagttgtacccattagacatggattctattttgaaggagaagctcagcttgggaacctgggtgagttattacaaagatgaagggtgcaggctcaacttgcagaggaatatggtagagagtgtcgatgaagacataattaccaatgaaatcacaagctcatggatcatctttagcatatggaatacttgtgaggcttataggcttcaacttaaaaagtctcagccacttaggtttctccatacaacattaaatcatgcaagagacaaaatcttcccttgtctgagaatgtcggtgagtgaatcactctgcacaccctttgggtttctcttcctctatggactccatggagagggagagaaccttggggagttaatggaatccatatggaggttcacatcaaggttgggagaaagcttgaaggactgcagagtggttataactgagttagggtttggggatgcacttgtaaaccatgtccctctaacagcttctatgtcatgtatcgatgatatctggtacactaagagaatttcaagccacagtgatgaaaacgatgatgaactgctgatgaagagacaaatcgggaacgtgttcgttgaccctagagatttttaggtatataagcttcacacggctactttttgttgatctaagttgcaaaggcttcgtctatagcatcatgagatcgcagcatattgagaattatgtataccattgactttaaattatctcttagctgaaggactacatttatgattaacatcaattgatcatgtgatcctttttatttctacttttcgatcggtcttttccttttcaaatc

SEQ ID NO: 3018 - DNA, 495 bp, Glycine max var. Williams 82
atgcacaaattaggacaaccgatgtctctcttaacagatgagttgaagtccaaagctgaggtttactatggggacaaagtttgcagggagaagttctctttgttgctggcagaaataggtctacctgatgggttattaaccattcaagacattgaggaatgtggttatgtcaaggaaataggctttgtttggctgaagctcgagaagaagagagagcaatggtttgataaaatacttgtttgctatgatacagtggtcactgcttatgtggagccaaacaagattaagaatctcactggggtgaaggctagggacttcttgctttggttcactttgaacgagatttttgttaaggacaatccagaagctcctgtcatcactttcaagtctttggttggtttgtctatgtcttttccattgtcattgtttgaagcagggaaagaagccaataaggaagaagcaaaggaagagaagtggtggaggatgatcatgtaa

SEQ ID NO: 3019 - DNA, 1041 bp, Glycine max var. Williams 82
atgcctgacaccggaagagctagagtgagaaatgacaataaacttagccatattgataaaaagaacagtgacatgcatcatcatggtgccattgaggtcaaacaacttaatgaattgatgggctctactttgttcattaaagcatctgcaataaatgtggaaacatatgaatctgatagaataattgatcttcctggccaaccttcaagcccctcagtatcacacttttcaggttacatcactgtcaatgaaaaccatgggaggacccttttctactggttatttgaagctcaatctgaaccatccaagaagcctctccttctctggctcaatggagcaaatttgttatttgtggagtcccctgttggagttggatttttttatactaacacatcttctgatttcaccatattagaggataattttgtggttgccatatttgttgacaagctacttcaatcagctgaggatacctacaatttcttggtgaattggctacaaagattcccacagttcaaatctcgggaattttttatatcaggagaaagctatggtggtcactatatccctcagcttgcagagttaatctttgatcgaaacaaagatagaaacaaatacccctctattaatcttaaaggttttattgtagggaacccagaaactggtgattactatgactataaaggggtgctggaatatgcatggagtcacgcagttatatcagaccagcaatacgacaaagcaaaacaattatgtgattttaaacaatttgattggcctaatgaatgcaacaaggccatgaacgaagtcttcctagattactccgaaattgacatattcaacatttatgccccggcatgtcgtctaaacagcacatcctcaatagctgatcatagcaacagtaacaatcctgaatcatcaaccaaggagagaaatgattatagactgaggatgagaatttttgggggctatgacccttgttattccaattatgcagaagaatatttcagtagaaaagatgttcagtcatttttcatgtag

SEQ ID NO: 3020 - DNA, 969 bp, Glycine max var. Williams 82
atggatgaaaaaggagcaagaagtagcaacacccttttaagttgtgaggacgagatggaccttcgaagaggcccttggaccgtcgatgaagacctcactcttatcaattacattgccactcatggcgaaggtcgctggaacacgctcgccctctctgctgggctgaaacgaacggggaagagttgcagattgaggtggctgaattatctgcgtcctgatgttcgacgtggaaacatcacacttgaagaacaacttttgattctggagcttcattctcgctggggaaaccgttggtcgaaaattgctcaatatttgcctggtagaaccgacaacgagataaagaactattggagaacccgtgtccaaaagcatgccaagcaactcaaatgtgacgtgaatagcaagcaattcaaggacaccatgcgttacctttggatgccaaggctcgtggaacgcattcaagcagcggcgacggcccccgtaaccaccaccgtaactgcggccgccaccaacaatgcattcacctacggaaacaaccttaataacaacaaattcgaggttctgaatcacaagggcagaatggggttaaccgatccttcagttgcgaacaatgactttgtgggttcacatgtcacgcaaagttacactactcctgagaatagtagcacgggtgcgtcatcatcagactcgtttgggactcaagtctcaacaatttctgatttgactgaatattacagtgtccctgaaaatactaattctgcggattattatcaaccctctcaaattagtaattactcggataattgcatcacaagcccatctgggttcttgttccctcaaggactagatcttcaatccatggatccaaacacaccgtggaacatgcaaagtggggactcctctgacaatttttgggacgttgaaagcatgttattcttagagcagcaactcatgaatgacaacatgtga

SEQ ID NO: 3021 - DNA, 1143 bp, Glycine max var. Williams 82
atggtagcggaagcggaaattatctgtcagcagaacattccgatgttggacgtgaagtatcatatttgcgtggctcaagaacacaacgtgaaggttgaggtttcacccaaatcaccttcacctcctgttccgatctttggccaagcagtgagttgctctgagatcattaaagattccattttggaggcccctgcgatgaattttttcccaaatgtgcgttctggtagctatgccgagattggaccgcgcgtttctatggatgatgaacacatttgtattgatgatctgggagctcatcttggatttgtgttcaagtgtccgataccgagtgcattttatgcagtttttgatggccatggggggcctgatgcagcagcctttgttaagaggaatgctatgaggttgttttttgaagatgcagacatgctgcagtcgtatgatgctgatgcgttttttctacagaaattggaggattcccatcggagagcttttctacgggcagatcttgccttggctgatgaacaaactgttggtagttcttgtgggactactgcattgactgcccttgtgcttggaaggcatttgcttgttgctaatgctggtgactgccgagcagttctttgccggagaggtgtggctgttgagatgtctaatgatcacaggccaagttatctaccagagaagaggagggtggaggagttaggtgggttcattgatgatggatatctcaatggttatctttcagtaactcgagcccttggggattgggacttgaaatttccacttggtgctgcatcccctcttattgctgagccagatgttcggctggttacattgactgagggtgatgagttcttgatcattgggtgtgatgggatttgggatgtaatgtctagccaagttgcagttagtcttgttcgccgaggattaagaaggcatgatgacccacagcaatgtgccggagagctagtcaaggaagcattgcgcctaaatacatcagataatctcactgtaattgttgtatgcttgtcgcccattgaaagcattgttgaatcatgtccaccccaaaggagaagattcaaagcttgcagtttgtctgaagaggcccgtaatagattgaagagcttgattgagggaaattga

SEQ ID NO: 3022 - DNA, 1179 bp, Glycine max var. Williams 82
atggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggctttgtctcaaacgatgtgggactggatgccgacaactgcaaggtcctcgtcaacattgagcagcagagccctgatattgctcagggtgtacacggccacctcaccaaaaaacctgaagaaattggtgctggtgaccagggtcacatgtttggctatgccactgatgaaacccctgaattgatgccattgagccatgttcttgcaacaaaactcggtgctcgtctcaccgaggttcgcaagaacggtacctgcccttggctgaggcctgatgggaagacccaagtgaccgttgagtattacaatgacaatggtgccagggttccggttcgtgtccacaccgtgctaatctccacccaacacgacgagactgtcaccaatgacgaaattgctgctgacctcaaagagcatgtgatcaagcctgtgatcccagagaagtaccttgatgagaagaccattttccacttgaacccttcaggccgttttgtcattggtggccctcatggcgatgctggtctcaccggccgcaagatcattatcgatacttatggaggatggggtgctcatggtggtggtgctttctccggcaaggaccctaccaaggttgataggagtggtgcttacattgtgagacaggctgctaagagcattgtggcaagtggacttgccagaaggtgcattgtgcaagtgtcttatgccattggtgtgcctgagcctttgtctgtgtttgttgacacctatggcactggaaagatccctgacaaggagatccttaacattgtgaaggagaactttgatttcaggcctggtatgatctccatcaaccttgatctcaagaggggtggaaataacaggtttttgaagactgctgcatatggacactttggaagagaggaccctgacttcacatgggaagtgatcaagccactcaagtgggaggaggcctaa

SEQ ID NO: 3023 - DNA, 474 bp, Glycine max var. Williams 82
atggctagtgtggtaaaggagcgttcaggggcagagatagtgtatggttctgaagagtgttatcgccactccatagagctcttagaagagttgggtttcccaaagggtgttcttcccttgcaagacctggtggagtgtggtagggttagagaaactgggtttgtgtggatgaagcagaaggcaccttatgagcatttctttgagggaaccaacacgagggtgagctatgctgttgaggtcactggctatgtggagaagtttaggatgaagaaaatgagtggcattaagagcaagcagatgatgctgtgggtgccaataactgagatgagcattgaagatcctaaggggcagaagatactctttaagacccctatggggattggaaagtccttccctatcctggctttcatgaccccagaggaaaaggaaaagcacctgctgttgcagtataaggagattcaagaaaacagttag

SEQ ID NO: 3024 - DNA, 3828 bp, Glycine max var. Williams 82
atggaaggggatatcagtgtgaatggagatcctaacattaacaacaatcatgactcaaagaagagggatgacaaagatgaacccgccaaaacagtacccttatacaagcttttctcatttgctgatcctttggatctcttgttgatgtttgtggggactgttggtgccattgggaatggaatctccatgcccttaatgactctgatatttggaagtctgatcaatgcatttggagaatccagtaacactgacgaggtcgtggatgaagtttccaaggtgtccctgaaatttgtatacttggctgtgggtaccttttttgcggcatttttgcagttgacatgctggatgatcactgggaatagacaagctgcaagaattagaggattataccttaaaacaattttgaggcaggatgtcagtttctttgataaagagactagtactggagaggttgttggaaggatgtcaggtgatactgttcttattcaagatgccatgggtgaaaaggtgggacagttcatacagttagtggcaactttctttggaggttttgttgtagcattcatcaagggatggcttctaactgttgtcatgttatcttgtattccacttcttgccttgtccggggctatgataactgtgattatttcaaaagcatcatctgaaggacaagctgcttattctacagcagcaattgtagtagagcagacaattggttctatccgaactgttgcatcattcactggggagaggccagctatagctaaatacaatcagtccttaaccaaggcatacaagactggagtgcaagaggcactagcttctggtttgggatttggcgtgctctactttgttttaatgtgcagttatggtctggctgtatggtttggtgcaaaaatggtaatagagaaaggatatacaggaggcgaggtcgtgaccataatatttgctgtattgactggctccttctctattgggcaggcatctccaagcttgagtgcttttgctgctggccaagctgcagcctttaagatgtttgaaacaattaaaaggaagccagaaattgatgcttacggcacaactggtctgaagattaatgacattcgtggcgatatagagctcaaggaagtttgctttagttatcctacaagacctgatgaactggtattcaatggattttcgctttcaataccaagtggcactaccgcagctttggtgggacaaagtgggagtgggaaatccacagttgttagtttgatagagagattttacgatccacagtctggtgcagtacttattgatggtatcaacctcagagaatttcaactgaaatggatcagacagaaaataggcctagtcagccaggaaccagttctctttacttgtagcataaaagagaatattgcctacggcaaggatggtgcaactgatgaagaaatcagagctgcagcagaactagctaacgctgccaaatttatagataaacttcctcagggactagacacaatggttggcgagcatggtactcagctctctgggggtcaaaagcaaagagtggcaatagcaagagcaattttgaaagatccaagaatcctacttctggatgaagctacaagtgcccttgatgctgaatctgagagaattgtgcaagaggcattggacagaataatgataaacagaacaactgtcattgtagcccaccgcttaagtactatacgaaatgctgataccattgctgttatccatcagggaaaaatagttgaaagcggttcacatgcggagctcaccaaggatcctgatggagcctatagccagcttatcagactacaagaaattaaaagatctgaaaagaatgtagacaacagggacaaatctggaagtattgggcattctggaagacattcaagtaaaaggtcttctttcttacgatctataagccaagagtcactgggagtaggaaacagtggtcgccattcattctcagcatcatttagggtgcccacatctgttggcttcatagaagctgctacaggcgaagggcctcaagatcctccaccaacagctccttcaccaccagaagtgcctctttatcgcctggcttccctaaacaagccagagattccagttttactgatggggactgtagctgctgtgctaactggagtgatattaccagtttttagtatcttgcttaccaaaatgataagtattttctatgagccacatcatgaactccgtaaagattcaaaagtttgggcaatagtgtttgttggacttggtgcggtatcattacttgtttatccaggtagattctacttttttggtgttgctgggagtaaattgatccaaagaattcggaaaatgtgttttgagaaagtagttcacatggaagtaagttggtttgacgaagctgagcattcaagtggagcaattggatcaaggctttctactgatgcagcttctatccgagctttggttggggatgcacttggtttgctggttcaaaatattgccacagcaatagctgcattgataattgccttcgaatcgagctggcagcttgctcttataatccttgctttggtgccgctactaggactaaatggatatgtgcaattaaagttcttgaaaggattcagtgcagatacaaagaaattgtatgaggaagcgagtcaagtggcaaatgatgctgtggggagtataagaacagttgcttctttctgtgctgaagagaaggtgatggaattgtaccaggaaaaatgtgaaggaccaattaagacaggcaaaaggcaagggataatcagtggaattagttttggagtatcattctttatgctgtatgcagtttatgcaaccagtttttatgctggagctcgactggtggaggatggcaaatcttcattctcagatgttttccgggtcttttttgctctcagtatggcagctttgggaatctctcagtctggctctttggtccctgattcaactaaagcaaaaggtgctgctgcttccatatttgcaattcttgaccgaaagtcagaaatagacccaagtgatgactctggaatgacactggaagaagtcaaaggagagattgaacttaggcatgtcagtttcaagtatcctaccagacctgatgttcaaatattcagagatcttagcttgaccattcataccggcaagacagtagcactggttggagaaagtggatgtggaaaatcgacagtgatctcattgttacaaagattttatgacccagactcaggtcacattatactggatggaaaagaaatccaaagtttgcaagttagatggctaagacaacagatgggtctggtaagtcaagagcctgtgttgtttaatgacaccatccgagccaatattgcatatggaaaaggagatgcaaccgaggcagaaattatagctgcggcagaattggcaaacgctcataggttcattagtagtttgcagaagggttatgacacgttagtaggggaacgaggagttcaattatctgggggacagaagcagcgtgtggcaattgcacgagctatagtgaagaacccaaaaatattactgctagatgaagccacaagtgcactggatgctgagtctgaaaaagtggttcaggatgcactagaccgtgtcatggtggaccgaaccacaatagtagtggctcataggttatccactattaagggtgcagatttaattgcagtagttaaaaatggggtcatagcagagaagggaaagcatgaagcattacttgacaagggaggtgattatgcttccttagtagcattgcatacaagtgcttctacatcttag

SEQ ID NO: 3025 - DNA, 3801 bp, Glycine max var. Williams 82
atggccagacagcaagatttcaagaagaacaagatgatgaagaaggaggaaagtaacaaaacactaccatttcacaaacttttttcatttgcagactcaagggattatctattgatgtttgttgggacaataagtgctgctgggaatggaatgactaaggcttcaacgaatatagttatgggagaagcaattgaagcttttagaagaagtggtaacactaaacaagtagttcatgaagtttcccaggtgtctctgaagttcgcactactaggtgcaatttcctttctggcagcatttctacaggtggcttgttgggtatccaccggggagagacaagcagcgagaattcgaggcttatacctcaaagcagttctgagacaagatataagctactttgacaaggaaaccaatactggtgaggttgttgaaaggatgtcaggtgacacagttcttattcaagaagccatgggagagaaggtaggaaaattcatacagtgtgtagcatgttttttaggaggtttagtcatagcattcatcaagggttggtttctaacccttgtccttctatcttgtattccacctcttgtcctctccggctccataatgagcattgcttttgcaaagttggcatcccgtggacaagcagcttattctgaagcagcaactgtagcagcgtgtgcaattggttcaattcgaactgttgcatcatttacaggcgagaatcaagctatagctcaatacaatcaatccttaacaaaagcttacaggactgcagtgcaagatggagtggctgctggtttaggcctggggtcaatccgtttttttattaccagtagttttgcattggctttatggtttggagcaaagatggtactagagaaaggctatacaccaggtcaagtcatgagtatatttctggcactattttatgcctccatgtctttggggcaggtttctacaaatttaacagcatttgctgcaggacaagctgccgcctttaaaatatttgaaacaataaataggcatccagatattgatgcttacgacactgctggtcaacagaaagatgatatttctggagatatagaacttagggaggtttgctttagttatccttcaagaccagatgcattgatattcaatggattttctatttcaatatcaagtggtactaatgcagctttggttgggaaaagtgggagtgggaaatcaacagttattagtttgattgagagattttatgatccacaagctggtgaagttcttattgatggtatcaacctcagagaattacagttgaaatggatcagacagaaaataggccttgtcagccaggaaccggttctcttccattgtagcattaaagaaaatattgcctatggtaaggatggggcaacagatgaagaaatcagagccgccactgaacttgctaatgcagctaaattcatagataaatttccacatggacttgacacagttgctggtgagcatggtacacagctctctgggggtcaaaagcaaagaattgccatagcaagggcaattctgaaagatccaagagttctgctccttgatgaagctacaagtgcccttgacgctgagtctgagagagtggtgcaagagacactagacaaagttatgataaaccgaacaacgatcattgtagcacaccgcctaaacacaataaggaatgctgataccatatctgttattcatcaaggaagagtagtagaaaatggtacacatgcggagctcattaaagatccagatggagcttatagccagctcattagattgcaagaaattaacaagcagttagatggtacagatgactccggcagggtagaaaactctgtagattctgaacgacaatcaagccagtggtttcctttccctcaatctttaagcttgggatcatctggaacaggaaacagcagtcatgactcattcagaatatcaaatgctatgcctactacacttgatctcttgaaaacatcagaagaaggacctgaagttcttcctccagtagtatcacattcacctcccgaagtctcattccttcaccttgtttatcttaacaagcctgaaatcccagagttagtcctagggactctagctgccatagtaactggggcaatactaccccttatggggtttcttatctccaacatgataaatactttccttgagcctgcagatgaactccgtaaagtctcaaagttttgggcattaatgtttattgcccttggtgtagctggcaccatatttcatccaataaggtcatacttttttgctgtagctggttctaagttgataaaaaggatcgggctgatgtgtttcaagaaaattattcacatggaagtaggctggtttgacaaagctgggaattcaagtggaatacttggagcaaggctgtcacttgatgtggcttctattcgaacttttgttggggatgcactcggtttgatggttcaagatgttgctacagtaatcatagccttggtaatcgcctttgaggcaaactggcagctttctctcatcattcttgttttgctacctctattattagtaaatggacaagtgcaaatgggatccatgcaaggatttgtcactgatgcaaagaaactatatgaggaagcaagtcaagtagcgaatgacgcagtagggaatatcagaacaattgccgctttttgtgctgaagagaaggtaatgaacttataccagaagaaatgtttaggacccatcaagacaggtatatggcaaggtatagtcagcggaacaagttttgggttatcactcttcttggtgttctcggttaattcatgcagtttttatgctggagcccgacttgttgagaatggcaaaacatcaatctcagatgttttccgtgtgtttttcactctcacaatggcagctatagcaatttcacaatctggcttcatggccccaggtgcaagcaaagcaaaaagttctgttacttctatatttgctattcttgaccagaaatcaagaatagatcccagtgatgagtgcggaatgacattgcaagaagtgaagggagaaattgagttccaccatgtcactttcaagtatccaaccaggcctaatgttcttctattcagagatctttccttgaccattcatgcaggggagacagttgctctagcaggcgaaagtggaagtggaaagtcaacagtaatctcattgctgcaaagattttatgagccagattcaggtcagattacactggatggaacagaaatccaaaagctacaacttaaatggtttaggcagcagatgggtctggtaagccaggagcctgtgctgtttaatgataccatcagaaccaacattgcatatggaaaaggaggtgatgcaacagaagctgaaattatagctgcaactgaactggcaaatgcccacacgttcattagcagtttgcagcagggttatgacaccatagtaggggagagagggattcaactatctggagggcagaagcagcgggtggcaattgcaagagccatagtgaagaatccaaaaatattactgctagatgaagccacaagtgcacttgatgttgagtctgaaagagtggttcaggatgcactagaccaagtgatggtggaccgaaccacaattgtggtggctcacaggttatccaccataaaggatgcagattcgatagcagttgttcaaaatggagtcattgctgagcaaggaaaacatgacactttgcttaacaagggtggtatctatgcttcattagtaggcttgcacacaaatcttgtttcatcttag

SEQ ID NO: 3026 - DNA, 462 bp, Glycine max var. Williams 82
atgcagatctttgtgaaaactttgaccggtaagactatcacccttgaggtggagtcttctgacagcatcgaaaacgtgaaagctaagattgaagaaaaggaagggatcccacctgatcagcagaggcttatctttgccgggaaacaacttgaagatggaagaacccttgaagactatgaaatccagaaggaatcaacgctgcacttggtgttgcggcttcgtggtggcatgcaaatttttgtcaagaccttgacgggaaagaccataactttagaggttgaaggttctgatacaattgaaaatgtgaaagctaagattcaggaaaaggagggcattccaccggatcagcagaggcttatttttgctgggaagcaattggaagatgagcgtaccttggaagattacgatattcaaaaggaatccaccctgcaccttgtccttcgccttcgtggtggtttctaa

SEQ ID NO: 3027 - DNA, 1260 bp, Glycine max var. Williams 82
atgtgccaaagaagcatgagtggtggtggcatgaagctgctgaggatgtttgtgtttgtggggttggtgattgtgaaatgggtggaaggctttgaggatgctaatgtgacagacctaggcatgcaatatgtcagtggaagaggtttctacagacctttgatggttggttttactcatattaatggtgctgctgctaaaggagctgtctgcctggatggatctttaccggggtaccacttccaccgtggatatggttcaggatcaaacagttggctcatacaattggagggaggaggctggtgtggaactgtaaaaaattgtctttatagtaagaaaacacgtcatggttcatcattttttatggaaaaacaaataccatttattgggatattgagcaacaaagctgaggaaaatccagattttttcagttggaatagaataaaaatccgttattgtgacggtgcatcatttagtggggacagtcaaaatgcgggagcagggttgtatttcagagggcagcgcatttggcaagctgctatggaagatttaatgtcaaaagggatgcgctatgccaaacaggctcttctatctggttgttctgcgggaggtttagctactattatacattgtgatgaatttcgggaattgtttcctagaaccacaagagtaaaatgcttaagtgatgctggattattccttgattctgttgatgtttctggtcgtcgcagcttaaggaatttgttcggaggtgtggttaccttgcagggagtgcaaagaagtcttccaaggagttgtactagtcgcctcaatccaattttgtgctattttcctcagcacttaattgctggtgtcaggacaccactgtttcttctcaatgcagcttatgatacttggcagattcaagcgagtcttgctccaccatctgctgactaccactggaactggtatgaatgcagaaaaaattatgcacgttgcagtgcaccacagatacagtatcttcaaggtttccgaaatcagatgcttagatctacaagagccttctcacggtcttttaaaaacgggttgttcataaattcttgtttcgcccattgccaatcagaaagacaggatacatggtttgctcgtgattcccctcatattggaaatagagggattgcggagtctgttgggaactggtattttgatcgagttagtgtccaggccattggctgcccttacccttgtgacaaaacatgccataatttggtatttaagagatag

SEQ ID NO: 3028 - DNA, 3147 bp, Glycine max var. Williams 82
atgcttgggaacggggttgttgggatcttggcagaatctgtgaataaatgggaaagaagggcacctttgaccccatcacattgtgctcgattactccatggtgggacaggtgtttctaggatcattgtgcagccttccactaagagaattcaccatgatgctctctatgaagaagttggtgctgaaatatcacaagacttgtcacaatgtggtctcatccttggcattaagcaaccaaagctggagatgatattaccagatagagcttatgctttcttctcacatacacataaagcacagaaagaaaacatgcctttgctggataagattctagctgagagggcatcgttatatgactatgaattaattgttggggacactgggaaaaggttacttgcatttggaaaattcgctggtagagctggaatgatcgactttttgcgcggattaggacagcggtttttaagtcttggatattcaacacctttcttgtcacttggatcatcttacatgtacccttccctggctgctgctaaggctgctgtgatttctgttggtgaagaaattgcgacgcagggattgccattggggatttgtcccctggtttgtttatttactggttcaggaaatgtttgttctggtgcacaggagatatttaagcttcttcctcatacctttgttgatccatctaaactacgcgacctacatagaacggacccagatcaaccaaggcatgcttcaaaaagagttttccaagtttatggttgtgttgtgactgcccaagacatggttgaacccaaagatcccgtgaaagtgtttgacaaagcagactactatgcacatcctgagcattacaatcccactttccatgaaaaaatagcaccatatgcatctgttattgtcaattgcatgtattgggagaaaagatttcctcaattgctgagctataagcagatgcaagacttaatgggccgggggagcccccttgttggaatagctgacataacgtgtgatatagggggttcaattgagtttgttaaccgcagtacttcaattgattcacccttcttcagatatgatcccttaacaaattcctaccatgatgatatggaggggaatggagtgatatgcttagctgttgacattcttccaacagaatttgcaaaggaggcttcccaacattttggaaacatactttcccaatttgtcgtaaatttggcttctgctacagacattacaaagttgcctgctcacttaaggagagcttgcatagcccataaaggagtgctaacctccttatatgattatatcccacgcatgcggagttctgattcagaggaagtatcagaaaactcagaaaattctctatctaacaaaaggaagtataatatatcggtgtctctgagtggtcacttatttgatcagtttctgataaatgaggccttagatattattgaagctgcaggaggctccttccacttagtcaactgccatgtgggtcagagcattgaagccgtatcattctctgaacttgaagttggtgcagataacagggctgttctggatcaaatcattgattctttaactgctattgctaatccaactgaacatgatagattttcaaatcaagattcaagtaaaatttcacttaagcttggtaaagttgaagagaatggcatagagaaggaatctgaccccagaaagaaggctgcggttttaattcttggagctggtcgggtctgtcaaccagctgctgaaatgttatcatcatttggaaggccatcatcgagccaatggtataaaacattgttggaagatgattttgaatgtcaaactgatgtagaagtcattgtgggatctctgtacctgaaggatgcagagcagactgttgagggcattccaaatgtaaccggaattcagcttgatgtgatggatcgtgccaatttgtgtaagtacatttcacaggttgacgttgttataagtttgctgcccccaagttgtcatattattgtagcaaatgcttgcattgagctgaaaaaacatcttgtcactgctagctatgttgatagctccatgtcaatgctaaatgataaggctaaagatgctggcataacaattcttggagagatgggcttagacccaggaattgatcatatgatggcaatgaagatgatcaaccaagcacatgtgaggaaggggaaaataaagtctttcacttcttattgtggtggacttccatctcctgaagctgctaacaatccattagcatataaattcagttggaatcctgcaggagccatccgagctgggcgcaatcctgccacctacaaatggggtggtgaaactgtacatattgatggggacgatctttatgattcggctacaagactaaggctaccggaccttcctgcttttgctttggaatgtctcccaaatcgcaattcattactttatggggatttgtatggaataactgaagcatcaaccattttccgtggaaccctccgctatgaaggatttagtgagatcatggggacactgtctaggattagcttatttaacaatgaagcccattcgttgctaatgaatggacaaagaccaactttcagaaaattcttatttgaacttctcaaagttgttggtgataatccagatgaactattgataggagagaatgacatcatggagcaaatattaatacaagggcactgcaaagatcaaagaacggcaatggagacagcaaaaacaatcattttcttgggacttcttgaccaaactgaaatccctgcttcctgcaaaagtgcttttgatgttgcttgtttccgcatggaggagaggttatcatacaccagcacagaaaaggatatggtgcttttgcatcatgaagtggaaatagaatacccagatagccaaattacagagaagcatagagctactttacttgaatttgggaagactcttgatgaaaaaaccacaactgccatggcccttactgttggtattccagctgctgttggagctttgcttttattgacaaacaaaattcagacaagaggagtcttaaggcctatcgaacctgaagtatacaatccagcactggatattatagaagcttatgggatcaagttgatagagaagaccgagtaa

SEQ ID NO: 3029 - DNA, 3751 bp, Glycine max var. Williams 82
tcacatgcaacacttcaacctttttaaaaactacaagattgttgtgctgacattaccccaaccaagaacgaactgcacaacttgttcattctagttcagttgttacacactcatatgatcctgtcagaaatcacttcttctcttatcgttgtttgttccttacttcccttcttttctctaattcagtttcaaccataatccatctcaaaaacgtgttcaactttactgatattggaggtaaaaggatcatgcttgggaacggggttgttgggatcttggcagaatctgtgaataaatgggaaagaagggcacctttgaccccatcacattgtgctcgattactccatggtgggacaggtgtttctaggatcattgtgcagccttccactaagagaattcaccatgatgctctctatgaagaagttggtgctgaaatatcacaagacttgtcacaatgtggtctcatccttggcattaagcaaccaaagctggagatgatattaccagatagagcttatgctttcttctcacatacacataaagcacagaaagaaaacatgcctttgctggataagattctagctgagagggcatcgttatatgactatgaattaattgttggggacactgggaaaaggttacttgcatttggaaaattcgctggtagagctggaatgatcgactttttgcgcggattaggacagcggtttttaagtcttggatattcaacacctttcttgtcacttggatcatcttacatgtacccttccctggctgctgctaaggctgctgtgatttctgttggtgaagaaattgcgacgcagggattgccattggggatttgtcccctggtttgtttatttactggttcaggaaatgtttgttctggtgcacaggagatatttaagcttcttcctcatacctttgttgatccatctaaactacgcgacctacatagaacggacccagatcaaccaaggcatgcttcaaaaagagttttccaagtttatggttgtgttgtgactgcccaagacatggttgaacccaaagatcccgtgaaagtgtttgacaaagcagactactatgcacatcctgagcattacaatcccactttccatgaaaaaatagcaccatatgcatctgttattgtcaattgcatgtattgggagaaaagatttcctcaattgctgagctataagcagatgcaagacttaatgggccgggggagcccccttgttggaatagctgacataacgtgtgatatagggggttcaattgagtttgttaaccgcagtacttcaattgattcacccttcttcagatatgatcccttaacaaattcctaccatgatgatatggaggggaatggagtgatatgcttagctgttgacattcttccaacagaatttgcaaaggaggcttcccaacattttggaaacatactttcccaatttgtcgtaaatttggcttctgctacagacattacaaagttgcctgctcacttaaggagagcttgcatagcccataaaggagtgctaacctccttatatgattatatcccacgcatgcggagttctgattcagaggaagtatcagaaaactcagaaaattctctatctaacaaaaggaagtataatatatcggtgtctctgagtggtcacttatttgatcagtttctgataaatgaggccttagatattattgaagctgcaggaggctccttccacttagtcaactgccatgtgggtcagagcattgaagccgtatcattctctgaacttgaagttggtgcagataacagggctgttctggatcaaatcattgattctttaactgctattgctaatccaactgaacatgatagattttcaaatcaagattcaagtaaaatttcacttaagcttggtaaagttgaagagaatggcatagagaaggaatctgaccccagaaagaaggctgcggttttaattcttggagctggtcgggtctgtcaaccagctgctgaaatgttatcatcatttggaaggccatcatcgagccaatggtataaaacattgttggaagatgattttgaatgtcaaactgatgtagaagtcattgtgggatctctgtacctgaaggatgcagagcagactgttgagggcattccaaatgtaaccggaattcagcttgatgtgatggatcgtgccaatttgtgtaagtacatttcacaggttgacgttgttataagtttgctgcccccaagttgtcatattattgtagcaaatgcttgcattgagctgaaaaaacatcttgtcactgctagctatgttgatagctccatgtcaatgctaaatgataaggctaaagatgctggcataacaattcttggagagatgggcttagacccaggaattgatcatatgatggcaatgaagatgatcaaccaagcacatgtgaggaaggggaaaataaagtctttcacttcttattgtggtggacttccatctcctgaagctgctaacaatccattagcatataaattcagttggaatcctgcaggagccatccgagctgggcgcaatcctgccacctacaaatggggtggtgaaactgtacatattgatggggacgatctttatgattcggctacaagactaaggctaccggaccttcctgcttttgctttggaatgtctcccaaatcgcaattcattactttatggggatttgtatggaataactgaagcatcaaccattttccgtggaaccctccgctatgaaggatttagtgagatcatggggacactgtctaggattagcttatttaacaatgaagcccattcgttgctaatgaatggacaaagaccaactttcagaaaattcttatttgaacttctcaaagttgttggtgataatccagatgaactattgataggagagaatgacatcatggagcaaatattaatacaagggcactgcaaagatcaaagaacggcaatggagacagcaaaaacaatcattttcttgggacttcttgaccaaactgaaatccctgcttcctgcaaaagtgcttttgatgttgcttgtttccgcatggaggagaggttatcatacaccagcacagaaaaggatatggtgcttttgcatcatgaagtggaaatagaatacccagatagccaaattacagagaagcatagagctactttacttgaatttgggaagactcttgatgaaaaaaccacaactgccatggcccttactgttggtattccagctgctgttggagctttgcttttattgacaaacaaaattcagacaagaggagtcttaaggcctatcgaacctgaagtatacaatccagcactggatattatagaagcttatgggatcaagttgatagagaagaccgagtaatttgcatctatgaattgatgtataggtgtacattaatgtacaccatgcaatgtttgatttgaataagataaaatataataattactgcagtcatggaattgcaactgccattctatgcaactgtcagaaatggaccacacggtaccagcatagttaaaacacttaggcagatgccaatttcaattgcagcagtacaatccaaccagttatgaagtatggttctagaaaaattgttaactggtgttcaattgaactacttcctcagtttttatttatcagacttaattactcactccatcaacaacaacaacaacaacgtcttatcccactaggtggggtcggctacatggatcaac

SEQ ID NO: 3030 - DNA, 486 bp, Glycine max var. Williams 82
atgaacgctgtttctcctctagaggcccaagccttcaactacttgagcttcggcttcctcagcaatttctggacctggctcgccctcactttctggaggacccgaactcccacctccgagttgctcccaccacccgacgacccgattcacgacgagtcggagtcggaccctgttgccgtaccggcgcgtgttccaattccatttgccgttgacgttgacggagccaggaaggggaagtttaccttgtgttacgaggatgagtttgagagggaatgcgagacgacggtaacagaggagagagacggaagaggccgggagtggtgggagagttgggaaaccttgttgaaactgagacgaggagagaaccagaatggctggtacacttgccaggatttaacggcgcttaacggcagcgttgttaggttatgggatggtaccttcaccacacaacccagtgacaacacaagctgtgttcttgtatggtaa

SEQ ID NO: 3031 - DNA, 627 bp, Glycine max var. Williams 82
atgattctcattatctccctcattttttctcttctctctttctcccatgcttctgtcctagatttctgtgttgcagattatgcaggtcctattggacctgcaggatattcctgcaagaagccttcaaaggtcacagcagatgattttgcttacagtggccttggcattgctggtaacacctcaaacattatcaaagctgcagtgacccctgcatttgatgctcagtttgctggtctcaacggtcttggcatttccgcagcacgtttggacttagcagcaggtggagttataccacttcacactcatcctggagcttcagaattacttgttgtaattgaagggagcatcctagctggattcatttcttctgccaacattgtctacctcaaaactcttaagaagggggatgttatggcattccctcaaggcttgcttcatttccaaatcaatgcaggcaaatcttcagccctggcaattgtaagcttcagtagctccaatcctggtctacaaattctggacttcgctttgttcaaaagtagtttccccacaccattgatagtacaaaccactttccttgatgctgctctggtgaagaagcttaagggtgtacttggaggctcaggctaa

SEQ ID NO: 3032 - DNA, 3841 bp, Glycine max var. Williams 82
gtgaaggcagtaagcagcagcagcggctaatacaaaacaaagaaaggcgtgcaaaataagaaactgagcttcttctcttctcttcctctttgcgttccatcactttctcaacttgtctgtcctttcgttccacccttcaaccacttctcagttttcccttattattattattgtattttcctttttcttctatctttctgttccatcgatcacctccaaatccaattatatatttatatttttcactccgcaacccaacactacctgaaccaacttcttcatcaatttattctccctaaagcttcgccaacggccaccccaactctctgctttccagcttcttcctttcttttgctatttcgaggtcaattttccttttctctgtcatttttttaccgcttcaattcgtatcgtattgggggagggggttctgttactgactagtatgttgtgcttccattcaattacatctttttttttcctgtgatcattgttttgtttcgttcaattggcgcgtgttttcttcctctatgtttctcagttagcgtaacagactgagcagagcatgaaaattgaaaatggaagatattcacttcctctttgggcttttttgtttaattaattttattttataagtaatccaagttattttttagttatgtggaagcttttgcttgtatgggagacataggaaaaatgggatatggcatgattagttgtggacccagtgtagactacgttcattgttcatttggtatcgtatgttcagttggtgcagttactagcaataaaataggctgctaacatcacctttaatcacttaagtaaagtcttttaagagttgttggctttatttggtgagtgtcacctcctccccccccccactatttgatggacttcacatcccaacctatgacaccaataatgggggcagcactttaaactggatgcagctctgagaattcttaagcaaataaagttgcactcttgccattagctatagcttctcacctagtggcacagatgactggaatttcaaaggaagaagggtcagctagtccaagttggggtgcttcattttttatgcagacaagagaggaagtggctagagctgttgcagctgctgttaaccctccaatgtcgtcaaaagatgataatagtggtagccaacttcaaaggctgcagtatcaagttgcaaaaatgttaaaaggcttttctcaccctcctgatgttgaaacaacaaattacaatcctgaaatcctgactagtctgaagcgtcaatgggctgcaaactttcagttgcagtacatggaccataggtcttggaaggaaccttcacgactgtttgaaagcatggtggttgttggacttcctcctaattgtgatgttcaggcactgcaaaggaaatatgttgatagaaagtttgaaggctctggtaaattgagaagtgcactcggttatcagaatcaatctcgtgtagaacccaatattgaacctcaggtcttatttgtttaccctccagaaaaacagctgcctcttaagtgcaaggatcttctttctttctgcttccctggaggcttagaggtccgtgctgttgagagaaccccttccatgagtgagttgaatgaaattctttatgggcaggaacaccttaaacaaagggatctgtcatttgtattcaggttacagggtgctgacaactcaacactttatgggtgttgtgtcttagttgaagaactagtgcaaaagccctctggattgctttctctgatttctgataagcagccttcttactcgtctttgagacggcatatattaaccactcagagatgttactgcatactttcaaggctcccagcttttgatttgctctttggtgtattgaatagcatcttcacacaagaaaggctagagcgtttgacaaaaggtgttggagatttaaatttagaatttgatgaaggtaaccataaggaagaaaacctagagggctactcagacagtgttttggtgagtgatgaaccaatagaagacagacttggtggaaatatggtaatttctcaatcaagagtaggaaagtctacacctgaaaatattgtggatgatggtcaaccagagcatctaatggttgatggggagctgcagccttataaggagagaatcaattatgatgatgtcttgcttactgatcctgtaaatgataggacaacagccaaagaagattctggccctgcaaattctgaaaatagtgatcactatggagatgcttttggaaccaacaaacaatcagaagacaaacatttacctaatgctattttgcccctcctgcgctattgccagtatgaaagctctgaatcttcctgcagttttcaaggctcgccttgtgaagaccgaaattttaggagtgatgttgatgataatgagacagaagaagcatctttctccggccaagaggatttaaacgacttaaatgatattcttgaatgggccaaggaaaataaccacggaccactacaaattgtaagcgagttttaccgtttaagttgccctgccaggggctcatcacttacatttcatcctttggagcacttgcatcccttggaatatcacagatcagctgagacagttctacgtcttgctggttcaacagttgatttgaaaacgtcaagtactggtctgggattagctgatgcacacattgctcttctggtggaagaggcaaatgcattatctgtatgggctgtagcttgcttgtgcggtacattgagacttgaaaatgtgttaacattctttgcaggagttctactagagaagcagatagttgttgtctgttctaatttgggaatcctatctgcttcaattttatcagttattccactaatccagccttaccggtggcaaagcctgctaatgccagttttaccaaatgacatgcttgagtttttagatgcacctgtcccttatgtagtcggtattaagaacaagaccagtgaacttcagtcaaagtttaccaatgttattctggttgatgctgatagaaaccaggtgaagtcaccaacaataccccaactgccaagacagaaagagctagtctcttctttacgtccttatcatgcaactcttgtaggagaaagttacttgggtaggagaagaccagtatatgaatgcacagaagtgcagattgaagctgcgaaggggttcctttcagtgttaagatcttacttggattctctttgctataacatccgttctcacacaatcaccaatgtacaatccaatgatgataaggtatcattgcttctgaaggagagtttcattgagtcgttcccatatcgtgatcagccttttatgaagcttttcgtggatacacagcttttttctgtacatacagaccttgttctttctttcttacaaaaggaatagggttgccatgcaaaacattatggtaatatatattgttttgcttcaagcttgaacgcaagttcagtgttgtataattttcctaaattgggtttaaaattttctccctttatccaatccagtctctgcccccaaaacgatccccgggcacctttttcttaggctttgtgcgtctgcggtacctgtaaatacatatttgaatgttgtattcaagcctagctaaaagagttacaagggtttcattctatgtaatttttttcttccatgcaacaaaactaagagatgattaatcttatgctcctaagactgttatccggatttgatagctgtttgtttccgtgagttcattccagatagtccgtgtttgtgcacttcatagcagagatgggaatttatttatccccttttataaaaaattagtccc

SEQ ID NO: 3033 - DNA, 1651 bp, Glycine max var. Williams 82
aacatagtcatctgttgcgtaataatttactattttcaaaaaagctgaaactcctctctttattcttttttaattgtcaaaactcaaaaataacaaattcatgaacgagaagtactgtgttcgtactgcatatagtttgttgaggtttctgttcctccttcattcccttccttcactcttcatgcactattttcattttgctaagggatcgatcataaggaggaagaaatacaaggttttgggacctcttctcttggcttataaaaagtccaaaacaggagccttcttggtgttttagaaaggaggaggcttgggggaaaagggtggagaaaaaagtggttaaagggacagcaacttattggatactggaggataagaagactattgctacaaggcaaagtaaaccaatggaggaaatatcttctagtgttgcagtaccttttacacttggtgttggaaatttgattcaaaaggagtccgcggtgacgactcacatggagataactgggctgaagctcatggcaaatacagcagcggctgctttaatgttaaatcctgcagtggagtgtttaaaggagaatcaagttggagctgctgctcttgtctcagaaatggttattgaatgtgagagtaattgggtcttgaatgaaagccataaccaggcaataaaggaagatgaattgatgttagcagtggattttcagtctctgcatagttcaagctctcaatctgtggctaatggcaaaagtgatccttgtagggaggaagctgcagcattgaagagtagtttttctgaaatagattcaccaatcatgatcaaggttgatgatgatgttgatggtaagtccggaataagcgagctgtgtccatcaatgaagccgccagtggaggaaacagtttctgttgctatggatattactagtgaggatcaaagtggatcagatgagtctgatcctaaaccatctgctgtgcttcttgatcagttgccaggggagagtaaaacatggagaacaggcaacccaaatgctttggaattgaatagtggacctctctggggttgttcatcaatttgtggaatgaggcaggagatggaagatgctatttctgttaagcctcgactttttcaagtttcttcacagatgctagtgaatgaccatgtgaatgagaacgaaaaacagtcactagcccacttttttgctgtctatgatggacatgggggccttcaggttgccaattactgccaggaacgtcttcattcaaaattgattgaggagatagagactgcacaatcaacttcggctgaaacaaatgggagaggtgattggcaggaccaatggaagaaagcatttatcaattgttttcagaaaatggatgatgatgtgggaggaattggtgcaagtaacaggggaaacaacagtggtgggtctgagtctaatattaaaactgttgctcctgagactgctggctccactgcagtggttgccattttaagccaaacccacatcatagttgcaaactgtggagattcaagaactgtcttataccgtggaaaagaagccatgccattgtcttctgaccacaaagtaaggcatttcattccaattttttagtacttttggtgaatttatattagaagccaaagatgtctgat

SEQ ID NO: 3034 - DNA, 1593 bp, Glycine max var. Williams 82
atgggattatcactttccttactccaatctgcgtgggaagaaattgttagacattttcccttttctgatttgcctctcagcatcagctttgcttccaaagatggaactttgattttaagggcatcaagcttcaagagaagagaatcagaaagtgctattactgttttgtcaaacgggtccagaagttcgaaccggttgagggataacagaccccaacatgtgatccttgaaagaaacttttcgtttgttcaagatgaggagaacaacaaaatgggttgggatactcttgcaagcaaaggtggtgaattgaaacataaaccagtgcctgtgctttctctgcctcaagcagcgattttctctcactctagacctgcctctgagcttgatgctgcagcaacaaagcttcaaaaagtttacaagagttaccgtactcgaagaaaccttgcagattgtgcagtggttgtggaagagctatggtggaaggcattagactttgcagctctcaaacggagttctgtgtcattctttgatgttgaaaaaccagaaaccgccgcgtcacggtgggcaagggcaaggacaagagtagctaaggtcggcaaaggtttatccaaagatgacaaagcacaaaaactagccctgcaacattggcttgaagctattgacccacgtcatcgttatggacacaatttgcacatgtattatgatatttggtttgaaagtcaaagcactcaaccatttttctactggttggatgttggagatggcaaagaaataaatcttaagaaatgtccaaggagcactctacaaagccaatgcattaaatatcttggaccaaaagaaagagaagaatacgaagtaatagttgaaaatggaaagctagtttacaaaaaggatggtaggcttgtggacactgatgagaaatccaaatggatatttgttcttagcaccacaagggccttgtatgtggggagaaaacaaaagggtacgtttcaacactcaagctttctttctggcggtgcaaccacagcagctggcagattagtggcccatcaaggtgcccttgaggctatttggccatatagtggtcactaccaccccacagaagagaacttcaaagaatttataagctttcttgaggagcacaatgtagacctcaccaatgtaaagagatgtgctatagatgatgataatccatcacttattgggactaattcatttactgccactaatgaatcacaacaagctatgggccctactctaaattctcacacaggcccagcaagtgcaatcaatgtcaatgatagcaagacgcacaaaaaggatgatgcagcaacatttaacttgtctaagaggttgtcttgtaagtggaccactggggctggacctcgtattgggtgtgtccgtgactatcctgaacatttgcaatcgagggcgttggaacaggtcaatttgtctccaaggcccacttctgcacgcctgagcaattacggcccaattccttcacccaggcccagcccgaaagtgaggatgtctcccaggattgcttacatgggcttgcccagtccaagaaacccaattccagctgcgagttaa

SEQ ID NO: 3035 - DNA, 1215 bp, Glycine max var. Williams 82
atggggggagaagaagtagcaagagtcaaagcagagttgttcgacgacaacgaaagcgatcgcaacgacgacgacgttttgagcgagagcaaggactcgggagtgacgacggctcacgcagtgaaagaagagatggatgacggcgccgctaactggtcttcgtcgtcgtcgacttcgcccaaaccgatggaagggttgcacgaggtgggcccccctccgttcctgaagaagacgtttgaaatggtggaggaccctcacaccaaccccattgtgtcgtggagccaaactcgccatagtttcgtcgtttgggactcgcacgagttctccaaaacccttctcccaaagtacttcaagcacagtaatttctcaagcttcgttcgccagctcaacacctatggctttaggaaggttgattcggaccgttgggagtttgcgaatgaaggattccaaggagggaagaagcatttgctgaagaacataaggaggaggagtaagtgcaacaaactgcatcagggagcattcaatatgatgaagccagacgtggattctgaagtggagaagctgaagaaagaccagaacattttgaaggtggagattctgaagctgaggcagcagcaggaaaattctcatgttcagctcacaaatgttcaggagagaattcggtgtgcagagatgaagcagtttcagatgatgtatttcctcaccagaatggctagaaggcctgcgtttgttgagcagttagtccataagattaggcgaaaaagagagattgatggtaatgacatggttaagaggcctagattgatgggaaatccgtgccatgtacccttccctaagacaatggaaacaacacctaattttgattatagacaccaacaaggtcataaacaatttgcaacattgcaatctgagctcaatgtgacagaagtgaactccagtaggatggagcacccaactccctctcctttagaagatgaattaggcaactctttgcaagggttaagggctcatggttgttctagagcaagggcacaagatgcatcttcttctgcctatcatgttatgtcagaaaaactaatgagagaaaattctatagttgatgaagaactagatgtgaatgactccaatatctatcttgaattagaggatttgattactaagcctacagattggtctgttggatctgcaagtggattggtggaacaaactagttga

SEQ ID NO: 3036 - DNA, 354 bp, Glycine max var. Williams 82
atggattgctggcacaaaatcactaagacttggacttcactctctactcgtttcaaacatcatcgcaaatctagtggtcgagttggtggtgccgctcaatactctgccgattgtgacggaatcagtgccggtttgctcaagcttcgagatgatgtgcaaatgtgcggctacagagatgttcaggtcatgtggaacatgttgaacgtaagtttgcaacatgaccaaatgccaatggaagcagccagaagaagctccaacaacgctaaatttcgcaagcgtggctgcagcaagcagagatcaatttcgagggtcttgttttggactaaccgtgacaacctcgtgaatgtacagtaa

SEQ ID NO: 3037 - DNA, 306 bp, Glycine max var. Williams 82
atgagttcttctatcttccttctatgttgccttctcatattttctttatattccctctcccaacacacaggctactctctagatgctactccaacacggaagttgagcatgccagcccctgtccacgacctcaaaacccagtataaaatgcagggagcagacaaggcaatggaaagtacccctgcaaacgaagattccatgacaccagagtataacagcaacagttacagtccccatgatcttgtctttcatatagattaccatggagtaacaactcatccaactcctaaacatcccaaaccatag

SEQ ID NO: 3038 - DNA, 2533 bp, Glycine max var. Williams 82
tttgcttccatgctacattgaccagttgagacacacacacatacacattggctacacagaattggcaacagtgcctatgattgattcaccaaggaatctgattttcccaaagagcaaaccaatgttttgtttttcgtttcagtttctgccaccacaattacttgtacaataaaaccacacacaaagagagaaaggaaaagagagagagagagagagagagagagagattcatagaatgggaatggcaacataacaagaagcttagcaaaccgttggtggcgcttggggtggcaattggcggcgactggttccaccaatcaacattgggaatctgagacccaatttcaatttcaaaccaatatctcaatcaaacttcacctatttaatccttccaactcatgcactttcaacatgttcacacagcttcagggtcttagaaagttctgatctttcaccttattcctcttcagttacaggattggtacataatatatcagtatgcgggatagtgagaagaagttaaacaaaaaaggatctaaaaaatccagtcctttgaaggtgcgtaagaagggccaagggaagaaggaaaaagtgaaagtgggatcaaaatctcacacaaaaaatgctggcactgatatatcaaggaagagagttatctcttctctcaaggtcaaagggccacctaaggattcttcagataagaaattgattattggaaaaaaattgcctatcaagaacaaaaaatcttcactgaagccatcctcaaagttacaaggcaaaaaagcttctcttagctctagaaaagaggggggagatgctgatggggcggtaaagcttcccaaaatgaagaggaagagaaagaagaaaaggcaaaggaataatgtggatcttgatgatccttcacgcctgcagaggagaacgaggtatcttttaattaaaatgaagctagagcagaaccttattgatgcttactctggagaaggttggaaaggtcagagtcgagaaaagattaagccagaaaaggagcttcaaagagcaaggaagcagattttaaaatgtagacttggtattcgtgatgtcattcgccagttggattctcttggttcactgagtagcattgaagattctgccattgctccagatggatctgtttaccatgaacatatattctgtgtaaagtgcactgtgcgtgaagagcttccagataatgatattatactatgcaatggtacatgcaagcgtgcttttcaccaaaaatgtctagatcctcctttggacactgaaaatattcctcctggagagcagggctggttttgtaaattttgtgaatgtaaaatggaaatactggaggcaacgaatgctcatcttggaactcacttctccttgcacagtacttggcaggatgtattcaaagaagaggctgctatacctgatggtgagactgcattactgaatcctgaagaagaatggccatctgatgattctgaagatgatgattatgacccagagaggaaagaagacagccacaatatcaacacagaaggagcaaatgatagtgcatctgaggacttaaccagttctaccagtctgtgttcttctgatggtgaatcttctccagtagatggtgtcagtcatgaatatttttctgtcaaaagcagcatagattctgatgagtctgaggacaaagcctgtggctgtaggcagcgaaaagccgttgactacaagaaactttatgatgaaatgtttgggaaggatgctcctgcatatgaacaattgagtgaagatgaagactggggtcctggcaaaagaaagcgaagagaaaaggagtctgatgctgttgattctcttatgactttgcatgaaagtgagaatatgcaccccaataatgagcacctcgacatgacaagaaaaaattcttcaagcataaaaatcaaaaggcattgttttaggattccacatgatgcagttgagaagcttcgccaagtgtttgctgagaacgaacttcctccaagatctataagagagggtctttcaaaagagctgggacttgacactgagaaggtcagcaaatggttcaaaaatgcacgttacttagcacttaaaaacagaaaggactttatggagatcagtgatgatgtgagcttgaagaaactgttaaagaaaagaaagaagaggttgataagttttacatttgaaggagactctcaggcggcagagttggaatttgaaaggctaagcaaattgaagactaaagtagatagtatgaagcaaaaattaactgcaattcaaaattccagagttaaggattcaaatgaaccccattctagtgaaccatccattgtatatgtacccacagcagtgttacgggaaaaggttgaatgataacttttattgaaaaaatgcaaagcaggggaatacatgatttgtagttagttcctgtctcaccttgtattattcaaagaaaggaactgttttgaagttaatgatattatacctgtctcacttcacttggtaatattaaatattaataata

SEQ ID NO: 3039 - DNA, 1745 bp, Glycine max var. Williams 82
agaaattaagaatggacagcggcacagcacgtagagaaagaaagaagaagaaaaaatctgttttggtactatagtaaaagttgaagttggggaagtataaagtgaagtgtggtgttattgggttcatgaaattgaaatctgaaactgaacatcagcctccgcagcagtatatatggattcactgcttcttcgatctttccctaatattaataacgcctcttctctcaccaccactggtgcaaatttctccaggactaaatctttcgccaacatttaccatgcaagttcttatgtgccaaatgcttcatggcacaataggaaaatccaaaaagaatataattttttgaggtttcggtggccaagtttgaaccatcattacaaaggcattgagggagcgtgtacatgtaaaaaatgtaatataaaatttgttgtgaaagcgacctctgaaaaatctcttgagtctgaacctcaagcttttgatccaaaaagcattttggactctgtcaagaattccttggatgctttctacaggttttccaggcctcacacagttattggcacagcattaagcataatttctgtgtctcttcttgctgttgagaaaatatcagatatatctccattattttttactggtgtgttggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctgagtttttggcttggctgggttgtaggttcatggccattattttgggccctttttgtaagctttgtgctaggaactgcttattcaatcaatgtgcctctgttgagatggaagaggtttgcagtgcttgcagcgatgtgcattctagctgttcgggcagtaatagttcaacttgcatttttccttcacatgcagactcatgtgtacaagaggccacctgtcttttcaagaccattgatttttgctactgcattcatgagcttcttctctgtagttatagcactgtttaaggatatacctgacattgaaggagataaagtatttggcatccaatctttttcagtgcgtttaggtcagaagccgcttatggagtcgccctcctggtgggagctgcatctccttgtctttggagcaaaattttcacgggtctgggacacgctgtgctggcttcaattctctggtttcatgccaaatctgtagatttgaaaagcaaagcttcgataacatccttctatatgtttatttggaagctattttatgcagaatacttactcattccttttgttagatgaggatgcatctgcattattgacttgaaaattagttttgtttaaatggtgctgcctttgtcaaaggcaggcgttgagtcgctacgttagttttaagtttttaattgctaatttaaatgaagaattatttcttttgggatgaaattttgtttactgctttgttttcagtggtttctccaatgattttttcaacttattactattaaaaaaaaactaaaaaactaacaaactaatggttcaagcatcatcattacttctaagataatttcattttttaacagaattatgtgtcttgaaaacaatactagatgcaataactttgaatatttataaatatggactttatataggagaattattatctaatcagtgat

SEQ ID NO: 3040 - DNA, 1821 bp, Glycine max var. Williams 82
atggtacttccctcccctgccaaaatactagttggcctctccttagacccagatgacaacaaggagcttctctcatgggcaataagagttttagccaatccaaatgacaccattgtggctgtgcatgttcttgttgttgcggacaagaagaagcgtgtctcggtcagaagaaggcaatcacaacttaggcaggcaaaagcttatgttatatctgtgcttggagaatttgtacaatgctgttggtctaagcaggttaatttagaggccagggtagcactcaattcctcagttggtgaaggtttagtggaggaagccaagtccatcagtgctgactatcttcttatccgtggctcgagaaaccgaacaaataaaattggaacttctaaaggaattaccaagtattgctttgagcatgcacatgatgggtgtacaatggtctcagttgggagacttacaaaggcaaatcaaagtgccaattcaaactcaacacgttttcaagcagataaaagacaaccaagttcaagatggtttaagaaggataaccaatatggcaagggtacctcccctgttctaaaggattatatatcaggaagcaaggctcagaaccgttcaccaagaacagtactaaatggtctagagggacaatcgaacagcactgaagatgataccttcagcactagggtctcaagcaccacgtataccccatcgtcatcggattctaagaggcgatccaagataagaaaaccacagttctcgttcaggttcatagcctcattccttgcttcaccatttagaagcaaaaactttagcatatccaaaaatgaaaagcgtcagcctttgttgaagtgcttcagctatgaacagatatccaatgctaccaaagacttccaccgagataatttggttggacgaggtgggtactcggaagtatacaaaggtgatctttcagatggacgaagcattgctgtgaagaggttggccaaggacaacaaggatcctaacaaggaaaaagagtttcttatggagttgggtgttattggacatgtctgccatcccaatactgcaactttagtgggctgctgcattgaaaatgggctttatctgattctcaattactctcaaaatggaaatttggctactacactccatggtaaagcaggagattcactagactggccaatcagatacaaaattgccattggtgttgcaaggggtcttcattatcttcacaaatgttgtaaacaccgaataattcaccgtgacattaaagcctctaatgttcttctgggtcctgattatgaaccacagattaccgattttgggcttgcaaagtggcttcctaacaagtggacccaccatgctgtgatccccgtagagggcacatttggatacttagcgccagagtactttatgcatggaatcgtggatgagaaaacagatgtttttgcatttggaatcctacttttggagattgtaactggacggagacctgttgattcatcgaagcaaaaccttctcttatgggcaaagcctcttatggaatcagggaatattgctgagctagctgatccaagaatggaaggaaaatatgatggagagcaactgcatagggtagttctaacggcttcatactgtgtgagacaaactgccacgtggcgtcccccaatgagtgaggtattagagctgctaaccagtggccaagagagtgagattggaaagagctggaggatcccaaagttcatttctgaagaattggatgattactctatggttttcggatatgatgtaccctcagacatatcattggaggattatttgtga

SEQ ID NO: 3041 - DNA, 1254 bp, Glycine max var. Williams 82
atgtgtgatttgagaggaccaaaaccactgttgtatactttaaaagaaaaaaattcatttggacacaagctccttaagttgagcacttcattattccgtaacagtgtgccaattatgggatcctccttcagttgctgcggctcagagagggtcgaagaagtgccaacatcatttggcgtagttcacaattcatggagaatattcacatacaaggagttgcacgcggctaccaacggattcagtgatgataataagcttggtgaaggtggttttggaagtgtctattggggaaggactagtgatggtcttcagatagcggtgaagaaactgaaagcaatgaactcaaaggcagagatggaatttgctgtggaagttgaagttcttggaagggttaggcacaataatttgctgggtcttaggggctattgtgttggggatgatcaacggctcatagtctatgattacatgccaaatctcagcttgctttctcatctccatggccagtttgctgttgatgttcaactcaactggcaaaggagaatgaagattgcaattggctctgcggaaggtcttctgtacttgcaccgtgaggtgacaccccacattatccacagggacattaaagcaagtaatgtgcttctgaattcagactttgagcctctagttgcggattttgggtttgcaaagctaatcccagaaggagttagtcacatgaccacacgtgtgaagggtacattgggatatttggcacccgaatatgccatgtggggaaaagtctccgaaagctgtgatgtctatagctttggaattcttctcttagaacttgtaaccggtagaaaacccatagagaagctcacgggtgggcttaagaggacaataactgaatgggccgagcccctaataaccaacggaaggttcaaggaccttgttgatccaaaactcagagggaattttgacgaaaaccaagtcaagcaaacagtcaatgtggcagctctttgtgtccaaagtgagcctgagaaacgacccaatatgaagcaagtggttaaccttttgaaagggtatgaatctgaagagaagaaggtcactaccatgaggatagatagtgtcaagtataatgaagaattattggcacttgatcaatctagtgatgatgatcatgatgatgcaaccgctatctttggtgtttttagtgccattgaaatccaaaagatgaaggatccatacaagcaaagtgataacaagattatgggctaa

SEQ ID NO: 3042 - DNA, 1495 bp, Glycine max var. Williams 82
gccaaagtcgttcggccggcattaattacatgtgtgatttgagaggaccaaaaccactgttgtatactttaaaagaaaaaaattcatttggacacaagctccttaagttgagcacttcattattccgtaacagtgtgccaattatgggatcctccttcagttgctgcggctcagagagggtcgaagaagtgccaacatcatttggcgtagttcacaattcatggagaatattcacatacaaggagttgcacgcggctaccaacggattcagtgatgataataagcttggtgaaggtggttttggaagtgtctattggggaaggactagtgatggtcttcagatagcggtgaagaaactgaaagcaatgaactcaaaggcagagatggaatttgctgtggaagttgaagttcttggaagggttaggcacaataatttgctgggtcttaggggctattgtgttggggatgatcaacggctcatagtctatgattacatgccaaatctcagcttgctttctcatctccatggccagtttgctgttgatgttcaactcaactggcaaaggagaatgaagattgcaattggctctgcggaaggtcttctgtacttgcaccgtgaggtgacaccccacattatccacagggacattaaagcaagtaatgtgcttctgaattcagactttgagcctctagttgcggattttgggtttgcaaagctaatcccagaaggagttagtcacatgaccacacgtgtgaagggtacattgggatatttggcacccgaatatgccatgtggggaaaagtctccgaaagctgtgatgtctatagctttggaattcttctcttagaacttgtaaccggtagaaaacccatagagaagctcacgggtgggcttaagaggacaataactgaatgggccgagcccctaataaccaacggaaggttcaaggaccttgttgatccaaaactcagagggaattttgacgaaaaccaagtcaagcaaacagtcaatgtggcagctctttgtgtccaaagtgagcctgagaaacgacccaatatgaagcaagtggttaaccttttgaaagggtatgaatctgaagagaagaaggtcactaccatgaggatagatagtgtcaagtataatgaagaattattggcacttgatcaatctagtgatgatgatcatgatgatgcaaccgctatctttggtgtttttagtgccattgaaatccaaaagatgaaggatccatacaagcaaagtgataacaagattatgggctaagtccaaagaatatatataatatgaacttattcattgtgtgaagtcttttttatctattggtatttgataatgtaatcaactttcaacttctaagtataattttcccataatgattaattattcatcttatgcttttaatcacggcggtgtacaaggctagaccatcgaagttgctgtcttagatctctaatttttttttaattgtttgcttt

SEQ ID NO: 3043 - DNA, 2568 bp, Glycine max var. Williams 82
atgctatcaagatcttgcttggggctattgaatttggtatcagtggatgattaccacgcgctggctagtcgcgctccgcggctggtgaatacggcggccggagacttgccggagttagacatcgacggcatggagaattcgggatccgacgacgccgttgcgccggcgccgctcgagcggaggatcgtggtcgcgaatcagttaccgatacgcgcgtttcgcgaggggaagaaatggaggttcgagtgggacagagacagcctcgtccttcagctcaaagacggatttccttccgacgtggaagtgttgtacgtcggttcgcttaaagcagagatcgaaccctgcaaacaagaagaagtcgctcagttactcctcgaaaagttccgctgcgtcccaacgtttattccttcagaagttcacaacaaattctaccatggtttttgcaagcattacctgtggcctcttttccactacatgctacccatgtcgccgagccaaggcgcgcgtttcgaccgcgagcagtggaaggcttacgtgctcgcgaacaggatctttgccgacaaggtcaccgaggttatcaacccggacgaggattatgtctggattcacgattaccacctcatgatactacccactttcctccggaagcggttccaccgcgtgaagctggggttcttcttgcacaacacgtttccctcctcggagatataccggactctgcccgtgcgcgaggacattctccgcgcgtttttgaactgcgacttgattgggttccatacattcgactatgcgcgccattttttgtcgtgttgtagtaggatgttggggctggattatgagtccaagaggggttacattggtttggattactacggtcgcaccgtgacggttaagatcctccccgcgggaattcacatggggctcttggagtcggtgttgtcgttgccgcagacggcgttaagggtgaaagaattaaaggaggagtatgaaggaaagattgtgatattgggagtggatgacatggacttgttcaaaggtattagtttaaagttcttagctttgggtaagcttctggaagtggatgagagtttacggggtcgtgtggtgttggttcagattctgaacgcggcgaggagcaaagggaaggacattcaggacgtgaagaacgagagcgaggccattgcgagggagataaatgagaaatattcacaaccgggttaccagcccattgtttacatcaatggaccaatctccacgcaggagaaggctgcgtattacgctgtttctgagtgttgcgttgtgaatgcggtgagggatgggatgaatttggtgccttatgagtacactgtttgtaggcaggggagtgttgcgttggacaaggctcttggcgttgaaggtgaggataagaaagctcctaagcagagcgttatcattgtgtctgagttcattgggtgttccccttcgctcagtggagccatcagggtgaatccgtggaacattgatgatgtcgctgaggctatgaattcggctgttacaatgtcggaggcagagaagcatctgcgccacgagaagcattacaagtacataagctctcatgatgtggcgtactgggctaggagttttgatcaggacttagatagagcttgtagggagcattactctaagaggtattggggtgttggattgggtttggggtttagaattgttgctttggatcctacctttaggaagctctctgtggatcacattgcctcagcatatagagatacacacagtcgattgatccttttggactacgatggcacaatgatgccgcaggcaacaataaacaagactccaagcagggaagttattgctgtcttgaattatttatgcagtgatcctgaaaacatggtgttcattgtgagcggcagggataaggattgcttgggcaagtggttttctccgtgtgagaaattgggtctctctgctgagcacggttacttcactaggtggagcaaggattctccttgggagacttgcggattggcgactgattttgaatggaaaatgattgcagaacctgtgatgtcgctttatacagaagcaactgatggttccttcattgaacataaggaaagcgcaatggtttggcaccatcaagaagcggatccttattttggatcatgccaagctaaagagcttcttgatcatctggagagtgtgcttgccaatgagccagtagtggttataagaggacaacatatagttgaagttaaacctcagggtgtgagcaagggtaaagtggtggaagaccttatctcaatcatgcgaagtaaggggaagtcaccagattttctactgtgcataggagatgatcgctcagatgaagatatgtttgaaagcattgctcgttcagcatctaatccagctcttcccaccataccaaaagtgtttgcttgcactgttggacagaaaccaagtatggctgaatactatttggatgatactagcgaagtaatgaagttacttgaaggacttgcaaccgcttcagcaccatctgcgtccatagcttctcaggaattgtga

SEQ ID NO: 3044 - DNA, 342 bp, Glycine max var. Williams 82
atggaagtgagtggaaggagctgtggcgttttgggcctcccttattgtgtacctgtgagaaaaaatggaaggaggtttgtgacaactttggctaaaaggaatgagtctcaagagaagagtaagggaccctctttcacactgagggtttccaagtcaactatcgctcgtggtgccattggactgtttggattggggttcgtcgatgccgggtacagcggagactggtcgaggatcggagtgataacaccgcagactgaggatttgcttaagcttgcagcttttctcgtggttcccttgtgtatttttctaattttttttctgcccagcgagcaaaattcttga

SEQ ID NO: 3045 - DNA, 1938 bp, Glycine max var. Williams 82
atggcgacaaaggaaggcaaagccataggcatcgatctcggcacgacctacagctgcgtgggcgtgtggcaaaacgaccgcgtcgagatcatccccaacgaccaaggcaaccgaaccactccctcttatgtagccttcaccgacaccgagaggctcatcggagacgcggcgaagaaccaagtcgccatgaacccgcagaacaccgtcttcgacgccaagcgtttaatcggtcgcagattctcagactcttcagttcaaaacgacatgaagctgtggccgtttaaggtcgtggctggccctggcgacaagcccatgatcgtggtcaattacaaaggcgaggagaagaaattctccgccgaagagatatcttccatggtgttggtcaagatgagggaagtggcagaggcgtttctcggacacgccgtgaagaacgctgttgtcactgtccctgcgtacttcaacgactcgcagaggcaggctacgaaggacgcaggggcaatttcgggtttgaatgtgttgaggattatcaatgaacccaccgctgctgccattgcgtatgggttggataaaaaagcttcgagaaaaggtgaacagaacgtgcttatctttgaccttggtggtggtacttttgatgtttcgatattgaccatcgaggaagggattttcgaagtgaaggccactgctggtgatactcatctcggaggtgaagattttgataacagaatggtgaatcactttgtttctgaattcaaaaggaagaacaagaaggatattagtgggaatgccagagcgttgaggaggttgaggacagcgtgtgagagagccaagagaacgctctcttccacagcgcagacaactattgaaatcgattcactatacgaagggattgatttctatgctacaattacgagagctaggtttgaggagatgaacatggatttgttcaggaagtgcatggagccggtggagaagtgtttgcgtgacgccaagatagacaagagtcaggttcatgaggttgtgcttgttggaggttccactaggatccccaaggttcagcaactcttgcaggatttcttcaacgggaaagagctttgcaagagtattaaccccgatgaagctgtggcgtacggtgctgctgttcaggccgcgatcttgagcggcgaaggagacgagaaggttcaggatttattgctgctggatgttacaccactcagtctcggtcttgaaactgctggtggtgtcatgactgtgctgattccgcggaacacaactattcccacgaagaaggagcagattttctcaacctattctgataaccagcccggggtgttgatccaagtgtttgaaggagaacgggctagaacaaaggacaacaatcttctcgggaagttcgagcttacagggatccctccagcaccaagaggagtgcctcagatcaatgtctgcttcgacatcgacgctaacgggattctgaatgtctctgcagaggataagactgctggtgtgaagaacaagatcacgatcacaaacgacaagggtaggttgagcaaggaggagattgagaagatggtgaaggatgcagagaggtacaaggcagaggatgaagaggtgaagaaaaaagtggaggctaaaaattcgcttgagaattacgcgtataacatgaggaacacgataaaggatgagaagataggagggaagctgagcccggatgagaagcagaagattgagaaggctgtggaggatgcgatacagtggttggagggaaaccagatggcggaagtggacgagtttgaggacaagcagaaggagttggaagggatctgcaaccccatcattgctaagatgtaccagggtgctgctggacctggtggagatgttcctatgggtgctgacatgcctgctgctggtgctggacctaaaattgaagaagttgactaa

SEQ ID NO: 3046 - DNA, 711 bp, Glycine max var. Williams 82
atgttgcatccaattgtcaagtggctgtcattcacaacatgcataccctatttattaatcgttaattggaaaagccaaaacccactactatactgctttgcattgcatatctctctcacacttctctcccatattcaattaatcaatatggcttcatgttttccaaatgcatctccatttttggtcatgctcgcaatgtgcctcttaatttccacctctgaagctgaaaaatatgtggttggaggcagtgaaaaatcctggaagtttcctctctcaaaaccagattcactcagccattgggccaactctcaccgatttaaaatcggcgacactctcatatttaaatacgaaaagagaacagagtcagtgcacgaagtgaatgagacggattatgaagggtgcaacacggtggggaaataccacattgtgttcaacggtggcaacaccaaggtgatgcttaccaaacctggattcagacacttcattagtggaaatcagagtcattgccagatggggttaaagctggctgtgcttgtcatatcgtcgaacaaaaccaaaaagaatcttctttccccatctccttcgccttcaccgccaccatcatcgttgctatcaccatcaccttcgccacttccaaataatcaaggtgttactagtagttcaggtgcgggattcatcggggttatgatgtggttgatgttattgctttaa

SEQ ID NO: 3047 - DNA, 984 bp, Glycine max var. Williams 82
accaaaatgtgatgttgcatccaattgtcaagtggctgtcattcacaacatgcataccctatttattaatcgttaattggaaaagccaaaacccactactatactgctttgcattgcatatctctctcacacttctctcccatattcaattaatcaatatggcttcatgttttccaaatgcatctccatttttggtcatgctcgcaatgtgcctcttaatttccacctctgaagctgaaaaatatgtggttggaggcagtgaaaaatcctggaagtttcctctctcaaaaccagattcactcagccattgggccaactctcaccgatttaaaatcggcgacactctcatatttaaatacgaaaagagaacagagtcagtgcacgaagtgaatgagacggattatgaagggtgcaacacggtggggaaataccacattgtgttcaacggtggcaacaccaaggtgatgcttaccaaacctggattcagacacttcattagtggaaatcagagtcattgccagatggggttaaagctggctgtgcttgtcatatcgtcgaacaaaaccaaaaagaatcttctttccccatctccttcgccttcaccgccaccatcatcgttgctatcaccatcaccttcgccacttccaaataatcaaggtgttactagtagttcaggtgcgggattcatcggggttatgatgtggttgatgttattgctttaaattgagagtattgtgtattcgcaattttgcatgttaatgcctccgtcactaatcactatatatgcaatatatatatttgtggttgtggggttagttattcaggtcaagcatgcattttcgctttcatttttgtaattttttttaaaagtttggacgttttcttttgattgcgcaattgtgcccttaaactcaatgcccgtcttggtaattttgagattgaataagtcatttggatttttatgcatgtgggtttgctgttcct

SEQ ID NO: 3048 - DNA, 1125 bp, Glycine max var. Williams 82
atgccaatggcttactcaaaaagtttttcattcctcatttccattctccttttcatctttcataatttccatgtatccactgcacaaaaaatcaaaggagggtactggttccccggcagcagttttgcagtgtcagacatcaactccacgctttacacccatctcttctgtgccttcgccgacttgaacgcctctacttaccaagtcaccatttcctcctcaaacgcacctcagttctcaaccttcacccaaaccgttcagaaaaagaacccttcagtcaaaaccctcttatccataggaggtggtgcttccaatccatcaacattctccgccatggcgagccaagccggtcgccggaaaacattcatcgattcatcgatacaactagcccgatcgaacaacttccacggcctcgacatggattgggagtatccatcaacttctacagacatgacaaactacggtttcctcatcagagagtggagaacagctttggtcaacgaggctagaaactcagggaagcaaattttgctcttagtaggagcagttttttactcttccaattattactcattgaattacacaattcaggatgtaattaacgcctttgactttgtgaatgtgatggcttatgatttctatggaccaaattggtaccccaatttcacagcaccaccagctgctttatatgctcttaaccatccagcagctaatcgggttagtggtgacatggggatcagagattggattggatccggtatgcctgcgagtaaactggtgctgggtgtgcccttttatggctatgcatggcgtttgttgaattctaataaccgtggattgtttgatagagctaatggttcggcctttggtggtgatgggtccatggggtacagtcagataagggagtttgtaagccagaatagagcagcgtgtacgttcaattcaactgtggtctctgattattgctcttctgggacaacatggattggttatgatgacgtgcagagtgtgtctgcaaaggttgcttatgccaagacaaataatttgggtggtcattttgtttggcacgttggtgcggattacaattgggttctttctcaagcagcttcccggacgtggggatga

SEQ ID NO: 3049 - DNA, 2175 bp, Glycine max var. Williams 82
cacactcctcactatacaaaaacattttcactctcactctctcgttatctctcattctctctgttttctccaaagcaaaaccttccctacacactttcaatggccgccaaaacggtaacccctgacgccgtttcgatgctcctggcaaacacttgccccgattcctcatcggatctccccgaaatcgttgttcaagttctcgatctcaaggcgacaggcaataaatacatgtttactgctaatgatggaaaaacgaaactgaaagctatgatttcttcggatatgtgctctcaggtgctctccggggctattcaaaacctaggtcttattcgcgtccttgattacactgtcaacgtaatacccaataaatcggacaaatacctcattgtcactaaatgtgaacctgtatctcctgcgcttgaaattgagataaagagtgaggaatctggatctgggattcttttgaagtccaaggtagagggtggagtcaatactgaaggtcctgctgctgctgggattcttctcaagcccaaacaagtagtgacaaaatctgccaatcagattctacgcgaacatggaaattcggctcctgctgcacgaatggcaatgacgcgtagagtgcgtcctcttgtttccttaaacccttatcagggtaattggacaataaaggttagcgttacgagcaaagggaacatgcgtaactataaaaatgctaggggtgatggttgtgtcttcaatgtcgaattgacggatgaagatggtactcagattcaggcaaccatgtttaataatgctgcgaggaaattttatgacaaatttattctgggaagggtttactacatttcaaaggggactttgaaagttgctaacaagcagttcaaaaccgtgcaaaatgattatgaaatgacgcttaatgagaattctgaggtggaagaggtagccggtgaagcaagttttgttcccgaaacgaagttcaactttgtgcagattgatcagctgggtcctcatgtaaataagtccgagcttgtcgatgtcattgggattgttaagaatgtgtcttcaacaatgaccattcgtaggaagagcgacaatgagagtattccaaagcgtgacattactattgctgatgacaccaagaagacagtagttgtgtccttgtggaatgaacttgcaactaccacaggacaagagttactggacattgttgataaatctccagttgttgcaatcaaatctctcaaggttggggacttccaaggtgtttctttgtcaactataggcaaaagtgtggttctggtaaatccagtcatacccgaagcaaaaaatctcagaagctggtatgattttgaaggcaaggatgctgcaatggactctgtaggctctggttcaagtccaacatctaacaatgggattagatcagtgtacactgatcgtgttttactttctgacataacctcaaacccatcattgggggatggcaagcccgcatttttcagtcttagaggacatataagcttcataaagcctgatcaggcaatgtggtatcgtgcctgtaagacatgcaataagaaagttactgaaagcgttggttctggatatttgtgcgatggatgccagaaaagcgatgagcagtgcagtttaaggtatattatggttgccaaggtttctgatgcaagcgctgagacttatatctctgcctttaatcaggaagctgagaagatcattggatgctctgctgatgatctagataaccttaaatcacaagagggagaagttaatccttatcagatgacattgaaggaagctacttgggctcaacatctttttcgggtaagtgttactccgaacgagtataatggcgagaagagacaaaggataacagttcgggcagttgttcctgttgacttcgctgctgagtcaaggtttctgctggaagatttatcaaagatgagagcataagatggatatgcggattcacagtttctacatttttttgctaacggttgtttagtatgttaccggttgtaattattaattaattccctaggtggcttatattatacattttgccgagttttatagaatatctttgccatccacatggttactgattttccattatgtcatcagtgattcctcaaaaagctttgcctcaatgaaagtgatttttctttc

SEQ ID NO: 3050 - DNA, 1167 bp, Glycine max var. Williams 82
atggcttccttacccagttttgctccttttgtatttctattgcttgtaattgggagcaatgcaaggactttgtatccacttcccagcaaaggtggtaatgggagtaggaagcccctacaaacttttcgcccttataacattgctcatcgcggttcaaacggagagcttcctgaagaaacgcgtcctgcatacttgagagctattgaggagggtgcagacttcattgaaactgatgtcttatcttccaaagatggtgttcttatatgtttccatgatgttacccttgatgatactactgacattgcaaatcacacagggtttgctaaccgtaaaagaacatatgaagtccaagggataaacatgactggcttttttcctgttgatttcacattaaaggaactaaagtcattgagggtgaagcagaggtatagcttcagggaccaacaatttaatggaaaatttcaaatcatcacttttgaagagttcattaccatagcacaggatgcacccagagttgttggaatatatccagagataaaaaatccagtatttatcaatcaacaagttaaatggtcacatggcaaaagatttgaggacaagtttgtggagacacttcagaaatatgggtacaagggttcctacctgtcaaaagattggttgagacaacctgtatttattcagtcatttgctccaacttcactcgtgtatatatcaaacaaaacggacttgcccaagattttcttaattgatgatgttattgttccaacgcaagacactaatcagtcattttgggagattacatctgatgaatacctagactacataaagcaatatgttgtgggaattggaccttggaaggacacagtggtacctgtggtagaaaattatatgacaaatcctactaatcttgttgccagggcacatgctcataacctgcaggtgcatccatatacttaccgaaatgagttcccatttttgcacttcaacttcagtcaagatccgtatatggagtatgattactggatcaacaagataggcgttgatggtctctttacagacttcactggtagtcttcatcgttatcaggaatggacctctaaccataaagatgatgatgacaagaatctattgcataaaattgctttgttagtctcctcttatgaatga

SEQ ID NO: 3051 - DNA, 4583 bp, Glycine max var. Williams 82
gaagagaaacaaagtctaatcatatctgagtctcgaggaccactaaacatttctcagttaccttttttttgttttgtctttcttacaaatcaaattatatataaccaaaaaacatggactttctgacccagctctgaccagattttggtgcccattttcatgattctccatttgttgagactcgagaaaacattaatacaatacttcttggatctgcagaaattcattggaactagtttcatttaggtgtttcaagccgttgtgtgtgtgtatttgttcctctgcgttttttgtgcatatttttgggagcattaattgtctatatttttggtaaaaccaatacccaaatgctaatataagtcctaattgcaaaaaatttgggaatgcaattcagttggcaaaatttgttctctttcatattttttaaggaaccaattctatatttatttgatgaaatcaactagagatttttttttgcatcaaatatttattgtggccctgtaatttagcaatagtattattgtttatgtgtaagctgaggatggaaaaccaactttgtggatgctgaatatggaactatataacataaatgtggagacctgctccattgacttgtagttgtcttatgaaccgtgtcctggaattaacttctgagtgtaaaggaagagaaaggagcttcctttatatctttaagcacaatttggatggtaaggactaaggagtaaggacccttgtgagctgtctgaaatgctggattctatgttatattaattgttacttaatagaatctgcaaccttatcagaaagtgtttgcactttgcattgttgtcgtcttttgttagtggatttgagagtacaaatgatgaagcttttatgaagagggagtaattgtaattgattgtggtggttgagagaagttgagtttaattggagaagaagaggtagatatggcagcaaagctattgcattctttagcagatgacaacccagatttgcaaaagcagataggatgcatgactggggttttccaactctttgatcgtcaccatattattcctcctcgccacattacccagaagatgcttcctccaggtaattcccactccaattatgacaacctggaaagaggttctaatagaatacaccaaagacaatcagcagctgatataaggggtgtgagtgaaaaacaaagaatttcaacggaatcatcaagaacctcattctcttcttcttgttcatcatcaatgtcctctttggagtataaagctcaagcaggcgctcccttcaaccggaatggttatcctaaaagtcctatgagggagccagttatgaaccaaacaagttcctctcccgatttaagatgtcagtcccttgatctgagggatgtggcgaaggactctatgtatagggaggccagaggactatctaaagaaaaggattccccaacacattttcagctgtccaaatccatcaaaggaaaacaaactcctattcatctaagggagtctctgagagtccttgctaaacttagagaagcacctcggcattatgttgaagctaaagaacttccaagattatcatatgaagtaaaaggacattggcattccatctcaaaggatgctcctcggttttcttatgatggaagagaaacaagtggtacatctttcgaatcacatgattcctttaaatgcccaccaaagctaaaagagcttgctagacattcacttgacagtagggaaggttcttggcgtgcatatggctctgattcaaaatccagtaacccctcaagaaatttcaatgcaggtgatgcctctacctcagttgacaacgtttctagtcgacaacaaccgtcagcatcccagagccggccacctagtgttgtagcaaaattaatgggcttggaagctttgccagaatcctataatgccagtgatactaactttagtttgagtgaaactggctcagctcaaggcaatgatcagtttttgaaaaatggactcgtcaagccacttcgagttcataattctcctaaaatctcattgaaagacacgacttcccctcgatggaagaatcctgacttggctgtgaaaccaatcttaagttcaaggtttcccattgaaccagcaccatggaagcagcaggatggaaaccaaagctctgagaaactaacttcccgggccataaaagctactgcaagatcaccagattcatttccatcagtttattgtgagattgaaaagagattgaaggatcttgaatttaaacaatctggaagggatctcagagctctcaaacggatactggaagcaatgcaagtaaaggggctgttagagaccagagaagaagaacaagctttaaatgttggaaataaaagagactatgaactaaatccgagtcttattcagcattctatatcagtgaggcaacaaacagccagggaaactgaatctgtaaaggctatagaatcaccaattgtgatcatgaaaccaggaaaacttattgagaaaagtggaatttctgcttcttcagtctttccaattggtgaactctctgattcccataaacttcggagtggtggtgtacatgcacatgataaaagggggacagcttccaatcaaatagcaaaagatcagtctcttagaaacagtcactggaatgctcctaccagttttagtgaaaagaaagaaaacagtatcaggactattaaatcagcacaatcccaaccaaggtctaaacaacttccaaaagaaaatagtccaagttcagtaaagaattcgggatctgttagcctgagaatgcaacagaagaagttagagtctgagaagcaatctaacctgcctaccccaccatccgattcaaataatcccagaaggcagtcctttaagcagccaacagaatcaggttctcccagtcaaaaactgagacctaaagttgctagttcacggtactgtgatgaccgacttagtgagactagcaatgaattgagaagtctaagtagtcagtgggatgaaatatctctgcaatcagacagtatcacagttgactcaaagatggatactgaagttaccagcagtttacaatctgctgaaattattgaaagccaatgctcatctatgaagcctattgagcatttggtttcaggatcaatgcataagaaatcaactctgaggtggaatgaggatgagtcaattgcagaacctgcaacatatgcctcagatcatccaagtcttgattcagtcgatgatgtctcggtatacaaatatgatatgccatccccagtaaagagtaaatccaatgctcctaaagctgataatgctcaagaaaataaagcaaatgataatacagatcagtggaaccctgcagatggtttcttcgttaacaacacgatcaactgcaagaaattgcaaagcatagattgtcttattcaaaagcttaggcagctaaattcgagtcatgatgaaactagaaacgattacatagcttccctttgtgaaaatacaaatccagaccacagatacattgctgaaatactattaacttcaggtctattattgagagctttgagttctgagttgctgacatttcaacatcactcatcaggtcatcccattaaccctgagttattccttgtgctggagcagaccaagttaagtagtttgctttcgaaagacaaaagcagatttggaaaagctgcttacatgaagctaaatacagagaagtggcagaggaaactcatctttgatgctgtgaatgagattcttggtgaaaaactaggctcttttcttgagccatgcttgaagcctaatgaactcgtagcaatgaaattcgtcagtgcacaaaagcttcttaaagaactttgctttgaggtacaaaaacttcaatatgtgaagccagattgtagcttagaagatgagggagatgaactgaaaagtatgctacgggaagatgtgatgtgtcactcagaaaactggacaggtttctcagttcaattacctggggttgtgttggatgctgagagacagatatttaaggacttaattgatgagcttgtgattgatgaaatggctagtttgcaagtgaaatccggtaggcacaggtagctatttggaaagttgttcattccatttgttccctattttcgtgaatccataatgcatcattttgttcatttacacataattttttgtatcaagccataaaagtttgcagattaagagctttgactatttttgctaaattgtgaagcaagtaacttgccatggattttacaccataagtattctcaagagttcgttttggaacatgtttgtcatctctgagtttggcttctgtaactgtaaggccaccaacttccttgccatgaaggcattgacggacctatgttgtcctgagggggtgcagatgcgcgggactttgatgaagttacaagtatatatttagtgttgttatctttttgccccttcaatttttataatttcaactcactgctctcaatttttcatttctagactttgagaaaaatacaagtatatatctagtattattatcattttgtctcctctatttttttaatttgaatccgt

SEQ ID NO: 3052 - DNA, 774 bp, Glycine max var. Williams 82
atggagtccccaatctcaatccgcgacactgagatccctcttcaaatgcagaacatcatcgacgcttccaccgcttcttacatcaaatccctccattccctcagagccacagctcaagaaactgctcgatttcaactagacgaggttaaagctaaactcagagagaccgaggatgatttcgttaaagcacttgcagtcaagacccgtaaagaggccaagcgaatggctttgatggatgttgttgcttctgcaaaggccagagttgaagacctcagcgcaagtattcgggaccatcgaaccaaaaaacaagaatatgccgcatttatatctctcgctttggcagcatctaaagggaagttaaatgaaagcattgaacggaaagatgaaacacaggtcatttcttggtacaatagggtccttggttttcaggtaaaaggtggacgtggggtaaaattcacattcaagaatataaatattaacaatccagatgaggagtactttttactcttccatgaaactgatacatactcatggaatttagttgtgacaactgatgaacatgaagaatctgcctttaactctgcatctgctccagttttatcaatgtcatctgttagaagagattttctaggcaaggaaaatgagcatcaagctgaacctacagaaggcaataaacagttcaaaaaacaaaatgtgcacagaaggctaaaatcatcagttttatctcctggatctgcttcatctgtttgccagtctcctcgtttgaaggtatga

SEQ ID NO: 3053 - DNA, 1080 bp, Glycine max var. Williams 82
atgaggattagaggaaaaagcatgaagaacttgtactggttcaaagagatttctaacaacgtgagatcagggagaaggctttcactaggggaatacaagagagcagtatcatggtcaaagtatttgatctcttctggggcagccataaagggagaaggagaagaagaatggagtgctgatctgtctcagttgttcatagggtcaaaatttgcctctggaaggcatagcaggatctacagaggcatctacaagcacatggatgttgcaattaagctggtgagtcaacctgaggaggatgaggaattggctgttttgcttgagaagcaattcacttctgaggttgctttgctctttcgattgcgccatccaaatatcatcacttttgttgcagcttgcaagaaacctcctgtcttctgtataattactgaatatttatctgggggttccttaagaaaatacttggttcaggaaggaccacattcagttcctctcagagttgttctgaaattagccttagacatagcacggggaatgcaatatcttcattctcagggtatacttcacagagatctcaaatcagaaaacctgctgttgggggaagatttgtgtgtaaaagtagcagattttgggatctcatgcttggaatcccagacaggcagtgcaaaaggattcactggaacataccgttggatggctcctgaaatgatcaaagaaaagcgtcacaccaagaaagtagatgtctatagtttcgccatagttctgtgggaactattaacaggattgacgccatttgacaacatgacaccagagcaagcagcatatgctgtgactcacaagaatgaaaggcccccgttgccatgtgactgtccaaaggcttttagtcacctcatcaacagatgttggtcaagcaatccagataaaagaccacattttgatgagatagtcgcaattttggagagctacactgaagcacttgagcaggatccagaatttttctctacttacaaaccatgtcctaataatataattcttagatgcttgtcaaaatgtaataatatatttgcttcttgcaaagcttaa

SEQ ID NO: 3054 - DNA, 348 bp, Glycine max var. Williams 82
atggcattacgcgagcttcttatgatggggatattgctgctggtatgtcttgctaaggtttcatctgatgttaacatgcaaaaggaagaagatgaagaacttcgctttcctaatcaccctcttatcgtgagagacgggaacagaaggctaatgcaagacatagattgcggaggattgtgcaagacaaggtgcagtgcccattcgaggccaaacgtgtgcaacagggcttgtggcacgtgttgtgtgaggtgcaagtgtgttcccccaggaacttcaggcaacagggagctctgtgggacctgctatactgatatgatcactcacggcaacaagaccaagtgtccgtag

SEQ ID NO: 3055 - DNA, 1150 bp, Glycine max var. Williams 82
ttgcccccttcctcttagttgagtatgctactcaatacaaaagaagaaaattttgtgcagcattgttggctagtatctaaattctagaaagaaaagaaaaattaaatatgaaactgtgcaagtatatttactctagcataaaaacagtaataagaaactagttaattagaacaacatattgaaagtccaatgctatatctttatgttaaaacttcaaaatataaaatgcaataatatctttatttatagtagctaagaagatatttatgaaaatgttattgtgtatgctaaaagagtgagtgttgtacttaaccggctcccacaatagcaaacattgacacggaacactcagaagtgttctggcattcggtaaataaaaatctctcgaaacataggcctataaaatgccaaagattgggccattttggtaatttcatgttacaagatatgttttctgagttcctcttttgcctatataaatgctagtatgtagagtgagcaagccactaactcaattagaattctccaaacactctagaatttgcatgcactgttcttcatacaatggcattacgcgagcttcttatgatggggatattgctgctggtatgtcttgctaaggtttcatctgatgttaacatgcaaaaggaagaagatgaagaacttcgctttcctaatcaccctcttatcgtgagagacgggaacagaaggctaatgcaagacatagattgcggaggattgtgcaagacaaggtgcagtgcccattcgaggccaaacgtgtgcaacagggcttgtggcacgtgttgtgtgaggtgcaagtgtgttcccccaggaacttcaggcaacagggagctctgtgggacctgctatactgatatgatcactcacggcaacaagaccaagtgtccgtagagcccggcccattgaaggtcagccctatccaattgggcccttcacacaccgagttgattacaccaagcaaagttagtctagtttagtaaataataaatatgggttatgtacacttttatggatttggattttgcatcttaagatcgtgttctagtttttacctttgttataatgtatcgtattgttggagccaagtttataaattttatatatattttttaattcgggtctcatccgt

SEQ ID NO: 3056 - DNA, 1135 bp, Glycine max var. Williams 82
ttgcccccttcctcttagttgagtatgctactcaatacaaaagaagaaaattttgtgcagcattgttggctagtatctaaattctagaaagaaaagaaaaattaaatatgaaactgtgcaagtatatttactctagcataaaaacagtaataagaaactagttaattagaacaacatattgaaagtccaatgctatatctttatgttaaaacttcaaaatataaaatgcaataatatctttatttatagtagctaagaagatatttatgaaaatgttattgtgtatgctaaaagagtgagtgttgtacttaaccggctcccacaatagcaaacattgacacggaacactcagaagtgttctggcattcggtaaataaaaatctctcgaaacataggcctataaaatgccaaagattgggccattttggtaatttcatgttacaagatatgttttctgagttcctcttttgcctatataaatgctagtatgtagagtgagcaagccactaactcaattagaattctccaaacactctagaatttgcatgcactgttcttcatacaatggcattacgcgagcttcttatgatggggatattgctgctggtttcatctgatgttaacatgcaaaaggaagaagatgaagaacttcgctttcctaatcaccctcttatcgtgagagacgggaacagaaggctaatgcaagacatagattgcggaggattgtgcaagacaaggtgcagtgcccattcgaggccaaacgtgtgcaacagggcttgtggcacgtgttgtgtgaggtgcaagtgtgttcccccaggaacttcaggcaacagggagctctgtgggacctgctatactgatatgatcactcacggcaacaagaccaagtgtccgtagagcccggcccattgaaggtcagccctatccaattgggcccttcacacaccgagttgattacaccaagcaaagttagtctagtttagtaaataataaatatgggttatgtacacttttatggatttggattttgcatcttaagatcgtgttctagtttttacctttgttataatgtatcgtattgttggagccaagtttataaattttatatatattttttaattcgggtctcatccgt

SEQ ID NO: 3057 - DNA, 1761 bp, Glycine max var. Williams 82
atgacaggcgtagagacaatgggaaaaaatgagaatcaaagtgtggaaaaaaatgagaaaagtgtcatagatgaggagccaaagattaactacagaggatggaaagtcatgccctttatcattgggaatgaaacttttgagaagctaggaaccattggaaccttagccaacctcttggtctatctcacaaccgtcttcaacttgagcagtcttacagctacaaatattattaacatcttcactggcagcgccagtttatctaccttgcttggggcttttctttgtgacacttattttggccgctacaagacactgggattctgcacaattgcttcttttctggggttgcttgttatacaactaacagcatggattaagaaaatgcatccacctcactgtggaagtgagagcatcacatgcacaggcccaaccacagggcaaatgacatttctgcttgctggatttggacttctaattgtgggagctgcagggatcagaccttgtaacttagcatttggagttgatcagttcaaccccaacactgagtctggaaaaaagggaatcaacagcttcttcaattggtacttctttacctacacatttgctcaaatggtgtctttgtcactaattgtctacatacagtcaaacgttagctgggcaataggcaattattacgtgaaagttaaagcaactggtccagctccactaacaagtttagctcaagctgtagttgtggctataaagaaaagaagactgaatctatcagaatatccactggattcttcgctctttgcctatgtttctccccagtctattaactccaagcttcttcacacgtctcagttcaggttcctagacaaagctgcaattataaccccacaagacggcataaacccagacgggtctgcatcagatccttggagtctttgcagcatgcaacaagtggaagagctaaaatgcttgctgagagtgatccccatttggttcgcaggaattttcttctacattgcaatagtccaacagaacacaatgctggtcttccaagcccttcaatccgacagacgcattctcagcaccaacttcaagatcctagcagcctcctacaccatcttccagatgctgagcctaaccatatggctacccatctacgaccgaatcctcgtgccgtcgctccaaagggtcaccaaaaaagagggtggcatcacagttcttcaaagaataggctttggcatgttcctctctatactatgcacaatggtgtctggtgtagtggaagaaagaagaaggacattggctttgaccaatcctattggattagagccaagaaaaggtgccatttcttcaatgtcaggtctatggttggttcctcagctaacactggcagggttatctgatgcattcgcgattgtgggacaagttgagtttttctacaaacagtttccagagaacatgaaaagccttgcagcgtctctatttttctgtggcctcgcgggatcaagttatttgagtagtttgctgatttctattatccatagggcgacagctaaatcttcaactgggaattggttacctcaggatctcaataaggggagattggattatttttattacattataactgctctagaagtcgttaatttcggttactttatattgtgtgccaagtggtataaatacaaagggactggttctagcagcagtggtgaccttcaactcgatcaagtatccaaaccatccgaaagaactgttaacactgtctag

SEQ ID NO: 3058 - DNA, 675 bp, Glycine max var. Williams 82
atgttcaagtctttggttagcagagctactaaggattcaatttcacgcaaccacaatgccattgcttcttttgctttctctaggtgtgctcattcattatcatttgccacagtagaagcagaagaggtatcaggttctaggccagctgaagttttgcacttggtgcaaggtaaatgggtaggatcttcaaattggaacacaattgcagatcctttaaatggagactcgtttattaaagttgctgaagttgatgaaacgggcattcagccttttataaagagcttgtccagctgtcccaaacatggtgtacacaatccttttaaggcaccagagagatatcttatgtatggagatatatctactaaggcagctcacatgctatcacttcctaaggtttcagatttctttacaaagttaatacaaagagtttctcctaagagttaccagcaggcttttggggaagtgtcttttggtgtccctggaaatcatcttagacaacaaagtcatggttttcgttggccatatggtcccgtggcaattattactccttttaattttcccttggagattgctgtccttcaattgatgggtgcactttacatgggcaacaagccagtccttaaagttgatagcaaggcaagttcttttggctctgattttggcatacttttatga

SEQ ID NO: 3059 - DNA, 1389 bp, Glycine max var. Williams 82
atgaactccatagccttcaaatccttcgtcggcctccgccagtcctcgccggaggccccacatttcgctgcccagtcccgccccgccactccccaccgcaaattccgcgtcgtggccggaaaattcagccccaggctgaacggccggaacctccgcgtggcggtggtgggcggcggtcccgccggaggagccgccgcggagacgctggcgaagggcggcgtggagacgttcctgatcgagcgaaaaatggacaactgcaagccgtgcggcggcgccatcccgctgtgcatggtgggggagttcgaccttccgctggacatcatcgaccggcgcgtgacgaagatgaagatgatatcgccgtcgaacgtggcggtggacatcgggaggacgctgaagccgcacgagtacatcggcatggtgcggcgcgaggtgctcgacgcttacctaagggaccgcgccaaggagaacggcgccaacgtcatcaacggcttgttcttgaaaatggatattcctaaggataataactccccctacgttctgcattactctagctacgacgggaaaaccaatggagctggtgagaagcgtaccttggaagttgacgctgtcattggcgccgatggggccaattctagagtcgccaagtctatcgatgccggtgattatgagtatgccatcgcttttcaggagagggtaagaattccggatgataagatggtgtattacgagaatcttgcggagatgtacgtgggggatgatgtttctccggatttctatggatgggtgtttccgaaatgtgaccatgtggctgttggcactggtaccgtgacacacaagggagacatcaagaagttccaactagcaacaaggaaaagagcagaggacaagattttgggaggcaagatcatccgagtggaggctcaccctatcccggaacatcctcggccacgaaggttgtcgggaagagtggcgttggttggtgatgctgctggctatgtaaccaaatgctctggagaggggatctattttgcagccaagagtggcaggatgtgtgcagaggcaattgttgaaggttctgagaatggaaaaaggatggtggaagaaggggacttgaggaagtacttggagaagtgggacaagacttattggccaacttacaaggtcttggatattcttcagaaggtgttttataggtccaaccctgcaagggaagcgtttgtggagatgtgtgctgatgagtatgtgcagaagatgacctttgatagctatttgtacaagacggtggtgcctggcaatccattggaggatctgaaattggccattaacaccattgggagcttagtgagagccaatgcaataaggagggagatgaagaaacttaatgtatga

SEQ ID NO: 3060 - DNA, 804 bp, Glycine max var. Williams 82
atgccttctgcttttaatttcctcacaacttctctgcttccctttctccctctctatcgaggaaacatggtatttttgggtgttctcttggtggggtttctcttaggtgcttatggggacagtgatggttggatggatgctcatgctaccttctatggagggggcgatgcctctggcacaatgggtggagcttgtggatatggaaacctgtatagccagggctacggaactaacacggctgctttgagcacggccttgttcaacaatggtttgagctgtggggcttgctttgagatcaagtgtgtcaatgaccaaaggtggtgccttccagacacagttgtggtcactgccaccaatttctgtccaccaaacaatgccctcccaaatgatgcaggtggctggtgcaaccctccccttcaacattttgatctctctcagcctgtcttccaacaaatagctcaatacagagctggcatagtacctgtggcttacaaaagggtcccatgtcaaaagagaggaggcatcaggttcaccatcaatggccattcttacttcaatctagtcctaatcaccaatgttggtggtgctggtgatgttcaagcagtttcaatcaaaggttcaaggactaattggcaaccaatgtccagaaactggggtcagaactggcaaagcaacacttacctcaatggacaaagcctctcctttaaggttaccactagcgagggccgcaccttggtctctaacaatgttgcccctgatagctggtcctttggccagaccttcacagggaaacaattcaattaa

SEQ ID NO: 3061 - DNA, 975 bp, Glycine max var. Williams 82
atggaagtttcatgcaagattctcagaagatcaactcacagttttctgcaaaactatcattacttcacctcaacagcagctttcttagcttttcctttctcagcttcaatactcctctctcaagcattagtcccttctccttcatccctcttgcctcaaatctatagccgactaaggactctctttgatgctgcaggcttcccttcttcacaattgtttaccattctcaacctcaaagtttctcaaacaatcacttcttcaatcctcacccttcctttcacactcacctttctcctcattgcaaaagcatccataattcaggctctcaatcaccacaaaccaacttttccaccatccttcaaatcaatactatccctttacaagcctctcctccacacctatttttgcaactgtttcttgattctctcagcaaatgcaagtgcttttggtctcatgttttcggccttcagcttcattgaaagacttggctactcttcctcccctagtggcctcatcctcttcatgtcagtaactggggcaattctcttttctgtgattcttgccaatgctattgtcatatgcaacatggcactggctctatctggcatggagggacatggtggatacttggcaattctgaaagcatgtcttctcctaaggggaaggacttcaatggctttgttcctggcacttcctgtcaatgtggccttggctgccattgaggccttgttccaattcagggttgtgaggccctatcatattgctggaataacaaggccttgtgtggctttggaggggattttcattgcttacctctactcaattttcatcatccttgacacggttgtgagctgcatgttctacaaaagccttaagacaggaccactgatcggtcatgaggacaaacatttgttcaggattgaattcccagatgaagacaagtacggttacatgggcaccaaggaacttccttga

SEQ ID NO: 3062 - DNA, 525 bp, Glycine max var. Williams 82
atggataaagctctcactaaactgggtagcacttggatctccaagaaagccaaggcagagatttcccacataaccgacgacctatcatctctctcaaatactgtcgaagagaaggcaaagcttttcatcaacaagctcaaaggtaaaacccagaaagccttgccagatctccttcgagagtacagcattcctccgggtctgttcccccgcaacataacatgctacgaatttgatgcatcaaagggaaagttgatcgtgtacttatcctcaccctgtgaggtgtgcttcaaggactcatccattgtgaggtatgcaaatcgtgtcaaaggaacattatcaaaggggaagctcagtgttacagatggaatgaagaccaaggttcttgtgtgggtcaaggtgactagtgttgttgttgagagttacaagtctgacaaagtatggttcactaccaccggagttaagaaatcaaggcccaaagatgcatatgaaatgcctcgtgatgctattaaggtagaagaattttga

SEQ ID NO: 3063 - DNA, 1614 bp, Glycine max var. Williams 82
atgtttttgtctcccttcaacttcatcctatcttctctctgcctttttcttctcatttttcttgcaaccttacctcgtagtcctacccccgagtcagtttgcaaaatcatgggtagtgagatagatactaaatcaattgaaccggtccggaatgccgtttctttgtttggagataaaagtgatcagaagaaatatcaaactgcgaggagtaagagtgaatgtgaaaaagaatttgaggagttgaccaaggaattggccaactgcaaagtacaattagaagcaaagcatgctgcacacatgcaatcacttcttaagctggagcacaaccaaaagatgattaatgagttgtctaccctgctgaagaaatctgacctcgaaagaaacaagaacatgaatgaatgttcagattgcaaggctcttaaagatgaactagagtccaaggtgaaagagatggctgatcagaatttggagactgcaaaggtccgggaccagctttcacatgttttaagtgaattgaaggccacacaaagggagcttcttaacaaagaaacaaaacttgttgctgctagagatttagaactgaacgctttgaaaaatgcaaaacaaatggaatctgccttggaggccgaaaaggaacagaaagaagaactcctgcagcaagtgaaggagctcaatgaagttatttacgattcaaaactagctgccattgaatttgagaaagagaagttagctatattgtctgagaaggatgagaaaattgagttagcaacaaaagctactgctcaattagaacaacagttaaaagatatgagaaagcatgtagaaatgctacaaggattacaaaatcaaccaatggataagtctacactggttggttctcttcctttggaacctatgcaagctaatgaaacactggtcatggaactaaaggagagaaagaccatggaccaatctgtgtacattgagagactagaaatggaattgagtaagttaaaacaagagcttactattgcaaaggaagaaagaaattccttgaatattactactgaatcactcaaaagtgagttacatgagactaaagcagccctaaacatgaacaaggagagtgacattgaagcacaggtggaaattgcattgctcaaatctcagcttcaggaacataggttggctcacaagaatggacatgttactgaagtttccaaagctgatcggtcaaaggcagaagctgaagagcaaaatagtgagaataacaatgacagtgtcacaagcaaatccttagttgagaagagaaatgaagttcaaggatcggtaggggaagttggaagattttcagagttagcattgatgaaaagggagctggaaaatgcattagtgaaaatttctgagttgagggcacgtgcagaacaggctctaagcagggctgagtttgctgagaatgctaaagcagcattagaggacaaaataaggagacacagggaacataggcagagaaggagggctgcacttactgcacttagggaggaatctacccctaaaccatttagtccttccacatcatatggaacacctggaacctaccagcccttaggtaaggttctgaatatgaaaatgtga

SEQ ID NO: 3064 - DNA, 3276 bp, Glycine max var. Williams 82
atgtcagagcaggaaacagattcctgtggcttgctcttattctttttcttgatccttctttcaggtaaagttgctgtaggggaatctttggacaaagacaaagaggttctgctgaagctgaaattttacctggacagcaaaattcttgcagacagaggaggttacatatattggaacgccaatagctccaatccttgtgaatggaaaggaatttcatgcagtgctacgaagagggtggttggcatagaactttctaatagtgacatcaccggtgagatattcatgaatttttcgcagctcactgaactcacacaccttgatctctctcagaacacgctctccggcgagattcctgaggacttgaggcactgccacaagcttgtacatctcaacctatcacataatattcttgaaggggagctgaacttgactggattgataggcttgcgcacattagacttgtcaaataacagattttatggggatattgggttgaatttcccttccatttgtgccaatttagtcgttgcgaatgtctcaggtaataaattgactggtgtgattgaaaactgctttgatcaatgtctcaagttgcagtacttggatttgagcaccaacaatctgagtggaagcatatggatgaagttttcgaggctcaaagagttttctgttgcggagaaccatctaaatgggactattcctttggaagcttttcctttgaattgtagccttcaagaactagacctttcacaaaatggatttgctggtgaggcacctaagggggttgctaactgcaagaatttaacaagtctgaatctttctagtaacaaatttactggggctattcccgttgaaatagggtccatctcgggcctcaaagcattgtacttgggaaacaacagcttttcaagagagattcctgaggcccttctgaacttgaccaatttgtccttcttggatttgagcagaaaccaatttggtggggacatacaaaagatatttggcaaatttaagcaagtaagctttcttctgttgcattcaaataattacagtgggggattgatatcctcaggaattctcacattgccaaacatttggcggttagacctaagctacaacaacttttcaggtctattacctgttgagatttctcaaatgactggtctgaagtttctgatgttatcctacaaccaattcaatggatccattccaaccgaatttggaaacatgactcaactgcaggcactcgaccttgccttcaacaatttgagtggatctataccctcaagccttggaaacttgagctccctcttatggttgatgcttgcaaacaattctttaactggagaaatccctcgagagttgggaaactgttcaagcttgttatggctaaaccttgccaacaataagctctctggaaagttgccttctgaactgtccaaaattggaaggaatgccacgaccacatttgaatcgaataggcaaaactatcgaatggttgctggatctggtgaatgcttagcaatgaggagatggatacctgcggattaccctccattcagctttgtgtacagcctcttaaccaggaaaacttgtagagagctttgggacaaattgctcaaaggatatggtgttttccagatttgcacacctggtgaaagaattcgcagaacacagatatccgggtatattcagctaagttcgaaccagctcagtggtgaaatcccttcagaaattgggactatggtgaacttcagcatgatgcacatggggtttaacaacttctctgggaagttccctccagagattgcaagtattcccattgtggtgctaaacatcacaagtaaccagttttcaggtgaaatccccgaagaaattggcaacttgaagtgtttgatgaatcttgacttgtcttgcaacaacttctctgggacgtttccaacaagtttgaacaaattgacagagcttaacaagttcaacatctcatacaaccccttaatatccggtgtggttccatcaacaggacagtttgctacctttgagaaaaattcatatttaggcaacccctttctgatccttcccgagtttattgataacgttaccaacaatcaaaacaacacctttcccaaagcgcataaaaagtccacaagactgtctgtgtttttggtgtgtatagttataacactggttttggcagtattcggacttcttacaatcctagtctgtgtatcggtgaaaagcccttcagaggaaccaagatacctcttgagggatacaaaacagtggcatgattctagcagctccggatcctcatcatggatgtctgacacagttaaggttatccgtttgaacaagacagctttcacacatgctgatattctcaaagcaactagcagcttctcagaggaaagaatcataggaaaaggaggatttggaacagtgtacaagggagtgttttcagatggcagacaagtagcagtgaagaagcttcagagggaaggcctcgaaggagaaaaagaattcaaggctgaaatggaggttctgagtggtcatggatttggctggcctcatccaaacctggtcacgctctacggttggtgcctaaatggttcagagaagatactgatttatgagtacatagaaggtggaagcttggaggatttagtcactgatagaacacgtttgacatggaggaggaggctagaagtggcaattgatgtggcacgtgcactagtctatttgcaccacgagtgctacccttctgttgtgcacagagatgtgaaggctagcaatgtattactagacaaagatgggaaggccaaggtcactgattttgggcttgcaagagtggttgatgttggggacagtcatgtgagtactatggtggctgggacagtgggctatgttgcaccagaatatggacacacatggcaagctactacaaaaggggatgtgtacagttttggggtgttggttatggagttggcaacagcaagaagagcagtggatggaggtgaagagtgtttggtggagtgggctaggcgtgttatgggttatggacgacatcatcgcgggttgggtcgttctgttccagttttgctaatgggttctgggcttgttggtggggctgaggagatgggtgagttgctaaggattggggtgatgtgtactgctgattcaccacaggctagacccaacatgaaggagattcttgctatgctgattaagatatctaatcccaaggggtactcaagttatggacactaccttgtttag

SEQ ID NO: 3065 - DNA, 327 bp, Glycine max var. Williams 82
atggcaactggtgccgccccagatggattattctggtcagtggtgtatgaagggtgcatatctggctatgataactgcgtggaacgacgaccctaccaccgtaactgtggctgtgcactccataacacgtcacttattaatcgcacgcacaagcttccgaggtgtaacaatgtgtcataccctatgaggagggcatggagtgaaggaagcttggtcttggcaacttcttcttcttcatcatctccttctcaagttgcaactgggggaaggccacaaccaagtttggcaaacgttgaggaggaaaataagaattgctttaattattga

SEQ ID NO: 3066 - DNA, 1152 bp, Glycine max var. Williams 82
atgtgtgtgcaagatggtgaacaagctggtgaagatcatatagagaagaacgttgataacagcataagagtttcatggcctttgcattgtgatctcttgaatgcccacatggataacaaggaaaaagactcttcttttagaactccctctgaccagatcagtgttgcaaattcatctcctctggaaagcatatgtgaggatgcagaaattgtggacaaaaaacaaaacttaatgaactttgtccctactcttcggtctggagagtggtctgatattggagatcgcacttccatggaggatacacatatatgcatcggagacttggcagaaaaatttggcaataacgaactttacaaggaagctatttccttttatggtgtatttgacggacatggagggaagagcgctgcacaattcgttcgtgatcatctgccacgggtgattgttgaggatgctgactttcctttggaattagagaaggttgtcacaaggtcatttttggagatcgatgcagagtttgcaagatcatgttctactgagtcttccctgtcttctggtacaactgcactgactgcaattatattaggaaggtctttacttgttgccaatgctggagactgccgtgctgtattgtcccgtggtggaggggctatagaaatgtccaaagatcacaggccattgtgcattaaggaaaggaagaggattgagtctctaggtggatacatagatgatggttacctgaacggccagttaggtgtgactcgtgcactaggcaactggcatctccaaggaatgaaggaaattaatggaaagggtggaccattgagtgctgagcctgaacttaaattaatcacattgacaaaagaagatgaattcttgataattgggagtgatgggatctgggatgtttttcgcagccaaaatgccgtagactttgctcgaaggaggcttcaagagcacaatgatgtgaagcagtgttgcaaggaggtgataggagaagcaataaagagaggagcaacagacaacttgacagtggtgatgatatgttttcactcagaaccaccagctcctatggttgtagaaaggcctagagtcagaagaagcatatctgctgaggggcttcaaaatcttaagtgcttgctagaaggataa

SEQ ID NO: 3067 - DNA, 741 bp, Glycine max var. Williams 82
atgggcactacatctaccaccatcaaattgcttccactttctcctttgccaaaaccaaccacttcatcttcatggctttcttgcaaaccaatttcccatccctttccaaattctcgtccgcgaggtaatgtcgcagtctcggtttcctacaacccccaaggcaacttcgacctctctttatttgacgatgatgatgaaactaaagctgcacctcctctgcccccaactgaaggccgatttgaagttgtcattgacaatgacgttattagtcggcttgacttgtctccttttcaagctgcaacaggcatgaaatcccctttatctgtaaaaccaaaagaatttcttgaccgcacaatcggcttcaccatcaactatactagagaagatccccgtgatcctcgagaattatcagagtatcctgatattagggtatggtttgtgagacttgatgctacttatccatggttgccagttttgttggattggagagctggagaactggctcggtatgctgcaatgttggttccacatcagatgaatattaaaatgggagttgtcttcaatcctgaggcattggaactgtttgttatgaagaaagttttcattgtgtattcctggttgaagcatcacaacgttcccaagccaaaattgaaggcaaatgatatggccagaatgcttggatttacaattggagatgaactatatgactttattgataagcatccacttgatctttcgtaa

SEQ ID NO: 3068 - DNA, 1104 bp, Glycine max var. Williams 82
atggaagaagaagagagtgaaaaatccccacaattggtgcgagtccttgaagctctgaaagaagccacccacgacatccaacgacaccactcctcggattccccagccataaaggcactcctggaactccactccattctctcctcctcggacccctacctctccgctctctccgaccacctcatccgcctcaaaaccctcgtccactctctcaaccactccaatggccttctatccttcctcactcgccccctctccactctctccctctcacgcctcgcctcccaaatcgagtccgaaatccaatcctggatcgaccgcgaaactctccacaccctctcctcttctctacgaaaccctaacaataaccacgaatttgtctccttgttgactcagtccatttaccgtgtctcgcagggcttcaatcgcgagttgcaggacctggttctcaaactaaagctcttctcatcgctggagtcggttctgttcgacgataagtgttcgatcccggttcgggaacaggccggtctggctgtctccgcgttaatccggttcaataaagacgtgttcgtgggccaggttctgatgggccccaccgtccgggctttggtctcgatgggctctgttctgtcccttgaggtgctgtgttcactcatcaggtccattaggtctcctctggtggacgagatcgagagcaacggtgagattccgaatattatcgcgatgttgaattcggaggatctggaactgcgtgttgttgcgttggggtgcgcgctggagatagggtacttcgggcggaaggaagcggtggaggcgatgatgaaggaggggttggtggagaagctggtggagttgcagaggtcggagaaaggtggggatttgattgagattggaagggaaaaggttagtggggttttggagagaaaaccttttgcgagctgcgtggcgaggtttgcggtgcagttggaagttggggaagggttgcggcagagagaaaagagggcttttaaacctgagattttgatcagagttagagacgcctctgtttctgaagccgaagctgccaccattgctgctgaggttttgtggggttccagcccatga

SEQ ID NO: 3069 - DNA, 690 bp, Glycine max var. Williams 82
atggatctatctacactgttgctagctgttctcttcatcgcaggcctcattaatattttcttttacgtacccaccaccaagattggtgcgtggcttcaaactttcttattccccaacaacaatgcttgcaacaaaaccaaaaccaacttagttccttcttcctcttcttcaccaacgaccaaggtggagagtactggttcccaaaagaagaaggaagagcttagaaaagtgttctccactttcgacaaaaacggcgacggattcataacgaagcaggagctgagggagtccctgaggaacatcagaatcttcatgacagaacaagaggtcgatgatattgttgtcaagtacgattccaacggggacgggttgatcgattttgaagagttttgcttgttgactagtgagtgtgtaggagtggatcatgagaaagagggtgatggtgttattgaaaatgaagaggttgatttgaaggaggcttttgatgtgtttgataaagataatgatgggcttatttcggtggaggagttggctttggtgcttacttcgttgggactaagggaagggagaaagattgaagagtgcaaagagatgattaagaaggttgatatggatggagatggcatggtcaattttaacgagttcaagagaatgatgatgaatggaggaaagtttttctttaacgcataa

SEQ ID NO: 3070 - DNA, 1188 bp, Glycine max var. Williams 82
caaggttacttgctcctagctcttcctggttctcttcttccttatcccttaatataccctctctgtcgtttgcaatatcgaatccaacaaaatacatggatctatctacactgttgctagctgttctcttcatcgcaggcctcattaatattttcttttacgtacccaccaccaagattggtgcgtggcttcaaactttcttattccccaacaacaatgcttgcaacaaaaccaaaaccaacttagttccttcttcctcttcttcaccaacgaccaaggtggagagtactggttcccaaaagaagaaggaagagcttagaaaagtgttctccactttcgacaaaaacggcgacggattcataacgaagcaggagctgagggagtccctgaggaacatcagaatcttcatgacagaacaagaggtcgatgatattgttgtcaagtacgattccaacggggacgggttgatcgattttgaagagttttgcttgttgactagtgagtgtgtaggagtggatcatgagaaagagggtgatggtgttattgaaaatgaagaggttgatttgaaggaggcttttgatgtgtttgataaagataatgatgggcttatttcggtggaggagttggctttggtgcttacttcgttgggactaagggaagggagaaagattgaagagtgcaaagagatgattaagaaggttgatatggatggagatggcatggtcaattttaacgagttcaagagaatgatgatgaatggaggaaagtttttctttaacgcataatccactacaggttctctttaatttcttcttcaattcagatccgccatcactattaacaccgaaaattcatcactcacttgaaattgtgtgtgtgtatatgaatatgatgcccacatcataatcatgtatacgttttacatggaatgaaatactgttatgaattctgatttagtaagtgtagattcttagttaattttccatgtttctctgtaacatatggctattgttgtgatccattaattctttgtctttttggcaaggaatttattttctttaatttgtgtctgtgtatatatatatatatatacttgcaccaataactatacaacaactccgcctacagttgcgctttgcagcacaagaaagtcttgaatttccagcctgttctcttttctccatgaaa

SEQ ID NO: 3071 - DNA, 510 bp, Glycine max var. Williams 82
atggccaacgtggaaatcctcgttctacttgttgcagcggcattattaatgccattgcgacacaccacagaagctgcagagcatgttgtgggtggttctgccggttggattattccttcccaaggagacacctccttatatacctcctttgcagctaataacactttcagactaaacgacatactcgtgttcaacttcgcaacaggatttcacaacgtagtcaccctgtcaaagaaacactacgacagttgcaacgtgagtgaagtaatgcaatcattcgacacagcgccggcgagaatcattctgaaccgcacgggcgagttctatttcgcatgcgcgttctcgagtcactgctccctcggccaaaagctgagtattcatgtgactgcagggtcgtcttcccttgctccattatccccacctccacctgcgtcacgtgcagccatgccccttgttgctgtcacaatccctgttcttttcattgcagttgccacaaatgtcttgttctag

SEQ ID NO: 3072 - DNA, 1833 bp, Glycine max var. Williams 82
atgctgtggtcttatgcctcgcactatgtccctccacaacaccgcactaacagcttccaaaccttaaccgatgattcaaccagccgtggtggcgctagaccacgtgacggtggccgcggtggttccggcagccgtgggttttctcgtccccgcattccttctaaccggttacccgtggaggaaccacaagacggcagcgacgctattaacttcgacgcgtacgagtcggtaccggtggaggcgagtgggaaggacgtgccaccgccggtgaacaccttcaatgaagcggacttggacgaaggtttaaagaggaacatcgaccgatgcaagtatgtgaaacccacgccggttcagcgccacgcgattcccatcgcgagtgcgggacgcgacctaatggcgtgcgcacagaccggttcgggcaaaacggcagcgttttgttttcccattatatctgggattttgaagggtcgttctctttctgggttttcatcaatgccggctcgtggtgccgctgttgcataccccactgcacttattctgtctcctaccagggagttatcatgccagatacgcgatgaagcgaataaatatgcgcatcaaactggagtgaaggttgttgttgcctacggtggggctcctattactcagcagctgcgccttatggagaaaggtgttgatatattggttgcaactcctgggcgtttggtggatattattgaaagagaaagggtttcgttgacaaagataaagtatcttgctttggatgaggctgatcgtatgttggacatgggttttgaacaccaaatacgcaagattgtggagcaaatgcagatgccctcgccaggtattaggcaaacattgttgtttagtgccacgtttcctaatgatatacagaagctagcatcggactttttatccaactacatattcctgtctgttggaagggttggatcgagtactgaactgattgtgcagaagattgagcttgtacaggatatggacaaaagggaccatcttattaatcatctgcgacgtcaaaaggtgcatggggcaaatgggaagcatgctttgactcttgtatttgttgaaaccaaaagaggagcggatgttttagaaggttggttgttgagaagtggcttttcagctgttgccatacatggtgacaaagttcaaatggaaagggaacgggctttaagatcattcaaatctggtttgactcccattttggttgcaactgatgttgcttcacggggattggatatcccgcatgtggctcatgttataaactttgacttgcctagagacattgataactacgtacatagaattggaagaacaggccgtgcaggcaaatctgggttagccactgccttcttcagcgacaagaatagccctattgcaaaggctcttattggactcttgcaggaagcaaaccaagaagttccatcttggctcaaccaatatgctactgagggttcatcatctggtgggggtggtcgtggctatgaagctcagcgttaccgcagtggcagttatggtggtcatgatttccggaatgtcactgaacctgaggtgcagaattacaactgctacaataccaatggcaatgcagttcagtttgtagagtcttacactgctgatgatgcctcttacgttgatacctcctatgacatccaaaactccaatatagattgctcttttgaatgtttacatatagcttcttccggcagttataatcacactgattcttgtgagttgaatggaggtggtggtagggttgaagaagatgggccacgcggttatgcatctattgttgccactggatgggattag

SEQ ID NO: 3073 - DNA, 438 bp, Glycine max var. Williams 82
atggccaatcccctgcaactcaagtcattgaatcatatctcaattgtgtgtgcatcagtggagaaatccgttgatttttacgtgaatgttcttgggttttctcctattaagagacctagttcattagacttcaatggggcatggttattcaattatggcattggaatacaccttcttcaatcagaagacccagaaggcatgcccaagcttgttccaattaatcctaaggacaaccacatttctttccaacatagcagcggtggaaaaagactgcagcaaatgaagatagagtacgtgaagaacagagtagaggaaaatggcatgatgattgaaatctgcaactgtgacaacatccctgtagtacctttaccagaggacaaagtatggtcatgctcacgcttcaattgcaatattcaaaatcgccagcagcagatttaa

SEQ ID NO: 3074 - DNA, 438 bp, Glycine max var. Williams 82; identical to SEQ ID NO: 3073

SEQ ID NO: 3075 - DNA, 2628 bp, Glycine max var. Williams 82
atgttggtgtgcggccaagacgagattgacttgtctagagatggcagccactacagtctctctactgggatactaccttcccttggagccaaaagtaaccgcagacttaagctcaagcccttcattgtttctccctatgaccgccgttacaggatatgggaaactttccttgttattctggtggtttacactgcttgggtttctccctttgaattcggattcctgaagaaaccacaagcacccctttccataaccgataacattgtcaatggattttttttcgtggatatagttctgaccttcttcgtggcttacattgacaaaagcagctatttgatcgtggatgaccgaaaacaaattgcttggaaatatgcaaggacttggttgtcctttgatgttatctccatcattccttctgagcttgtacaaaagatatcaccttctcctcttcaatcttatggcctattcaacatgcttaggctttggcgtcttcgaagagttggtgcattgttttctcggcttgagaaggacaaaaattataactatttttgggttcgatgcgctaagctcattgctgttaccctcttcgctgtccattgtgctgcatgtttctattatcttattgctgctcgttatcatgatcccaaaaagacatggattggtgcaacgatggataatttccttgaacacagcttgtggtcaagatacgtgacatctatttactggtccattactaccttaacaactgttggttatggagatttgcatcctgtgaattcaagggagatgatctttgacgtcttttatatgctctttaatctgggtttaacagcatatttgattggtaatatgaccaacttggttgtccatggcacaagtcgaaccagaaaatttagggataccatacaagctgcctcaaattttgcccaaaggaaccaattgccacatcggttgcaagaccaaatgcttgcacacttgtgtttgaagtatagaacagactcagaagggttgcaacagcaagagacacttgattctcttcctaaagccatcagatcgagcatttcacattatcttttttattctctgattgacaaggtctacttgtttcatggggtttcaaatgacttgctctttcaattggtgtcagagatgaaagcagaatattttccacccaaagaagatgttatcttgcaaaacgaagcccccactgacttttatatactggtcactggtgccgtggaactactagttcttaaaaatggggctgaacaggttgttggagaggccaaaactggtgatctttgtggtgagattggtgtgctttgttataagccacagcttttcacagttcgaacgaagcgactaagtcagttgctcaggctaaaccgtactacgttcttgaatattgttcaggccaacgtgggagatggaaccataataatgaataatctccttcagcatttgaaagagatcaacgatccaatcatggagggagttttggtggatattgagaacatgttagctcgtggtaggatggacctaccagtgagtgtgtgctttgcggcagcaagaggagatgacttgttgttgcatcaattactcaaacgaggcatggatccaaatgaatccgacaacaatcgaaggacagctttgcatatagcggcatctcaaggaaaacagaactgtgttttgcttctgttagactatggggcggatcccaacattagagatttggaaggtaatgtgccactatgggaggctatagtgggaggacatgaatcaatgagcaagctgttatcagagaatggagcaaatttgcaatgcggggatgtgggccaatttgcatgtactgccgctgaacaaaacagcctcaacttgctgaaggaaataatgcgctacggaggagatatcacgcttccaaacagcagcaacacagggaccacagctttgcacgttgcagtctctgaaggcaacgttgagactgtcaaattccttttggatcacggggcgagtattgacatgccagacaagcatggctggaccccaagagatcttgcagatcagcaggcacatacagaaatcaaagccctttttgattccattggggagcctaaggtccattcttccgtcgctattccggtgaggaatagcaagatcaagtaccttggtaggttcacaagtgagccaaccatgacattgcctcttgatggatcgtttcatggaactgatggctcttggagccagaaccagagccaaaaccagagccggccgaggcgtcggagcaacaactaccataactctctgttcgggatattgtcagcagcacacaatggggaaaagtacctgctttcagctgttgacatgaataacaatgcaaggaatggtatgaagagtagtagtgcagttggtccaactagagttataattagttgtcctgagaagggtgaggttgttgggaagcttgttttactgcctggaagctttcaagagctagttgagattggagccaagaaatttggtttctatcctaataaggttgtatgcaaagatggaggtgaaattgaagatatagagataattagggatggtgaccatcttgtttttcttggtgcaagtggagggtgctag

SEQ ID NO: 3076 - DNA, 435 bp, Glycine max var. Williams 82
atgtctaagatcatgtcagcacctacacttcatcatttctcttctctcttcacccttttcatagttttgcttcaccactccaacgctgacgttggcaccgcttctcgttactcccctccatatttaccatccgggtgctacggtaccgaagcgacgcagtttccgtcgagcaatctttttgcggcggcgggagatggaatatgggataacggagctgcgtgtgggaggcaatacctagtgaggtgtataagtgcggagcaacctaggacttgcattccagaccagagtattcagattaaaattgttgattacgctgccactgccgtgtcgccggcttccgccggcggcaccaccatggttctttccgataaggctttcgggactatagctaacatgtctgccaccttgatcaacatagagctccaacaagtgtga

SEQ ID NO: 3077 - DNA, 909 bp, Glycine max var. Williams 82
atgtcatcaagtggaaccatttggagctatgaggaagaaaaagcatttgagaatgccatagctatgcattggattgaggaatcctcaaaagagcaatgggagaaaattgcttcagcagttcccagcaaaagcatggaagatgtgaagcaacattaccaggttctagtagaggatgtaagtgcaatagaggcaggtcacatatcattcccaaactatgctgcttctgaggaaatcacatcttcaaataaggactttcatggctcttccaaggccacaagctcagataaaagatcaaattgtaattatggacgtggtttttctgggttaggacatgactccaccactcatagtagtggtaaaggaggcttgtcaaggtcatcagaacaagaaagaagaaaaggaatcccatggactgaagaggaacacaggttatttttacttggtctagagaagtttggaaaaggagattggagaagcatttcaaggaactttgtgatatctaggactcccactcaagtggcaagccatgcacaaaagtacttcataaggttgaattcaatgaatagagacaggaggaggtctagtatccatgatatcactagtgtgaacaatggagatgtggctaataaccaagcacctattacagggcagcatagtagcacaattccttcaaacacaatgggtgtaggacaatcccttaagcatagagttcagggtcacataccacctggtttaggcatgtatggaacaccagttggacatcctgtggctgctcctccagggcacatggcatctgcagttggcactcctgtcatgcttcctcctggaccccacccccatgctcatcctcatccaccttatgttcttcctcttgcttacccaatggcacctccaacaatgcatcaataa

SEQ ID NO: 3078 - DNA, 1053 bp, Glycine max var. Williams 82
atgctacaaaacccaagagtagtgcgatattccgctcagccattcaatcctccaactcgcatggcaacaccatcactttctccattccaattaatacccacttctccatcttttccaatcctcaaacaacaatgcagattctcacgtagagagctcaccatcttcagcaactcttgcttgctactactcttgggtgctcaggcaagagcagaagagaatttgactttggcagaagaagatgttggtaacacaagtaacagcgatcaaccagaagagaatctgactttagcagaagaagatgttgctaacacaagtaacagtgataagccagaagagaatgtggctgtcactcccagctgcactgaaagaaaacctacaaaacaagtattcttagacatatctattgatggcgaacctgttggtcgcgttactatagggctctatggagatgatgtccctgcaggagttgataggtttagtaagattgcaagtggagctgctggtattagctacagaagaaaggagtttgtcaaaataatgcccaattacgttcaacatggtggcctgagatcgtatggggtggatgctgaacttgcttcgaagacaggtagcaacttgggaactagtagacttggtgaggaatgggaaagggagtatgagagatgtcctgggactaaaaatgtggccggaagtgtaggcattattgtgagaaacccatcaaaaccgcctccaaagttgaagcttattgcaaaacaagggaagctggagattgatgaagaagaagtaggaaatgatcccaatgggacagaatttgtcatagctacgaaggattcgccagaattggatgcatcgactctggtaattggaagagtaataggagggatggaggttgtgcagaggatcggtctagttaaaaccgtacaagagaatacaggatctccatattttagggtggcaaagctaataggagacaagagagctgttgtagcagaaagaggattcaaccgcccttattcaaaggtcattgttacaaattgtggtttaatggagtaa

SEQ ID NO: 3079 - DNA, 1545 bp, Glycine max var. Williams 82
atggcccctctttatagtgccttcaacggcgaaatcgatggcgaaaatctccctttagcttttgatatctgggcaaccaatctatgggcctatggctattatcctcatcaacctgctatatcggagaatagttcttctaaattggttgatttccccttttgcgatggcaccatcatcagggataacaaaagggtcaagagaaccgtgtgtttccccatttataacagcgttagttgccatagtttcttcaacaccaacagcagtagtaggaatagcataccaaaactccacttcagagatcacatacggacttacactcaaagatatctcgcagctgaacccgtagaggaggcatcagaagatacaaacagttcagaaagtagtggaggcgaagaagatgggtgtgctgatggagtgaggcttgttcagcttctaatagcgtgtgcggaagcggtggcttgccgcgacaagtcacacgcttccatattactttccgaacttaaagcgaatgctttagtgttcggatcctcattccaaagagttgcttcctgtttcgtccaaggcctcaccgagaggctcaatctgattcagcccatcgggtccgcgggcccgatgatggcacccgccatgaacatcatggacgccgcctcggacgaaatggaggaagcatacaggttggtttatgaactgtgtccgcacatccagttcggacactatttggctaattccacagtattggaagcctttgagggtgagagttttgtccatgtcgtggacctaggcatgagtcttggtctaagacatggacaccaatggagagctctgatccagagtctcgccaaccgtgcaagtggcgaacgcgttcgtcgcctgcggatcacgggggtgggactctgtgtcagacttcaaaccattggagaagaactctccgtatatgctaacaatttgggtatcaacttggagttctcagtggttaataagaatttggaaaatctgaaaccagaggacatagaagtgagggaagaagaagttcttgtggtgaacagcattctgcagcttcattgcgtggtgaaggagagccgcggggctttgaattcggtgctgcagatgattcacgggcttggacccaaagtgttggtgatggttgagcaggactcgagtcataatggacccttttttctagggaggtttatggaatcattgcactattactcttcaatttttgactcgttggatgttatgctgccaaagtatgacactaagagggcaaagatggagcagttttactttgccgaggaaataaagaacattgtgagctgtgaggggccgttgagaatggagaggcacgagagggtggaccagtggagaaggagaatgagcagagctgggtttcaagctgcacctataaagatggtggctcagtctaagcagtggcttctcaagaacaaggtttgtgagggttatactgttgtggaagagaaggggtgtttggtttttggatggaagtcgaggcctattgttgcagtttcttgctggaaatgctga

SEQ ID NO: 3080 - DNA, 1704 bp, Glycine max var. Williams 82
atggacatcggaacctatggctatcctacaccagcagtgaaaaagattgagtcttactatgatgtgccagagggagtggatattcggggaagatatgatgcagagtttgcaaaaatcctcacaaaagatgctttgaaattcgttgctgacttgcaacgtgagttcaggaaccatatcaagtatgcattagagtgcagaagagaagcaaagaagaagtacaatgaaggggctcttccagagtttgatcctgccacaaggtacatcagagagcaagagtgggtgtgtgcacctgttccaccagcagttgctgatagaaaagttgaaatcactggccctgtggatagaaagatggtcatcaatgctctcaactctggagctaaagtctttatggctgattttgaagatgcactgtcaccaggctgggaaaatcttatgagaggccaagtgaacttaaaggatgctgtggctgggaccataagcttgcatgacaaagcaagaaacagggtttacaagctcaatgatcaaacagcaaagctttttgtgcgaccaagaggttggcacctaccggaggcacatattctgattgatggtgaacctgcaactggttgccttgttgattttggcctctatttctaccacagctactcagcattccggcgcactcaaggtgctggctttggccctttcttttatcttcccaagatggagcattcaagggaagctaagatttggaacaatgtgtttgagaaagctgagaaggtagcaggcatcgaaagaggaagcataagggcaactgttctgatagaaacacttcctgcagtgtttcaaatgaatgaaattttgtatgaactgaaggaccattcagtgggtttgaactgtgggcgttgggattacattttcagttatgttaagaccttccaagctcatccagatcgcctcttaccagatagggtcctagttggcatgactcaacacttcatgaaaagttattctgatcttctcatcaggacgtgccacaggcgcggcgtgcatgctatgggaggaatggcagcgcagattccaatcaaagaagatccagtggctaacgaggtagcactggaacttgtaaggaaggacaagcttagagaagtgaaggcagggcacgatggaacttgggctgcgcaccctggtctcattccagcctgcatggagattttcaacaacaacatgggcaatgcttccaaccagatagacacagtgaaacgcgaagatggggcaaacatcaccgagcaagacctcttgcagataccaagaggagcccgcaccatggaaggtctcagattgaacacaagggtgggaattcagtacgtggcggcgtggctcaccggaagcggttcggtgcctctatacaacctcatggaggatgctgccactgctgagatcagcagggtgcagaattggcagtggctcaagtatggagtggagctcaatggggatggtcttggagtgaaagtgaacaaagaactttttggtagggttgttgaagaagagatggctaggattgaaaaggaagtggggacagagaagttcaagaagggaatgtacaaggaggcttgcaagatcttcactcgccaatgcacgtcaccaatgcttgatgattttctcactctggatgcttataattacattgtcgtgcatcacccgagggaaacatcaaagctttga

SEQ ID NO: 3081 - DNA, 1746 bp, Glycine max var. Williams 82
atgggtgttttgtggtggaagctgttttttgctgctcttgctgggattctcttctcaacccaacattgtgcttcccaaaaagttccgaactacacatttatgcacaatgcaacaacagcaccagacgtatcatactacgactacatcgtaattggcggcggcaccgcagggtgccctttagctgcaacactgtcccaaaattacagcgtattgctccttgaacgtggtgggtcgccctacggcaaccctaacatctccgacttagctgctttcggtgctgccctctccgacacctcccctacctcccccgctcagcgtttcatctccgaagacggtgtcatcaactcaagagcccgcgtcctaggtggtggaagttgcttgaacgctggcttttacactcgcgctagccctcaatatgtaagggaagcggggtgggatggaagggcagtgaatgagtcgtacgaatgggtggagaagatagtggcgtttgaaccacaattgaagcagtggcagtcagctgtgcgggatggactaatagagataggtgtggtgcctaataatggcttcacttatgaccatattgatgggactaaggtagggggcaccatctttgaccagaatggcttcagacacaccgctgctgatcttctggaatatgccaaacccactggaattactgtgcttttggatgccactgtgcataggatcttgtttagagtcaaagagggatcaaaaccaacggcccatggagtggtgtttagagattcattgggtggaagacacaaagtgtacctgaaggccgatccaaggaacgagataattgtttcagccggtgcacttggaagcccacaacttctaatgttgagtggaattggacccagagagcaccttaaagcccacaacatcagaataacattgaatcagccattagtaggacagggaatgactgacaaccccatgaacgccatctttgtcccttctcctgtccccgtagaggtctctctgattgaggtggtgggcatcaccagttttggcagctacattgaagctgccagtggtgaaaactttgccggtggttctccaaaagactacggaatgttctcccccaagattgggcaactctccacggtgcctccaaaggaaaggaccccagaggccctggccaaggcaacagaactgatggaaactctagaacaagcagccttcagaggaggattcatattggaaaaaatcatgggtccaatctcaagcgggcatttggagctccgaacccgcgacccgaacgacaacccatcagtgaccttcaactacttccaggaccctcgagacttgcagcgatgcgtgcagggcctgagcaccgtggagaagataatcgagtccaaagctttctctcccttcagataccccaacatgccagtgcccgttctgctcaacctgaccgcaagtgcccccgttaacttgttgcccaagcacaccaattcttcactttctttggaacagtattgcagagacactgtcatgaccatttggcactaccacggtggctgccaagtagggaaggttcttgatagggactacaagcttcttggtgtggatgcactgcgtgttattgatggctccacctttaactactctcctggaactaatcctcaggccactgttatgatgcttggcaggtatatgggagtgaaaatattgagcgagagactaggtggtgcggctgctgctgctgaaacagagcaataa

SEQ ID NO: 3082 - DNA, 2226 bp, Glycine max var. Williams 82
atggatgctttccttttcattcttacattcttgttgagcttccacaaactttcttctgccgcaagcagttcaaaaacatatattatccatgtggaggggccacaggataagacactagatcaaacagaagatttagagagttggtaccattcattcatgccacctactactatgagctctgaggaacagcctcgaatgatttattcgtaccggaacgtgatgagtggttttgctgcaagacttactgaagaagagctgagaacaatggaaaaaaagaacggctttatctctgctcgtcccgaaaggatgctgcattgcctaaccacaaataccccacaatttttggggttgcagaaacaaacgggattatggaaggaatcaaactttggaaagggaataataattggggtgctggattctggaatcacgcctggtcatccttcatttagcgatgcaggaatgccgccgccaccacctaaatggaaagggagatgcgagattaatgtgacagcttgcaacaacaaactaattggagtaagggctttcaaccttgcagagaagttggctaaaggagcagaggcagcaattgatgaggatggacatggaactcacacagcaagcacagctgctggtgcttttgttgatcatgcagaattactaggaaatgccaaaggaacagcagctgggattgccccttacgctcacctggcaatctacagagtatgctttggaaaagactgccatgagagtgacatattggcagcaatggatgcagctgtggaggatggcgtggatgtaatatcaatatccctcggctcgcatacgccgaaatctattttcgatgatagcactgcaataggtgcatttgcagcaatgcagaagggaatctttgtaagttgtgcagcaggaaactctggccctttccatggctccttaattaatggagccccttgggtcctcacagttggagcaagcaatattgacagaagcattgcagcaacagcaaagctgggaaatgggcaagaatttgatggggaatctgttttccagccttccgatttctctccaacattattacccttggcatatgctggaaagaatggcaaacaagaagctgcattttgtgctaatggatccttgaatgatagtgatttcagaggcaaggttgttttgtgtgagagaggaggaggtataggaagaattcccaaaggagaggaagtaaaaagagtaggtggtgcagccatgattctcgcgaatgatgaaagcaatggcttcagtctctcagctgatgtgcatgttctacctgcaacacatgtaagctacgatgctggacttaagattaaagcctatataaattccactgcaatacctatagcaaccattttattcaaggggactataattggaaactccttagctcctgctgttacatccttctcttcaagaggtcccaacttgccaagtcctggtattttgaaaccagacatcataggaccaggcgtgaacatcctagctgcctggccattccctctgaataacgatactgattcaaaatccactttcaactttatgtctggcacatcaatgtcatgcccacatcttagtggcatagctgctttgctcaaaagctctcatcctcattggtcaccagctgccataaaatctgccataatgacttctgcagacataatcaattttgaacgcaaactcattgttgatgaaacacttcaccctgcagatgtttttgccacaggttctggtcatgtgaatccatcaagagcaaatgaccctgggttagtttatgatattcaacctgatgattatataccttatctgtgtggtctagggtacagcgatacccaagttgggatcattgcacacaaaacaattaagtgttctgagacttcaagcattcccgaaggagagcttaactatccttcattttctgttgtgcttggttccccgcagacattcacaaggactgtgacaaatgtgggtgaggccaactcatcttatgttgtcatggttatggcaccagaaggggttgaagtgagggtccagccaaataaactttacttttcagaagcaaaccagaaagacacgtattcagtgacattcagccgtataaagtcgggtaatgaaactgtgaaatatgttcaagggtttttacaatgggtctctgccaaacacattgtaaggagccctatctcggtcaactttgtataa

SEQ ID NO: 3083 - DNA, 660 bp, Glycine max var. Williams 82
atgaaactagtttggtccccagagacagcatccaaagcatacatcgaaacagttcaatcttgtcggattttccgggaatccggggtggcggagctggtgtcggcgatggcggcggggtggaacgcgcagctaatcgtggagacgtggtcggaggggggagtgatagcgacgagcgtgggtttagccgtggcgagaactcacacgtgcgggaggcacgtgtgcgtggtgcccgacgagaggtcgagggcggagtacgcggagagaatgggggaggcggggatgtcgccggagatcgtggtgggggaggcggaggaggtgatggaggggttgggcggcgggatagacttcatggtggtggattccacgcgcggaaacttctccagagtgctgaggctggcgaagctgagtaacaaaggcgcggttcttatatgcaagaacgtgaactccgccaccaatattgcttcttcttcgggtttcagatggcggagcgtgctcgaagaagggtcagggtcgcgtcgtgtggttcgttcggtgtttcttcctgtggggaaggggcttgacatagcacacgtgtcggccattggggggggctccgctgctaagagatggttcaagcatgttgaccaacaatcaggggaggtgcacgtcattagacgatga

SEQ ID NO: 3084 - DNA, 1234 bp, Glycine max var. Williams 82
aaatgtcaacggtcctactctctctctctctctctgtctcgccatagccaatatattaatccctcgtgacccaattcctcccatattcagtaattcacaatctcagacagagaaaccaatcggaggaaaatgaaactagtttggtccccagagacagcatccaaagcatacatcgaaacagttcaatcttgtcggattttccgggaatccggggtggcggagctggtgtcggcgatggcggcggggtggaacgcgcagctaatcgtggagacgtggtcggaggggggagtgatagcgacgagcgtgggtttagccgtggcgagaactcacacgtgcgggaggcacgtgtgcgtggtgcccgacgagaggtcgagggcggagtacgcggagagaatgggggaggcggggatgtcgccggagatcgtggtgggggaggcggaggaggtgatggaggggttgggcggcgggatagacttcatggtggtggattccacgcgcggaaacttctccagagtgctgaggctggcgaagctgagtaacaaaggcgcggttcttatatgcaagaacgtgaactccgccaccaatattgcttcttcttcgggtttcagatggcggagcgtgctcgaagaagggtcagggtcgcgtcgtgtggttcgttcggtgtttcttcctgtggggaaggggcttgacatagcacacgtgtcggccattggggggggctccgctgctaagagatggttcaagcatgttgaccaacaatcaggggaggtgcacgtcattagacgatgaatttgtgcatatttcatttgcagttatgaggtgcattttcaatgcagcttcaacgaataaaaactaaaacaaatgttctgattctttggccgaatgagttttgtctcataattattttgtaccagatttttaacatgttctttgtctcactagggttacgtacgtttttagttttagcagcacttctattagggacagattgggacaaaagttaagtatagttgcctaggctttctcatgtccgtaactagtattcaattttgctctttcttgtgtaaatacgctgatacaatacagcatgaattgtgtatgccacagaccatcctatttgttttatgattcgttataatatagatatatcaccttactctgatctgatcttcacccatatttgtagattgtccattttcttaagccaactacttttatttttttacaaattctc

SEQ ID NO: 3085 - DNA, 2274 bp, Glycine max var. Williams 82
atggcggcgacgaacgccggcgtggcggcggcggactcggccgcttcctcggacgaggcggcggcgaagacggcgcagaagcgctacgaggggcttctgatggttcgaaacaaagcgataaagggtaaaggcgcatggtactggacgcacctcgagcctctgctggttcacaacaccgaaacgggactccccaaagcggtgaaactccgttgcaccctctgcgacgccgttttctccgcttccaacccttcccgcaccgcctccgaacacctcaagcgcggcacgtgccccaatttcaactccgccgccaaacccatttcctctgtttcccctgttcttgtttcttcttccacttctcctccttctgcttctccctttaacaaccgcaaaagaaccaccacttcgccctcagcttcgggttcaggctcgggttctctctaccacgcaccctctcggtttggaataggtttgattcctcatcagcagcagcagcatttgaagctatctggtgggaaagaggatttgggagctttagctatgttggaggacagtgtgaagaagctcaagagtcccaaaacttctcctgggcccactttgagtaaggcccaaatcgacagcgcgattaagtttctcggcgattgggtctacgagtcgtgcggcgccgtctctttctcgagcttggagcatccaaagtttcgagcttttctcgcgcaggtcggtttgccgccggtgtttccgagggagttcaccggtacgaggttggatgcgaggttcgaggaggctaaggttgagtccgaggcaaggattagggatgcgatgttctttcagattgcgtctgatggatggaagtggaagagggagagggagagttattatgattatgatgatagcaattcggggttggtgaatttgagtgtgaatctaccgaatgggaccagtttgtacagaagggcgttgtttgttactgcttctgcgccttcaaagtatgcggaggaggttatgtgggagacaatcactggcatttgtgggaatctcgtgcaacagtgtgttgggatagttgcagacaggttcaaggccaaggccttgaaaaatctcgagaatcagaatcattggatggttaatctaacttgtcagtatcagggtttcaacactttgatcaaggacttcgccaaggagcttcctttgttcaggaccgtcgttcagaattgtctcaagctagccaatttgttcaattacacctctcaggtcaggaacagtttccacaagtaccagctgcaggagtatggccacacctggctgctccgggtgcctgctcacgagttcgaattcggactgcccgtgtgtgctatgatggaggacactttgagctctgtccgcgccttgcagctggtgctcatggatgagcctttcaagatggtcgccattgaggaccagggcgcgagggaggtcggggacatgattcgcgatgtggggttttggaatgacttggaggctgtccatggtttggttaaattggttaaagacatggctcaggagattgaggcagagaggcctctggttgggcaatgccttcccctttgggatgagttgagggcaaaagttaaggattggtgttcaaaattccacattgcagaaggggttgtggagaagcttgttgagaggaggttcaagaagaattaccaccctgcttgggctgctgcttacattcttgatccgctttacttggtgagggatactagtgggaagtaccttccgccatttaagtacttgacaccggaacaggagaaggacgtcgataggctcataactagactcgttgcaagagatgaagcgcatatcgctctgatggagctcatgaagtggaggacggaagggctcgatccggtttacgcccaagctgttcagatgaaggagagggatccggtcactgggaagatgaggattgtcaatccacagagcagtaggcttgtgtgggaaacttatttgactgaattcaagtccttggggaaagttgcagtgaggctcatattccttcatgcaacctcatgtggcttcaaatgcaattggtctttgtggagatgggtttgtgcacaaggtcaccactctaggaatgcactcaacaaggtgcagaaattgatatttattgcagctcattccaaactcgagagaagggatttttccagtgatcaagataaggatgcagagctgtttaccttggcaaatggtgaggatgatgtgttaaacgacgttcttgttgatacatcctcagtgtaa

SEQ ID NO: 3086 - DNA, 456 bp, Glycine max var. Williams 82
atgaaaatgggtggtgggtgcaagtgtttggtatcgttggtgttggctttggtgttgatgaggagtttggcggaggcgcaatcgggcagcagcaccacctgcgcccaggagctaattccatgtgtgaactttctgaatgggacaaccaccccaccaagctcttgctgtgaccctctcaaacaaaccgtggaaaaccaactggattgcctctgcaacatcttcttcagccccggcttgcttcaaagcttcaacgtctctgttgatcaggctctcgctctcagtcgccgctgcggcgtcaccaatggtatcaccagctgcacaaacgggtcagctccagctccgggttcagggccaccaccagtcacacctggaggtgacaaaggaggagcaggcagagtcacattcaccgggctttctttcctcctcttattttgggtatctatgctgtttaattag

SEQ ID NO: 3087 - DNA, 1488 bp, Glycine max var. Williams 82
atggcgcttgatcgctccattataagcaaaacgacgtggtacagcgtcgtattatggatgatggtggtgctggtgagagtgcacggtgcagccgcgaggccgaaccggaaggagtgggactcagtcataaagttaccgactgaaccggtggatgctgactcggatgaagtgggaacacgatgggcggttctcgtggctggttcaaacggctacggaaactacaggcatcaagcagatgtgtgccatgcgtaccagttgctgataaaaggtggactaaaagaagagaacatagtggtgtttatgtacgatgacatagctaccaacgagttgaatcctagacatggagtcatcatcaaccaccctgagggagaagatctgtatgctggtgttcctaaggattacaccggtgataatgtgacgacggagaacctctttgctgttattcttggagacaagagtaaattgaagggaggaagtggcaaagtgatcaacagcaaacccgaggacagaatatttatatactactctgatcatggaggtcctggaatacttgggatgccaaacatgccatacctttatgccatggattttattgatgtcttgaagaagaaacatgcatctggaagttacaaggagatggttatatacgtggaagcttgtgaaagtgggagcgtgtttgagggtataatgcctaaggatctgaatatttatgtcacaactgcatcaaatgcacaagagaatagttggggaacttattgtcctggaatggatccttctccacctccagagtacatcacttgcctaggggatttgtacagcgttgcttggatggaagatagtgaggctcacaatctaaaaagggaatccgtgaaacaacaatacaaatcggtaaagcaacggacttcaaatttcaacaactatgcgatgggttctcatgtgatgcaatatggtgataccaacatcacagctgaaaagctttatttataccaaggttttgatcctgccactgtgaacttccctccacaaaacggcaggctagaaactaaaatggaagttgttaaccaaagagatgcagaacttttgttcatgtggcaaatgtatcagagatcaaaccatcagtcagaaaataagacagacatcctcaaacaaattgcggagacagtgaagcataggaaacacatagatggtagcgtggaattgattggagttttactgtatggaccaggaaaaggttcttctgttctacaatccgtgagggctcctggttcgtcccttgttgatgactggacatgcctaaaatcaatggttcgggtgtttgaaactcactgtgggacactgactcagtatggcatgaaacacatgcgagcattcgccaacatttgcaacagtggcgtttctgaggcctccatggaagaggcttgtttggcagcctgtgaaggctacaatgctgggctattgcatccatcaaacagaggctacagtgcttga

SEQ ID NO: 3088 - DNA, 1779 bp, Glycine max var. Williams 82
atgtcttcttttagagctctcttcttcttctttctcatcaacgtctccttgctcctcacactctcttctgcggcggatccattcgtttcatacgaatttgaagtctcttacatcactgcatcccctcttggagttcctcagcaggtcattgctatcaacaacaagttcccaggtcctattatcaatgttactacaaacaacaacgttgctgtcaatgttcggaacaagttggatgagagcctcctcattcattggtctgggattcagcaaaggaggagttcgtggcaagatggtgttcttggcacaaactgtcctattcctgcaaagtggaactggacttaccagtttcaggtgaaggatcaaattggaagctttttctacttcccttcccttcatcttcagagagctgctggtggatttgggggtttcattataaacaacagagccatcattcctattccttttgataccccacatggggacattgttgtttttattggagattggtacacccgcaatcatacggatttgaggaaggcccttgatgatggaaaagatcttggcatgccggatggtgttctcatcaacgggaaaggcccttaccgatataacaacacacttgttcctgatggcattgattatgaaaccattgaagttcatcctggaaaaacttaccgacttcgtgtacataatgttggagtatcaacaagtctgaatttcaggatccagagtcataacttacttctagcagagacagaggggtcttacacagtgcaacagaactacactagcttagatattcatgttggacaatcttattcttttctgttaagcacggatcaaaatgcaagtacagattactacattgtagcaagtgccaggtttgtgaatgaatcacgttggcaaagagttactggagttgctatcttgcgctatacaaattccaaggggaaggcacgtggtcctctcccacctgctcctgatgatcaatttgacaaaacttactcaatgaaccaagcaagatccatcagatggaatgtatcagcaagtggtgctcgtcctaacccacaagggtctttcagatatggttccatcaatgtgactgatatttatgtattgaaaaataagccactggagaaaatcaatgggaagcggcgagcaacactcagtggaaactcttttgtcaatccttctactccaatcaggcttgctgaccagtacaaattaaagggagtatacaagcttgatttccctaccaagcctcttacaggatcacctcgcacagaaacatcagtcattaatggaacttataggggatttatggaaattatactgcagaacaatgatactaagatgcatacctatcacatgagtggatatgcattttttgttgtcgggatggattttggtgattggtctgagaatagcaggggtacatataacaagtgggatggaatagctcgcactacagcacaggtctatcccggagcatggacagcaattttggtttcccttgacaacgtaggagtttggaatctcagaacagaaaaccttgattcatggtatcttggtcaagaaacatatgtcagggttgtcaacccagaggtcaataacaagactgagttgcccattccagacaatgcccttttctgtggtgcccttagcaaattgcagaagcctcaaaaggtttcttcagatgcaccatcaatcagtcggaacaaactgaagctgttcttcacttggctcattgtattcgcctggatccacattttccagtaa

SEQ ID NO: 3089 - DNA, 561 bp, Glycine max var. Williams 82
atgtcgacttacagagacgaggatccccgtcttcatgacatcaaaactaagattcgtgttgtccctaatttccccaaacctggtattatgttccaagacattactactctgttgctcgaccccaaagcctttaaagacacgatagatttgttcgttgagcgatacaaaggcaaaaacatttctgttgttgcaggaattgaagctcggggtttcatttttggttctcccattgctctggcaataggagcaaagtttgtaccattgaggaaaccaaaaaaattgcctggcaaagttatttctcaagagtatattctggaatatggaagagactgtcttgagatgcatgttggagccgttgaacctggtgagcgtgctttagtggttgatgatttgattgccactggtggaactctctgtgcagccatggacttactagagcgagtgggagcagaggtagtggagtgcggatgtgtaattgaattgccagaattaaaaggccgtgaacggttgaacgggaaggccttgtatgtgttagtggaatgttttgagtgctgtcagtag

SEQ ID NO: 3090 - DNA, 315 bp, Glycine max var. Williams 82
atggggggaatgcgtcaccaccaagtggatactttcctatatggaaatcccattttttttctgcttcctcctttattaacgactattgaattagaaaggcttcccctgttgagactcaatgaatgcctttgcccaaagattttgatgtatggaaagaatgtttttttggggcaaatgattgtaactaggaacaatcacataaaattaatgactctgtatgacccttttggtgtatcctctctttgcttacccaccccttctatttcaaataaaaccattactttgactacagtagatttccatgaccaaaaatga

SEQ ID NO: 3091 - DNA, 396 bp, Glycine max var. Williams 82
atggcttccaagggtgcacttctcttgtgtctcaacattctcttcttcactgtggtaagctccacatatgtcccatgcaacccaccccctaaaactcctaaacacacacctgtcccaaagccaccttccccaaagcaaccaagttgccccaaagacaccattaagtttggtgtgtgtgctgatgtgttaggtttgattaacgtgcaacttgggaagccaccaaagaccccatgctgcaacctcattcagggtcttgctgatcttgaagctgcggtgtgcctttgcaccgctctcaaagctaatgtgttgggcatcaaccttaatgtcccagtcaagttgagcttgcttctcaactactgtggaaagggtgttcccaagggattcgtctgcgcttaa

SEQ ID NO: 3092 - DNA, 1050 bp, Glycine max var. Williams 82
atgcacaagagcgcttcaggttccacgttgggcccgggcggcctggacctaacccaggccttcttcaggcccataaccaacgcggctcctccctctccgaccaagcgccacaacaagatctccgtgatcggcgccggcaacgtgggaatggccatagcgcagaccatcctcactcaggacctcaccgacgagctcgtcctcgtcgacaccaacaccgacaagctccgcggcgagatgcttgacctccagcacgccgccgccttcctcccccgcaccaagatcaactcctccgccgattcctccgtcaccgccggctccgacctctgcatcgtcaccgccggcgcccgccagatagtcggcgagtcacgcctcaacctcctccagaggaacctctccctcttccgcgccatcattccgcctctcgtccgttactcccccgacaccattctcctcatcgtttccaaccccgtcgacattctcacctacgtcgcttggaaactctctggtttcccctccaaccgcgtcatcggctccggcaccaacttggactcttcccgctttcgtttcctcatcgccgatcatctcgacctcaacgctcaggacgtacaggcatatatagtaggggagcatggggatagttcggtggcgttgtggtctagcattagcatagggggtgttccggttctgagctttttggagagccaacacattgggtatgagaaagagacgttggagaacatacacaagtcagtgatagatggtgcctatgaagtgatcaggctgaaagggtacacttcatgggccattgggtactctgtggctaacttggcacggtccttcatcagggaccagaggaagatccaccctgtgtctgttctggctaagggcttttacgggatcgatggagaagtgttcctgagtttgcctgcacttgttggtagaggaggggttctgagtgtgaccaatgtgcacttgaatgaagaggagacacagaggcttaaggactctgccaagaccatccacgaggtgcagactcaattgggtatttga

SEQ ID NO: 3093 - DNA, 579 bp, Glycine max var. Williams 82
atggcaggtgctatagtagtaaagtacggaatcataggagtaggaatgatgggtagagagcatctcgtgaatttgtaccatcttcgcactcaaggcgtggcagttgtcgctattgctgaccctcatcttccctctcaacaactcgctcttgacttagcacactcctttggttggcctctcaaggttttctcaggtcaccaggagctgttggacattggactatgtgatgttttggtggtatccactcctaacatgacccatcataggattcttatggacataatcaatcattccaaaccacatcgtgtactggtagaaaagcccttatgcaccacaatctcacattgcaaagaggttgtcaatgctgctaggaagagaccagatatattggtacaagttagactggaatatagatacatgccacctgttgcaaagctgatagaaattgttaagggaggaaaccttggacaagtcagaaaggtagcaattcgggagcatcagtttccttttctggttaaggtgaacaattggaatcggttcaatattaactctggtagagaagtgttgccacttctttga

SEQ ID NO: 3094 - DNA, 882 bp, Glycine max var. Williams 82
atgaggagcatctttgtccttctccttgttctgggtttgtttaagtatgcatttgctgaagaagggttttgctctgctccttcggaatcgaaatcaaagcctctttattggaaagtggataaccccactctctcacctatccaccttcaagatttgcctggattcacacgcagtgtttataagagtaatcatgctttggtatcaccagaaagtcatgtatatggcccattgcctgattggatcgacacgtcaggcgcatatttaatttcaccagaaatgggttcacactttgtaatgtacctagctaagttgaaagaaaaatcaaaatcaggactacccctgcctggtgtggagagatttatctttgtgctccaaggtgctgtcaccctcactaatgctgctggtgttagccaactactgaaggttgattcttatgcttattttcctccaaattttgaacattcaattgaatgtgatacacctgctactattgtggtatttgaacggagatattctccgctaccaaatcatatcccagagccattggttggttcaactgataagcagccactccttgagactccaggcgagatttttgaactgaggaagctaattccaacatctttggcatatgacttcaatatccacataatggattttcaacctggagaatttcttaatgtgaaggaggtccattataaccagcatggtttgctgctactggaagggcaaggcatttatcgtttgggtgatagttggtacccagttcaggctggtgatgtcatttggatggcaccattcgtcccacaatggtatgctgccctgggaaaaacaagaacacgttatcttatatacaaagacgcgaacagaagcccactgtaa

SEQ ID NO: 3095 - DNA, 1623 bp, Glycine max var. Williams 82
atggctctaacacttcgttcttcaacttcttttattaatcagaaggaaaccaaagtcctcaaaacttctgacaatgcccctgcaatagttagtttttcaaaattcaagccatcatcatcattgttccggctccgggcaaaaaattccatgcaagaagctcatcacactcgtgagaaatgggagaaggtgctggctccgtcggtcgcacatagccacaatgattcaaagagagtacctgtgtatgtgatgttgccattagacacagtaacaatgggaggaagcttgaacaagcccagagcgatgaatgcgagtttgatggccctgaagagtgcaggggttgaaggtgtaatggtggatgcttggtggggtttggtggagaaagaagggcctttgaagtacaactgggaaccctatgctgaacttgtgcagatgctgcaaatgcatggcttgaagcttcaagttgttatgtctttccatcagtgtgggggaaatgttggagacaattgcagcattcctctaccaccatgggtgttggaagaaatcagcaagaaccctgagctggtttacacagacagatcagggaggaggaatcctgagtacatctccttgggctgtgattcggttcctgttctaaatggaagaactcctctccaagtgtactctgactacatgagaagctttcgtgacaaattcagagattacttgggcagtgttatcgtggaaatacaattgggaatgggtccttgtggagagctcagatatccatcttatccagaaaccaatggaacttggaggtttcccggaattggagaattccaatgttatgacaagtatatgaaagcatccttggcagcagcagccgaagacattggaaagaaagaatggggaggaggtggaccccatgactcaggccagtacaatcaatttcctgaggatactggatttttcaaaagggaaggaacatggaacactgaatatggacagttctttctggaatggtactccggtaaattgctggaacacggtgagaggatccttgtatctgccaaaggaatatttgaaacaactggggtgaaactatcagggaaagttgcaggaatccactggcattacagagcaagatctcacgcagctgaactaaccgctggctactacaacacacgaaataacgatggatatctgcctatagcaaggatgctcgcaaaacatggagttgtcttcaatttcacctgcatggaaatgaaggacagagagcagccagactttgcaaactgctcacctgaagggttagttcaccaggtgaagatggcaacaacaacagctagagcagagcttgcgggggaaaatgcattggagagatatgatgcagatgcatatgctcaagttttatcaacaagtaagtcagaatccggcagtggattggctgcattcacatatctaagaatgaacaagaggttgtttgaagctgacaactggcggcacctagtggatttcgtaagaagcatgtctgagggtggtcggagagagagacttccggcagctgattcccatgggagtgatctttatgttgggcacatcaaagcaacacaggaaaagcacacacaagaggctgctcttgtgtaa

SEQ ID NO: 3096 - DNA, 552 bp, Glycine max var. Williams 82
atgaaattcgcttataacctagtgatgattttctttatctttctctttcaatactcaaacggctccaaccttatccttcaatcatgcaaagaggcctcaaagaatgatccaaatttgagctatgatttctgtgttgcatcccttgaagaagccttatccaagtgtcacccaccacccaccaaccttgaagaccttgtgggcatgtcaattaatctatccaaatccaacgtaaccaacatggtttccatcatttcaaacctattgaagaacaaaacttttgatcaatacactaaggcttgcctaaaagattgcttcgatctttactcggattcgctttcggctttagatgatgctgtggttgctttcaagtccaaggatttggacacggctggtataaacttgagtgcttccttggataattctgttacatgtgaagatcaattcaaggataagaaaggtgaaacttctcctataacaaaggagaacaacgtgtacttccaactcaatgtaatatctctagccttcatccaaatgtttcgtcaacattattga

SEQ ID NO: 3097 - DNA, 594 bp, Glycine max var. Williams 82
atgatgttacaagcttcttttttgcgcttgatctctttcttctttctcatcgcactccctcttggaagaagctctaccaccttgaatgtaccaaaggacataatcaaccaaacatgccaaaaatgtgccaaccaatccatcatcttgagctacaagctatgctccacttctcttccgacggttccggtgagtcactccgcaaatctcgaagggttggcgttggttgcaatggagctagcactagagaatgtcactagcactttggcaatcatagagaagctattagatagcacaagtttggataattctgctttggggtgcttagcagattgcttggaactgtactctgatgcagcatggacaatactgaattccgtaggtgttttcttgtctgggaattatgatgtaactaggatttggatgagttcagttatggaagcagcatcaacatgccaacaaggttttactgagagaggtgaagcttctcctttgacacaggagaattataatctctttcagttgtgtggtattgcactttgcattattcatttggctacacctggagtaccttattctcaattattccacagataa

SEQ ID NO: 3098 - DNA, 1332 bp, Glycine max var. Williams 82
atggaagccgtccaagtcatatccaccactacaatcaaggcaccaccgagtcacaataaccatgactcagttcagaaaatcgatttaactccctgggatcttcagttcctcccaattgaaaccattcaggaaggccttctttttcgcaacaaacacacaaaaaaccaaatcgagcacctccaacactccctttcatccactctcgccttctttccacccctcgcaggtcgtcttgtcattctccaacaccacgacaacactgtctcgtcccacatcgtatgcaacaacgcaggagcactctttgtccacgccgttgcagacaacaccactgtcgttgatattcttcaacccaaatacgttcctcccattgtttgctccttctttccgctcaacggagttaaaaaccacgaaggcacgtcacagccagtgttggcagtgcaagtgacggagctacttgacggcgtcttcatcgccttcacaatcaaccacgtggttgcagacggcaagtcattttggcatttcgtgaattcctgggctgaaatctcacgcggtatccctaaaatatcaaaaatcccttttttcgaacgtttctttcccgttggcattgaccgcgccatacggtttccgttcacaaaggtggaagaaaaagaagaaggagaacactcacaaaaccttgaaccaaaaactctctctgagagggtcttccatttcaccaagcgaaaaatctcggaactgaaatcaaaagccaacgcagaggccaacacggacaaaatatcttctctgcaggcggttttaactctcctttggcgcgctgtgagtcgttgcaaacatatggggccacaagaagaggttcattttgttcttctgattggagctagaccaaggcttattccaccactcgcaaatgattatttcggaaacgcagcactggttggtcgtgctaccatgaaagcagaagaactattacaggagggtggattcggaatgggtgcttcggagataaacaaggtgatttcttcgcactctcatgagaaggtgaggagctactacgagtcttgggtgagaaccccaaggctttttgcgataggtcgcctcgctaatagtaactcattggccactagcggttctccaaggttcaacgtttacggcaatgattttgggtggggaaagcccctgaccgtaagaagtggcggcgcaaataaaagtagcggaaaaattactctgtttggtggcgctgaagaaggttctatggacattgaagtgtgccttccttatgtgattctcgaggcaattggaaatgactctgagctcatggatgccatttccaactag

SEQ ID NO: 3099 - DNA, 237 bp, Glycine max var. Williams 82
atgaccaaggtcactgccctatttttcaccttattactctgctccatgctcgtccatgccatgtccatacgccttgaaccagcttttcaccaagaatccttagccaaaccgcaccaacagagcgttgaggcggttgatgagagctgcgaaggcgttggagaggatgaatgcttgatgaggagaacacttgccgctcacgttgactatatttatactcaaaagcataataatccttga

SEQ ID NO: 3100 - DNA, 1890 bp, Glycine max var. Williams 82
atgaagtttatgaaacttggatctaagccagattcttttcagaatgacggggataatatcaggtatgtggcaactgagctagcaactgacatagttgttaatgttggaaatgtaaaattttatctccataagtttcctcttttgtcaaaaagtgcgggctttcaaaagctgattacaaacactaatgaggagaacaatgatgaagttcacatccatgacattcctggcggacctgctgcttttgaaatatgtgtcaagttctgttatggtatgacagtcactcttaatgcatacaacgtcgttgctgctcgctgcgccgcagaatatcttgagatgtatgaaactgttgagaaaggaaatcttatctacaagattgaagtcttcctcgactcaagcattttcaggagttggaaagactcgattattgttcttcaaactaccaagtctcttcttccatggtctgaggaacttaagttagtgagccatggcattgactccattgctaccaaggcttcaattgatacatcaaaggtggagtggtcatacacctataacaggaaaaagctaccatctgaaaatagtaatgatcctcccttcaatagtgtgaggaaacaacaattggttccaaaggactggtgggtggaggacctttgtgagctccaacttgatctttatgagcgggttataaaaacaattataagcaaaggtaatgtttctggcactgtaattggagaagctctaaatgcttatgcctcaagaaggatgcctggtttcaacaagggtgtgatccaaggagatattgtaagaaatagattactgttggagaccataatccgaatattacccttggacgtgggcagtgtctctttcagtttcttggtgaagttattaagggtagctattcagttggaacgtgaagagttggagagatctgaactgattaggagaataggtatgtgccttgaggaggctaaggtgtctgatttattaatttgcgccccagttggtgacacagtttttgatgttgacattgtgcaaaggctagtagaagagtttgtagcatgtgatcaacatgttcagacggatactctgttggaagatgactttcaggaggagatcagaagccccgggatggtttcagaatcttcaaaggcaaaagtggcaaaattggtggatggataccttgctgagattgcacgtgatccaaatttaccttttgcaaaatttgttaatcttgctgaattagtatcaagctttccaagagcctctcatgatggcctttatcgtgccattgacatgtatttaaaggagcatcctggaatcagcaaaagcgaaaagaaaagaatatgcaggttgatgaactgcaggaagttgtctgcagaggcttgcatgcatgctgtgcagaacgagcggcttcccatgcgcgttgttgtgcaggttctcttctttgaacagctgagagctacaacatcttctggaggcaatggcacaccggatcatcctggctccatcagggccttacttcctggtggatctcatgggagctcaaggtctactataacaaacacagaagaggaatgggatgccgtgggaacaatggaagacataaaatccctgaaaggggagcttgatgcactgaaattatctggtggaaccagcggggccagcagcagaagcgacaacaacgatggcggtaaagacaatgctgagaaagttgctgctagtaaaatgaaaggtctcatgtcgaagaagataatctctaagatttggtcaagcaaagaaagaagtggtgagctaagtagttctgatacatcagagagccctgcttctactgttgtagaggaaacaaaatctactccatctagaagtaggaggcattcattgtcttag

SEQ ID NO: 3101 - DNA, 1230 bp, Glycine max var. Williams 82
atgggagagtctgagtttgttccttcggtggctgtgagtgtgagagagtttgatccaactaaagacatagagaaagtggaagccgttgaaagaatatgtgaggttggacccagtggaaagctttccctcttcaccgacctccatggtgacccaatttgcagggtccgcaactcacctactttcctcatgctgatagccgaaattggccaagagacagtaggaatgataagaggttgcatcaaaaccgttacttgcggaaaaaagctccacaggcaaggaaaaaacaacaccgagccaaaacaagtccctatttacaccaaactagcctacatattaggccttcgtgtttctccacatcacaggagaatgggaatagggatgaagcttgtgaagaaaatggaggaatggttcagggataacggggcagagtatgcatacatggctacggagaaggacaacgttgcatccgtcaagttgttcaccgacaaatgtgggtactcaaagtttcgtaccccctgcattctcgcgaatcctgttttctcgcatcctgctagaatctctcacaaagtgactatcattgaactctctccgagcgatgccgaaatactctaccgcagcaagttttccacaacggagttcttcccgcgcgacgtagactccgttctccgtaataagctctccttaggcacttttcttgccgtccccaaaggcttgtaccgggctgacacgtggcccggctcaacccgctttcttgagggtccaccaccctgttcttgggccctagtcagtgtgtggaactgcaaggacgtgttcacactggaggtaaaaggtgcttcgcgcgtgaagaagacgctcgccaagaccactcgcgtcctcgatcgtgccttcccctggctgcgcttgccctccgttcctaatttctttgagcccttcgggtttcattttttgtatgggcttggaggagagggcccgcaggcccagaagatgatccgggctttgtgcgggtttgcccataacctcgcccgggatcgcggctgtgaggttgtggccaccgaagtttcaagccaagaaccgttacggtgcgctatcccgcactggaaaatgctctcatgcgaagaagatctgtggtgcattaagagattaggagaagattacagtgatggctctctgggtgattggactaaatcccctccaggcttctcaatttttgttgatcccagagaagtttga

SEQ ID NO: 3102 - DNA, 288 bp, Glycine max var. Williams 82
atggagaagcaacaacaacaagcaccatctaaggaaacaaaggcacagagtgatgaatcagttaaagaaagcagcactgaagggcttccaatggaggatagtccctatgtgaaatacaaggatttggaggattataagcgtcagggttatggtacacaaggtcatcaagaaccaaagacaggtcgtggagctggagccactgaagcacccactctctctggtgctgcagtttcatctgatgcacaagtcgctgccactgatgccattaacagtaaaggagtcccttaa

SEQ ID NO: 3103 - DNA, 657 bp, Glycine max var. Williams 82
cgattcattcaccaatggatcgcaacggcgttctctctctcgcattcatcttgcattgtagtcgccggcgtcggaggacagtctcccgccgcagcgccgtcaaacactccggcaactcccgccgccgccactcccgcccaagcaccttccacagtaccgaaatcaccagctcccgttgcttctcccaaatcatctccaccagctgcaacccctgcatctactccggcggcatctcccaccaccacccccgccgcgcctgctccggtgaccaagccacctgcagcctctcctcctccggcgactcctccaccggcaactcctcctccggcgccggttcccgtgagctctccccccgctcccgtgccggtgagttctccacccgctcctgttccggtggcggcgccaaccacccctgtggctccctctccggctccgaagcataagaagaagggcaagaagcacggtgctccggctccttcaccgttgttaggacctcctgcgccacccaccggagctcctggacccagcgaggatgcttcttcccctggacctggcactgctgccaacgatgagagtggagcagagaccaccatgtgcttggagaaggttctaggaggcctagctttgggttgggctacccttgttttggtcttctag

SEQ ID NO: 3104 - DNA, 1782 bp, Glycine max var. Williams 82
atggcaattgctaattgtgatgataaaaacgcaaaaactttgcagttcattgaagatatgacacgaaacactgatagtgtccaagagagggtccttgctgagattctgagccaaaacgcccaaaccgaatacctgaaacggtttgagctgaatggagccacagaccgtgacactttcaagtccaaggtacctgtcgtttcatacgatgatttgaagcatgatatccaacgcattgctaacggtgaccgctctcctatcctatgcgctcacccaatcaccgagtttctcaccagttctggaacatctgctggggagagaaaattgatgccaacaattagtcaagagacggaacgccgtcaattaattttcagccttcccatgccagtgatgaatcaatacgtggctgatttggacaagggtaaggctctcctcttcctgttcaccaaagccgagacgaaaactccaagtggcttagtggcacgtccagtgtctgctagcatgtacaagagtgaacagttcaaaaacagaccctatgatccatacaacgtgtacactagccccaacgaagcaatcctctgtcttgattccttccaaagcatgtacacccaagtgctatgcggcctcatcatgcgccatcaagtcctcagaatcggagccaatttcgcttcgggccttctccgagccattcgcttcctccagctcaattgggctgaactagcccacgacatctccaccggaaccctaaaccccaaaatctccgacctccccatcaaacaacgcatgacccaaatcctcaaacccgacccggaactcgctgatttcattgtgaaagaatgctcgggagaaaactgggaaagcataatccccagaatctggccaaacaccaagttcgtagaggtgattgtgaccggtgccatggcgcagtatattccaactcttgattattacagcggaggcctacctatcgcttccaacatatacggatcctccgagtgcttcttcgggattaacctaaacccattttgcaacccctctgatgtgtcctacaccatcatgccaaacatgggttacttcgagttcttgccccatgatcacgatgatgacgacggtgctttgtattcaggttccgattccagttcgcgattaaccgacctggctgatgttgaactcggaaaatcatacgaaattgttgtcaccacgtactccggtatatgccgttaccgtgtgggcgacattctccgagtcaccgggttccacaactccaccccgcagttcagcttcgtgaggagaaaaaacgtattgttgagcatcgactccgacaaaacggacgaagcggagttacaaaacgccgtcgagaacgcctccgtgctgttgaaggagttcaagacgagcgtggtggagtacacgagctttgcggacacgaagtcgatcccggggcactacgtgatttactgggaactcttgatgaaggactcgtccaacgctccaacgagtgaagcgttggagcagtgttgtttgagaatggaagagtcgctgaatgcggtgtatcgacaatgcagggtcgcggagcattcaattgggccgttggagattcgtgtggtgaagaacggaacttttgaggagcttatggactacgctatctcacgcggcgcgtcgattagccagtacaaggtgccgcgctgcgtgagcttcacgcccataacggagttgcttgactctagggttgagtccgttcattttagccccgctgaaccgcactggaccccggaacgacgtcgttga

SEQ ID NO: 3105 - DNA, 1476 bp, Glycine max var. Williams 82
atggcaattgctaattgtgatgataagaacgcaaaagctttgcagttcattgaggatatgacccaaaacactgacagtgtccaaaagagggtccttgctgagattctgagccaaaacgccaagaccgaatacctgaaacggtttgagctgaatgcagccacagaccgtgacactttcaagtccaaggtacctgtcgtttcatacgatgatttgaagcatgatatccaacgcattgctaatggtgaccgctctcctatcctatgcgctcatccaatttccgagtttctcaccagttctggaacatctgctggggagagaaaattgatgccaacaattcgtcaagagatggaccgtcgtcaattactttacagccttctgatgcctgtgatgaaccaatacgtgcctgatttggataagggtaaggctctactcttcttgttcatcaaagccgagacaaagactccgagtgggttagtggcacgtccagtgctaactagcctctacaagagcgaccaattcaagaacagaccctacgatccattcaacgtgtacacaagcccagacgaagcaatcctctgccccgattccttccaaagcatgtacacccaaatgctgtgcggcctcatcatgcgccaccaagtcctcagagtcggagccgttttcgcctcgggccttctccgagccatccgcttcctccagctcaattgggctgaactagcccacgacatctccaccggaaccctaaaccccaaaatctccgaccttgccatcaaacaacgcatgacccaaatcctcacaccaaatccagaactcgctgatttcattgtgaaagaatgctcgggagaaaactgggaccgcataatcacaagaatctggccaaacacaaagtatctggacgtgattgtgaccggtgccatggcgcagtatattccgaccctcgattattacagcggaggcctacctaaagcttgcaccatgtacgcctcatccgagtgttactttgggcttaacctaaaccctatttgcaccccctctgacgtgtcctacaccatcatgccaaacatgggttacttcgagttccttccccacgaagaagatttatcttctagctcttcaagctccaccttgtcacgtgactcgctcgaccttgcagatcttgaactcggaaaatcctacgagctcatcgtcaccacgtactccggtctgtgccgttaccgcgtaggcgacattctccaagtcacggggttccacaacaccgccccacatttcagcttcgtgaggagaaaaaacgtgcttctgagcatcgactccgacaagaccgacgaagcggagttacagaacgccgtcgagaacgcctccgtgctgctgagggagttcaagacgagcgtggcggagtacacgagcttcgccgacacgaagtcgatcccggggcactacgtgatttactgggaacatctatctctattctttttataa

SEQ ID NO: 3106 - DNA, 633 bp, Glycine max var. Williams 82
atgaccttcataagggaggatgatgatgatcaagttgatgatgatcatgatcatgatcatgtggatggtggtggatcacaaaacagtgccagcaacatcactgaaattgtgaccaccccagaaggggaaaacttaggagaatggctgagtctaggcctcaaaggagacatcaacatgccagcagaagaacaaaactcatcatcaaggcctctccacagcaacaacaacaaggtattctcatgcaacttctgcatgagaaagttttacagttcacaagccttagggggtcaccagaatgcacacaagagggagagagaagctgctagaagctaccaccaatctcatcatcacagaattgggttttcttacactacttctctggcaactaggtcactgggaattaagcctcactctcttgtgcacaggcctaacagagaaaggtctgctatggtggctagattcagtagtagtgatgccattaatgttggggttggatcagtggcatcatcatggacaccctttatgcttgaacaagctgtggatttctattggccaggtagctttcgtggggacttattgccaaagcaagaatcatcagatgttaagaagattgacttagatcttcggctctga

SEQ ID NO: 3107 - DNA, 399 bp, Glycine max var. Williams 82
atgatgaaaactcaggccttactagttctcatgttattggtgaactttgtttttttcatgggctcagaagcccgtccattgagtatcattgagacggaaaaatcagtcactggaggggaagtggtggatttctttgattggttatctcttggagcaatgaaggattctgggccaagtccaggtgtgggtcacaagttcaccaatagtgaaacccttggtgggattaaggactctggtcctagttccggggggccaggtcaccaatttactaacagccagacccttggtggaatcaagaattcgggtcctagccccggaggagagggtcacaaatttaccaacagtgagacccttggtgagatgaaggactcaggtccaagccctggccaaggacactaa

SEQ ID NO: 3108 - DNA, 324 bp, Glycine max var. Williams 82
atgaagtggcaaatcatgtcttataaaattagatgcagagatttgccctgtttttgcattttgttgaatggtttccatccaatttattcttcttataatggttgtgatttttatgttggacatctacaggctgccaaagaagcaaggcatgataaggaggctctggtgaaatttttctgcatgttgatcaggagaagatatttctcagatgaaatacaaataccttcaccagcatggtccattccttctgttcagagacaagctcagcgtatagatgaaaatttcacagaagatgatcaatcttataatacaaggctaaggtga

SEQ ID NO: 3109 - DNA, 1788 bp, Glycine max var. Williams 82
atgatggattttcctagctctatggaaggttggatgaaggctttgtatgtggtctttgtgttcttctatgctttcttccttggtgctttaaaaggcatagttgtgggtcctattgctgctctgattcttattataggcaacgttggggtgattctggggttgtttcctgcacatgtggcttggactctttacacccttttgaagattcatatgtttgatgcaccaatgaaagctgctattttgattgctttgcctgctttgtttggcttgtggttgggtctaggcgtagctggaagcgttcttgttggagtggggtatggctttttcaccccttgggtttcaacttttgaggccttcagacaagacaatgagtccaagaaattttctcactgtattgtggatggaacatggggaactatcaaaggtagttgcactgtggttagggattttgcagatatgtgttatcattcatacccaagttacttaaaagaactgcgtgaatcacctgcctcagatgagcgtcaaaggctaaggttaattcatgttcccggatgtgtcattgttgggataatggggctagttgtggagattcctcttttcactgcaattgctctagtaaagagcccctacttgcttttcaagggctggttcagacttttgcatgatttgattagcagagaaggtccattccttgaaatagtttgtatccccattgctggtttgacaatatttgtgtggccactagttgtcattgccagcattttgttggctattttctcaagcatttttgttggactttatgcatctgttatagtatatcaggaaagatctttccgtagaggtatagcctatgtgattgctatggttgctgagtttgatgaatatacaaatgattggctctatcttcgcgaaggaacattcttgccaaagccccaatatcgaaagaaaaaggcttctcaatcatcagagttttctgttaggggaaacagtgtgagaggaaacacttctatggagccacctgcaatgcttatgccatgcttagctccttcaagatctgttaaagagaccattcaagaagtgaaaatggtgcaaatctggggaaatatgatgaggtactgtgagatgagaggcaaggaactattggatgctaatgtacttacagcttctgacctctatgaatggatgaagggaaagaataacaatgaagctgccatagttggtgttggcttgccttgttattcactcctacaaacacttgtcttctccatcaaagccaactcatgtggtgtattgctacttgatgactttgaaataacctacttaaacagaccaaaggataagttgttggattggttcttcaatcctgtgatggttctcaaggaacagataagggttatcaaattgggggaagctgaactgagatacttggaaaaagtagttctctttggaagcaacaagcaacgcatggaggcttgggataatggtggtttgatgattcatgatgctcttagagctgctcaaatcgagggaatttcaagaaggatgattggaatgataagaggtatatcaaaacttccaacttataaaaggaagtttcgtcaaattgttaaagctctagttactcattctctggagaaagacgtttcagaaagggctttagttactcatcattctgtggatgtactagatgtttctgaaaaggctttagttactcgttatctggagaaagatccttctggaagatcaagtaggtctatagtatcagttgcctctgatgaaattgcttag

SEQ ID NO: 3110 - DNA, 1830 bp, Glycine max var. Williams 82
atgaatgccagagcacgcaccactcttcactcaatgaaacctcctttaaatgaaaccaaacaggggaagatggaaactggaggagggaagagagcagtgggtggtggccacaagaacgggcgtcgatccaatcgagaaaggaaaatggctttgatccaagatgtagataagctgaagaggaaactcagacatgaagagaatgttcatagagctttagaaagagcattcactaggcctttgggatctctacctcgtcttcctccttatcttcctccatatacattggagcttttggctgaagtagcagtgttggaagaggaggtggtaagacttgaagagcaggttgtgaattttagacaaggcttatatcaggaagctgtgtacatttcctcaaagaggaatgcagagaatttgaatgaccctattgaccaaaacaccataaggagttccaagcatcagagatcaaaatccatgtctcaaagtgagttcaattcaactttgatgatgggtaggccgcagccttctcttgccagaagtgcttccagcagaaagctaatgttctctgatgctgtcaatgaccacaccgtgaaactagtccatgggaagcaattgcacagaaaacatgattcattctcttctatcccagaagatggaaggggaaaagagaatcgatcatttggtaattttgtgaaggataagcaatcacctgagaagaaaacaaccaaagttgttactccaataaagaagtctccattcaaacaagaatcacctgagaagtgcattgatcacttgaagttacagctggattggagattagcagatcatgaaagggctcaaagttcttcaagttcttcagatgataaggtgtcagaaattgatagcacacccaatagagtttctgaggatattgtcaagtgcttgtgtagcatatttgtgagaattggtacatctaaggacaaaattggggaatcaaaaacaccttcacgttctgcatcagctttccatcaatgcagcaaggaaaaggatcaatcttgtgatccttatggtatctgttcagaatccaaaacaagggaagttggtccttataaaaatttatgtgaagttaaagctaccactgctgatatgaaccgaacaacaaatgcagtgtttctgatccacagattaaagttcctacttgggaaactagcctctctgaacttgaagggtcttactcatcaggaaaaacttgcattctggataaacacttacaattcctgcatgatgaatgcatatttagagcacggcatacctgagagtccagaaatggttgtagcattaatgcagaaggcaacgatagtagtgggaggccagtttctcaatgcaatcacaatagagcattttatcttgagactgccttatcacctcaagtttacctgtccaaaagctgcaaaaaatgatgaggttaaagcaccaggcatatttggcctggaatggtctgagcccttagtaacatttgcactttcctgtggaagctggtcttcacctgcagtgagagtttatacagcatcaaaagttgatgaagagttagaagcagcaaagagggactatttacatgcttcagttggcattactaaaacaaacaagttaataatccccaagttgttggactggtatttattggactttgcaaaggacttggaatctttattggattgggtttgcctccaattaccggacgaattgagaaaccaagcagttgaatgccttgaaagaaggggaagagattctctttcacaaatggtacaaatgatgtcctatgacttcagtttcaggttgcttttgcaccaataa

SEQ ID NO: 3111 - DNA, 2305 bp, Glycine max var. Williams 82
acaacctcaaccccgtcgttttgcttcttcttctgttgctctgtctttcactctgttcgagatttgtcatctcaacaccaacaccaacaacaatattattattattattatcaatacacacaaaaccataaaaacctttctttttgcactctgcattttctccattttccgctacctcaattgtttttaattgttcacgctttctcgtttcgcgagaaagggaaagttgaacgagcaatgaatgccagagcacgcaccactcttcactcaatgaaacctcctttaaatgaaaccaaagggaagatggaaactggaggagggaagagagcagtgggtggtggccacaagaacgggcgtcgatccaatcgagaaaggaaaatggctttgatccaagatgtagataagctgaagaggaaactcagacatgaagagaatgttcatagagctttagaaagagcattcactaggcctttgggatctctacctcgtcttcctccttatcttcctccatatacattggagcttttggctgaagtagcagtgttggaagaggaggtggtaagacttgaagagcaggttgtgaattttagacaaggcttatatcaggaagctgtgtacatttcctcaaagaggaatgcagagaatttgaatgaccctattgaccaaaacaccataaggagttccaagcatcagagatcaaaatccatgtctcaaagtgagttcaattcaactttgatgatgggtaggccgcagccttctcttgccagaagtgcttccagcagaaagctaatgttctctgatgctgtcaatgaccacaccgtgaaactagtccatgggaagcaattgcacagaaaacatgattcattctcttctatcccagaagatggaaggggaaaagagaatcgatcatttggtaattttgtgaaggataagcaatcacctgagaagaaaacaaccaaagttgttactccaataaagaagtctccattcaaacaagaatcacctgagaagtgcattgatcacttgaagttacagctggattggagattagcagatcatgaaagggctcaaagttcttcaagttcttcagatgataaggtgtcagaaattgatagcacacccaatagagtttctgaggatattgtcaagtgcttgtgtagcatatttgtgagaattggtacatctaaggacaaaattggggaatcaaaaacaccttcacgttctgcatcagctttccatcaatgcagcaaggaaaaggatcaatcttgtgatccttatggtatctgttcagaatccaaaacaagggaagttggtccttataaaaatttatgtgaagttaaagctaccactgctgatatgaaccgaacaacaaatgcagtgtttctgatccacagattaaagttcctacttgggaaactagcctctctgaacttgaagggtcttactcatcaggaaaaacttgcattctggataaacacttacaattcctgcatgatgaatgcatatttagagcacggcatacctgagagtccagaaatggttgtagcattaatgcagaaggcaacgatagtagtgggaggccagtttctcaatgcaatcacaatagagcattttatcttgagactgccttatcacctcaagtttacctgtccaaaagctgcaaaaaatgatgaggttaaagcaccaggcatatttggcctggaatggtctgagcccttagtaacatttgcactttcctgtggaagctggtcttcacctgcagtgagagtttatacagcatcaaaagttgatgaagagttagaagcagcaaagagggactatttacatgcttcagttggcattactaaaacaaacaagttaataatccccaagttgttggactggtatttattggactttgcaaaggacttggaatctttattggattgggtttgcctccaattaccggacgaattgagaaaccaagcagttgaatgccttgaaagaaggggaagagattctctttcacaaatggtacaaatgatgtcctatgacttcagtttcaggttgcttttgcaccaataagttctgagaggtgttactttctcatctttggtgtgggtttttgtacattgggttgttcacacaggaagtacataagccgaagcatgagatgtttttcaattgggaaatgggttagttatgcttttaggaaatatacatagaggcggaggtttattagacattcatttggctgcaaacgttttgggattcataataatcttatgtgttaattaagtttttagtctcaactatttcatatttt

SEQ ID NO: 3112 - DNA, 1734 bp, Glycine max var. Williams 82
atggagtcttccggtgcagcgaatgagaagctcttagaaaatggcacttcttctgataaacccacaaagggaaagggtggtttaagaaccatgcccttcatcatagtgaacgagtgtctggagaaggtggcgagctacgggatcatgcctaacatgatactgtatctgagcaacgattacggcatggctattgtggagggcacaaaagtaattaacacttggtctgccatgtgcagcgttttatccttattcggggcctttctctcagactcttactttggtagattcatcgtcatttgcatcggttccttctccagccttcttggtttaaccactttgtggttaactgcaatgatcccagagctaagaccttcctgtcaatcactcatgctaggttgcaactctgcttcagctgcccaactagctgtgttgttcctttccctgggattaatttccattggagctggttgtgttagaccttgttccattgcatttggagcagatcaattgacaatcaaagtaaggtccaatgatgagaggctcttggatagctactttaattggtattatacctcagttggagtatcaactgtgttttccatgagtgtaattgtgtacattcaagaaaatcttggatggaaaattgggtttggaatacctgctgtgctaatgttggtatcggctatcagtttcattcttggttcaccgttctatgccaaagtgaagccaagtcacagcttactcactagttttgcacaagtagttgtggtggctgtaaagaacagaaaacttactcttcctgattgcaactttgatcagtattatcatgaccgtgattcggagctgatggtccctacggatagccttaggtgtttgaacaaagcttgcataataagaaatcctgagacaatctcaaaccctgatggatcagtttcagatccatggagccaatgcacagtggaacaggttgagtcactgaaatctatgctcagaatccttcctatgtggtccactggcatctttatgattactgcctcccaaacctcattctctatcatccaagctaatacaatggaccgaaggttatttggcaatttcgagatgcctgcaggatcctttagtcttatcagtgtaatcaccctaacaataatcattcccacatatgagcgcgtaatggtacctctactagcaaaatacacaggcttgcctagaggattcagttgcaaaactagaattggggtaggatttttgtttgtatgtgtaactaaggcaacatcagctatagttgaaactatgagacgaaatgcggccattaaagaaggctttgaagaccaacctaatgctgtaattcaaatgtcagttttatggcttgttcctgagttttttttccttggaatagctgaggctttcagctcagttgggcagcttgagtttttctacagttatattcccaaatccatgtctagttttgcaatggctattttcactcttgaactagctgctgctaatacagtggcaagtgtgttggtgagcattgtggacaaggtcactagtgtaggagggaacaagagctggctatcaactaacattaatagtggacatctgaattactattatgcactgctcagtttcttaagtataattaactacctctactttcttgctgtttgttgggcttatggtcctgctccggggccaaatcttgaagcttctgcaggcaaggaagaagagtaa

SEQ ID NO: 3113 - DNA, 1185 bp, Glycine max var. Williams 82
atggaagggtggacgacggtggtcaacaggaggaaagcaaatgaaaggaagaagagtaccttagaggagagattatcctataagtgtgatacgtggggtaatcctccaaactatcatcataactggagaaataaggaggacatcacgtcctattatttcacccatttcacagatgaggtcaacgaggtgaggctctgggagaagtttaagttatggggggacgttcgtgaggtgtacattgccaaacgccgtaacaaggatggtaggagatatgggtttgtgcggtttaagggagtttcagacataaagcacttggagataaagctggataatattttcatcgataatcaaaaactgttcgtcaacctccctaggttcgcaagatcagtctggaagttagaggcgcagccaaaggttggtaagggaggggtgtcagataaagacactatcagaagtccacaggataacagcagaccacggcagagatcctatgcggaggtcgcggctcagggaggagcttcagctggaacgacgagttgcgagggagaaacaccagtcatcacgatcacactccatgaaggtcatgattactggtgcaagggggcctgggttggcagactaaagaaacacacggcgatggagttactggaggatcacatatcgtgggaactagggtacaatatcagtaccaaattcctcggtgacgatatgatcctcctaactggcctgtcggaggacaaagctcaacagattatcagaacggaggttgacggtggaaactctctgttctattccttcgagaaatggcggccggagtgtagaccaaacaaccgggttgtctggatacaactctggggattcccggttgaagcgtgggacgtcgaccacatgaagaaggctatatctgttatcggtgatgttattgaacccgacgaagacacagacgatcgccgccgtttggaccgtgctcgactgctcgttcggacaccccttccgccggcgatcacgaaggagatcactgtgcgtactggggacgttgatcacaaggtgtggatggtggaggagattggagacgatgtgggtatgaggaacaggagaaccccttcgtcagtagggtggacagacgaaatcacgtctgtagaagacggtgatgccgccgttcacgacgacgaagactcgtcatag

SEQ ID NO: 3114 - DNA, 1413 bp, Glycine max var. Williams 82
atgggaagcatgcacatagaaaccccagaaacttttgctgatggtagcaaaaacttcgatgatgatggacgagctaaaagaactgggacttggattactgcaagtgctcatatcataacggctgtgattggttctggagtgctatctcttgcatgggcaattgcacagatgggttgggtagctggtcctgcagtgctctttgtcttctctttgataacatacttcacctccactcttctcgctgactgttaccgttcacctgaccctgtacatggcaagcgaaactacacatattctgaggttgtcaaagccaacctaggaggaagaaaatttcagctgtgtggattggctcagtatataaatcttgttggtgtaacaatcggctacactataactgcatcacttagtatgggggcggtgaagaagtcgaactgtttacacaaacatggccatcaagacgagtgcaaagttaaggacaacgcttttatgattgcttttgcctgcatccaaattcttctaagccaaataccaaacttccataagctctcttggctctctatcgtagcagctgttatgtcttttgcttattcttccattgggcttggcctttccatagccaaaatcataggtgggggacacgtgcgaacaaccttaacaggggtggaagtttcgggaacggaaaaggtttggaaaatgtttcaagctatcggtgacattgcctttgcttatgctttttctaatgtcctaattgagatccaggacacactgaaatcaagcccacctgagaacaaagtcatgaagagagcaagtttgattggcattatgactacaacattgttttatgtactatgtgggtgcttaggctatgctgcatttggaaatgatgcaccatctaatttcctcacaggattcggcttctatgagcccttttggctaatagactttgccaatgtctgcatagcagtgcacttagttggggcataccaggtctttgtccaacctatatttgggtttgtggaaaagtggagcaaagaaaattggacagaaagccaatttataaatggcgagcatactttgaacattcctctatgtggaagctacaatgtgaacttctttagggtagtgtggaggactgcatatgtgattatcactgccgttgtagctatgttactcccattcttcaatgactttttggcccttattggtgcactctctttctggccattgacggtttacttccctatagagatgtacattaagaagtcaaatatgcaaagattttccttcacctggacttggctcaagatattgagttgggtttgcttgatcatttctattatctcacttgtgggttccatccaaggcctttcggttagtatcaagaaatacaagcccttccaagcagaacaatag

SEQ ID NO: 3115 - DNA, 1101 bp, Glycine max var. Williams 82
atggaatcacccagctcttccccaattttcccacaattcaccttcgacaacaacaactccgaccacttcatcgtggaggacctcttggacttctccaacgatgacgttgtcatcaccgatgccacctttgactccatcactactgactcttccaccgtcaccaccaccgtccacagctgcaactcctcctccttctctggctccgaccccaataccgtccctgatattggtagccggaatctctccgatggccatttttctgatgacctctgcgttccgtatgatgacatagcggagttagaatggctttcgaatttcgtggaggagtcgttttcgagcgaggacttgcataagatgcagctgatatcaggcatgaatgcgcaaaacaacgacgtatcagaggcccgcgagttccactacgagcccaccaccactagaagcgggtcccacaccccagagcccaccagaaacagcccaatattcaattcggaagtgtcggttccagccaaggcccgcagcaagaggtcccgtgggcccccttgcaactgggcatcgcgcctcctggtcctgtccccaacgtcgtcgtcctcggataacgaggtcgtcgttccatctcccgccactgccgaaccctgtccgactccggcgaaaaaaatggcaaaggtcgggccgaggaagaaggacagtagcagcagtgacggaaacggcagtggtggggacgggcgcaggtgcttgcactgcgccacggacaagaccccgcagtggcggaccgggcccatgggcccgaagactctctgcaacgcttgtggcgtgaggtacaagtcgggccggctggtgcccgagtacaggcccgcggcaagcccaacatttgttctgactaagcactccaactcgcaccgcaaggtgctggagctgcgaaggcagaaggaaatggtgcggtcccagcaacaccaccaccagcatcaacaacagtttctacaacaccaccaccataaccatcaccactatcaacatcaccagaacatgatgtttgatgtatccaacggtgacgattacttgatccaccaatacgtgggccccgatttcaggcagcttatctag

SEQ ID NO: 3116 - DNA, 1953 bp, Glycine max var. Williams 82
atggctcttagaagagcatattattgccttcttatgctgttggtgttggccaatatttgttttgtgccattgttgggagacacaaatgctcaaattttgatgaggttcaaagcttccttgtccaataacaatgccttaaacaactgggtgaacgagtctagtttatgtagttggagaggtttgttatgcaaccacactgaccaaacattttatggtttgagactagagaatatgagtctaggggggaacattgacgtagacaccttgtttgaattgccaactttgacaagctttagtgtcatgaacaatacatttgagggtccaattcctgagttcaaaaagcttgtgaagttaagggcattgtttctgtccaataacaagttctctggtgatattccagatgatgcttttgagggcatgacaaaactgaaaagggttttcttggcagaaaatggcttcacgggtcatattcctaagtcacttgctaacttgcctagactttgggatttggacttgcgagggaacagttttggaggcaatataccagagtttcgacaaaaggttttcagaaattttaatttgtcaaataaccaattggagggtccaataccaaaaggcttaagcaacaaggatccaagctcatttgctggcaacaaaggcctatgtggaaaaccgatgagtccgtgcaatgagattggccgcaacgagtcaagatcagaggttccaaaccctaattcacctcaaagaaagggaaacaaacatagaatccttataactgtcattatagtggtggcagtggttgttgttgcttcaatagtagcacttctatttatccgtaaccaaaggagaaaaaggttagaacccttaatattaagcaagaaggagaattccaagaacagtggaggcttcaaggagtcacaatcatccattgatctgacaagtgatttcaagaagggtgctgatggggaattgaactttgttagggaagagaaagggggctttgatttgcaagacctgcttagagcttcagctgtggttcttggtagtggcagtttcgggtccacatacaaggccatgattttgaatggaccaacagtcgttgtgaagaggtttaggcacatgaacaacaatgtcgggaaacaggagttcattgagcacatgaaaaggcttggaagtttgacacaccctaatcttctccctcttgctgcattctactaccgaaaagaagacaagtttttgatttatgactatgctgaaaatggtagcttggccagtcatctacatggtagaaataactcaatgctaacctggtcaacccgtttgaaaatcataaaaggagtagctagaggcttagcctacctctatgaaagcctccctagccaaaaccttccacatggtcatctcaagtcctccaatgtgattttggaccattcatttgagccacacttgacagagtatggccttgtgccagtgatgagcaagagccacgctcagcagttcatggcagcctacaaggccccagaggtgatccaatttgggaggcctaatgtgaaaagtgatgtgtggtgtcttggtatcatgattctagagctactaacaggaaaattcccagcaaattatctgaggcatgggaagggtaggaacaataatgccgacttggcaacatgggtggattcagtagtgagagaagagtggactggtgaggtgtttgataaagacattatggggaccaggaatggggagggtgagatgttgaagttactgaggattggaatgttttgctgcaaatggagtgtggagagtaggtgggattggagggaggcattgggaaagattgaggagttaaaggagaaggatagtgatgaggagtactactcttcttatgtcagtgaaggggatttgtattcaaggactatgactaaagatgagttctctatttctgtcactaattga

SEQ ID NO: 3117 - DNA, 1128 bp, Glycine max var. Williams 82
atgacagagtgtcaaccaggaagtaggatcattgttacaactagaaacaagcaaatacttagcccaattgatgaaatatatcaggtccaagatttgagctctgagcattctcttcagtttttctgtttgactgtttttggagaaatacaacctaaagatggatatgaagatcaatcaagaagagcaatttcctattgcaaaggattggatagagattgggtaacaagtatattagaagcttataatttctttgcagcatctggcataaaagtcctttcagaccttggacgacgaagtcgattgtggaaacttgaggaagtgcaagatgtattgaaatatgacatgggaactgatgctgttgaaggcataactttagatttgagcgaattaacttgggatctatatttgagctctaattccttggcaaagttgtctaacatgagatttcttaaaatccatgattggtgctgcactttcggatttaatgtgtacctttcaaacggtctcgactcatgggatggatttagtcttgacaagcttaaaaaactttgggatggggttcagcaaattgacctttgtggctccagacacctgattgagatgtcgaacttatctaaggcagaaaaacttgaaagaaaacatagatttctttatttaagtggttgtaagaaccttgactctgttggcaacaagttattatcagatgatcagcataatgcatcaaatttattgttcttaaaagcactccttcacaacattggctacttagtgtctttaagagagttagaccttcgcggaacaagtgttgagagcttgcctgcaaacatacaaaacctttcaatgttgacaacactttggctagatgattgcaggaaactcatgtctctgccgaagcttccaccatatcttgaacagttgagagcctttaactgcactttgctggagacagacaccactcaacgtttggtgttacaacacatgctgcaaagcagcataccctcctacatgcacaaacaacgtgtatattcaggcggtggatatttcattctcgcgggagaccatgtcaccaatgagtgttggttacatgcagcagagagttcaataactattccttgtcttcattcttaa

SEQ ID NO: 3118 - DNA, 1497 bp, Glycine max var. Williams 82
atgaagcttaaaaggtggctcgggagtgttttgttcctcattgttgccacagtgagcaatgccgcaggtgcatttgtgggggtaaacattggcactgatgttactgatcttccatcagcttcaaacgttgttgctattctgaaatcacatcaaattacacacgtgcgtctctataatgccaatgggcacatgctacaagccctttcaaacactggcattgaagtgattgttggtgtcacagatgaagagatactaggcattggagaatctgcatcagttgctgcagcatggatcagtaagaatgtggcagcatacatgccatccactaatatcacagcaatatcagttggcagtgaggttctcacctcagtcccaaatgttgcacctgttcttgttcctgccatgaaccatcttcacacagcacttgttgcttcaaaccttaacttccgtgttaaggtttcaacgccgcagtccatggatgtaatctctaggccttttcctccttccacagccacctttaactcctcatggaactccacaatctaccaactccttcagtttttgaagaacacaaattcctcttacatgttaaatgcttacccttattatggatacaccaaaggagatggaattttcccaattgaatatgctctattcagacccctttctccagtgaagcaaattgttgacccaaacacactattccactacaacagcatgtttgaggctatggtggatgctacctattatgccatagaagccttcaatttcaataatatacctattgttgtcacagaaactggttggccaagttttggtggagcaaatgaaccagatgctactacaaagaattctgagacctacaataataatttgattaagagagtaataaatggttcaggtccccctagtcagccaaagatagccatcaatacctacctatatgaattattcaatgaagataagaggaaaggtcctatatcagaaaggaattggggtgttttttatgctaatggaagtagtgtttattccttgagttttagtgcttccaacatgagtaatgcaaattctcaaggatcattttgtgtggctaaagatgatgcagacactgataaattgcaagctggattgagctgggcttgtggacaaggccaagctaactgtatagctattcaaccagggagaccttgctattcccccaataatgtgaagaaccatgcctcttatgcttataatgattattatcaaaagatgcataatgctggtggaacatgtgactttgatggtacagctacaacaactactgaggatcctagttatggatcttgtatatacgctggaagtgctaacacaagaaatggtggaagaagttcatcttctacagcacttggacttggacctgtaagtccagttggagctggtttgaacctgcaagtgtccacacttcagtatttgatatcgtttattagtgtatttttctctctgttgttgtcatga

SEQ ID NO: 3119 - DNA, 1101 bp, Glycine max var. Williams 82
atgaagggaaggttcatgtttctgtcggtgctcctttgtgccacttttcatgtctccttctctattatcgacggtttagttgccaacggcaactttgagttgggtccaaagccctccgccctaaaaggaacagtggtggtgggcgggagccactcgatcccagaatgggagatctccggctttgtggagtacataaaatccggccaaaagcaaggggacatgttgctcgtcgtcccagagggtgcctacgcggtgcgcctagggaacgaggcctccatcaagcagagaatcaaggtgatcaagggcatgtactactccatcaccttcatggtggctcgcacgtgtgcacaagaggagaggctcaacatttccgtcactcctgattggggtgtgattcctattcagactttgtacacgagcagtggttgggatcccattgcgttcgggtttaaggcagagagtgaaacggtggagatgctgattcataaccctggaaaagaggaggatcccgcgtgtggcccgcttgttgattccgttgctctcaggactctctaccctcccaaagctactaaccagaatatactaaagaatggtggatttgaagaaggaccctatgtgtttcccaactcatcttggggagtgatcatccccccaaacattgaggatgaccactctcccctcccagggtggatggttgagtccctaaaggcagtgaagtacatagactcagaccacttctcagtccctcaaggcaagagagcagtggagctaatagcaggcaaagagagtgccattgctcaagttgccagaaccatccctggcaaaacctatgttctctcattctctgttggggatgctagcaactcctgtgaagggtccatgattgtggaagcctttgcaggcaaagacaccatcaaggtgccctatgagtccaaaggcaatggagggttcaagcgtgctgcactcaagtttgtggcggttacccctagaacaagagtcatgttccttagcacattctacaccatgagaagtgatgacttctcttcactctgtgggcctgtgattgatgatgtcaagttggtgagcctgcgtaaaccatga

SEQ ID NO: 3120 - DNA, 2295 bp, Glycine max var. Williams 82
atggctttctccgcttcaattcgccctacctcttctcactctcagttgttttgctctgttaggttcaataggaggcaccatagcagtagccgaataggtttctcgtcgaacggcggaagaagatgtcgtcgtttacggaacagtgttaggtcggtgttgaacgacaaccggcctagcgcaagcgtgaacgacgattacggagcggcggagtctgctagggttttgttcgagagactgttcacggagaaccggataaccggagatgaaccggatcttcggattcttgaatcggatctcgaggcggcgctggcggcgctgaagatgaaggaggatcacttgatggaggcggagaggacggtgttgttggagaatagtaagttgaagctcacgaaggaggagctggagcggcaagagagtgaaattgaggctgctaggattaggtatgagaagcttgaggaggagatgaaggagacaatggttaaattggtttctcaggcgggggagattgaggagctgaagcttagggttaggggtcgcgatagtgagatcgatgcggtgaagtatgcgctggggttgaaggaaggggaagtggagaaaatcagggttgaattggaggagaggagtcgcgaggctgcgaattttgattctgagcttagagagaaggggaggattctggatgaagcgaatgaggttatgaagaagcaggaggctgagcttgaggagctaaagagggtggttcgagagaaagaggaggagattgaggttttgttggttcagagggaggttgagagggagaagctgagggtggctgaggcgaatttggagaagcaggcaatggactggatgttggcgcaggaggagctgaagaggctgggtgaggatgctgcgaggcatgctgaggagagtagtgagaccttggaggatttcaggagggtgaagaagcttctcaatgatgtgaggtctgaattagtttcgtctcagcaagcgttggcatcttccagaagcaaaatggaggagcaggagcggttgttggaactgcagctgagtgagcttggggagcagagggcaagtgtgatgtcctacatggaaaatttgaaggatgcacagattgaagtggagagtgagagaacgaaactcagggttgcagagtctcggaacagagagcttgaacgggatctgaagatggaaaaggagcttattagtgagttggaggaggagctgaagaaagagagaacttctttggagcaggcagtcaaagaagtggctttgcttcaagaggaattggagaagaaaactgccgagtttagagaaacaagtgccgttcttcaggttaaagagtcagagcttgttgatgctaagctagaaatccagcgtttgaaatctgaaaaggcttctcttcagggtatcttggaggagaaagacttggagctttccagtgctaggaaaatgctgggggatgttaaccaggaaatctatgatcttaagatgcttatgcacagtaaagaaacccagctcattgaagcaaacagtatgctaagggacaaagatgagcatgtgaaggtaatccagaacaagttgaataatacaaaccagaaggcttttgaggctgaaactgtggtagaaagaattttagatctcacaaacagacttgttgcttccattaaggatgaagatatgaactcatcaaaaccactactagatgaaatgggtaaccaactacttgatcaactattggagaaacctgctaatgaattgaaatggcaacaaaaaagccttgagaatgagcttgagttggccaaggtaaccttaaaagaaaaggagatggaagttcttgctgcacagagggctctaacgataaaagatgaggagctgaagatgacactttcaagattggactcaaaagaggaagagttgaaaaaagtaagggaagaagtgacagaagactccaatgatcttaaaaggctgtatgcttgggcacaggagagaattggcgagaaaagcttaggagatttggcaattgagaaacttcagcttgaggcagctcagcttgaagttgaagctgccaccaatgcactacaaaaactggctgaaatgagtcgacaacttctgaacaaagctatcatgagtgttgaagctgataactacatcagtgtccctgatggtaataaagcccccgatttgatccccgacaccaataaccctgaatgtttcgaagaggtaaaagcaagagttgctcgcctctcatctttgtctgagcagcttgtgatgcaggcgggtattgttcctgcaaactaa

SEQ ID NO: 3121 - DNA, 585 bp, Glycine max var. Williams 82
atgtttgtcctagaaaatggtgtgaagaacaagggggaagacccaaggcttcaagcaatctctcaagccatcagagtggtgcctcactttcccaaacaaggaataatgtttcaagacataacaacattgttgttggatcacaacgcgtttaaagacgcggttgacatttttgttgatcgttacagagacatggatatttctgttgttgccggagttgaagccaggggattcatttttggttcctcaattgcgttaggcattggtgcaaagtttgctcctttatgcaaacctggaaagctaccaggtgaagtaatttcagaaaaatatgttctagaatatggaactgattgcttggagatgcatgttggtgctgtccaacaaaatgaacgggtcataattatcgatgatttggtggctacaggtggaactatgtcagcagcaattagacttctagaacgtgctgatgctgaagtagtggagtgtgcttgtgtgattggtctgtctgatcttaaggtacgctgcaagcttaatggaaagccactttatatccttgtggagccacgccaagtagaaaatggtttttga

SEQ ID NO: 3122 - DNA, 784 bp, Glycine max var. Williams 82
atgcttgttctctcctccgtaaaactccaagtcagttacataaactacgaaaatcatgaaattgtgttgaatgacccggaaaattgccttccgcacaagtttctgcaaatcaacgattctcttattcatccttacaaatttgacgatgaagctaaaacaagtaagttgagcttcttcaactgttcttcagttgagcatcaacacctgagaaactaccagcagtcactgtcagactcacaagacatgatctcctgtccgatttatgtttctgatcttcatgacagtgtgctcagtttggacctaacatcctgtaccaaaatgttcgatatcgttacgccagtttcggcatacgggatgcagcgaaattcgttggatttaagatggtccgaagcaaattgtagtcagtgcaaagcaaaaggcaagaaatgtaaatggaagaacaacagaggtgacatcgaatgtttcgactgcaaggacaagcgaaaaactattcatgttcccaaatcttttatttactctgcaccaggttcgattcttttggggttcgcggttattgtcgtttttaagatcatataccattttagacagaaacaagaggaccaagcaagggtggagaagttcttagaggaatacagggcagaaaagcctgcaagatttacttatgcaggacttatatacctttttgataaaaactcatgcatgacttatatacctttttgataaaaatacatgcatgacttatgcatcacactgagagtgacacttagattggacatatatacaa

SEQ ID NO: 3123 - DNA, 2874 bp, Glycine max var. Williams 82
tattactcatgtttagggttatagaactgcttttaattccctttaaaaaaacagttttattatagatactttatcataatcctatcctatttgaataattttttttttctggttgagtgatctaaaagaaaaaaaaaactgtttttagtttttacactaaaaaaaatccctttcttctattgagtccatgtccaagaatcacgttggaattgcggatcggagctccggtggattttgtggccgttgaagccagcaagggtggtgccgacacggtggttgccgttgtgcttccaattttttccggcaagggcacttgttagttccttcctcagattaaaaggtcaccggttcaggactcgccctcaactcggacaccaactcaaccaccttgtcctaatgtctgtggagagcgaaactgggtcgtttcgggactctgaaactcggaacaatcttcgaagaattcttgagtcatgctctaaattggcggaggctggagattttcatgaatctgaaaacacagcagtttcagagcttgtcgagttccttgattctttgttggatgctgccatgtctgacctggatagtgaaaatgcagagaatgatgcatttgaagctatctctgagatccatagatatatttgttctccttctattgaccaggaagttgttgatgccctttcctttgaactgccaaaggctgtttcaaagtttgtggggatttcaagtagatttttggacttggcaattagcatcattgatcagtttattgtgaaatgtggtccaagggatatgctctcaattctctgtaatacattaggttactcaagtaagatcatcaaggctgccagttacattgtccctcctttatcagggctctcaaaggtcttactttccattcagaggcgtcagtttgagcaagtaaaagtagccgttcctataattcttaatatattgaaggctgtgtctttggagtcagaagaagcagaacttgaggatgtatttgacacagctgttgagattgcaaattctatatatgaagtttgcaataagttggagagggacacaaaggagaagctccgagctcttcttggtctatatgtcatgcaatgcatggctcttgtttcagctagcataagctataaagcttccagttgtccttcttcggtattacaactgtcacaaatttcttcatattgtggtttatcatatctcagtctagtaacaacttatgatgtagagattgtggctgaatctgtgtttggaggagaagataaagatcactgtaccggttgtttttctcatgtcaaacatggtgctgctctttcagtggtttgggggcatgtctcaaaggaggttgctcaaactgctaaagaggatttgattgccatcagggatgaacttcgtaataaccaaacaaaaaggtggcaagcaataggaacattaaagcatgtactttactttgtaaatctaccatgggaattaaagaaacatgctatcgacttcttgcttagcatcacagatgaaggtgtctccagaaactacaacgaggaacgttctgaatggtcatcttatgtgccaagccttttctcggctttgcaggctgtaaaaatggttatcatgtatgccccagagccagaacttagaaaaaaatcctttactgtgctgaaaggagtacttgctgatattccaaattctcaaagatttgacattatgaaagcattgattacaaataccgactcttcctcgatgatcgccattttcatcgatcttgtcaggaaggaaatgcatacagcaatctgcagtagtagatcaatagtaaaagatgccccacagatagataacaaagcatttccggatacctccttttggaatcccgggatccttgagttggtggagttggttctaagacctccacagggcggacctccttcccttcctgagcagagtgatgcggtgttgtcagccctcaacctatacagatttgtattgatgacagaatctgcagaaaagacaaacatcactggagtgctgtcaaggaacaatttactgaaggcctacaatgaatggttgcttcctttgcgtaccttggtgacaggtataatggcagagagccatagtgattatgatgagtttgcagttgacactgtatgcaccctaaatccacttgagttggtgttgtatcggtgcattgaactcgtagacgagaagcttaagcaatccacataagctgccccattagcaaaaggttttttttaataaaagatggcaaatgttgtttttgaaatattgatcatctaaagcaaggttattgaattgcaatgcaaatagtgagtgaattgtccagccagtttttgaatggtgatttataaactgtattgaatagtatgattagagatacgatgaaaatagcttttcagatataaataacgtagtgtttaatataataatttttaaactagagaataaccatgagtatcatgaaacaagttcataaggggcaatgaaatttgaacttgattttatgcaaactatttagagggtgtttgctttcacattctaaacgtgcattaacattaaaacccatgtcaaagaggatgaaactacgcgcggaagcaactttcagacgtggatcaagttggacgcgatcagttaacaagcacttaaatttctctccactagggatgaattctataaaatatttttgtaaaccggtccgagcaagaatattttaacctatagtctataaaaagtagattgcccacttcattcttatgcatattttgacattatgattgtgtattacatcacttctaattttatgcattccttttagtgtttctcaatggttgaatcatcttgatcgtttaacttttt

SEQ ID NO: 3124 - DNA, 552 bp, Glycine max var. Williams 82
atggctggttattcaaaagcttcagctctttggatcctttttcttctctttggcttctctgtagctaaggaaattttggttggaggtaagactgatgcatggaaggtttcagcctctgaatcagattcactcaaccaatgggcagaaaagtctcgtttccaagttggagactatcttgtttggaaatatgatggtggaaaagactcagtgttgcaagtgagcaaagagaactatgtgaattgcagcatctcaaaccccataaaggagtacaatgatgataccacaaaggttcagcttgagcatccagggccattctacttcatcagtggtgcaaagggtcactgtgagaagggtcagaagcttgttgtggtggttttgactccaaggagaggaacaaggttcactggttttgctgcaccttcaccagctccttctgcttctgctgagtttgaaggtcctgctgttgctcccactagcactgccaatgctttgaatgggggaattttgatggtggctatgggaatgattgctatgtgggttttttttatgtga

SEQ ID NO: 3125 - DNA, 1491 bp, Glycine max var. Williams 82
atgatagcgtacctagaacactttgtgcacggaaatgacacagaatcgatgccaaacgacgacgtttcagctctcgatggagcttttcacttcggcgccaccgccgccgccggcaaggacttcggcgggatgaaatccgttaagccgcgggcggttattcgccccgccttggccggcgacgtggagagggcggtgaaggaggcggcgcgcacgacttacctgactgtggcggcgcgcggcaacggccactccatcaacggccaggccatggcggagaagggcctggtcctcgacatgcgcgccatggaggaccacttcaccctcctctctctcgacgacgggtcactatacgtcgacgtttcgggaggggcattatgggaagatgttctcaaacgctgcgtttcggagttccgcctcgcgccgcggtcttggaccgattacctcggcctgaccgtcggcgggacgctctccaatgccggcgtcagcggccaggccttccgctacggcccgcaaaccgccaacgtaacggaattggaggtggtgagcggcaaaggcgaaaccttagtctgttccgaatcacaaaattcggaactcttcttcgccaccctggggaggattaggccagtgagatggataagggtggtgtacacagaatttggcgacttcactcgagacgcagagtggctggtgactctccgagagggtgatggttttgattacgtggaaggtttcgtttttgtcaacagtgacgacccttgcaacggctggaccaccgtccccgtgggccccaaccaatacttcgacccggttcggattccttcaaccgccggcccggttctctattgcttagaacttgcccttcattatcgtaaccaagaccatccttccgcagttgatatggaggtggatagattacttggacggttaagattcgttgagggtctaaagttcagcgtggatgtgacgtacatggaattcttgctacgtgtgaagcgtgtggaggaggatgcaaaagccaatggaatctgggacgcaccccacccatggctgaatatgttcgtctccaagtccaacatcgctgaatttgatcgtgaagtgttcaagaaaatcctcaagcacggagttggtggccccattctagtgtaccctcttttgcgaagcaagtgggatagtcgacactcggtagtggtgccggacagcaacattttctacattatagccttgctccgatttattccaccacccccaaagggaccacctacagaactattggtggaacaaaaccatgagattattcagttgtgctacaacagaggcttcgatttcaagttgtatctccctcactaccagtcaaaggagaactggatgcgacactatggagataagtggtccagattcgtcgagagaaaggccaattttgatcccttggctattcttgcacctggacagaaaattttttcccgaatccctcaacccttgtctatcacttaa

SEQ ID NO: 3126 - DNA, 324 bp, Glycine max var. Williams 82
atgaaaagcaaaaccgtctgttttggcatcagaggacgcaacaacaagagcaaggaaaacaaagtcgaagatttagagaaactctcccatgtcaagcctaatcacaagggaaaaactaaaaggtgtgcttcaacaactcctgttggtgatgatgatggtggcatcaatgttcatggagccaacatagttgctagcaatgatgcaggagtagctgctgctgtgatcactgcagctcatatgtctttgatgtgtgtcaatgatggtcaagatggaagtggtcatggtcatgggggtgaatctggggtagatggtgatggtggctga

SEQ ID NO: 3127 - DNA, 2943 bp, Glycine max var. Williams 82
atggcatttcgatttggagtccttattcttgctttggttatttgtttgaatttcaattctgtggaatctgatgatggagcaacgttgttagagataaagaagtcatttagagatgtggataacgtgctctatgattggactgactcaccatcatcagattattgtgcctggagagggatatcatgtgataatgttacctttaatgttgttgcactcaatctttcagggttgaatcttgatggtgaaatttcacctgcaattgggaaacttcagagtttggtctcaattgacctcagagaaaacaggttatcagggcagataccagatgagattggtgactgttcatctttaaagaacttggacttgtcatttaatgaaattagaggggatataccattttctatttctaagttgaaacagctggagaatctgattttgaagaacaaccaattgattggaccaattccttcaactttgtctcagattcctgatttgaagattctagacctggctcaaaataatcttagcggagaaataccaaggcttatatattggaacgaagttttgcaatatctaggcttgagagggaacaatttggttggttcactatcaccagacatgtgccagttaactgggctgtggtattttgatgtgagaaacaatagcctgacaggaagtattccagagaacataggcaattgtactgccttccaggtcttggatttatcctacaaccaactaactggagagataccattcaatattggattcttgcaagtagcaactttgtccttgcaaggcaataaactctctggacatattccaccggtgatcggtctcatgcaagcacttgctgtcctagacttgagctgcaacttgttaagtggatcgatccctcctatcttgggaaatttgacttacacagaaaaattgtacttgcatggaaacaagctgactggcttcatccccccagagcttggaaatatgtcaaagcttcactatttggaactgaatgataaccatttaagtggacatatcccgcccgagcttggaaagcttacagatctgtttgacttaaatgttgcaaacaacaatcttgaggggccaattcctagtaatcttagctcatgtaaaaatctcaacagcctcaatgtgcatggcaacaagttgaatggatcaattcccccttctttgcagagtttggagagcatgacctctttgaatctttcttccaacaatcttcagggcgcaattccaatagaactgtcgcggattggcaatttggatacattggatatttcaaacaataacttagttggttccatcccttcttcccttggtgacttggaacatcttctgaagttgaatctaagcagaaacaatttaacaggaattattccagcagaatttggaaatcttagaagtgttatggaaattgatctttcaaataatcaactctctggcttgattcctgatgaacttagtcagcttcaaaacatgatatccttgagacttgaaaataacaaattgactggcgatgtggcatcactttcaaattgcattagtctctctctacttaatgtgtcctataacaaactatttggtgttatcccaacgagtaacaactttaccaggtttccccctgacagtttcattggaaaccctggtctttgtggtaattggctgaatttgccgtgtcatggtgctcgcccttcagagcgagttacattatctaaggctgccattcttggaattactcttggtgcccttgtgattcttcttatggtattgctggcagcttgccgaccacatagtccctctccttttcctgatggatcatttgacaaaccagttaatttctcccccccaaagctagtgattcttcatatgaatatggcactacatgtgtatgaagatatcatgaggatgactgaaaacctgagtgagaagtatataattggatatggagcatcaagtacagtttataaatgtgttcttaagaattgcaagccggtggctatcaagaggatctattctcactatccccaatgtattaaagaatttgaaactgaacttgagacggttggcagcatcaagcaccggaatctggtcagtctccaaggttattccttgtccccatatgggcatctcctgttttatgactacatggaaaatggcagtctatgggatcttcttcatggacctaccaagaagaaaaagcttgactgggagctgcgtctaaaaatagcacttggagcagcacaagggcttgcttatctacaccatgattgctgtcctagaatcatccacagagatgtgaaatcatctaacattctattggatgcagactttgagcctcatctcactgattttggcattgccaaaagtctctgcccctcaaagtcccatacttctacttacataatgggcacaattggctatatagaccctgagtatgctagaacttcacgtctcactgagaagtctgatgtgtacagttacggtattgttttacttgagttgctaactggaaggaaagctgttgacaatgaatccaacctccaccatctgattttgtccaaggcagcaaccaatgcagtgatggaaacagttgatccagacattactgccacatgcaaggacctaggagctgtaaaaaaggtttatcagcttgctctattatgcacaaagaggcagccagctgataggccgacaatgcacgaagtgacacgtgtactcggaagccttgtgctgtcaaacaccccaccaaagcaactagctgcactaccacctgcttcaaatccatctgccaaagtgccatgctacgtggatgagtatgcaaacctcaagactccacacttggtgaactgcccctcaatgagcacctcagatgctcaactcttcctcaagtttggagaagtaatctctcaaaacagtgagtga

SEQ ID NO: 3128 - DNA, 4195 bp, Glycine max var. Williams 82
gataatgcaatggcaaaaccacacagaaagtgacccctgggaatcaaaagttaaaaccaatggcacagcatagcacagtgtacagtgtttatttactatatagcaaaacactcactggcataacactttagggagagagagagtgaaaacaagtgtaaaaagagagaaagttaggagggggatagagagtgtgtgtgtgtgcagagtttgcaggcttgtagcagaaatggtggcagatggttttaactttatgtgtgaaataattttcttctatctcttttctctttagtgttttctctctctctctctctcttctttttcttcctgcatcttcttgtgtttagggagtgtgatgttttgtggcagaagaacgatgtgattggacacagccaaagctgtggacttgttctgttactactttgtaattgtaatcacataaaaggctagagggtatgaagagtgcacagaaaaatactagtactagtttcaaacaaaactcaccttactactacccttccatctcaagccatagttgagttgagtggtgcacagtgtcactatacataccactaacacccttttttggttcttgttctgtggctccttgtgctttgagcaagagctttttgagaaagagcttggtggtggtggttgttgttgagtggtttcatggttaggctgttgttaagttgaagttcatcagttgcagctatggcatttcgatttggagtccttattcttgctttggttatttgtttgaatttcaattctgtggaatctgatgatggagcaacgttgttagagataaagaagtcatttagagatgtggataacgtgctctatgattggactgactcaccatcatcagattattgtgcctggagagggatatcatgtgataatgttacctttaatgttgttgcactcaatctttcagggttgaatcttgatggtgaaatttcacctgcaattgggaaacttcagagtttggtctcaattgacctcagagaaaacaggttatcagggcagataccagatgagattggtgactgttcatctttaaagaacttggacttgtcatttaatgaaattagaggggatataccattttctatttctaagttgaaacagctggagaatctgattttgaagaacaaccaattgattggaccaattccttcaactttgtctcagattcctgatttgaagattctagacctggctcaaaataatcttagcggagaaataccaaggcttatatattggaacgaagttttgcaatatctaggcttgagagggaacaatttggttggttcactatcaccagacatgtgccagttaactgggctgtggtattttgatgtgagaaacaatagcctgacaggaagtattccagagaacataggcaattgtactgccttccaggtcttggatttatcctacaaccaactaactggagagataccattcaatattggattcttgcaagtagcaactttgtccttgcaaggcaataaactctctggacatattccaccggtgatcggtctcatgcaagcacttgctgtcctagacttgagctgcaacttgttaagtggatcgatccctcctatcttgggaaatttgacttacacagaaaaattgtacttgcatggaaacaagctgactggcttcatccccccagagcttggaaatatgtcaaagcttcactatttggaactgaatgataaccatttaagtggacatatcccgcccgagcttggaaagcttacagatctgtttgacttaaatgttgcaaacaacaatcttgaggggccaattcctagtaatcttagctcatgtaaaaatctcaacagcctcaatgtgcatggcaacaagttgaatggatcaattcccccttctttgcagagtttggagagcatgacctctttgaatctttcttccaacaatcttcagggcgcaattccaatagaactgtcgcggattggcaatttggatacattggatatttcaaacaataacttagttggttccatcccttcttcccttggtgacttggaacatcttctgaagttgaatctaagcagaaacaatttaacaggaattattccagcagaatttggaaatcttagaagtgttatggaaattgatctttcaaataatcaactctctggcttgattcctgatgaacttagtcagcttcaaaacatgatatccttgagacttgaaaataacaaattgactggcgatgtggcatcactttcaaattgcattagtctctctctacttaatgtgtcctataacaaactatttggtgttatcccaacgagtaacaactttaccaggtttccccctgacagtttcattggaaaccctggtctttgtggtaattggctgaatttgccgtgtcatggtgctcgcccttcagagcgagttacattatctaaggctgccattcttggaattactcttggtgcccttgtgattcttcttatggtattgctggcagcttgccgaccacatagtccctctccttttcctgatggatcatttgacaaaccagttaatttctcccccccaaagctagtgattcttcatatgaatatggcactacatgtgtatgaagatatcatgaggatgactgaaaacctgagtgagaagtatataattggatatggagcatcaagtacagtttataaatgtgttcttaagaattgcaagccggtggctatcaagaggatctattctcactatccccaatgtattaaagaatttgaaactgaacttgagacggttggcagcatcaagcaccggaatctggtcagtctccaaggttattccttgtccccatatgggcatctcctgttttatgactacatggaaaatggcagtctatgggatcttcttcatggacctaccaagaagaaaaagcttgactgggagctgcgtctaaaaatagcacttggagcagcacaagggcttgcttatctacaccatgattgctgtcctagaatcatccacagagatgtgaaatcatctaacattctattggatgcagactttgagcctcatctcactgattttggcattgccaaaagtctctgcccctcaaagtcccatacttctacttacataatgggcacaattggctatatagaccctgagtatgctagaacttcacgtctcactgagaagtctgatgtgtacagttacggtattgttttacttgagttgctaactggaaggaaagctgttgacaatgaatccaacctccaccatctgattttgtccaaggcagcaaccaatgcagtgatggaaacagttgatccagacattactgccacatgcaaggacctaggagctgtaaaaaaggtttatcagcttgctctattatgcacaaagaggcagccagctgataggccgacaatgcacgaagtgacacgtgtactcggaagccttgtgctgtcaaacaccccaccaaagcaactagctgcactaccacctgcttcaaatccatctgccaaagtgccatgctacgtggatgagtatgcaaacctcaagactccacacttggtgaactgcccctcaatgagcacctcagatgctcaactcttcctcaagtttggagaagtaatctctcaaaacagtgagtgaaagagtgagcggggattttgaaatgaaaatcaagtccaagaatcatgtatattatttaaaaaccaaaaaagagaagcgaaaaaatggatgaggggtaatagttaatgaaaatgtttataaaaagttttagtactagtttttttttttagtgttggttgatttgaacaaaaagaaagatattatgtatcatcatcatcacaatttgaaaggtgaagtaaatccaattcttgtacttgtttggtggtagcacacaagggtttgcagtagcaaaagttaaggttttggggccaatgttgcagggtggggtagctaaggtcttaaatgttagtaggagggaagcaaatactattgcataatgtgtgaacatcaataatgcactgaatttcttagctggctttggatcagttatctgtctgaatgctggcggtattaagaaaaaaaaaaagtgtatccattacctcttttactacctgatgccatttgctcagtaaagtgctatgaaattatgtcatgaaattttgggtcattttggcctcacact

SEQ ID NO: 3129 - DNA, 1803 bp, Glycine max var. Williams 82
atggatcttggggtggtgggtttggagggggtggtgggttcagaaagtggttgtgtgtttggttcttctcttgtttcagatcctgagacaaagcacaagtggtacggatctggtttgctcaagcaagagagatctgccatagctactgaagatgatgagtggagaatttccaaagttgctaaaactgatcatgacatgtcttcagcctccaaagcaatgctctttcagcaaagaaacaactctttgttgagatctaataatgcaactctcttctctgatggtcatcaccaatcacaaatgttgagcttctcttctccaaagtcagattctttgttgatagataaggcttcctcaaatgccacattgcctttttcttcccaccaattgtctagctacaccagaaatacaggttacaattcaggaagcataagcatgcatggggctttggctagtgtgagagggccattcactccatcacagtggatggagcttgaacaccaagccttgatctacaagtacatcacagcaaatgttcctgtgccaactcatcttctcattcccatcagaaaagcacttgattctgttggcttctgcaacttctcagccggactcctcagacccaactcattgggatggggaggtttccatctaggattctcgaacaatacagaccctgagccagggaggtgtaggagaacagatggaaagaaatggcgatgttcaagagatgccgtagtagatcagaagtattgcgagcggcacatgaaccgaggacgccatcgttcaagaaagcctgtggaaggccaatcaggccatgccctcaccaccaccaccagtaatacacctaatgcttcctccaactctgtggtgcctggcaacaacaacaacacctttgcacacaacaatgtgcaccaccctattcctcctcattcctctccggtcaacaccatcactaggatgtttacaagcaacaaagagaataataacagtaccagtgagaggatgcaggaccctgcacttcccatgcttcctcccactcttgagctgaaaccaaaggagaacaatcctttcatgattcataaacaccaaatcccatctgatgaatactcaagtaggaacaacaatgagtttgggcttgtcacttctgattctttgcttaacccctcagagaaaagaagctttacttcttcacaaaagaatgattcttctgagtcccaacaacaacattccctcaggcacttcattgatgactctcccaaaccacagtctaatcatcatcatcgttcgtcgtctatatggcctgaacttgacaacatgcagtcagacaggactcagttatcaatctccataccaatatcttcctcagatcacttcatgtcattcactacttccttgccctcgaacgagaaactcacgttgtcaccacttaggctttcaagggagttagaccccattcaaatggggttgggagtgggaagtgcccccaatgaagcaaacactaggcaagccaattggattccaatcacttgggagagttcaatgggtggtcctcttggagaggttttgaaccttagtaacaataacaacagcaatgctagtgatcaatgtggcaagaacaacaacaacacttcagctctcaacctcatgaaagatggatgggacaataatcctccatcagggtcatccccaactggggtgcttcaaaaatctgcatttggatcactttccaatagcagtgctgggagcagtccaaggggggcagagaacaacaaagaaggtgccaccttgtgcaatgccttgtaa

SEQ ID NO: 3130 - DNA, 474 bp, Glycine max var. Williams 82
atgagtcaaccaataagaaagataagcttctcatgggaaaagaagcctggtgtctccaaagtaacaactactactcatggtgaaaatctgatcccaaaagaggaagagtttttggccaagttgccaccaccaccttgcacaccagaagaatcaagtgctactcatcatcacaaaaaccaccaccctcttcttgattttcaaattccacttcctccttgtgcttttcagcctcccttttatagaacttcctccaagaggggcctttgggttcaagacaaagaccctttcttagcagctttcaaagagtgcaccaagaatcatcagaaaactagtgctaaggtgaacaaaaagttgatcaaagatggaattgaggccagggtaaggaagagcatgtcctttttctcatgtactcgatcatgcaccgttcatgacactaatttggtcaggatctctcatctagaccaagattactga

SEQ ID NO: 3131 - DNA, 1083 bp, Glycine max var. Williams 82
atggcttcagcaacaccaaaaccacgaaaaaggctagcagaatttctcaatgaggagcaagaacctttccccctagaggtttacctttcagaaagtgagtattcaaaaaggtggagtttggatgatggagattcaagcaacaacacttcagagaaatcaaccaaatctggcttaaacaaaaggaaaaagggtctactcctcccattttgccaagttctgaaagctctatataacaagcttggtttcaacaaagaaagcaaaaatagtctaaccaagtttcatgaccaaagaaacaaaaatgaaggtgttcctgaacctactattgttcagttttcatcagatagcagctttactatgttcaattcatgccaagatattgatgaagagggaacctccattttgtcacatatagaccagcacttactttattctcacactttatgcaacatgggaccccagagaaggaagcgacggagattcatagaaggtagccatgaattactgaggaagaatcctgtacaaagagctccaaatgtgagtgaggaagttaggataatgcaacagagaatacggagtggtgtcattctaccaaagaaaatcagagaggactcactgttatcagcagctatctggagtagtttacttgatcagtcaataaagaaaggtaattgttgtactagggagttaggagtgcttcttcctgggactaatgatgtttcccagatattgaaatccaaaagggtgttgcataggataaagaagatgctgtttgattgtgtgaaagatattaccataacccttccagcacaagacgacagaaagaaaggtagcagacaattcatggggcctctacagattgcaaaggtccttcctcagagaacaaaaaaatggggccaacaagctggtgatggagaaaacctcacctacttactcgctttggattacttgaattcaatcatggaatggaacaagttcgaaccgcacgtgaaggacattagtgttgagatcactgatgcaattttagataacatccacaatgaaattgtatttgaaatgataggaaatttgacacgaaatacataa

SEQ ID NO: 3132 - DNA, 1227 bp, Glycine max var. Williams 82
atggagcttctaatggtggtggatgatttttttgtcacggcgtccctggcgcttcttcttaccttcatcgtcttaaagctcgtcgaggccatgaacgacactcacgccgcaccaaaacgtcacgtcgtccacctcgaaccggatcatccggtttctcgagccaagaccaaggtcggtctcattagtccggttcaggaggaaattgccacgtgtgcagtaggagccaaacacgggatagaaaaaaaggctgccgtcaaatcggttcgtcctcgtgggaaacggttcaccgttaaccccgctcaaagcaaggttaaggtcgaaccggttcctcccgctcaaagcgagagcacgatcggttttgttagtccggttcaatctgccatgtgtgtggagactgaacgcaaggtagaagaagctatggtcgaaccggaactggttcagctcgttaagaccgagggcacggttggttttattagtccgattcaagctgacacctgtgtaggaacagaagacaagaaagaagaagctacggtcgaattcgattcccacgttgttgtggagtcaccggtgaaatcagacacagacattgtcgttacagaggaaatagctgagggcaatgaaggaacacaagaattggatgattcggcggagaagaggatcgtggaaagtgttgaagaaatcaacgtggaaccttctgttgtagatagcgacggaaaagagaatgaagatgattatgatgatgattgggaagggattgaaaggagtgaattggagaaagaatttatggcggctacggaatttgttagtggcgaggaaaatcgattggggggtgtaggaagcaatttgagaatggagttgtatgggctttacaaggttgcgacggaagggctttgccgtgaacctcaaccaatggctctcaagctcgccgcacgtgccaagtggaatgcttggcaaaagctggggaacatgaatccagaggttgcaatggagcagtatatcagccttctttcggataaatttcccggatggatcaaagatacttctgctggaatgagtgaacatgaaaccacaaggcctgaagtttctgggtccgatgcttctgatttgagcacaactttgtctcatcaacaaatgatcataactgaaagggagcttgaacaagagtctgattccaaggaccgtagcccacttacagagacagatttggagaacaatgttaacaaatga

SEQ ID NO: 3133 - DNA, 648 bp, Glycine max var. Williams 82
atgccactacaccatcacctcttcttagaagaaactaaaatggcacatcgttacccaaaaccccttctagacaccctctactgcttagaagatcacattcattgggaggaagaagaacaagtagactataatgagtacagtaacacaacaaccacaaacactaattcctccaatgtggtcttgttagaacacgacctcttctgggaccacgaggagctaccttctcttctcgccaaagaacaccaaaaccaactctcgaatactcttctccaaaacaacctcgttttagcctcatctcgagaagaagcagtggagtggattctgaaagtaaatgctcgttattccttttctaccctcactgcggttctcgctgttaactacctcgataggttcctcttcagcttcagattccaaaacgacaacaacgacaacaacaacaacaacaatccttggctcacacaactatccgcagtggcttgcctctctctcgctgccaaatttgaagagacccacgtgcccctttttatagacctccaattggaggagagtaagtacttgtttgaagcgaaaaccgttaagagaatggaaatcttggttctttccacacttgggtggaagatgatccttgtaacacctcttcattcttga

SEQ ID NO: 3134 - DNA, 1143 bp, Glycine max var. Williams 82
atgcaagtgggtaccattggcaatattgttagcatttctggtccctttttaaccaaactttctgccccctaccctttactcctcccactcttttggacaatggaaagtggagtacccttccttgactgtctcttgcaaaacactcttagaagcatttgctcatttcccacttcttcaacttcttccaagtgggtgtatgcagtcttctggaggatagtacctcgaaactttcctccgcctaggtgggaatttggaggaacagctcttgatcgctcaaagggaaacaaaagaaactggatccttgtatgggaagatggtttctgcgattttaatgaatgtgaacaagggaggaatggatgcttgaactacaagtttggagctgatgtattcttcaaaatgtctcatgaagtttatagttatggagaaggactaatggggaaagtggccgcagataataatcataaatgggtttacagtgacactcaaaatgggtgtgaatctagctacattggtgcatggaatgcttcaatggatcatcaaccaaagacatgggagtttcagttaaattcaggtattcagaccattgctgtcattgctgtcagagaaggcttagtacaacttggttcatttaacaagattgctgaagatctcaattttgtggttagcattcaaaggaagttcagctacctccacagcataccaggtgtattttccattcaaagaccacacctacccattcaacatccatgcattgccaaaccaaacctacaaatgatggaaagcaatgaaatgaccctatctgcctataatgcaacaaatcaagtcacaagagtcaatggagtgcatgaggaaaaatccagcttcttttccatgatatccatcaacttgggtaggaatccaccaccccaaaatggaacaacaacaacacaagggtcacctctttggtcagctccaccttccttgcccaacatgtcttgtagttttggtgctatgctatcaaagcttccatatgttactccttccaataatccccctcaagttcttgaaaccaataagaccaaccacaaagtgaagattgaggagtgcagatttcatggtgctgctaatggagatcagaacaaaaatgcagggtggaatccttga

SEQ ID NO: 3135 - DNA, 186 bp, Glycine max var. Williams 82
atgataggtgttgccggaagagtgagatgcgcctccatcaccatcggctccgatgtaggacttggcttgaacacaaacgcagggagtgattttgggcacggcagagattgccatcgcaagcgacaacggcggatagagaacaggattcagatcgacggggaagggaccaatgaaggccaaatatga

SEQ ID NO: 3136 - DNA, 645 bp, Glycine max var. Williams 82
tcaaattccgtttttcgtccttcactttttattgtccttatgcctttgttgtctctgtcaaatgtcagagtgcccccccatctcacacaccggtccaggacctagttgctgggaacgaaatgcttgcaaagtttcacaataatttgatcattttgcttcttgcatgacaatttgacaatttggattccttgctggtttttaaatgataggtgttgccggaagagtgagatgcgcctccatcaccatcggctccgatgtaggacttggcttgaacacaaacgcagggagtgattttgggcacggcagagattgccatcgcaagcgacaacggcggatagagaacaggattcagatcgacggggaagggaccaatgaaggccaaatatgagaggttgacatcgacggaaggtggtgattccggcggaagcggaaggaaccaccgtgaaacccattccaaccaacatctcatttgttttttttttttttcttcttctttttggctacggggaaacacccgtgaatcccacaaataaaaaaaattataattaaggataaaatagtaactttgtttgtattctttttcttttattatgtatcaactttaatttaaatatttttctttaattttattcttttttttcaatc

SEQ ID NO: 3137 - DNA, 879 bp, Glycine max var. Williams 82
atgtatcctgaatggttttttgcgctaagaaatggttttgggcttctgatgtatggctttggatccaagaaggttctgattgaagattttgcttcaacggcactgaccgagtattctgtagttgtcattaatggatatcttcaaaccattaacttgaagcaggttgttatagctttagctgaaattctgtgggaacaagtgaaaacaaagcaaagggtttcctatcgggacttacccaagagccaacagtcattcaattcaaaatccatggaagatcttcttacatttttggatcaagcggaaatagaggcgggtgctttttttgtttgtgttgttattcacaatattgatggatccggattaagggactctgaaacccaacaatatcttgctcgactagctgcatgtgcccagattcgtgttgttgcctctattgaccatgttaatgctcctctgttttgggacaagaatatggctcatacacagttcaattggtgctggtatcacgttcctacttttgctccttacaaggtggaaggcatgttttatcctatgattcttgcacatggtagtgccagccaaactgtcaaaacagctacaatagttctgtcaagtttgacacgcaatgctcagagtgtattcaaagttcttgccgaacatcaactctctcaccctgacgaaggaatgccaatcagtgatctctactcagtctgtcgagaacgtttccttgttagcagtcagattacgctgaattcccatttgactgaatttaaagaccatgaactggtcaagattaagaagcattctgatggtcaagattgcttgcacatccctctgacagccgaagcacttcagaaagttgtgctcgagatcatttag

SEQ ID NO: 3138 - DNA, 699 bp, Glycine max var. Williams 82
atgtttctagttgtttcaatatatatcctctcatgtgaaaaagttgatcaagggattcacaccatgggtggtgtcttctaccatgaagaagagccaataaaccataccaagagatgcaaattccttgcagggactttgaaagaagtattttcccactgtcaaactttaagttgtcggaggctttcaactgcaagccttgaggaggagtgccccatcattgatgatgttgatgaggtggttgtttcagcggttagaagtcgagttatggagaaacaaaagcacaagccaagcccattgagagaaggcttttccatggcatattctcctgcaacaagggaactgtatgtcactcacagtcacacaatggcaccacaagcaaaggtggtagtaggtgatgaagaacacaacgaaagagaagagttcttttcggttaaaagttgtctctcgtgctgttcttcttcgagtgctgtgagtgaccaagcattttattctgtgaagacaaacctgtctagatgttcaagcatgaatgaggttgacatctcagaatgttggcggcgttcgataattcaagagttttgtcactgcgagggatggccttttggtctgtgccgtaaagctgtgttacttccaccactgcctaagtcgccgtctgagtcatggttgtcacgcaaaatacaacgaagtaccaaagttacctga

SEQ ID NO: 3139 - DNA, 885 bp, Glycine max var. Williams 82
atggaagtggtggtacaaagtcctagtagtccaaccatggataatttcgattttggtggcaacatgggttcgatctatcaaagtgttccttcttcaccaaaaggttttggtaattactacctaagcgcacccgcgagtccatctaggatgtctgaattattcagcgaatttgaatattattcttcagcttcaccctcttcattcgaagccgccaacataattgatgatgatgacgacgacgaaaacaaggactacagtttcgcgttttatgttaatcgcgatcaatccgacaagtcctctcgctcggccgaagagctcttccacggtggcaaaatcaagcccttgaacgagccacgttcttcttctaaggactcttctgttgctgaacaaaaaagaggcagagaaagagagagaacttcttcttcaacaacaacgttgtcatcttcgaactcgggtggtcgtagggtgacacgatcacactctccttatagaaaatcatgggaagttgaacaacaacaacaacaacaacctcaacctcggagcagcaaagaggaatcaagtgcaagtgttttgtcctcgagtacttcttccaagggttcgaagaggtggtggctgaaggactttttgttgttccgtagtgcctccgaagggagaggttcaagcaaagatgcattgaagaagtactacaagaagaatagtaacgaagaggttaaagggtcgtcgagttttagatcctcggattcgtcgagatcaagaaaggaaccgctttcggcgcatgagttgcactacgccatgaagagacaagagtccgaggatatgaagaagagaaccttcttgccttacagacaagggattctgggaaggttggctggtttcggaatctag

SEQ ID NO: 3140 - DNA, 1074 bp, Glycine max var. Williams 82
atggcgcttcgaaaactgttatcgaagcgtttcttcgaccgtatcaaaacgaggtcgtttgaacgcagcgtggtgtcatctccaactatgcaacaacaagtcatcacgcctccgagcatgccgggagcgagttcggcagatggaggatttctcttgcggtttttcctcctccggcgagcggtgtaccactccggtccggcacggttcccagatttcctgtctctccccgtcggagagaagctccgggagaaactcaaaggcatcaacaacatagccggcataggagactgttgcgttgctctcgctccggcacctatggccagcgatgcggtgtttggaagtggaatgtctgtcagccatgcgaggaagattttgagggtgccacaaatggagaaggtgaaagcaaagctgagaaacgtttcggagagatcggttccgtattcagaagtattttgcgaatctgcgttgagacgtgtgagaatcatgaaacaaggggctgagttcgcgaagatcttggatgagtccggaaacgtcatcgttttagggaaggcagtttttctccggccagaggaggtggcaaaatcaatagagagcttaatctatcaatcaatagccaatccaaatgaccctagaaggaaggagctagagctgatggagaagcaaaagtggatgattgatgaaaaggccaaggcccaggtccgagctgagctttattttgggctgggcttcttgacggtccagaccctcgggttcatgaggctcactttctgggaactaagttgggatgtgatggagcccatatgcttctttgttacctcattcggcttcgctcttgcttatcttttcttcctcaagacctccacagaacccacctttcagggcttcttccatcaccggtttaaggccaagcaagagcgtctcatgaagacacacaactttgacatgagtaggtacaacgagctatttaaggcatgctatacaaattatcatggtggtgccaaatttgaatcttcttatcccttccactaccttggggagacacatctaactgatctaagagccttgcatcgttga

SEQ ID NO: 3141 - DNA, 1299 bp, Glycine max var. Williams 82
atgaagcttggtttctttgtggtctttctggttctctatatgatactagaacgtgggatcttgttattaccccaagtagaagctgatgatcatgatgatggctttgtgaaagtaagaggggtgcagcttatgctgaatgggagcccctactatgctaacggttacaatgcatattggttgatgtatatggcctctgatccatctcagagaaacaaagtgtcttctgtgtttcaaaagggtacaaaccatggacttaacatagccagaacatgggctttcagtgatggtggatacaagcccctacaatactctcctggattctacaatgaagacttgttcctggggctggactttgtaatatcagaagccaggagatatgggaccaagcttgtgttgagtttggtgaataactatgataactttggaggaaagaaacaatatgtggactgggcaagaagtgagggccagaccatagattctgaagatgatttcttcactaaccctatagtgaagggatactacaaaaatcacgtcaagagtgtacttacaagacgtaataacttcacggggatcgtttacaaagatgatccaactataatggcttgggaactcatgaatgaaattagatgcccttcagatcaatcaggaaacacggttcaggcttggattactgagatggcatcttatttgaaatccatagatggaaaccatttgctagaagctggtctggagggcttctatgggctgtccaaacaagagtctaatcccagcttccacgtaggaacagatttcattacaaacaaccaaatccctggcattgactttgccacagttcattcataccctgatcaatggcttccaggttcaagtaatgaagaccaaatcttatttttggttcgttggctcaatgatcacatacaagattcacagaacattcagaagccagttctgtttgcggagtttggagtagcaacaaaaaatatcagtactgaagactcaacattaagggaccaatttttcaacttggtctattctgcaatctattcatcagcaagtgatagcggggcagctgttggtggcttgttttggcaacttctagctgaaggaatggattcttttcgagatggttatgaagtgccattagatgagagttgctccactgctactttgattgctcaagagtctcaaaagctaaacagaatccggatgaagatgtttcccagagtgaaaaattctaagaagtggaacaaagcaagggatgttagaatcccacgatggcagggtggtggtgctaattaa

SEQ ID NO: 3142 - DNA, 1152 bp, Glycine max var. Williams 82
atgcaaacaacaactcgaaggaaagaaatggaaacgttggaagtacttcacatgaacaaaggcgcaggccaaactagctatgccatgaactcttccgttcagaatacgataatctcttgcgcggagccagcaagaaagaaagctcttgtgcaaattctttgctcaagtaattggcctgagaagatgggaattgcggacttgggttgttcctcaggaccaaatgccttaagggtcatttcggagatattggatggtgtgtatgccaccacatgcctcttgaatcgccctgcgccagagttggtggtgtatttgaatgaccttttcaccaatgacttcaacaacatctttggctcattgccatctttctacagaaaacagaagcaagaaaagggtagtgggtttggatcatattttgtttcagcagtccctggctctttctatggtaggcttttccctagcaaaagcctccactttgcgcactcttcttctagcctccattggctttctcgggttcctagtgggttagagaatggtagtgggagagcattgaacaagcgaaagatctacttatcaaagagcagtccaaagtgcgtgctagatgcttattctcagcaattcaaaaacgatttttcagtgtttcttgcttcacgttcccaagaaatggtagcggggggacgcatggtcttgtctcttatgggcagagaatccatggacccaaccactgaccatagttgctatcagtgggaactcttagcacgatccctcatgagcatggtttctgagggtcttttagaagaggaaaaggtggattcttttgacgctccatactatgcaccatgcttggaggaaatgaaaatggagattcaaaaggaagggtcatttattgtgactgagcatgaagcttatgaaatcgattgggatgctggaatggaattgcaaagtgattccccaacaacaggtacgccattaacgagtggagaacgagttgcaaggagcattagggctgtggttgaatccatgttggaatctcatttcgggtgccacataatggatgagctgtttcgaaggtacgcacaaatggtagaggaccacttatcaaagactaggaccaaatacattaatttggtcatttctctcgtcaagcaaggttga

SEQ ID NO: 3143 - DNA, 579 bp, Glycine max var. Williams 82
atgtctccagtcctcagtgaaatccttcgttccgggtttatgatcaattcctcccttagacgcaggacccacctagttcaatccttctctgttgtcttcctctactgtggaacatcgagcacgtccattcttcttcagagctctggctctgaggaggatttgcagcttctgatggaacaaagaaaaaagaagagaaagcaatcgaaccgcgaatcggccagaagatcaagaatgagaaagcagaagcacttggatgatctcattgcacaagttgacctcctcaagaaacaaaagagcctaaccctcaagaaagtgaacatcaccacacaacactgtctcaaggttgaggctgaaaattccattctcggggcccagaagactgaactcacacaaagccttcaatcactcaatgatatcatcaatctcatcaacacgaccaccacttctgatcataacaattattattacaataataataataataacaataataataatttcatgatgaatcccatgcacatggcatatcttaaccaaccaattgtggccactgcagacaacaacatgtttctgtggtga

SEQ ID NO: 3144 - DNA, 729 bp, Glycine max var. Williams 82
atggaagactatgttataaggacaattgttgttggagttgtttcatggacatcagcttttgtcctagtgagaagaatctttcccaagcgttcttttgatttctgcaaccgcgttgtgtccacgctccatgcaactttagcagtcacattggcttggctctctgttgaagattggaagtgtccaatttgtcctgtgggatcaaaatcttcacccaaacagatgcaagtcctagcagttagcctttcttatctcatttatgatctagcttgttgtcaattggatgaaagagtgaatctagacaacaccgtccaccatttggtaagcattgttggaattggagcaggtctttcctatcaaaagtgtggctcagaaatggtagcgacaatatggataacagagatatcaagcccattcttgcatttgagggagcttcttaaagagcttggttacagggatacccttcttaatttggctgctgatattctattcgcagccatatttacatttgctaggatggtggtcggaccatgtatcacttacgtaactttatctgccaactatccacttctcataaaggctatgggattgggtttgcagctggtaagtgcattctggttcttcaaaattgtaagaatgatgaaacacaaattaaccaaaagaacaacatcgaaatatggggtcaaccacgccaacatcacgaggaagaccactaactcaaaattgcaatag

SEQ ID NO: 3145 - DNA, 1350 bp, Glycine max var. Williams 82
atgagggagatattgcacgtgcaaggtgggcaatgcgggaaccaaatcggttccaagttctgggaagtgatatgcgacgaacacggcatcgaccccaccggaaagtacaccggcgacgaggcctccgatctccaactggagaggatcaacgtctactacaatgaggcctccggcggaaggtacgttccccgggccgtcctcatggatctggagcccggcaccatggacagcatcagatccggcccatacggcaagatcttcaggcccgacaacttcgtctttggccagtccggcgccggcaacaattgggccaagggccactacaccgaaggtgccgagttgatcgattccgtcctcgacgtcgttcgcaaagaggccgagaattgtgactgcttacaaggttttcaagtgtgtcactcacttggaggaggcacgggttctggcatgggaacactgttgatatcgaagatcagggaggagtacccggacagaatgatgcttactttctctgtttttccatctccaaaggtctctgacacggttgtggagccttacaatgctactttgtccgttcaccaactagtggagaatgcagatgagtgcatggttcttgacaatgaagcactctatgacatttgcttcaggaccttaaaactcaccactcctagttttggtgatctgaaccacctgatatctgcaacaatgagtggagtgacctgttgcttgaggttccctggacaactgaactccgacctgaggaagctagcagtgaacctgatcccattcccacgtctccacttcttcatggtggggtttgcacctctcacctcacgcgggtctcagcagtacgtgtccctcactgtccccgaactcacccagcaaatgtgggacgccaagaacatgatgtgtgccgccgatccccgccatggccgttacctgacagcatcagccatgttcaggggaaagatgagcaccaaggaagtggacgagcaaatgatcaacgtgcagaacaagaactcgtcctacttcgttgagtggattcccaacaacgttaagtcgagtgtgtgtgacatccctccgaggaacttgaagatgtcgtgcactttcattggaaactccacctcaattcaggagatgttcagaagggtgagtgagcaattcactgcaatgtacaggcgcaaggccttcttgcactggtacactggtgaaggaatggacgaaatggagttcactgaggcagagagcaacatgaacgatttggtggcagagtaccagcaatatcaggatgctactgctgatgaggatgagtacgatgaggaggaggttgaggagggggaacaagcttactag

SEQ ID NO: 3146 - DNA, 3753 bp, Glycine max var. Williams 82
atggcagaagtggaactagccccagattcacgtttagaacaaaatgtatcatctaaaatagaccaacaaaccaaaaccgagagtgtttcgttttttggcttgtttgctacagctgatgcaactgactgtgtcttgatgttcctcggatgctttggttcgtgtgtccatggcgctgctcttcctgttttcttcattttgttcggtcgcatgatcgactctttgggacatctttctaatgatcctcacaaattgtcctcacgagtttctgagcatgctttgtatttggtctatcttggaggagttgttctggtatcagcttggatgggtgttgcattctggatgcaaacaggggagaggcaaacggcacgtttgcgcttgaaatatttgcaggcagtgctaaagaaggatattaatttctttgacaatgaagccagggatgctaatattattttccacatctctagtgacgcaatattggtacaagatgcaattggagacaagacgggccatgccattcgttacctttctcaattcattgttggatttgccattggatttacctcggtgtggcagctcacactactcaccttggctgtggttccattaatagctgtagctgggggagcttatacaataattatgtctactttatcagaaaagggcgaagcagcttatgctgaagctggaaaggttgcacaagaggtaatttctcaagtgcgtactgtttactcatttgtaggagaagagaaagcagttggttcatactcaaaatcacttgataatgctctgaagttgggcaagaagggtggtttagcaaaaggaattggagtaggcttcacatatgggttgttattttgtgcttgggcattgcttctatggtatgctagcatactagtgaggaatcataagacaaatggaggcaaagcgttcacaacaattatcaatgtcatctttagtggatttgctcttggtcaagctgctccaaaccttggttccatagccaaagggcgtgccgctgcaggcaatatcatgaacatgattgcgtccacttcaagaaattctaaaaagtttgatgatggtaatgttgtcccacaagtagcaggggaaattgaattttgtgaggtctgctttgcttacccctcaagatccaatatgatctttgaaaaattgagcttctcagtgagtgctgggaagaccatagcaattgtaggtccaagtggttccggaaagagcacgattgtttcgctaattcaacggttctatgaccccacttcaggtaagatcctgttggatggatatgacctaaagaatcttcaattgaaatggttgagagaacagatgggcttggttagtcaagaaccagcactatttgcaacaacaatagctggaaatattttatttggaaaagaagatgcagacatggataaagtcatacaagctgccatggctgcaaatgctcattctttcattcaaggattacctgatggttatcaaactcaggttggagaaggtggcacccaactttcagggggccaaaagcaaagaattgccatagcaagagcagtgctaagaaacccaaaagtattgcttttagatgaggcaacaagtgctctagatgctgaatcggagctcattgtccaacaggcattggaaaaaataatgtcaaacagaacaacaatagttgttgctcatagattatccaccatacgcgatgtagatacaattgttgtgttgaagaacggccaggtggttgaaagtgggactcatttggaattgatgtccaacaacggggagtatgtgaatctggtgagtttgcaggcatcacaaaacctcacaaactctagatcaatatctcgctccgaaagttcaagaaattctagttttagagaaccttcagacaacctgaccttagaggagcagttgaagttggatgcagcagcagaactgcaatcaagagatcaacacttgccatcaaagactacttccactccatcaattttggatttactgaaactgaatgctccagagtggccctatgcaatacttgggtcagtaggtgcaatattggctggcatggaagcccctctctttgctcttggaatcactcacattttgactgcattttattctcctcagggttctaaaatcaagcaagaagttgatcgggttgcttttatatttcttggagtagctgttattactatacctatttatctattactacactacttctatacactgatgggagagcgtctcactgcccgtgtgcgtttattaatgttctcagctattctcaacaatgaagttgcatggtttgataaggatgagaacaacactggctcactaacggccatgctagctgcggatgcaacattagtaagaagtgctctagctgacagactctcaaccattgttcaaaatgtagctctcactgtaacagcttttgttattggtttcacattgagttggaaactaacggcagtggtcgtagcctgccttccccttctcataggagcttctatcactgagcaactatttctcaaggggtttggaggagactatggccatgcttactctagagcaacttctttggctcgtgaagctattgccaacattcgtaccgttgctgcttttggcgcagaagatcgagtctcaacccagtttgcatctgaactgaacaaacccaacaaacaagcacttctacgtggccacatatcaggttttggctatggcataacacagctattggccttctgttcctatgcacttggcctttggtatgcatcagttttaatcaagaagaatgagtcaaattttggagacattatgaagtccttcatggtcttaatcatcacttctctggcaatagcagaaacactagctcttaccccagacattgtgaagggatcacaagcactaggatcagtttttggcattatccaaaggagaacagccatcaccccaaatgacaccaactcaaagattgtaactgatgtcaaaggagagatagagtttagaaatgttagcttcaagtaccctatgagacctgacatcaccatatttcagaacttaaacctcagagtcccagcaggcaagagtctggcagtagtggggcaaagtggttcaggaaaaagcacagtgatttctttggtaatgagattttatgaccccgattcggggttagtcctggtagatgaatgtgatatcaaaaacctaaacctgagatccttaaggctgagaataggattggttcagcaagaacctgctttgttctctaccacagtttatgaaaacatcaagtatggaaaagaggaggcatcagaaatagaggtaatgaaggcagccaaagcagcaaatgctcatgaattcatcagcagaatgccagaagggtacaaaaccgaggttggtgagagaggggtgcagttgtcaggaggacaaaaacaaagagtggcaattgctagagctatcctgaaagatccatccattcttttgttggacgaagcaacaagtgcacttgacacagtatcagagaggctagtccaagaggctcttgataaacttatggaaggtagaacaactattttggtagctcacaggttatcaactgttcgcgatgccaacagcattgcagtgcttcaaaatggcagggttgctgaaatggggagccatgagaggctgatggccaaatccggaagcatctacaagcaattggttagtctacagcatgaaacacgcgaccaagaagatcattga

SEQ ID NO: 3147 - DNA, 1119 bp, Glycine max var. Williams 82
atggttatggttcatctcactaagctactttcttcttcttgctcccattttctcccttcttcttccttggtgcttcgtttgacattaataatattactagtttcatgcaaaacaattaagggtttggtgaaactaccagcagatgtgtctgttccagcagtgtttgtgtttggagattcggtggtggatacaggcaacaacaacaacagaacaacatcgtttgctcgctcgaatttccctccatatgggagagactttcaaggtggcatcccaactggtcgatttagcaatggaaaggttccatcagaccttatagttgaagagttgggcattaaggagcttctgccagcatatttgaaacccaatctccaatctagtgatttgatcacaggggtctgttttgcttcaggtggctcaggctacgaccctttgacatcaatattagagtcatcgatgccattaactgggcaagtggatttgttgaaagaatacatagggaaactaaaagggctggttggagaggacagagcaaagtttatcttagccaacagtctattcattgtagtagcaggcagcagtgacatttctaatacctatcgcactagatccctcctctatgatcttcctgcttacactgatcttttggtcaactcagcttctaatttcttgacggaaataaatgagctgggtgcacggaggattgcagtattcagtgcacccccaattgggtgtttgccatttcagagaacagtgggaggaggattagaaaaaagatgtgcagaaaggcccaacaatttggcccaattatttaacaccaaattgtcaaaggagcttgattccctcaaccgcaactttcccaatagcaggaatgttttcatcaatgtttacgaccctctacttgacatcatcaccaatcaccaaaaatatggctataaagttggagacacaggatgctgtggcacaggcaggatagaggttgcaatactatgcaaccgtttcgattccagctgtcccaatgttcaggattatgtcttttgggacagttttcatcctacagaaagcgtttacaagaggctcatatctcctattcttcaaaaatatttggaccaattcaagtga

SEQ ID NO: 3148 - DNA, 1530 bp, Glycine max var. Williams 82
aatactagctagctagccaaaactgaagtagccatggttatggttcatctcactaagctactttcttcttcttgctcccattttctcccttcttcttccttggtgcttcgtttgacattaataatattactagtttcatgcaaaacaattaagggtttggtgaaactaccagcagatgtgtctgttccagcagtgtttgtgtttggagattcggtggtggatacaggcaacaacaacaacagaacaacatcgtttgctcgctcgaatttccctccatatgggagagactttcaaggtggcatcccaactggtcgatttagcaatggaaaggttccatcagaccttatagttgaagagttgggcattaaggagcttctgccagcatatttgaaacccaatctccaatctagtgatttgatcacaggggtctgttttgcttcaggtggctcaggctacgaccctttgacatcaatattagagtcatcgatgccattaactgggcaagtggatttgttgaaagaatacatagggaaactaaaagggctggttggagaggacagagcaaagtttatcttagccaacagtctattcattgtagtagcaggcagcagtgacatttctaatacctatcgcactagatccctcctctatgatcttcctgcttacactgatcttttggtcaactcagcttctaatttcttgacggaaataaatgagctgggtgcacggaggattgcagtattcagtgcacccccaattgggtgtttgccatttcagagaacagtgggaggaggattagaaaaaagatgtgcagaaaggcccaacaatttggcccaattatttaacaccaaattgtcaaaggagcttgattccctcaaccgcaactttcccaatagcaggaatgttttcatcaatgtttacgaccctctacttgacatcatcaccaatcaccaaaaatatggctataaagttggagacacaggatgctgtggcacaggcaggatagaggttgcaatactatgcaaccgtttcgattccagctgtcccaatgttcaggattatgtcttttgggacagttttcatcctacagaaagcgtttacaagaggctcatatctcctattcttcaaaaatatttggaccaattcaagtgaccagttatttttaagaaataaagcctcaaacttgtgggtggctgaaggcttggctaatttgttagaattatgtccattaatattatttaattattaaattaaatcttatattatcaatattaattatgaaaataagttttattttattttaatttatgaatattatttgaatttattatgcgagtgagtttatgacgtgttcttggtgttcacaccaagagttctattctcgtctgctaattataaaattattaatttgttagataatttctttgacgcaataatgttttggagattctagtcgttacgcatagacaagttttcgctcaattgttgtttgtgattcttttcaagataatatgtgcgaattttatctcc

SEQ ID NO: 3149 - DNA, 387 bp, Glycine max var. Williams 82
atgctcggttccgttcttctggcggttttcttgccgtgcatcggcatgagcgccgctttgatcgtgtacatgtgccttctctactacttcaccgaccacttctccgaccccgcgctaccggccaagccagcctccgacagcgggctctccccttcccagctcgacaagctacccagaatcaccggaaaggaacttgtgatgggaaacgaatgcgccgtctgcctggaccatatcggaacagagcaaccggctcggctggttcccggttgcaaccacgccttccatttggaatgcgccgacacctggctctccgagcaccctctctgccctctctgcagagccaaactcgacccagcgcttttctcttcctcccaaaatccatgctga

SEQ ID NO: 3150 - DNA, 1155 bp, Glycine max var. Williams 82
atgatgagtttatcattttgttcgctgatagcaaagccttgttccatgatcaatgggagcaataggaaaccatgttgtggtcgtacaagatttggtgttataattaggtcggaagtaaacgtggctcccaagcaaagaggaattccccaattgtcaaaacaaggagttcctcttgctgtacaagaggttgttcacaggcagtctcagatcataaatcattgtagcaagcctaggccactgttcgagcccacttttctttatgatgcctatgaaatgtgcagaaatatttgcgccgaatatgccaagaccttttatctaggaaccttgcttatgacggaagaaagacagaaagctatatgggcaatttatgtttggtgcaggaggacggatgaacttgttgatggtcctaacgctgggtatatgagctcttctgttcttgataggtgggaagatagattgcacgacattttcaatggacaaccctatgatatgcttgatgccgctcttactgatacagtctccaagtttcccttggatattaagcctttcaaggacatgatacaaggcatgagaatggatacaaggaaagcccgatacaacaatttccaagagttatatctttactgctactatgtggcgggaactgtgggcttaatgactgttccaataatgggcattgcccaggagtctgtcatcccagttcaaagtgtatatgatgctgcactatatctgggtgtaggaaatcaactcacaaacattcttagagatgtgggggaggatgcattaagaggtagagtgtaccttccccaagacgaactagcccagtttggattatgtgacaaggatgttttttcaagaaacgtcagtgaaagatggagaaagtttatgaaatatcagatcacaagggcaagattctacttcaaccgggcagaagaaggagtttctcagctccaaaaggccagccgttggccggtttggtcatcattaatattgtatcgtaagatcttggatgcaattgaagacaacgattacgacaatttgactaaacgagcttacgtgggacgagctaagaaatttttaacgttgcctctagcttacactagatctctctcaaatcacaaaacgaaatttcgttctttaacaaggcctatctag

SEQ ID NO: 3151 - DNA, 1875 bp, Glycine max var. Williams 82
acacaattgtaagagaaaatttacaagacaaaagcagcatctttgtaagccccgttcttgctcaaaccaaactaattaaatataaattatcaatattccagaactttgtttattgcattaactaggtgatttccattgtttcattcgttagtagtaaaaaatgaaatgcaatttaaagcatcaatcttacataagaatattctatactaccccaaattgccattgaaatggttgttggtgtttacaccctattatacaacaaccatatctaattatatagttgataggctcctccagccacattaattgagttagcagcaacatatatcccagttaagctaagccttgagaatagaaatagtgggatgatgagtttatcattttgttcgctgatagcaaagccttgttccatgatcaatgggagcaataggaaaccatgttgtggtcgtacaagatttggtgttataattaggtcggaagtaaacgtggctcccaagcaaagaggaattccccaattgtcaaaacaaggagttcctcttgctgtacaagaggttgttcacaggcagtctcagatcataaatcattgtagcaagcctaggccactgttcgagcccacttttctttatgatgcctatgaaatgtgcagaaatatttgcgccgaatatgccaagaccttttatctaggaaccttgcttatgacggaagaaagacagaaagctatatgggcaatttatgtttggtgcaggaggacggatgaacttgttgatggtcctaacgctgggtatatgagctcttctgttcttgataggtgggaagatagattgcacgacattttcaatggacaaccctatgatatgcttgatgccgctcttactgatacagtctccaagtttcccttggatattaagcctttcaaggacatgatacaaggcatgagaatggatacaaggaaagcccgatacaacaatttccaagagttatatctttactgctactatgtggcgggaactgtgggcttaatgactgttccaataatgggcattgcccaggagtctgtcatcccagttcaaagtgtatatgatgctgcactatatctgggtgtaggaaatcaactcacaaacattcttagagatgtgggggaggatgcattaagaggtagagtgtaccttccccaagacgaactagcccagtttggattatgtgacaaggatgttttttcaagaaacgtcagtgaaagatggagaaagtttatgaaatatcagatcacaagggcaagattctacttcaaccgggcagaagaaggagtttctcagctccaaaaggccagccgttggccggtttggtcatcattaatattgtatcgtaagatcttggatgcaattgaagacaacgattacgacaatttgactaaacgagcttacgtgggacgagctaagaaatttttaacgttgcctctagcttacactagatctctctcaaatcacaaaacgaaatttcgttctttaacaaggcctatctagcaaactagatagtacccgaaactacgtacggatccaatgaaatgcatacttggattccttgtaaagatgatatattctccgaagataatatgaatacttgagcttggtttcggttttcgcagaagggagaaagacccggatgaaacccccaggaatcttaccacctgccatttccttggggttaaaattgtgcaaatgtaccccaaaagataaaaattccgaatgcataaattcatttctttctctttaaacccactctccctacaccttaattaagaaagggtccttttgaaccaacgtgtgaatattgtgtatgcgtatattatatatacaagtacagatgcggagatcgaga

SEQ ID NO: 3152 - DNA, 1455 bp, Glycine max var. Williams 82
atgagtacggtgggagaagggaaggtgagtagtaatggtcatggatgttgcaaatcagggccaggctatgcttccccactggaagccatttctggtcccagagagtctctcatttatgtaacctctgtctacacagggaccggaatagagaagccagactatttggcgacagtggatgtggatccaaactctccaacttattccaaagtcatccataggcttcctgttccttatttaggtgacgaattgcatcacacaggctggaattcatgcagctcttgccatggagacccctcagcagaccgacgatttctcatcgtacctgcactcgtatcaggtcgagtatatgtggttgatgtgaaaacaaatccaagggctccatctttgcacaaagttgtcgagcctgccgatatcatacagaagactggattagcttatccacacacatctcactgccttgcttctggtgatataatgatctcgtgtcttggagataaagatggaaatgctgcaggaaatggatttcttcttcttgattctgagtttaatgtgaagggaaggtgggagaaaccgggtcacagcccactatttgggtatgacttttggtaccaaccacgtcacaataccatgattagcacatcatggggtgctcctagtgcttttacaaaaggttttaacttacagcatctctctgatggattatacgggaggcatctccatgtatatagctggcctgggggcgaactgagacaaacaatggaccttggtgattcagggcttatacccttagagataaggtttttgcatgatcctgctaaagatacaggttttgtcggcagtgcattgacaagtaacatgatacgattttttaagacccaagatgaatcatggagccatgaggttgccatatcagtgaaaccattgaaagtgcaaaactggattcttcctgaaatgcctgggcttataactgattttctgatttctcttgatgatcggtttctgtattttgtaaactggcttcatggggatataaggcagtataacatcgaggacgttaaaaatcctaaactgactggacaagtatgggttggtggacttatccagaaaggaagccctgtagtagctataactgatgatggtgaaacatggcaagctgaagttccagagattcagggaaacaagttgagagggggccctcagatgattcaattgagtttagatgggaagcggctctatgctaccaactcactatttagtacttgggacaaacaattttatccagagcttgtccagaaaggctcccacataatacagattgatgttgatactgagaaaggtggactgaaaatcaaccccaacttctttgtggactttggaactgagcctgatggtccttctcttgcccatgagatgagatatcctggtggtgactgtacttcagatatatggatttaa

SEQ ID NO: 3153 - DNA, 3188 bp, Glycine max var. Williams 82
gttatttaaagaaggaagagacagggcataacaataactgtgtctggcacatgaggttagcgcggttatcattaagcttctcttctctgcttccattctctttctcagtatctatctgtacaatccgacgcagtcaaacaccacacacactcccaaatctgaatggctgcctccaaattaaaacaaaaacccttactttctctctgtaagctctttcttctgttgttgtctctcgcctgcaccgccattgccgacgatggcgtgttcatgtcgaagctcgcgaaggcgctgatcccgtcgccgtcggggtggacggggagcagcttctgccaatggacaggcgtgaagtgcagcgccaaccgcgtcaccataatcaaaatcgcttctcagtcactcggcggaactcttcctccggatctgaactcgctctcccaactcacctcgctctctctccagaacaacaagctctccggcgcattgccttcactcgccaacctctccatgctcgaaagcgttttccttgacggcaataacttcacctccatccccgatggttgcttccaggggctcaccagtttgcaaaccctcagcatggccgatagcgtcaaccttgccccatggacgattcccaccgagttgacggatagcaacaacctcgtgaaactcgacctcggaaacgcaaacctcatcggtaccttgcctgatgtattcgacaagtttgtgagtttgcaggagcttcgtctctcttacaacaacctcactgggggtttacccaagtcctttgggggatctgagattcagaatctgtggctcaacaatcagaacggcttcggattttcgggttccattgaggtgcttgcttccatgacccacttgtctcaggtgtggcttcagaagaaccagttcacgggtcccattccggatttgtcaaattgcaccactttgtttgacctgcagctgagagacaaccagttaaccggtgtggttccaccttctctcatgtccctttctagcttgcagaacgtttctctggacaacaatgcccttcagggtcctgttccttcgtttgagaaaggtgtgaagttcactctcgatgggatcaatagtttttgtctgaaagatgttggaccctgcgattctcgtatctccactttgcttgatattgctgcgggtttcgggtatccccttcagttggcgcgttcctggactgggaacgatccttgtgatgattggagttttgttgtgtgtgcaggggggaagattattacggtgaatttggcaaagcagaatttgacgggaaccatttcacctgcgtttgctaatttaactgatttgaggaacttgtttctcaatgataacaatttgggtggttcaataccagggagcttgactaatctggctcagcttgaggttcttaatgtgtctaataacaacttatctggtgatgttcccaagttccctaccaaggtgaagttcactactgcaggtaatgatttacttgggcgttctgatggtggtggtggtggcagtggaactactccgtcgaagggttccggtgatgcaccgagtggaagcccgagcacagggccaggtggatcttcactttcgcctgcttggatcgcaggtattgttctaattgctgtgttttttgttgccgtcgtggtgtttgtgttttgcaagtgtcatgctaaaaaccggcatgggaagtttggaagggttaataatccggaaaatgggaaaggagaggttaagattgatatgatgagcgttaccaattccaatggatatggtggtgttcccagtgagttgcaaagccagggcagtgagcgtagtgacgttcatgtttttgagggtgggaatgctactatttcaatccaggttcttcggcaagtaacggataatttcagtgagaagaacattttgggtaggggagggtttggggttgtttataaaggggaattgcatgatggaactcaaattgctgtaaagagaatggaatctgttgcaacagggagtaagggattgaatgagttccaagcagagattgcagttcttagtaaagttcggcacaggcatttggtggcccttttagggtattgcattaacggcaacgaaaggctcttggtgtacgagtatatgcctcaagggacattaacgcaacacctgtttgattggggtgaaaatggctgtgctcctttgacttggaaacaaagagtagcaatagctttggatgtagctcggggagtggaatacttgcacagcttggctcagcaaagcttcattcacagggacttaaagccctcaaacatattgttgggtgatgacatgagagccaaggttgcagattttggtttggttaaaaatgcgccagatgggaagtattctgttgagacacgcttggctggaacatttggatatcttgcacctgaatatgcagctacgggaagagtgacgaccaaagtagatgtgtacgcatttggagtagttttgatggaactgattacgggtagaagggcattggacgatactgtgcctgatgaaaggtctcacttggtttcctggttccgtagggtactgattaacaaagagaacatcccaaaggcaattgatcaaactctcgatcccgatgaggaaaccatggagagtatatataaagtggctgagctagcaggccattgcactgctcgtgaaccataccaaaggcctgatatggggcatgctgtgaatgtcttgggtcctctggtagagcaatggaagcccaccacccatgaagaagaagaaggttatggcattgaccttcacatgagccttcctcaagctctgcgaagatggcaagccaatgaaggcacttccacaatgtttgacatgtccatctcacaaactcaatcaagacaacatccaatgtcttctcagttggaaggaccagatgagaatgttgttattaagtaagctgttttgatctcgcaacatcacctaattgtatcacaatttttatttaattttttaaatgatgattcttttatgttcttgcgatctctatttgtacaagtctgatgtcctttatctagttttttcaaagctaacggattggttttagttgatggttgggttcttggatgagaagtattatagaaatgttaattgtatgatatttttcaacatttattgaataagaaaatttattgcaa

SEQ ID NO: 3154 - DNA, 840 bp, Glycine max var. Williams 82
atggcttctactcacaatgagttttatgcacttatgctagtggtggtggttggctccatggtggcttcctgtggtgctaacttcaaccaagactttgatctaacatggggtgatcaccgtgctaagatattcaatggtggtcagcttctatctctttctctggacaaagtctctggctccggcttccaatccaagaaagagtacctatttgggaggatcgatatgcaactcaagctcgttgctggcaactctgccggcactgtcactgcttactacttgtcgtctcaagggccaactcatgatgagattgattttgaattcttgggaaacgtgagcggtgacccttacattctccacacaaacgtgtttaccaaaggccaagggaacagagagcaacagttctatctctggttcgaccccaccagaaacttccacacttactccatcatctggaagcctcaacacatcatattcttggtcgataacattcccataagggtgttcaagaatgctgagactattggcgttcctttcccgaagaaccaacccatgagaatctattctagcttgtggaacgctgatgactgggccaccagaggtggtttggtgaaaactgattggtcaaaagcaccctttacagcatactaccgcaatttcaaagccacagagttctccacctcttcttccaattccttctctgatgctgcatggcagagcaacgagcttgatgcctatggcagaagaagactgagatgggctcagaagtacttcatgatctataactactgcaacgatcttaagcgattcccacaaggcattcccgctgagtgcaggcgctga

SEQ ID NO: 3155 - DNA, 1842 bp, Glycine max var. Williams 82
atgtttgtttattttgtggttggtggtgatatgaataagatggagggtacagtgtttccgaataatcccatagagtgtttgggtaaagggtttgatctgacaagtgattttcgattgaagtttgcaaagggatatgggaaaaggttggtggtggtcgatgaagtgaacaaaagggacatcacggttcctgttcctggaggagtagctaccattccaaatgtttccgaggatatacgctgtgacaagggcgatcgcctacgcttcaagtctgatgtccttcaattcaaccagatgtctgagttgcttaatcaaaaatcagcaatacaaggaaaaattccttcgggctatttcaacgctctttttgatttgggtggtgattggtttcgtgatgctcatgacataaaatgtcttgcttttgatggttatttcatttccctgtactatttgcacctcactgcttcacacctcatactgcaagaggaaataaagaagtctgttccagctcagtgggacccagcttcattaaccaggttcattcagacatatggcacacacataataataggtatggctgttggaggtcaagatgtaatttgtgtcaaacaaaaacattcttcgaaggttccacctggtgatctaagaagacatttagaggatctaggagatattttgttttcagatttaagaagcccttctcaacaacaaaggaacaccccagaaggcaaacaaaaagttcctgaggtctttaagagtgtgatgcaatcaagtacaacgcagtacaccagtatttcagaaacatcaagcaaagatggcctcactatcatttgttcaaaaagaggaggggatgtgttcaagcaaagtcactccaactggctccagacagtggcttctaatcctgaagcaatcctcttcaagtttgtacctatttcctcacttctcacaggaattcctggaagtggctatcttagtcatgcaatcaatttgtatttacgctataagccccctccggatgatttacaatgcttcttggagtttcaaattccaaggcaatgggcacccatgttttatgaccttcctctgaggcatcaaaggaaaaagtgttcttccccttccctgcaatttggtttcatgtttcccaagcttcatgtcagctgtgcacaggtagtaagtgaacaaaaacctgtggtaggcctacggttgtacttggaaggcagaaaaagtgatagacttgcaatacatgtacaccacctttcaagcctcccaaacactatgatctactcttcaggcacatcttcgtggcgaggatctgatgacaatgaatccagtgacatctttctggaacctataaggtggaagggatttgcaaacgtgtgcactgcagtggtcaaacatgatcctacctggttgcaagaaacaagtggtggtgtttatattgtaaccggtgcacaactcattagtaaagggacttggccaaagaatgtgcttcacttgcgcctactctatactcacatacccaattgcagtatcaggaagtcagaatggggtggtgcaccagaggcttcaagaaaatcatctttcctcacaaatctgagcacaacattttcattcacacagcaaagtcctcctcagaagcaggctccgacagtacttgactctggtgtgtatccagatggtccaccagtgccagttcgatctggcaaaatgcttaaatatgtggacacaagcgagtttgtgaggggcccgcatgatgctcctggtcattggttggtaactgctgctaagcttgttactgagggtggtaagattggattacaggtcaagtttgctttgttagactactag

SEQ ID NO: 3156 - DNA, 270 bp, Glycine max var. Williams 82
atggccgccaacagatggttaaaacctgaggtatacccactgttcgctgcagttggtgtggctgttgggatctgcggtatgcaacttgtcaggaatataaccaccaatcctgaagtcagggtgaccaaacagaacagagctgcaggaattcttgagaattttgcagagggagagaaatattcacaacatagcctgaggaagtatgtccgcggcaaacaacctcagattatgccatccgtcaacaacttcttctctgatccatcaaactaa

SEQ ID NO: 3157 - DNA, 582 bp, Glycine max var. Williams 82
atggcagcaaccatagcagcaacaatggctatgataaactccaagtgtttgaacccaataacagggtcatcacccaagtcgaacaatcccaagctcccaccttcaaaacccacactctccctcttctccattcagaacttcccaaagggaataacctccaaccaggcactgccattgcaggcgcaatattctccctcactcgcaaactgtgacgcagccttggctgcgtcgcaaattgctgaaatagcagaaggcgataaccgtgggctggcactgctgttgccattgattcccgccatagtgtgggtgctgttcaacattctgcagccagcgctgaaccaactgaaccgcatgcgtagcagcaagggggtcatcattgggcttgggctcgggctgggcgcatcgggcatgctttttggctcagatgcatcggctagtgagattgctgtgattgctgatgctgccgccagtgacaacaggggacagcttttgcttattgtggttacacctgcgattgtttgggttatgtacaacattttgcaaccggcactcaaccagcttaacagaatgagatcagagtag

SEQ ID NO: 3158 - DNA, 582 bp, Glycine max var. Williams 82; identical to SEQ ID NO: 3157

SEQ ID NO: 3159 - DNA, 1179 bp, Glycine max var. Williams 82
atggcattttcattcacatttatgttccagttcttgcttcttgccccatctgtgatctatgcttctccagttcaagaccctgaattagtgatccaggaagttcaaaagagcatcaatggctcaaggagaaacttggggtatctttcttgtggaacggggaaccccattgatgattgttggaggtgcgaccccaactgggaaaggaaccgaaagcgtctagctagttgtgcaattgggtttggtaagcatgccattggtggaaaagatgggaaaatatatgtggtgactgaccctagtgataaccctgtgaaccccaagccaggaacattgagacatggtgttattcaacaagagcctttgtggatcattttcaagcatgacatggtgatcaagctacacaaggatctcttagttaattcttacaaaaccattgatggaagaggagcaaccatccacattgctggaggagggccatgcattagagtgcaaaagaagaccaatatcataattcatggcatacacatccatgattgcaaaaggggtggggtggatattgcaagatcagacggtgacgggatcacaatctttggtgggagccatgtttgggtggaccattgctccttgtcaaactgttttgatggcctcattgatgttgttcatggctcaacggccatcaccatttccaacaataacatgacacaccataacaaggtcatgctcttgggccacagtgattcctataaagctgacaagaacatgcaagtcaccattgccttcaaccattttggagtaggactagggggaagaatgccgagatgcaggtttggatactttcatgtggtgaacaatgattacacaaattggcaacattatgcaataggtgggagttcatccccaactattttcagccaaggcaatagatttcgtgctccaaatgatgaagaccacaaagaggtgaccaaacattttaaatcatcaaagagtgagtggaggaaatggaattggaggtctgaaggagatctaatgctgaatggtgccttcttcacagcttccggggcgggggcaactgctaggtatgataaagcgtcaagcatggcagcacgaccacctatgcttgtggtttccatgacagcaggggctggagcacttagatgcaacaagggcaatctatgccactag

SEQ ID NO: 3160 - DNA, 1179 bp, Glycine max var. Williams 82; identical to SEQ ID NO: 3159

SEQ ID NO: 3161 - DNA, 3744 bp, Glycine max var. Williams 82
atgggaagcaaagatggatttttccgttatgcagatggctttgacaaattgctattactctttgggactttgggttgcattggaggtggcctacaaacccctatgacaatgcttgttcttggcagtttgatagatgattatgctggtggatctggacattctgtgtccaaccatgttatagacaagtacgctctaaggctgctgggtgttgctattggggttgctctatcctcctttataggtaactattgctgcaaattttggatatttggtttccaactttccattgttaatgataacgtgggccaaggggtatgttggacaagaacagcagaaagacaaacttcccgcatgagaactgaatatcttaaatcagtcctaaggcaagaagttggtttcttcgacaagcaaactgactcttcctcaacttttcaagttattgccaccataacttctgatgctcaaacaatacaagataccatggctgataaggtgcccaattgtcttggtcacctctcagcatttttctctagctttgtagtggcactcttcctttcatggagacttgcactagctgcttttccattttcaatcataatgatcatgccagctatcatatttgggaagaccatgaaagagctgggaaataaaatgaaggatgcatatggagttgctggtagcatagctgaacaaacaatctcatcaattcgaactgtttattcatatgtaggtgagaagcagacactagaagcgttcaactcaggtcttcagaaaagtatggagattggcataaaactaggtcaaaccaagggagtgattattggtagctttgggttgctatatgctacttgggcattccaatcttgggttggtagtgttctggtcaggacaaaaggagaaagtggtggccctgtgttttgtgctgaaatatgcatcatttggggaggactgtctctgatgagtgcactcccaaatcttggtttcatattagaggcaacaacagctactacccgaatttttgagatgattgaccgagtgccaaccataaattcttataaagaaaaaggaaagctcttaacacatacaagaggagagatcacatttaacgaggttgagtttagttacccatcaaggccagatgcaccggttctccaaggactcaatctgaaagtacaggcaggtaaaacagtaggcctagttggagggagtggttctggcaaatctactatcatctctttgcttgaaagattttatgatcctgtatatggtgagatattgcttgatggatatgatatacagacactccacattaagtggttaaggtcccagatgggactggtaaatcaggaaccaattctctttgcaacatccataagggagaacattctatttggcaaggaaggagcttcaatggaagctgttataagcgcagcaaaggcagcaaatgcacatgatttcattgttaaacttcctaatggatatgaaactcaagtaggacaattcggagctcaattgtctggagggcaaaaacaaaggattgccattgcaagggctttaataagagagccaaaaattctcctactagatgaagccacaagtgcattggattcacaatccgaaagactagtgcaagatgcccttgataaggcttccagaggcagaacaacaatcatcatagcgcatcggctatccacaattcgtaaagctgattcaatagtagttattcaatctggaagagtggttgaatctggttcccatgatgaactactccaactgaacaatgggcaaggagggacttacagcaaaatgctacaactgcaacaggcaataagtcaagacgaaaatgcattgcttcaaataaacaagagccctttagctatggtaaatcaaacaagtccaatttttagcaggcaaagtagcccaattgatcatgcatttagctccacgcaaccgtttagtcccatatattcaatcagtattccagggtccagctttgatgactacagcagcgaaaactgggagaaatcttcaaatgcaagcttctctcaatggcgtttacttaaaatgaatgccccagagtggaaacatgcattgcttgggtgtttaggggccattggctctgggatatgtcagccaatttactcctattgcttgggattgttgtactcgtccatcttctgctgcatagctgttgtcaacttcctttcaggcctcattcaacattacaatttcaccattatggcagaacgcttgctaaaaagggtgcgagaaaacttgctagagaaggtgctgacttttgagatgggatggtttgaccaagaggataacagcagtgcggcaatttgtgctcgtttggcaactgaagccaacttggttagatcccttgttgcagaacgaatgtcattgttagttaacgtttctgttatggctttcttggcttttgtactaagtttaattgtcacatggagggtggctcttgttatgaccgcaatgcagccgttgatcattgtatgcttctactcaaaaaacattctcatgaaaagtatggcaggcaaagcaagaaaggctcaaagagagggtagtcaattagcaatggaagctactaccaatcataggactattgctgcattctcatctgagaaaaggattttaaatttgttcagaatggcgatggaaggccccaagaaagaaagcatcaagcaatcatggatttcaggttccatattgtcagcctcatattttgtaacaacagcatctataactttgactttttggtatggaggccggttattgaatcaagggctggtggaatcaaaacctcttttgcaagctttcctcattttgatgggcactggtagacaaattgcagagacagcaagcgcaacttctgacatagctaaaagtggaagagccattagttcagtatttgcgatactggataggaaaagtgagattgaaccagaagatcctagacatagaaagttcaaaaatactatgaagggccatataaaactgagagatgtctttttctcataccccgcaaggccagatcaaatgattctcaagggcctcagtcttgatattgaagctggcaaaacagttgcattagtgggacaaagtggctcgggaaaatccaccatcattggcttaattgaaagattttatgaccccatgaagggatctatatccatagacaattgtgacatcagggaatttaacttgagaagtttgagatcacatattgccttggtgagtcaggagccaaccctttttgcaggaactatacgtgacaatattgtgtatgggaaaaaggatgcatcagaagatgaaataagaaaggcagcacgtctttcaaatgctcatgagtttataagttcaatgaaagatggttatgacacttactgtggagaaagaggagtgcagctctcaggaggacagaagcagaggatagcaattgctcgagcagtgcttaaggacccttcagtccttctgttagatgaagcaacaagtgctctagacagtgtatcagagaatcgggttcaggaggcacttgagaaaatgatggttggaagaacgtgtatagttatagctcaccgtttgtcaacaatacaaagtgtagattccatagctgtgataaaaaatgggaaggtggtggaacaagggtcacactcagagttattgagcatgggatcaaatgaagcttattactccttgattaggctacaacatggccactcaacttga

SEQ ID NO: 3162 - DNA, 3744 bp, Glycine max var. Williams 82; identical to SEQ ID NO: 3161

SEQ ID NO: 3163 - DNA, 756 bp, Glycine max var. Williams 82
atgcatggattgagctctatgctgttcagatcccgtaagaaagaacatcaaattcgggagtttgtggacgggaatggaaacgtagctgtcggtttgaagttgcataataaaccaagtaatgatggccttaaccgacagtttcctctagagattccgccgattctatttgaagagacttcacttccagcaggattgcacggttcacatactaaagatgtttatagtatttcagtgttgcctgaggaagatgaaaatgcaaattgcgcttcaccactacctttcttgagcatcttaggggttcctaatcaagttaaaagcccaatgtgcttagatgatcccataaattgtcaaaactgcattgattttcaaatgaagaatgagggtgtgtattcccagtgcataattgatatccctagtgtcaatggaaactcagtttcacctgaatcctatgaagaggcagttgaaggttttaaaactgggaactcaccaacaagtgtactgtggagagaatcaagtttcaaagcggggaaacttatgcagagtctggtgaatgtgagcaatccaagagataaaccagtctctgagaagctacatgatttaccgagtaacagatggagaaaatataagcgtgctgcctcatttgattccagaaaagttgctcttctgttttcaatattgtcaagtttcggaacattggtattgatatatctgacattgagagtgaggcagagggctgatgggtttgctcttatttga

SEQ ID NO: 3164 - DNA, 2007 bp, Glycine max var. Williams 82
atgtgttggagctctagtaactcagaggtggttgcttcaaacaaaaccacgttagaagaggttttggacattgagaacaacatggctcatcagtgggtgctcaatgctccagagccaccttccatgctgcgtcaggtggtggacaacgtcaaggaaaccctcttaccgcatccaaatccaaacacattctcttatctcaggaaccaacccttttccaaacgtgcctttgccttgttgcaaaatttgtttcccattcttgcttcactccaaaactacaatgcccaaaagctcaagtgcgatttaatggccggtctaacccttgcaatcttcgctattccccagtgtatgggaaatgcgactttggcgcggctaagtcctgaatatggcctatatacaggaattgtcccacctcttatttatgccatgctggcgagttcaagggagatagtgatcggacctggatccgtggattcactgctactttcctcaatgattcaaacattgaaagttcctattcatgattctagtacttacatccaacttgttttcactgtgactttttttgcgggcatttttcaagttgctttcgggctctttaggtttggttttctggtggaatatctttcacaagccacgatcgtggggttcttggcagcagctgccgtgggcattggactacaacaactgaaaggattatttgggatcgataattttaacaataaaactgatttgttttccgtggtgaaatctctttggacatcgttcaaaaaccaatcagcatggcatccctacaatttaattattggattctcatttctctgtttcatcctatttaccagattcctggggaaaaggaacaagaaactgatgtggttgtcacacgttgctcctctcctttctgttattggatcatctgctattgcatacaaaataaactttaatgagcttcaagtgaaggactacaaagttgcagtcttgggaccaattaaaggaggcagcttgaatccaagttcactccatcagttaacatttgatagccaagttgtgggtcatttgatcagaatagggttgacgattgctattatttcactcacgggatccattgctgttggccgatcatttgcatctctaaaaggacacagtattgatcccaatagagaagtggtatcattgggcataatgaacattgttggatccttaacttcttgctatattgcatcagggtctttgtcacgtactgctgtgaactataatgctggatctgaaaccatggtctccatcatagtgatggcacttacggtgctcatgtcacttaaatttttgacggggcttttatatttcactccgaaagcaatccttgcagcaataattctctcggccgtaccaggactgattgaccttaacaaagcacgtgaaatttggaaggttgataaaatggatttccttgcttgcactggagcctttttgggagtcttgtttgcatctgtggaaataggccttgcaattgggatcgcgatatcatttgcgaagataattataacctctattcaacctgctatagcggttattggaaggcttccaggaacggctgcattcggcgatgttgaacaatatccaatggctgtcaacattcctggggttttgatagtctctttaaaatcttcttggctttgttttgcaaatgcaaatcttgtagaggaaaggattgagagatgggtgaacaatgcaaaagctaaggatggcaaaggaggagaaaacaccttcatacacgtcattattgatgcctcaagtcttacaaatattgacactgtgggaattgcttctctggtggagctcaacaaaaatttgatttccagtggagtaaagttagctatcgctaaccctaggtggcatgtaattcacaagctaagattagctaacttcgtgagcaaaattggaggaagggttttcctttctgtaggagaagcagtagatgcatgtgttggcactaaaatggttgctgtataa

SEQ ID NO: 3165 - DNA, 2284 bp, Glycine max var. Williams 82
ttgattaaacaataggaaacaattgaggctccattgtccaaacacattgtccttttgtgtataataactggcatgcatgtcaaaatagagaagcaagctagaaggggtgaagaattgaagcaccttctctgacaacactaggttcctaaaatgtgttggagctctagtaactcagaggtggttgcttcaaacaaaaccacgttagaagaggttttggacattgagaacaacatggctcatcagtgggtgctcaatgctccagagccaccttccatgctgcgtcaggtggtggacaacgtcaaggaaaccctcttaccgcatccaaatccaaacacattctcttatctcaggaaccaacccttttccaaacgtgcctttgccttgttgcaaaatttgtttcccattcttgcttcactccaaaactacaatgcccaaaagctcaagtgcgatttaatggccggtctaacccttgcaatcttcgctattccccagtgtatgggaaatgcgactttggcgcggctaagtcctgaatatggcctatatacaggaattgtcccacctcttatttatgccatgctggcgagttcaagggagatagtgatcggacctggatccgtggattcactgctactttcctcaatgattcaaacattgaaagttcctattcatgattctagtacttacatccaacttgttttcactgtgactttttttgcgggcatttttcaagttgctttcgggctctttaggtttggttttctggtggaatatctttcacaagccacgatcgtggggttcttggcagcagctgccgtgggcattggactacaacaactgaaaggattatttgggatcgataattttaacaataaaactgatttgttttccgtggtgaaatctctttggacatcgttcaaaaaccaatcagcatggcatccctacaatttaattattggattctcatttctctgtttcatcctatttaccagattcctggggaaaaggaacaagaaactgatgtggttgtcacacgttgctcctctcctttctgttattggatcatctgctattgcatacaaaataaactttaatgagcttcaagtgaaggactacaaagttgcagtcttgggaccaattaaaggaggcagcttgaatccaagttcactccatcagttaacatttgatagccaagttgtgggtcatttgatcagaatagggttgacgattgctattatttcactcacgggatccattgctgttggccgatcatttgcatctctaaaaggacacagtattgatcccaatagagaagtggtatcattgggcataatgaacattgttggatccttaacttcttgctatattgcatcagggtctttgtcacgtactgctgtgaactataatgctggatctgaaaccatggtctccatcatagtgatggcacttacggtgctcatgtcacttaaatttttgacggggcttttatatttcactccgaaagcaatccttgcagcaataattctctcggccgtaccaggactgattgaccttaacaaagcacgtgaaatttggaaggttgataaaatggatttccttgcttgcactggagcctttttgggagtcttgtttgcatctgtggaaataggccttgcaattgggatcgcgatatcatttgcgaagataattataacctctattcaacctgctatagcggttattggaaggcttccaggaacggctgcattcggcgatgttgaacaatatccaatggctgtcaacattcctggggttttgatagtctctttaaaatcttcttggctttgttttgcaaatgcaaatcttgtagaggaaaggattgagagatgggtgaacaatgcaaaagctaaggatggcaaaggaggagaaaacaccttcatacacgtcattattgatgcctcaagtcttacaaatattgacactgtgggaattgcttctctggtggagctcaacaaaaatttgatttccagtggagtaaagttagctatcgctaaccctaggtggcatgtaattcacaagctaagattagctaacttcgtgagcaaaattggaggaagggttttcctttctgtaggagaagcagtagatgcatgtgttggcactaaaatggttgctgtataacaaacaacaattggctttctatggattaattgtttttttttttttttgtatttggagcaaattgtcaaacatttgttagttattaattttatcacaagtatttaaaaatttaataatattaactgac

SEQ ID NO: 3166 - DNA, 540 bp, Glycine max var. Williams 82
atgaagggttatgagccccgttcaagctcttcatgtgcagcttgcaagctattgaagagaagatgcataccaaattgtatttttgcaccttactttaggtctgatgagtgcaagaagtttgcaaaggtgcacaaggtgtttggagccagcaatgtgagcaagattctgattgaagtgccagaagagcagagagaggacacggtgaattctctggcttatgaggctgaggcaaggctgagagacccggtttatggatgcattggtgccatagctctgttgcaaaggaagatggtggagcttcaacatgatctggcaattgcaaaggatcgtcttgcgcgttgtcacgctgctgctgctgctgctactactactatcccttctcctgatatcttgcatgccaatgttagccttcccccattccctgacttttgcacttcttcaagtgatttcaatgatatcttttgccacagttcttcgtctcaattattaggccgacatgaaacggtggatgatttcaatcaaatcccatatatattttga

SEQ ID NO: 3167 - DNA, 837 bp, Glycine max var. Williams 82
atggctgccaccaccgccaccgccacgtcatacttttttggcacccgcctcaacaacccgacaaccttaaacaacggaagattccacgcgctcctcaacttcggcaaaaagaaggcggcggcgccgccaccgaagaaaaaggaagtgaaagtgaaaccctccggcgaccggctggtgtggtttcctaatgcggagccgccggagtggctcgacggaagcatgatcggcgaccgcgggttcgacccgttcggtttcgcgaagcccgcggagtacctgcagttcgacctggactcgctggaccagaacctcgcgaagaacgtcgccggcgatgtgatcggaaccagggtggaggtcgccgacgttaaaccaacgccgtttcagccctactcggaggttttcgggattcagaggttccgcgagtgcgaactcattcatggaaggtgggcaatgctgggtgctctcggtgctttggtcgttgaggctctcaccggagtcgcgtggcaagacgccggaaaggtagagctggtggaaggatcatcttacctggggcttcctcttccattttcattgaccacactgatctggattgaggtgatagtgatagggtacatagaatttcaaagaaatgcagaacttgacccagagaaaaggttgtacccaggtggcaggttctttgatcctctgggtttggccaacgaccctgaagaaaaggccagacttcaacttgctgagatcaagcattctcgcttagccatggtggtcttcctcatctttgcaattcaagctgctgtaacaggaaaaggccctatcagttttcttgctaccttcaacaagtga

SEQ ID NO: 3168 - DNA, 1017 bp, Glycine max var. Williams 82
atgtcggatgctttgatcaatggattggccggagctggaggagggatcattgctcagctcatcacatacccacttcaaactgtaaacactcgccaacaaaccgagcgtgatccgaagaaagacacgaggagtcaaggggccctcgaacgaatgtgccaggttgtaaaagaagaggggtgggaacggttgtatggaggcttgatgccatcggtagtgggtacagctgcgtctcagggagtttactattatttctatcaaatattcaggaacaaagctgaagcagctgcactacaacaaaagaaaatgggcgttggtgatggatcagttgggatgctctcctctcttgttgttgctgctttatctgggtgtgttaacgtgctcttgacaaatcccatatgggtagttgttacgcgtatgcagacacatagaaaagagtcgaacagaactccagctgatcagggtttgtttgttgccactgagcagccaattctttctgcagttgagcctcttccttatggaactagtcatgtgattcaagaaatctacggtgaagctggaatttggggtttctggaaaggtgtattaccaacattaatcatggtaagcaatccttccatacagttcatgctgtatgaagccatgttggcaaagttaagaaaaagacgtgcttggagtaagaagggtagcaacggggtaactgctttagagatatttcttattggagctttagctaagcttggagctactgttgtaacttatccgatcctagttgtgaaggcaaggctccaagctagacaggataaaactggagacaggagacaccattacaaaggtacatgggatgctattattaaaatgatccgctatgaggggtttaatgggttttacaaaggcatgggcacaaaaatcgtacaaagtgtgctggctgctgctgttttgttcatgatgaaggaagaattagttaggggggttcgtttcttgcttgccaaggatgctgtaaagccaaagaatctgtga

SEQ ID NO: 3169 - DNA, 900 bp, Glycine max var. Williams 82
atggaattcgagactccacatcaaacttgttttatgtcaaattcaagttggttttctcaagaaagccactacacagaatggacaagagaagagaataagaagtttgaaagtgcccttgccatatatgataaggataccccagacagatggctgagggttgcagccatgctacctggaaaaactgtctatgatgtcatcaaacaatacagagaattggaagaagatgtttgtgaaatagaagcagggaggattccagttcctggataccctacctcttctttcacattgaagatggttgacaaccaatgttatgatgcatgcagaaagaagcctgcaactctcaggagttctgatcaggagaggaagaaaggggttccttggacagaagaggaacacagacgttttctgatgggacttttaaagtatggtaaaggggattggagaaacatttctcgtaattttgtggtcacaaaaactcccacccaagtggcaagccatgctcaaaagtattacataaggcaaaagctttctggagggaaagacaataaaaggaggcctagtatccatgatatcaccattgttaatcttacatcagatcaagagaagcctcttttactcaatgatgagtctcacatgacttttgagcaacagaagctaactagcatgccaaaagtacaactagaatggattaatcaccacgacaatgggtcacgtatggttgtcaacccaaattatgatatgttcatgtcaccttcatctggcatctcttccaagaccctcaagttgcaagggcaagatttctatgaatgtgcctttcatgagacttatgctaagcttaaaaattcgggtttcaggacaacttctagagacttcaacaaggaaggtattcatgcactctga

SEQ ID NO: 3170 - DNA, 1782 bp, Glycine max var. Williams 82
atggatgctttatctaagaagaacgaaaattctcaaaagaaaagagatggggttgttttgtcttgtctcaccacagattcttccagtgaaaccagtttctgtggatccagctcctcagtttctgctgaagaagctaagacaaaagggtcttcttcacctgctcctcttggttggcctattctcaaggccacaatctccaagcgctctaattctgatgaaaaagaaaacaaacataaatcccacttggaagacaaaaagtttaccagtattgctttgaagttgtcagaagttgacatgatgaaggagaggtttgcaaaattgttgcttggtgaagatatgtcaggttctggaaaaggggtttgcactgctttggccatctctaatgccattactaatctgtgcgcaactgtatttgggcaattatggagactagaacccttaccttctgagaagaaagaaatgtggcagagagagatggaatggcttgttagtgttagtgattacattgtcgagttgatgccttcttggcaaacatatcctgatgggagtaagctcgaggtaatgacttgcaggcctagggcagatatttttaccaatcttccagctcttcgcaaacttgacaacatgcttctcggaattttagacagtttcactgctacagagttttggtatgtagaccaaggaattgtagccccagatgcagatggttcggtctcttttcggaaaacaattcagcggcaagaagagaagtggtggcttcccgtacctcgtgttccccctgcaggactcggtgaagactcaagaaaacagttgaatcactctcgagaatgtgcaaaccaaatactaaaagcagccatggctatcaacagcattgctttggctgaaatggaagttcctgagtcatatttggaagttcttcctaagaatggaagaacttgcttgggggattttgtttaccgttacataacatcagatcaattctccccggagtgccttcttgattgcttagacatatcctctgaacatgttgcactagagattgcaaaccgtgtggaagcagcaatttatgtatggcgccgaagagctcactctaggtcctcaccaaaccccaaccgttctaccacaaaatcatcatgggaaatagtcaaggacttcatggttgacggagataagagagaactactagcagatagagctgagaacattctagtttccttgaagcagcggttcccaggcttaagtcaaactacccttgataccagcaagatccagtgcaacaaggatgttggaaaatccgtgctagagagctactcaagagttttggagagcatggcttttaacattgtggcccgcattgatgatttgctatatgtggatgacttgacaaaacattcagagaggtttgcattggttcctaccactacagttaacgtggtttctcagcaaaagaaggttacacgtccactctcagtgtctgtctcaggcactactccacacaaagcatcagttggcacacctagcttttcacctgcggcggtgccactaataagtcctgcaagaggggagagaactcctttcctccacaacatcaacatcaacaacaacaacaacatcaaaccccatcgtcgcggctttggggtgaggagagtgttgtcaaattatcttggagtagagacaaagactactaagatatgcagcaactcaactgaggtgaattgttcaaacccaagcagcaagaaaacggaacaacaacatcagaaggtgaaaaacaggaccaaatga

SEQ ID NO: 3171 - DNA, 2096 bp, Glycine max var. Williams 82
cacagtatgctgccacgtgtcggctgatccatcctgtatgtgtggatgtaaggcttctatgaccaatccttttgtgtacactcactctaccaagcaactactataagtcacagcctctggtcacaagccacttagcattgaatttgcaattgaagttaaaagccttagccttccctacaactccaaacacaaagacatcatcatccatggctgcctccgtctccactgtcggagctgtcaacagagctcttttgaacctgaatggttctggagctggagcttcagctcccagttcagccttctttgggaccagcttgaagaaggttattgcctcaagggtccccaacagcaaggtttccggtggaagcttcaagattgttgctgtagaagagaagaaagagattgaagagacccagcagaccgacaaggacagatggaagggtcttgcctatgatatctcagacgaccaacaagacatcacaagaggaaagggtttggttgactcccttttccaagctccacaggatgctggaactcactatgcagtcatgagctcctacgagtacctcagcactggacttcgccagtacttggacaacaaaatggatggattctacattgctccagcttttatggacaagcttgttgttcacatctccaagaacttcatgaccctgcccaacatcaaggttcctctcattcttggtatctggggaggcaagggacaaggaaaatctttccaatgtgagcttgtctttgccaagatgggaatcaaccccatcatgatgagtgctggagagttggaaagtggaaatgcaggagagccagcaaaactgatcaggcagagataccgtgaagctgcagacatgatcaagaagggaaagatgtgcgctctcttcatcaacgatcttgatgcaggagctggtcgtcttggtggaaccacacaatacactgtgaacaaccagatggtgaatgccactctcatgaacattgctgataaccccaccaatgtgcagcttccaggtatgtacaacaaggaagagaacccccgtgttcccatcattgtcaccggtaacgatttctcaacactctatgcacctctcatccgtgatgggcgtatggagaagttctactgggcaccaacaagggaagaccgcattggtgtttgcaccggaattttccgcactgatggtattcctgaacaggacattgtcaagcttgttgacaccttccctggccaatccattgatttctttggtgcactgagggccagagtatatgatgatgaagtgaggaagtggatttctggtgttggtgttgacagtgttgggaagaagcttgtgaactcaaaagatggacctccaacctttgagcagcccaagatgactctggagaagctcttgctgtatggtaacatgcttgtccaagaacaagagaatgtcaagagagtccaattggctgacaagtacttgaacgaggctgctcttggaaatgctaacgaggatgctattcagaggggaactttcttccagtcttgaattggaggcaaagcaaacttggcaagtaaatatttctgttcgtgaaggttgttgtactaatccaagtgctagaagttgtgatggaacttgcgtgtaacattcttagcattctcaatgtcttaggtgcaaagagaagatgctaagtttgagatgatcttactatatttttcatattggaccgtcttcctctataattttgagttacagtgtccacttaaattgaatttggtgccttttccttttgtcctatattcttgatttatttttttaaaatttatttcttttgtttgacgtacaaatattagtacatatctagcccttatagcttcattttcaagtgctaaggatctgaagaacttggagagaaaggtcaagttcagagctcaataatgaatggcaagcggccaccaaatcataaacattacaaattgttccttatatacagtaactactttaggcccaaaaagaaatgagcacccaaaccacttatcaaataactcccatcagatgttgcactgataacactcttttaacgtgatctttcatttttcatatgtt

SEQ ID NO: 3172 - DNA, 333 bp, Glycine max var. Williams 82
atggcttcttctaattgtgcaatatccacatgtactagtggcactactgcaggcatcaacaacaacactgatcaaagtactgtcccacctattatgtacttgagtaatagtgagaagtggaataagttgtcaaagaaagaaggccgttcctcaacaacttcttcttcctctctcatgaagaattcttcttcttcttcttcttcttccactcagaggaagtgtgcttttgctagaaagtgtgctaggctggtcaaagagcaaagggctcgtttctacatcatgaggcgctgtgtcattatgctcatatgctggcatgagtacaatgattcatga

SEQ ID NO: 3173 - DNA, 2025 bp, Glycine max var. Williams 82
atggtgttgaagaagagggtagattatggatttaatggctttcgagttcctgttatacctaaagctcctagatctgccagaaggagggttgctttcaacaaagcagttgaggatggtcaagtttgcgctattgaactactggcatctttagctggccaattgttgcaggagagtgaaagttctgcttccagcaatgcgtctgaaggaaatcatcagcctgccttcagccaaggtgtaattgagcaagatatacaagatgaagttaaaccattaaaaatggaggaaattcatcagggaaattgtgcagagagtacttttaagactgaggtagcctcacaaaaaagtagtcagaaacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataaagaatggatttaaatgggaacaggaggctggaagttcatgcattcggggatcaaatttagctgataagtgtagtttggaggatcacttagaattgtatgtatctcctgcactaattgactcgaaaagtaatattaaatctccatttcataggaaattttttcccagtgcttccttttccaggtatgggaatggcattaagttaggttttagagatgatgacgaaaaatttttaaggtgcaaaagggtttgcactaaaccaaaggcttttaggtctccacgacgcattgcacaccgaagaatcaggaatttgatgtcttccaaatactggaagacagctccaaagttgaaggactgtgaactttctgatctaggagtacctcgttatcataagaggaaaacttgttacggttttgaaagatctcagcacaatgccattgttaaaaagaggaaattcgttgaccgggtttcaggggtaacttctgatggaggattcagtagtgagagtgtgtccaattcacctcagaaagggatggatgcagacaagcctagctcatctgcaaaattgcatgtacttaaggctaaggattctcatgtaaagtttagcataaagtctataaggataccagagctttatattgaggttcctgaaacttcaactgttggttcactaaagaggacaatcatggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacgagcttctccaactatttgtgttggtgatccttcttctcaatgtgaaacatcccagcctacatggcccacagaaactcctgtcttagattcaggagttactgataccttgcatgactcacccttgctgacatatccgggcaacctaattgaaagtaaccatgagcccacttcttcactcgccgacactacagttaacaaaataacacctgattccagagcaatagttgctgttccagctaccacagaaacattagctgtggttcctgtgagtcagaaaaccaagcgctctgagtttgtacagcgtcgaaccaggagaccattctctgtgactgaggtagaagcacttgttcacgcagttgaggaacttggaactgggaggtggcgtgatgttaagttgcgagcttttgagaatgcagaccataggacttatgtagacttaaaggataaatggaaaacattagtgcacactgcaacaatctccccccaacagaggaggggagaaccagtacctcaggagctcttggacagagttttggctgctcatgccttctggtctcagcaccaagccaagcaacatggcaagcatcaagctggaccaggaaccttgaagattacagaagcctcagctgaaagaccttgtgtgtgttga

SEQ ID NO: 3174 - DNA, 657 bp, Glycine max var. Williams 82
atgggaaatgctatggggagtaaaaaagcaaaggtgatgaaaatagacggtgaaacgttcaagctcaatactccagcaagagcaaacgacgtcgttaaggactaccctggacatgttctcttggactctcacgcggtgaaaaacttcgggcctcgggccaagccacttgagcctgactaccagctcaagcccaagaagatttattttttggtggagttacccaaggttaagcccgaaccattagtaacgaggagggtgcgatccagtggaatccgtggcatgaacgcccaggataggcttgatttcttgatgctgtcgaaacgctccgtttcggaccttaccatggtgaagcatgggcccaagccagaaaatggtgggcccacgagggtcaaaatgaggctgcccaaggcccacttggagaggcttatggaggagagccacgacgggagcgaggtggcggagaagatcataagtttgtatatggggaataatgccgccgtggacggcggcggcgcaacggtggaggcccaaaaggaggttcacaatcgcaagccacgaaggaaacgggtgagtttcagcccagtggaacaagcagaaattcatgaagaatcagcagcaccacaacagtcactagtttatagcagtccttccagatag

SEQ ID NO: 3175 - DNA, 1482 bp, Glycine max var. Williams 82
atggaccctaatcacctcttcttcacgcatttccgcgatggtgctattgcctcacgcattgagggccaacacagaggagctcttccttctgttattgtgattggtgctggaatatctggacttgcagcagcacgaagtctctatgatgcatcttttaaggtgactgtactggagtcacgagataggcttggtggtcgcattcatactgacttctcatttggctgtccagttgacatgggagcctcatggctacatggagtttgtaatgagaatccattggctccattgatacgtggcctggggctttcattatatcgtaccagtggtgacaactctgtcttatatgaccatgacttggaaagttatatgctttttaacatcgatggtaagcaagttccacaacagatggtcattgaagttggagacacctttaagaaaattctggaagagacagggaaagtgagggatgagcataccgaggacatttcagtttcccaagctatttcaattgtgctagataagcaccctgatctaaggcaacaaggacttgcccatgaagtgctacaatggtttatatgcagaatggaagcttggtttgctgctgatgcagatatgatttcactgaaaacctgggatcaggaacatgtcctgtctggtggtcatggactcatggtgcaaggatatgatccagttataaaagttcttgcaaaagatattgacatacgcttgaaccacagggtgaaaaagatatctagtggttacaacaaggtaatggtgacggtcgaggatggcaggaactttgttgctgatgctgctatcataactgttcctattggaatcctaaaagcgaatttgattgaatttgaaccaaaacttcctgattggaaggtttcagcaatttcagatcttggtgtgggcaatgaaaataagattgccctaagatttgacaaagtattttggcctaatgtagaactcttgggcactgttgctccgacctcttatacctgtggctattttctcaatcttcacaaagcaacaggccatcctgttcttgtctacatggtagctggaaggttcgcttacgacattgagaaactatctgatgaagcagctgcaaattttgtgatgcaacagctcaagaagatgtttccaaatgcttctaagccagttcagtatcttgtgtctcgatggggaacagatccaaactctcttggatgttactcgtatgatttagttggaaaaccaactgatgtgtatgacaagcttcgtgcacccttgggtaatctattctttgggggagaagctgtaagcttggacaatcaggggtctgtgcatggagcttactctgctggggttatggctgctgaaaattgtgagagctatatgttagagaaactaggccacgcagaaaagctatctctagcttctgttaggcatgaaatgcttgaaactcttatacctcttcagatctcgaggatgtga

SEQ ID NO: 3176 - DNA, 585 bp, Glycine max var. Williams 82
atggagctagaaccaaagaaaggaccggttcatgatcaatacgatgatcttgttggttctttttcttcttcttcttcttcaacatcatcttctgtttctggaatttcaagtgggtcatcattggaatctgattcttttgaagaagtaacatcctctgcctcctcttcttcatcatcagcagctgatgatcaacttgtagttgtagctgatccattgggtgacatgacttctctctttcaacaacttcccatcaagagggggctatcaaaattctaccagggaaagtcacaatctttcacttcactgacaaatgtgaggagcttggaggaccttgcaaagccagagaacccttacaacaagaggttgaagtcttgcaagagctatgcaggagggttggcagagagccattcaacaagggctgtttctaagaggggaatggtgcattcaacaagttcaagaggttcatgttcttcttttagaaggggcagtgctactactaatttcatgggtagtaggccaccaattcctcctcatagatctaccagcaccaacaccatccctaatcaaactgtgttgtttgcttga

SEQ ID NO: 3177 - DNA, 1917 bp, Glycine max var. Williams 82
atgattcttcaacttaaacttttggccttaagtttgatatggtggagcagtattaatgttgaatatgcagttgcagccacacgtaacccacgtctaataaacactgggtgtagccaagttaacgcttccaacccgggtagcttctttgcaaatgtcaatgattcgatcttagagatgagagaagaaattagcaatgataacaagcactttggcacagcatataaagccaggggagaggtgctaacatatgctatgtttcaatgcagaaactatgtctccaaaaatgactgtcttgcttgcttcaacacggcctccacccaaattcgcaactgctccaaagccaacggcgccagagtcatctacaatgactgcttcctcaggtatgagagtgagaggttctaccaacagacgaatgaaattggtggtggggtaacatgtgggaacaagagttcaaatgccacaggttttagagcagttggacaacaagcactagtggaccttcaaacagcaacacctaaaattaaaggtttctatgcagctactaagacacaggtggagggtggtagtgcaatttatgccattgcacagtgtgttgaaactgcctccccacagaaatgtctggattgcatgcaagttggatacaacaacttacaaagttgccttccaagcacagatggtacagcatatgatgctggctgttttatgagatactccaccacacctttctttgctgataatcagaccattgatatcagaccctatttaaaagaaggaggttcaagcaagaagtgggctattataggtggtgtcgtaggaggtgttgttctcctccttctgttgtttgcttggagattgtttacaaaaccaaagagggttcccaaagctgacatattgggagcaactgagttgaaaggtccagttaacttcaagtataaagatttgaaagctgcaacaaaaaatttcagtgctgacaataaacttggagaaggaggttttggtgctgtatacaagggtactctgaaaaatggaaaagttgttgctgtcaagaaactagtgttggggaaatcaaacaagatgaaggatgattttgaaagtgaagtgaagcttataagtaatgttcatcatcgaaatctcgttagacttcttggctgttgcagcatagaccaagagagaatcctagtttatgaatacatggcaaatagcagccttgacaaatttttatttggtgacaaaaaaggttccctcaattggaaacaacgctatgatataattttaggcacagcaaggggactagcatatctacatgaggagttccatgtgtccatcattcatagagatataaagaccggtaatatccttctagatgatgatctacagcccaaaattgctgattttgggttggcaaggcttttgccaaaggatcgttctcatcttagcacaaaatttgcaggaacactgggatacacagcacctgagtatgcaatgcaaggtcaattatcagagaaggctgatacctacagctatggtattgtggtcctagaaatcataagtggtcaaaagagtactgatgtgaagattagtgacgagggtcgtgagtaccttcttcaacgagcatggaaactgtatgagagaggcatgcagttggatcttgtggacaagcgcatagaacttaatgaatatgacgcagaagaagtgaagaaaatcatagaaattgcgttattatgcactcaagcatcagctgcaacaaggccaacaatgtctgaattagtagtgctgctcaaaagcaagggcttagtggaggacttgcgaccaactacgcctgtgtatgttgaaacgaatatgatgaaccgggaaagcatctctactggttctccatccaatgctactatttccatttctgttctatcagcccgttga

SEQ ID NO: 3178 - DNA, 690 bp, Glycine max var. Williams 82
atgtcatccactgctagcttgggttatggggctccaacctgcttcaacaacgttcatcacacaaagaagcagcaagcaatgaggaacagtttcttgagcaataagcacaacagtgtgagagtgatgaagggttggagaggaagacatggtaacactaacaacacatccaaaagggtaggaattgtgcagtgtagagggttaggggacttcataggtggagacttgataaagtttgatcttggacgttggctttcagatgttgaagagcacaaagcacttgcaatataccctcctcatgaaggaggctatgagggccgctacttgtcgcgtctcaaacgccaagggtactatttcctcgaccttacggctcgtggccttggtgatcctgaaaccaccctcaccaagattcaccctgtttgccctcctcatgttggcaagcagccaatagcaaggtggtatttcccaccagaagttgattacagattagaagcgttgccaccaaatgccaaaggattggtagtgtggataattgaagccaaggttctctctaaggcagaactgcagttcctagctttgctgccaacacttaggcctaatgtgagggtcattgctgaatgtggaaactggagaaagtttatgtggaagccacttaaagaaattgcgggactaacaaccagtgaggaagcttga

SEQ ID NO: 3179 - DNA, 918 bp, Glycine max var. Williams 82
atgggtggtgatgatcaaatgaagacgctgcaggcaaagccaaaacaacaacaacttcaacttgaagaactgtaccaaggaatcccagatgagtctgttaaccttacctttcaagacctagccaatgtgaattcatcaaacaacacattggccactactaaacacgtttctgaaggaggtataattaacaaccctacaaatataccatcaccttctctttccacagtgcctagacttgacttcaaaaaaggcttggaggcatcctatcacagccatcaccaccatgacaacaactacaatcatcaccatcaacaccaacaacatagaggtggtggtgactctccatggggtcgttttagccatgcaagtgatggtgtaccaagtaggactggtgagtatagcatgagttataatggtatgaagagtggtgagagttttgcttctggaaaaggtggttctggtcgacgaaggcgaccagggattcctcactctaagatttgcaccatttgcagtaactatgtttatcttttcagaactagatgcctggtatgtggcagggtttattgcaggcagtgtgtggaaataggcatgggagaaatgacagaaggaagaaagtgcattgagtgccttggattgagattcagccaaaggtacatagaaagagcagggatggcagggtgttgtagtttgaggtatccaagtacattgaagcatgttgagctcaattgggctgagaaaggaccaaggaggagtggtgatagaggctataataatggtcaccatagtatggcctccacaagaccaagaacccctacaaaccgaaggagtcctctttctattgccagcactgaagcctcctttgtcatgtctgcaacccattctcccttttctgctcatcaccaccacatccctctttga

SEQ ID NO: 3180 - DNA, 1324 bp, Glycine max var. Williams 82
atggcttcaccatattttcactatttcaagaatcccttgtttttcattaatgatatctaaggttgatcaagatgaatctatatatgtatccagttatgcattttgataactgttggagctagagggcatcgtaatgaagtctcaagtgttgcaagtggatacatgcatctcgctatggaatgggaagtgaaagcccaatgaagacagattgttgtacctactaactaactcaatgggtggtgatgatcaaatgaagacgctgcaggcaaagccaaaacaacaacaacttcaacttgaagaactgtaccaaggaatcccagatgagtctgttaaccttacctttcaagacctagccaatgtgaattcatcaaacaacacattggccactactaaacacgtttctgaaggaggtataattaacaaccctacaaatataccatcaccttctctttccacagtgcctagacttgacttcaaaaaaggcttggaggcatcctatcacagccatcaccaccatgacaacaactacaatcatcaccatcaacaccaacaacatagaggtggtggtgactctccatggggtcgttttagccatgcaagtgatggtgtaccaagtaggactggtgagtatagcatgagttataatggtatgaagagtggtgagagttttgcttctggaaaaggtggttctggtcgacgaaggcgaccagggattcctcactctaagatttgcaccatttgcagtaactatgtttatcttttcagaactagatgcctggtatgtggcagggtttattgcaggcagtgtgtggaaataggcatgggagaaatgacagaaggaagaaagtgcattgagtgccttggattgagattcagccaaaggtacatagaaagagcagggatggcagggtgttgtagtttgaggtatccaagtacattgaagcatgttgagctcaattgggctgagaaaggaccaaggaggagtggtgatagaggctataataatggtcaccatagtatggcctccacaagaccaagaacccctacaaaccgaaggagtcctctttctattgccagcactgaagcctcctttgtcatgtctgcaacccattctcccttttctgctcatcaccaccacatccctctttgaaaattacaataagcaatatttaactttaaatactaccatatgcaataatatctcagacttcagtgcgatgcctgataatattctttcaatatattttttcagagtttgttttatgtgacattattttatattattgtgtcattcaatttatcgattctatttgaattgaaagct

SEQ ID NO: 3181 - DNA, 1143 bp, Glycine max var. Williams 82
atggccacacagacgcaagatccacgttcaaaccctaaccctaatcccaatgcaatgtcggcaacgccatcttcctccttcttcatccgcgccgccggcggcaacggtccctccgccgctcccgtcgccggctccggcgagtcgcactcgcaccaccggagggcgcactcggaggtcagcttccggctgccggatgacatgattgacttgtcgccgtcggatccgttcaacggcggatcctcgacggcgagcttcgaggagatcggatccgaggacgacctgttctccacctacattgacgtcgagaagctcggggctggacgcggcggaaacggatcggatcagagcggttatggaaatggcgccggcagcagctgctacaacgacggcgagaagagtccgagcaccgccgctgcgcggccgagacaccggcacagtagctccgtcgacggttccacgtcgacgagcatgttcggagagatcatggatgcgaagaaagccatgcctcctgataagctcgcagagctttggaacattgatccaaagcgtgccaaaagaatactggctaatcggcaatctgccgcacgttcaaaagaaagaaaggcacgctatatacaagaacttgagcgcaaagtccagacccttcagactgaagcaacaacactttctgcccaacttacactgtaccagagggatacaactggtctgagttctgaaaataccgagcttaagctccgtctacaagccatggagcaacaggcacagctgcgtgatgttcttaatgatgcattgatgaaggaggttgagaggcttaagattgctaccggagaggcattgaaccaatctgagtcttttaacctgggaatgcaccagatgccatatgcagggtcaaatttcttttcaatcccaccacattcaggtccttctgggcaccagaacatgcaattgccaccatttggccactcccattccactgtgccgactcatcagctgcaacaaacaaattctcaccaaatgtcagatatattgcaaaacgaccagcttggtcgtctgcaaggactcgacattagtagcaaaggaacacccgtggtgaagtctgaaggcccctcaatatctgcaaatgagagtagcaccacattttga

SEQ ID NO: 3182 - DNA, 1629 bp, Glycine max var. Williams 82
atgatcacttctttctctgaccttctttcttctcccaccaccgaccacaacctcggagtttccgaaagacctcatcttaagtcgtcctcgtcggatcaagcaggttcttctggtggtgtgccgaaattcaagtccacaccccctccttctctccctcttagccatcatcttccaccaatattttctccttcttcttactttaactttaacattcctcatgggttaagccttgctgaactacttgactccccagttctccttaactcttccaacgttttgccatctccaacaactggatcatttgctggtcaaggcttcaactggaagagcagttatggggaaagccagcagcatgtcaaagaagaagacaagagcttctcaagtttctcctttcaaacacaaacacaccctcctcttccatcttcaaatggatttcaatcttcaaccggcgtagttcaaaccggatggagttttccagaaattgctaaacaagatggttttgcctcaagaatgagtatgagcatggtgaaaactgaaaccacttctgcgatgcagagtttcaactctgagaataataaccacaggaatggttttcaatcagatcataaaaattaccaaccaccacaagttcagaccttaagcagaagatcagatgatgggtacaattggaggaaatatggacaaaagcaagtgaaaggaagtgaaaatccaagaagctactacaagtgcacataccctaattgtccaacaaagaaaaaagttgagagatccttagatggacaaattactgagatagtttacaaaggcactcataaccatcccaagcctcaagctgcgaagaggaactcattgtctgcctcatcacttgcaattcctcattcaaatcatggcggcattaatgaactaccacatcaaatggattcggttgccactcctgaaaactcatcaatatcaatggaagatgatgattttgatcatactaaatcaggaggagatgagtttgataatgatgaacctgatgccaaaagatggagaatagaaggtgaaaatgagggtatgccagctatagaaagtagaacagtgagagaacccagagttgtgtttcagacaaccagtgacatcgatattctagatgatggatacaggtggaggaaatacgggcagaaagtggtcaagggaaatccaaatccaaggagttactacaagtgcacattccctggatgtccagtgaggaagcacgtagagagagcctcacaagacctaagggcagtgatcacaacctatgagggaaaacacaaccatgacgtgcctgcagcacgtggaagtggcaacaactctatgaatagatcattgccaataaccaataccacaaacaacactagtgcagcaacttctctatacactaataacaattctcttcagagtcttagaccaccagcagcaccagaaaggacatcatcacatttcaaccccaacatgcagcagagttcatcaggaagttttggattctcagggtttggaaatccattaatggggtcttacacgaatcaacaatctgacaatgttttcatcactagagccaaagaggagcctggagatgactcgtttcttgactctttcctatgctaa

SEQ ID NO: 3183 - DNA, 525 bp, Glycine max var. Williams 82
atggacgaaattgccaatgcattgcacgatagcaatgttagattcatgttggtaacgcgtggtgagactccatggttgaaagaaatttatgggcacatggggatggttgtggcatggtgtgatcaattgagggtgttgttgcacccttctctggggggttattggacacattgtgggtggaattcggttatagagggtgtttttgctggggtgcccttttttaccttcccaattgccatggatcaactattgattagtaagtggaggattggaaggcgtgggcatagagtgaagaaggatgataagttggacacctcgatgagaagagatgagattgttgtgttgttgaggaagttcatggagttggatagtgacgctggtagagatatgaggaaaagagccaaggagcttcaacatatggctcagcttgcaattacaaaaaatgggtcatctgagatcgaagcctttatgaagaatatggttgagagtggaacgagcataattcaagttcaaaatggtatttag

SEQ ID NO: 3184 - DNA, 966 bp, Glycine max var. Williams 82
atgtcgaaggtggtttgtgtcaccggagccagtggcgccattggatcatgggtagccctcctcctcctccagcgtggttatactgtccatgccaccgtccaagacatcaaggatgaaaatgagacgaaacatttggaggaaatggaaggagcaaagagtcgtctccatttttttgaaatggatcttcttgacatcgactccattgccgctgccataaagggttgctccggcgtaatccacctcgcatgtcctaacatcatcggtcatgtcgaagatcctgagaagcagatactggagccggcgataaaaggaacagttaatgtgttgaaggcggcgaaggaagcgggggtggagcgcgtggtggcgacttcgtcgatctcatccattatgccaagccctaactggccagctgataagattaaggcagaagagtgttggacagaccttgaatactgcaaacagaaggggttgtactatcccattgcaaagactctagcagagaaagcgggttgggaatttgcaaaggagacaggttttgatgttgtcatgataaaccctggtacagctttgggccctctgcttccaccaagaatcaattcaagcatggaaatgcttgttagtgttctcaaagggggcaaagagacgtacgaggacttctttatgggaatggctcacttcaaagacatagcattggcacatattttggcacttgagaacaagaaagcagcaggaaggcacttgtgtgtggaatctattcgtcactttagtgatcttgtggacaaggtttctgagttataccctgaatacgatgtggtcaagttgccaaaggatacccagccagggttgttgagggcaagtacaaaggatgcatcaacaaagctgattgatttaggtctagagttcactcctgtagaccaaatcatcaaggatgcagtggagagtctgaagagcaagggctatgtctga

SEQ ID NO: 3185 - DNA, 941 bp, Glycine max var. Williams 82
acactaaaccagttagaagaggttgcataactgaacaaacaaagcaaccctatgtcgaagatcctgagaagcagatactggagccggcgataaaaggaacagttaatgtgttgaaggcggcgaaggaagcgggggtggagcgcgtggtggcgacttcgtcgatctcatccattatgccaagccctaactggccagctgataagattaaggcagaagagtgttggacagaccttgaatactgcaaacagaaggggttgtactatcccattgcaaagactctagcagagaaagcgggttgggaatttgcaaaggagacaggttttgatgttgtcatgataaaccctggtacagctttgggccctctgcttccaccaagaatcaattcaagcatggaaatgcttgttagtgttctcaaagggggcaaagagacgtacgaggacttctttatgggaatggctcacttcaaagacatagcattggcacatattttggcacttgagaacaagaaagcagcaggaaggcacttgtgtgtggaatctattcgtcactttagtgatcttgtggacaaggtttctgagttataccctgaatacgatgtggtcaagttgccaaaggatacccagccagggttgttgagggcaagtacaaaggatgcatcaacaaagctgattgatttaggtctagagttcactcctgtagaccaaatcatcaaggatgcagtggagagtctgaagagcaagggctatgtctgatttccatgctgctgcagagggactgagtgcactgttacaagtggtgatggcgttaatattattcttctgccattgcttcgactcattgttcatgccatttatgtacccaagtgattgatgccttaaaagcaaacctctcaattccaatttactctattaattggaccaaacataccatatttaaatctt

SEQ ID NO: 3186 - DNA, 1232 bp, Glycine max var. Williams 82
aatggatgaagaatgtagttcatatataaattaaacaccacactagttagaatagaaagtacaatataattgtctattttaaaaaaaaatgttgtggactaaatattgtgtatttaattatttggttgtttaatttggtgaaaataattatattgtgacacacttgcagaggatgaaaatgagacgaaacatttggaggaaatggaaggagcaaagagtcgtctccatttttttgaaatggatcttcttgacatcgactccattgccgctgccataaagggttgctccggcgtaatccacctcgcatgtcctaacatcatcggtcatgtcgaagatcctgagggtgagaggaaatacagaagcagatactggagccggcgataaaaggaacagttaatgtgttgaaggcggcgaaggaagcgggggtggagcgcgtggtggcgacttcgtcgatctcatccattatgccaagccctaactggccagctgataagattaaggcagaagagtgttggacagaccttgaatactgcaaacagaaggggttgtactatcccattgcaaagactctagcagagaaagcgggttgggaatttgcaaaggagacaggttttgatgttgtcatgataaaccctggtacagctttgggccctctgcttccaccaagaatcaattcaagcatggaaatgcttgttagtgttctcaaagggggcaaagagacgtacgaggacttctttatgggaatggctcacttcaaagacatagcattggcacatattttggcacttgagaacaagaaagcagcaggaaggcacttgtgtgtggaatctattcgtcactttagtgatcttgtggacaaggtttctgagttataccctgaatacgatgtggtcaagttgccaaaggatacccagccagggttgttgagggcaagtacaaaggatgcatcaacaaagctgattgatttaggtctagagttcactcctgtagaccaaatcatcaaggatgcagtggagagtctgaagagcaagggctatgtctgatttccatgctgctgcagagggactgagtgcactgttacaagtggtgatggcgttaatattattcttctgccattgcttcgactcattgttcatgccatttatgtacccaagtgattgatgccttaaaagcaaacctctcaattccaatttactctattaattggaccaaacataccatatttaaatctt

SEQ ID NO: 3187 - DNA, 1164 bp, Glycine max var. Williams 82
atgggtttttcttggataagagggaagtgcattggtaagggcgcgtttggcaccgtcagcgtcgcgcttcgcaaacgcgacgatcaaactcaaaatttcgcggtgaagtccgtggatttaaaaacgggtctcccgggtcagctcgaagcgttggagaatgagattcggattctccggcgcatgtcctctccgcacgtggtaacttttctcggcgacgacgccacgtgcgagcagcggaaccttcacatggagtacatgccacgtggtacgctcgctgacctggacgctgacgtggacgaagttttagtgagacgctacacgtggtgccttgtgagcgcgctgaagcacgtgcactcaaacggcgtcgttcactgcgacgtgaaaggaaagaacgtcctcgtcggagacggagggaaaggtttcaattgcaaactcgccgacttcggatcggcggcggagttctccggcgaggggtttccggcggtggtgccgcgcgggagtccgctgtggatggcgccggaggtgattcgccgggagtggcagggtccggcgtcggacgtgtggtcgttgggatgcacggtgatcgagatgctcaccggaaaaccgccgtgggagggaaactccttcgacgcgctgagtcggatcgggttctccggcgaggtgcccgaatttccgaggcggttgtcggagctcggaagggattttctggagaagtgtttgaggagggaaccgtggcggcggtggagctgcgatcagctgctgcagcatccgtttttgttgccgtgtggcgagattgcggaatcgtcgccgcggtgtgttctcgaccgagttgacacggagttcgccgagttcgaccaagaagaagaagaagaagaagaaacgagaattgaaaatgaaaattttgcgaggagtagaattggaaaactggcgatgagggtaagggtaaattgggaaacagaaggttgggtggtggtgagggaattcgcttccgatgcggaaccggcggtggcggttgacagttctgaggacgttaaagacggggcatgtccgggaaatattgggagcgtgagggtagaaaagggacttcatgtagggacaaatttggaatttaaaggtttagaaaacgaaaggttgaaatcaggcatgggacgaagagttgtatga

SEQ ID NO: 3188 - DNA, 1740 bp, Glycine max var. Williams 82
atgtgtggcatacttgctgtgcttggttgctctgattcatctcaagccaaaagggtccgcgtccttgagctttctcgcagattgaagcaccgtggtcctgactggagtgggctccaccaatatggtgataactatttggctcatcaacggttagccatagttgatccagcttctggtgatcaacccctcttcaatgaagacaaaactgttgttgttacggtgaatggagagatctacaatcatgaagaactcaggaaacaattgcctaatcacaccttccgtacaggaagtgattgtgatgttattgctcacctgtatgaggagcacggagaaaactttatggacatgcttgatggtatattttcatttgttctgctggatactcgtgacaacagttttatagtggcacgggatgcaattggggtcacttccttgtacattggttggggtttagatggctctgtctggatttcctctgaattgaaggggttgaatgatgattgcgaacattttgagtcttttccacctggtcacttgtattctagcaaagagagagcgttccgcagatggtacaatcctccatggttctctgaggctattccatctgccccttatgatcctcttgctttgaggcatgcctttgagaaggctgtggtaaaaaggttgatgactgatgtgccctttggtgttttgctctctggaggtttggactcttcattggttgcagccgtcacggctcgctacctggcaggcacaaaagctgcgaagcaatggggaactaaattacactctttctgtgtaggccttgagggtgcacccgacctaaaggctgcaaaggaagtagcagagtacataggaactgtccatcatgaatttcactacactgttcaggatggcatagatgccatcgaagatgtgatctatcacattgagacatatgatgtgacaacaattagagcaagcattcccatgtttcttatgtctcgtaagatcaagtcattgggagtcaaaatggttatctctggagaaggatctgatgaaatctttggagggtatctatatttccacaaggcacccaacaaagaagagtttcaccaagaaacatgccgcaagattaaagcactccacaaatatgattgcttgcgagccaataaatcgacctttgcctggggtctagaagccagagtaccatttttggacaaagagtttatcagagttgcaatgaacattgatcctgagtgtaaaatgataaaaaaggaagaagggcgaattgagaaatgggcactgaggagggcctttgatgatgaagaacatccttatctgccaaagcacattttatataggcagaaagaacaattcagtgatggagttggctatggttggattgatggccttaaagctcatgctgagaaacatgtaactgacagaatgatgctcaatgctgccaacattttccccttcaacactccaaccaccaaagaagcataccactatagaatgatatttgagaggttcttccctcagaactcagcaaggctcactgttcctggaggaccaagtgttgcatgtagcacagcaaaagctgttgagtgggatgctgcttggtctaacaaccttgatccatcaggtagagcagcacttggagtgcatgcatcagcttatggaaaccaggtcaaagctgtagaaccagagaagatcatacccaagatggaagtttctccactaggagttgccatatag

SEQ ID NO: 3189 - DNA, 2246 bp, Glycine max var. Williams 82
acttaactctttcaacttggaaccgttcttcgtgttctccattccctctctcactccttcatctacgtaatttccttccttcctttctttctttctttctttctttatcttctcatttttctcaatacaatttttttctttctttctcaagttttgctacttttctcttcttaaccatagttcacatattatatcatcacatatcatagtgatatcatatcacaatgtgtggcatacttgctgtgcttggttgctctgattcatctcaagccaaaagggtccgcgtccttgagctttctcgcagattgaagcaccgtggtcctgactggagtgggctccaccaatatggtgataactatttggctcatcaacggttagccatagttgatccagcttctggtgatcaacccctcttcaatgaagacaaaactgttgttgttacggtgaatggagagatctacaatcatgaagaactcaggaaacaattgcctaatcacaccttccgtacaggaagtgattgtgatgttattgctcacctgtatgaggagcacggagaaaactttatggacatgcttgatggtatattttcatttgttctgctggatactcgtgacaacagttttatagtggcacgggatgcaattggggtcacttccttgtacattggttggggtttagatggctctgtctggatttcctctgaattgaaggggttgaatgatgattgcgaacattttgagtcttttccacctggtcacttgtattctagcaaagagagagcgttccgcagatggtacaatcctccatggttctctgaggctattccatctgccccttatgatcctcttgctttgaggcatgcctttgagaaggctgtggtaaaaaggttgatgactgatgtgccctttggtgttttgctctctggaggtttggactcttcattggttgcagccgtcacggctcgctacctggcaggcacaaaagctgcgaagcaatggggaactaaattacactctttctgtgtaggccttgagggtgcacccgacctaaaggctgcaaaggaagtagcagagtacataggaactgtccatcatgaatttcactacactgttcaggatggcatagatgccatcgaagatgtgatctatcacattgagacatatgatgtgacaacaattagagcaagcattcccatgtttcttatgtctcgtaagatcaagtcattgggagtcaaaatggttatctctggagaaggatctgatgaaatctttggagggtatctatatttccacaaggcacccaacaaagaagagtttcaccaagaaacatgccgcaagattaaagcactccacaaatatgattgcttgcgagccaataaatcgacctttgcctggggtctagaagccagagtaccatttttggacaaagagtttatcagagttgcaatgaacattgatcctgagtgtaaaatgataaaaaaggaagaagggcgaattgagaaatgggcactgaggagggcctttgatgatgaagaacatccttatctgccaaagcacattttatataggcagaaagaacaattcagtgatggagttggctatggttggattgatggccttaaagctcatgctgagaaacatgtaactgacagaatgatgctcaatgctgccaacattttccccttcaacactccaaccaccaaagaagcataccactatagaatgatatttgagaggttcttccctcagaactcagcaaggctcactgttcctggaggaccaagtgttgcatgtagcacagcaaaagctgttgagtgggatgctgcttggtctaacaaccttgatccatcaggtagagcagcacttggagtgcatgcatcagcttatggaaaccaggtcaaagctgtagaaccagagaagatcatacccaagatggaagtttctccactaggagttgccatatagagcttgtatgagccatagcaaggactagtagttgccctagaaccagcatataatattattatactagtcatcataaaatgaaaattttgcttgctttgtagtttatccagggaatggtatataaatagataaggctctctatctagctgtcttaagtgttgtgccatccacatcttgtctttattttctatttatgtcacctgaacactatcataatgtactggatttccaagaaaatgttatcagttaaatttgaatgcatggttcactatttcaaatttt

SEQ ID NO: 3190 - DNA, 2103 bp, Glycine max var. Williams 82
acttaactctttcaacttggaaccgttcttcgtgttctccattccctctctcactccttcatctactgatatcatatcacaatgtgtggcatacttgctgtgcttggttgctctgattcatctcaagccaaaagggtccgcgtccttgagctttctcgcagattgaagcaccgtggtcctgactggagtgggctccaccaatatggtgataactatttggctcatcaacggttagccatagttgatccagcttctggtgatcaacccctcttcaatgaagacaaaactgttgttgttacggtgaatggagagatctacaatcatgaagaactcaggaaacaattgcctaatcacaccttccgtacaggaagtgattgtgatgttattgctcacctgtatgaggagcacggagaaaactttatggacatgcttgatggtatattttcatttgttctgctggatactcgtgacaacagttttatagtggcacgggatgcaattggggtcacttccttgtacattggttggggtttagatggctctgtctggatttcctctgaattgaaggggttgaatgatgattgcgaacattttgagtcttttccacctggtcacttgtattctagcaaagagagagcgttccgcagatggtacaatcctccatggttctctgaggctattccatctgccccttatgatcctcttgctttgaggcatgcctttgagaaggctgtggtaaaaaggttgatgactgatgtgccctttggtgttttgctctctggaggtttggactcttcattggttgcagccgtcacggctcgctacctggcaggcacaaaagctgcgaagcaatggggaactaaattacactctttctgtgtaggccttgagggtgcacccgacctaaaggctgcaaaggaagtagcagagtacataggaactgtccatcatgaatttcactacactgttcaggatggcatagatgccatcgaagatgtgatctatcacattgagacatatgatgtgacaacaattagagcaagcattcccatgtttcttatgtctcgtaagatcaagtcattgggagtcaaaatggttatctctggagaaggatctgatgaaatctttggagggtatctatatttccacaaggcacccaacaaagaagagtttcaccaagaaacatgccgcaagattaaagcactccacaaatatgattgcttgcgagccaataaatcgacctttgcctggggtctagaagccagagtaccatttttggacaaagagtttatcagagttgcaatgaacattgatcctgagtgtaaaatgataaaaaaggaagaagggcgaattgagaaatgggcactgaggagggcctttgatgatgaagaacatccttatctgccaaagcacattttatataggcagaaagaacaattcagtgatggagttggctatggttggattgatggccttaaagctcatgctgagaaacatgtaactgacagaatgatgctcaatgctgccaacattttccccttcaacactccaaccaccaaagaagcataccactatagaatgatatttgagaggttcttccctcagaactcagcaaggctcactgttcctggaggaccaagtgttgcatgtagcacagcaaaagctgttgagtgggatgctgcttggtctaacaaccttgatccatcaggtagagcagcacttggagtgcatgcatcagcttatggaaaccaggtcaaagctgtagaaccagagaagatcatacccaagatggaagtttctccactaggagttgccatatagagcttgtatgagccatagcaaggactagtagttgccctagaaccagcatataatattattatactagtcatcataaaatgaaaattttgcttgctttgtagtttatccagggaatggtatataaatagataaggctctctatctagctgtcttaagtgttgtgccatccacatcttgtctttattttctatttatgtcacctgaacactatcataatgtactggatttccaagaaaatgttatcagttaaatttgaatgcatggttcactatttcaaatttt

SEQ ID NO: 3191 - DNA, 2132 bp, Glycine max var. Williams 82
acttaactctttcaacttggaaccgttcttcgtgttctccattccctctctcactccttcatctacttcacatattatatcatcacatatcatagtgatatcatatcacaatgtgtggcatacttgctgtgcttggttgctctgattcatctcaagccaaaagggtccgcgtccttgagctttctcgcagattgaagcaccgtggtcctgactggagtgggctccaccaatatggtgataactatttggctcatcaacggttagccatagttgatccagcttctggtgatcaacccctcttcaatgaagacaaaactgttgttgttacggtgaatggagagatctacaatcatgaagaactcaggaaacaattgcctaatcacaccttccgtacaggaagtgattgtgatgttattgctcacctgtatgaggagcacggagaaaactttatggacatgcttgatggtatattttcatttgttctgctggatactcgtgacaacagttttatagtggcacgggatgcaattggggtcacttccttgtacattggttggggtttagatggctctgtctggatttcctctgaattgaaggggttgaatgatgattgcgaacattttgagtcttttccacctggtcacttgtattctagcaaagagagagcgttccgcagatggtacaatcctccatggttctctgaggctattccatctgccccttatgatcctcttgctttgaggcatgcctttgagaaggctgtggtaaaaaggttgatgactgatgtgccctttggtgttttgctctctggaggtttggactcttcattggttgcagccgtcacggctcgctacctggcaggcacaaaagctgcgaagcaatggggaactaaattacactctttctgtgtaggccttgagggtgcacccgacctaaaggctgcaaaggaagtagcagagtacataggaactgtccatcatgaatttcactacactgttcaggatggcatagatgccatcgaagatgtgatctatcacattgagacatatgatgtgacaacaattagagcaagcattcccatgtttcttatgtctcgtaagatcaagtcattgggagtcaaaatggttatctctggagaaggatctgatgaaatctttggagggtatctatatttccacaaggcacccaacaaagaagagtttcaccaagaaacatgccgcaagattaaagcactccacaaatatgattgcttgcgagccaataaatcgacctttgcctggggtctagaagccagagtaccatttttggacaaagagtttatcagagttgcaatgaacattgatcctgagtgtaaaatgataaaaaaggaagaagggcgaattgagaaatgggcactgaggagggcctttgatgatgaagaacatccttatctgccaaagcacattttatataggcagaaagaacaattcagtgatggagttggctatggttggattgatggccttaaagctcatgctgagaaacatgtaactgacagaatgatgctcaatgctgccaacattttccccttcaacactccaaccaccaaagaagcataccactatagaatgatatttgagaggttcttccctcagaactcagcaaggctcactgttcctggaggaccaagtgttgcatgtagcacagcaaaagctgttgagtgggatgctgcttggtctaacaaccttgatccatcaggtagagcagcacttggagtgcatgcatcagcttatggaaaccaggtcaaagctgtagaaccagagaagatcatacccaagatggaagtttctccactaggagttgccatatagagcttgtatgagccatagcaaggactagtagttgccctagaaccagcatataatattattatactagtcatcataaaatgaaaattttgcttgctttgtagtttatccagggaatggtatataaatagataaggctctctatctagctgtcttaagtgttgtgccatccacatcttgtctttattttctatttatgtcacctgaacactatcataatgtactggatttccaagaaaatgttatcagttaaatttgaatgcatggttcactatttcaaatttt

SEQ ID NO: 3192 - DNA, 240 bp, Glycine max var. Williams 82
atggcatttggagctaagaatggcgtgtgttttcccttcttttttttcataactttcttggttatatgttctgccactgctcggagccctattttcttctcaaatgatgaagcttcgagcatggtggggaggtcattaaaggtaataaaccttcaagactatggtgaaccaactgcaaatcatgggcacgatccatggaagggggctagttggggaggtaatggagggcgaaaaggctga

SEQ ID NO: 3193 - DNA, 1521 bp, Glycine max var. Williams 82
atggcttggttaagaaacctctcaaagtttgccaccaagagagcatcatcatctcaaagacccaaaaacactgacccattttgtcttttaccctccttcacttttctctcccacttcagcagcaccaacaccattgaggagaaaccttgtgtggagcctgttgagtacaattattcgggcttggagccaacaaggccccatgagaagccacgtgtggtggtgctgggttctggttgggccgggtgcaggctcatgaagggcttggaccctcgtgtgtatgacattgtttgtgtctcacctcgcaaccacatggtcttcacccctctattggcctctacttgtgttggaactcttgagtttagatccgttgctgaacccattgggaggatccaaccagctatttctagagagcctggttcttatttcttcctcgccaattgtacacaaattgatgcacataaccatatggtgcactgtgagactgtaaccgaaggagtagagacaatagctccctggaaattcacaatctcatatgataagctggtaattgcattaggatcacaaccttccacttttggaattcaaggagtcaaagaacatgccatctttcttcgtgaagttcaccatgcacaggaaattcgtaggaagctgctcctgaacttgatgctgtcagatgttccagggatttcagaagaggagaagcaaaggcttttgcactgtgtggttgtcgggggtggtcctactggagtagaattcagtggtgagcttagcgattttattacgagagatgttcgtcaaagatatgtccatgtaaaggattacatccgtgtcactctaatcgaggcaaatgagatattgtcttcctttgatgatcggcttaggcgctatgctaccaagcaattgacaaagtcaggagttcgtcttgttcgtggcattgtgaaagatgttaaacctcagaagattgtccttaatgatggttctgaggttccatatgggttgttggtatggtccactggtgttggtccattgcctataattcaatctttggatctccccaaagctcctggtgggaggattggtgttgatgagtggctccgtgtttcttcggtacaagatgtgttctctataggagactgcagtggatttgttgaaagtactggaagacaaacacttcctgcattagcccaagttgcagagaggcaaggtaaatatttagcagctctattaaacaaaattggtaaagcaggtgcaggccatgcgaacagtgcaaaagaaatagagtttggggatccatttgtttataggcaccttggaagtatggcatctattggtagatacaaggctcttgttgaccttagacagaacaaggaggcaaaagggttggctctggcaggatttctgagtttttttatttggcgctcggcatacatcacacgtgttatcagctggaggaacagattctatgtatttgtcaactggattacaactgtggtatttggccgtgatataagcagattatga

SEQ ID NO: 3194 - DNA, 1311 bp, Glycine max var. Williams 82
atgacacaccacaccatggaggaggacttgaacatcttggaggttaacactgagccttgcaacaacaatgctattacaagtgcaaagattgcaccaccacagggaaagaaccttagtccaaatgtaacaaagaagtgtctatttctggtcaccaaacttcgcttccaaatgctcggcaatttcacaaccaatttgcgagaggtcatttttgggactaagcttgcagtgctttttcctgctgtccctttagctgttgttgcagatttttataaacttggaagaccttggatttttgctttgagcctacttggactcacccctctagctgaacgtgtcagcttccttactgagcaaattgcgtattacactggccccacagttggagggcttctgaatgcaacctgtggtaatgcaactgagatgatcatatctttgctagcacttcaccaaaacaaagtaaatgttgtgaagttctctctgctgggatctattttctcaaaccttctattagttcttggaagctcactcctttgtggtggcttagccaaccttaggaaggaacaaagatatgacagaaaacaggcagatgtaaactcactacttttgttgctggggttgctatgccatttgctgccattactgctcagatatgccttagcaggagaatatccttctatagccactagtaatctacaattgtcaagagcaagcagcattgttatgcttctagcatatgctggatacatcttttttcaattaaaaacacatcgacaactttttgatgcacaagaggaagatgaaaatgaagatgaagagaaggctgtgataggattttggagtgcattttcttggttggtcggtatgacacttatcatatctctgctttctgaatatgttgttgcaaccattgaggctgcttcagattcttggggcatttctgttagcttcattagcataattttgttaccaattgttgggaacgctgcagaacatgctggctcaatcatatttgctttcaagaacaagttggacatatctttgggggttgctatgggatctgcaacccaaatttctatgtttgtggttccatttagtgtggttgttgcatggataatgggtatagaaatggacttggatttcaatctccttgaaactgggtgtcttgcttttacaattattgttacagcattcactttgcaggatggaacttcacactacctgaaaggagtggttcttttcctgtgttacatcatcattgctgcatgcttttttgttcataaaactagtactccactaatcaatcaagcatag

SEQ ID NO: 3195 - DNA, 1944 bp, Glycine max var. Williams 82
atggcatcacttcatgctaatgtgacatcagttgtttgcaagagtggcaaccatgcttctcaatcgaaattcacaagctcttcattcttgcctgggtttgatgttgttggtcgtgcttcaaatgcttggaagaaagaacttgtcccatcttccatttccttggtgcctagagccacactaacatttgatcccccaactaccaactcagacaaaaccaaacaaaggaagcacactgttgaccctgcttctccagattttcttgcccttccttcatttgaacagtgctttccaaagagcaccaaagaacacagagaagtcactcatgaagaaactggtcatgtgctcaaagttccctttcgtcgagttcacctgtctggagaagaaggacactttgatacctatgacactagcggtccccaaaatgtaaacccaaggactggactcccacagttgcgcaaagagtgggttgataggagggagaaactgggttatccaagatttactcagatgtactatgctaagcaaggaatcatcacggaagagatgctttactgtgccactcgtgagaaccttgacccagagtttgtgaggtcagaagttgctcgtggacgtgctatcattccttccaacaagaaacacttggagttagagcccatgatagttggaagaaactttttggtaaaagtaaatgccaacattggaaattctgcagttgcaagttctatagaagaggaagtttacaaggttcaatgggcaactatgtggggagcagatactgcaatggacctctcaactggtcgccatatccatgaaactcgagagtggatcctacgcaactctgctgtaccagttgggactgtgcctatttatcaagcacttgaaaaagttaatgggatcgctgaggatcttaactgggaggttttcagggacaccctgattgaacaagctgagcagggtgtagattacttcaccatccatgcaggagttcttctgagatatgttccattaacggcaaggcgcatgacaggaatagtatccaggggagggtctattcatgcaaagtggtgcttagcttaccacaaagagaattttgcttatgagcactgggatgagatacttgacatctgcaaccagtatgatgtggctctatccattggtgatgggctaagacctggatccatctatgatgcaaatgacacagcacaatttgctgagctcttgacacaaggagaactgacccgtagagcatgggaaaaggatgttcaggtgatgaatgaaggacctggacacatcccaatgcacaagattcctgaaaacatgcagaaacagttagaatggtgtagtgaagcgcctttttacactcttggtcctttaacaactgatattgcccccggctatgatcacatcacctctgcaattggtgctgccaatattggggcacttggtactgctcttctctgttatgtgactccaaaggaacatcttgggttgccaaaccgggatgacgtgaaggctggagttatagcctacaagatagcggctcatgctgctgatttagccaaaggtcatccatatgctcaagcctgggatgatgcattaagcaaggcaagatttgagttccgatggatggaccagtttgctttgtcattggatccgatgacagccatgtccttccatgacgaaaccctgccagcagatggtgcaaaagtggctcatttctgctcaatgtgtggccctaaattctgctctatgaagataacggaggatgtgaggaagtatgctgaggaacatggctatggaactgatgaagctttgcagcgtgggatggatgctatgagtgctgaatttcaagctgccaagaaaactatcagcggggagcaacatggtgaagctggcggagagatttacttgccagaagaatacgttagttccaagaggacttaa

SEQ ID NO: 3196 - DNA, 339 bp, Glycine max var. Williams 82
atggatgtggtgcatccacacgtcaaattcacaacctcagcagatttctcagcttgcaacatggcttccatcatcatgtcatttgctccagcaactggtagagtctttgcagccacagcggcaaagggtgctggtggaagcaaagaagagaagggtcttcttgattggatccttggagggttgcagaaggaagaccagctgctagagactgatccaatcctcaagaaggtggaggagaagaatggaggcaccaccagcaacactggccgcaacaagaactctgtggcagtgccacaaaagaagaaaggtggctttggaggcctctttgcgaagaactga

SEQ ID NO: 3197 - DNA, 1698 bp, Glycine max var. Williams 82
atgagaaactcttgggtaacagccaaaggatattacactaagaatgtcctcttctgtctccacacaacacagttgtctgcatttccttatctcatcacatgctctcactacaagcaattactaacccaatcccaatcagctccactttttccattccatccatacattgtcaccaccacattaattgcagaacacaaccacccccactctaacaactgccaccgtcagccgcagcacgccgccacattactccggcaacagacaagaccaatgacgagaaaggtctcgaatttctcggatctgatccaaagggtcaccgcctcctgcctcctccaccccctcgccaccgccgccgccaaggaagacgacaactcgccctacgagtccgaggaagaagtagagaatgacgaggagtacgaggaggaagagaacgaggagtacgaggaggaagagagaatgttggggcccttgaaggctttcaaagtaaaacagatggaggtgctgatggaggaagtgttcgacacggtgtcgtcgatgaagagggcttacgtgaggcttcaggaggcgcattcgccgtgggacccggagaggatgcgagctgctgacgtggcggtggtggcggagcttcggaagctcgccgtgctcagggagaggttccggcggagcggcggcggcggcgggaggaagaagggcaggagaagaggtggcggcggccgcgatggggtggcgtcggtgagggaggtagtggcaccgtacgaggcggtggtggaggagctgaagaaggaggtgaaggtgaaggatttggaggtgaagaatctgagggagaagcttgatagtgctgttgctctcactactaatggaagtgctgaaaagaagcctgggaggtctctgtctaagaggaaactgggaattcaagcaatggcagcagtaccaacccctgaactctttgaagcaacgatgatgcaagtgagagaatcctcaaagtctttcacatctctgcttctgtctctcatgcacaatgcacattgggacataacagctgcagttcgttccattgaagctgctaccgcctccactgataaattccataacacttcttcaaccacatccattgtctcggcttaccatgccaagtatgcccttgaatcctacatatccaggaaaatcttccaagggtttgaccacgagactttctacatggacggaagcctctcctcgctcctcaaccccgaccagtttcgccgcgattgcttcactcagtaccgtgacatgaagtccatggatccaactgagcttcttggaatcttgccaacatgtcattttggcaaattctgttccaagaagtaccttgccattgtccatcccaagatggaggagtccttgtttgggaacttggagcagcacagtcatgtccaagcagggaaccaccccaggagtgagttctacaatgagtttctaggggtggccaagacagtgtggttgcttcatttactggcattctcgttgaaccctgcaccaagtcagtttgaggcaagccgtggagctgagttccatccccagtatatggacagtgtagtgaaattttcaggcggccgagtgccggctggtcaggttgtagggtttccagttagccctggatttaagcttgggaatggttctgttataaaggccagagtttatttgatagccagaacataa

SEQ ID NO: 3198 - DNA, 981 bp, Glycine max var. Williams 82
atgggacgtattccatgttgtgagaaggacaacgtgaaaagaggacagtggacacctgaggaagataacaagctctcctcctacattgctcaacacggcactcgcaactggcgtctcattcccaagaatgctggcctccagagatgtggaaagagctgcagattaaggtggactaattaccttcgtcctgatctcaaacatggccaattctcggattcggaagagcaaaccattgtgaagcttcactcagtttttggtaacagatggtcactgatagcagcccagctgccaggacgcactgacaatgatgtcaaaaaccactggaacaccaagctgaagaagaaactgtcaggcatgggtatagaccctgtcacccacaagccattttcccatctaatggctgaaattgctacaacattggcacccccacaagcagctcaccttgctgaagcggcccttggctgtttcaaagatgaggtgctccaccttcttaccaagaagccaattaacttccaccaggggcaacattccactgcagcattggaaaataacttcacagattacattaattgtaagccagatgaaaaggacacagctattgagaagattaagtttgacctatcaaaggccatacaacatgaaccagaaatgatgcccgcaaacaaaccttgggactccaatgcaactacatctgcaaattttgtgatgccatacggtgtttttcctacaatgcctgggtttcaattctctccggcaacttttggcaaaggggatgatgcatctccatggagccaaagtgtatgtactggaagcacatgcactgtcatggatcagcaaagccagttacatgaaaaacttgaagacgaaatcggtgatgattctgaggctacgaaggagattagaaatttatccaatatattcaactcagattgtgttgtgtgggatctaccaacggatgatttgattaaccccatggtctaa

SEQ ID NO: 3199 - DNA, 225 bp, Glycine max var. Williams 82
atgcttgagttaaagttctgtggaactcaaaggaatctgtgcttcctctgttgcatgttatgtgagcaaaacttggtggtccacatttgcagttttccatgtccttttaaaggcagaacaaaatacccttttaaatggaagtgggtatctttcttcttagccattataggtgttttattattgggagacaatggaatggtttttcttaccttggatacgaagtga

SEQ ID NO: 3200 - DNA, 432 bp, Glycine max var. Williams 82
atggaggcccccaaatacgataatggctccaatgatgagtcatcctcttctacccctagcttttctaataaccaagaagaccaagaagaacccttagtccctggtggcttctccaatcctcttaagacacatgacagctataatatagaagaggccaattgcatcatgttatctggtggctctgatgactcatcagtgtccctttgttgccagaaatacacccattggactaaagaacaccacatgtcttttctccttgggcttgagaaatgtggccaaggagaggaaaaatggaaaaaaatttcaacatattttcttacatcaaaaactctgacccaaattgtaagtcatgttcaaaaatacttcctacgcaagaatgttccagagaaaggaaggaggagaagaagcatccatgacatgattcctctctag

SEQ ID NO: 3201 - DNA, 2231 bp, Glycine max var. Williams 82
tccgaccaaaaactgcagcacaagtgcacaaccaatgaaaccacataaacttccttctccggcactctcacgtgcgttcgcacgtgccctaggatccgccaccaccgccacgcaatgtggagtggcgtttccttcgaagaccgttaccaccgcgaacttcgaaccgtcgctggcggagctccggcgccatgtccggacgtcggacttcgtggccatcgacctcgagatgaccggcgtgacgagcgctccgtggcgcgagttgttggagttcgaccgctccgacgtgcggtacctgaaggtccgagactccgccaccaagttcgccgtcgttcaattcggcgtttgccccttccgttgggatccctccaaccactccttcgtcgcgtatccgcacaatttctatgtttttcctcgacagcagctcgcaggcttgggtccatgtgatgaattcctctgccagaccacatcaatggatttcttggctaaataccagtttgattttaatgcttgcatacatgaaggaatatcttatttatccagagaacaagaaaggaaagcattaaggagtttgaattctacatatgatagtgagtggtcagacattggtaaattaaaagatgttagggatataccattgctcagcgcggccgacattttgttcactgcacggatgaaaaataaattcagtgaatggcgtgatgggttatttcaggagcaaaatcaagaagaccaaattcaaggaatttcaaatgactcaaaatttcaagtgactttttttgagatgcatccagctcttaggcttaatagattcacatctcaccagcttaaattgattcagttgctcatcagaaaacacttcaaagatctttcatatgtcagtgtgaacagtgaggcttctggttcacaacaattagtcgtatatacagacttaaaggatgaattaaacttacttctgaagaaggtgaaagaagaaaatcacagagcagaagagatgaagatccaagctgccgttggattccgccatgttattgatctcctttcatcagaacagaagttgatagttggatacaattgttttttagatattgcacatgtctacagcaaatttataggccctcttccggggactcctgaagagtttgttgcctctgttagcaagtgctttcctcacattgttgacaccaagatactcctgagcactaatttgatgttccaagaaaagatgaaaaggtccagaaaatcactggcctctgcattcacttcattttgtccacaaattgcagctggctccagaagcacagatctaggttcactctctcatgtgaaagtgaacgttgaggttgatgattcaagatcatgcagctggagccctggaggcaagcatgaggcaggatatgatgccttcatgactggatgcatctttgcccagttatgcagtgatttaggttgcagattcttcactcaggagcctgacgaagcggtacccaaaaattatgtttgagaacattgttattatttggggattttcttctaagctgaaggcaaacgaaataagagagtgcatatctaaagtatttggaccaacttctgtagtttctgtcttccacttggatgcaactgcagcattcgtccagtttagcaaaactgagttagtttctgattttcttttagtgaaggattccttggagagaagtggtggtgcaatctcggttttgcatccactgtcaaaacttttggaaggtggaaatacatgtggtgccaattatgatacttacagagaaatatgtggttcatccttatcagaaggtctgttcgctgatcaggcagaggcagttggtataaagtggaagaccaaattaacagaatacaaggtagcatcgagaggcaaagaacatgaaaatcctagtgtacaagataatgtaaatacggttatgaagaatgtagaaaggaccaagccaaacacaattgatcagttaggaaatgctccatcttgtgggcaagtctcaacttttgagattgaagattcttatgttgcagaagccaatttgtgatttctgactaatgatttgtacacggtcagaatgaagatttaatattatattaaaataaatttttacaaagcaacctgtacttcgggctgatattgtccaaatttagaaaatgtagcagtctgagaaaagcatagaagcatattgatccacgaaatatccatacttgataacccagggtag

SEQ ID NO: 3202 - DNA, 1176 bp, Glycine max var. Williams 82
atgaatgttctggctctagggcgcttcctcacttcccccttatataagacttcccctctcactccctccccaatccaattcacacccatttttcttcatcccccaaagtttcaatctttgtattcaattcaccctttctctctctccatggccacttgtgttgatgccccaacccctctttctcggaagcctaacgggtcccaatccgatgatcgttccttcaattacatgaaattctgccgacccactttctctgatcgcgttccctgcatacccatttgcaagaatcgtgacactgccttcacacgcgtggaggagtttgacacatgtgtggaggataatgatgatattgaggttgaggttgtggagggtgttgatctttggttgaagattcaagaggaggcaaggttagatgttgatcaagaaccaattttatccagctactatttcagttccattttgtctcacaaatctttggagagtgccttggccaaccacctctccacaaatttgagcagcttgagccttccaagcagcaccctttttgaccttttcatgggtgttttggttgatgatggagatgatgacatcgtaggtgctgtgaaggatgatttgatagctgttaaggagagggaccctgcttgcataagttatgtgcattgcttgctgaatttcaagggttttttggcatgtcaggctcataggattgctcacaaattgtggcttcaagggaggaaggtcttggcgctgttgattcagaatagggtgtctgaggtttttgctgtggatattcaccctggtgccaaaattggacgtgggattttgctggatcatgcaacaggacttgttgtgggggagactgcagttattgggaataatgtgtcaattttgcataatgtgacattgggagggactggtaaggcaagtggggatagacaccctaagattggtgatggggtgttgataggtgcagggacttgtattttggggaacattaagattggtgatggagctaagattggtgcttgttctgttgtgttgaaggaagtgccaccaaggactactgctgttgggaaccctgctaggttggttggagggaaggataaccctattaaattggataagatgcctagttttaccatggaccatacttcatggtctgattatgttatatag

SEQ ID NO: 3203 - DNA, 3906 bp, Glycine max var. Williams 82
atggctaagcttgcttctcttgaagagccccttttgaatggtgactctaaagtacagaacaattctgatcccagtaagactaaaggaaataactattcaattgctggagttttcagcattcttactttctcatggatcagtccaataataaccctaggcaatgagaagacattagagcatgaggacctcccacttcttgctactgatgacagtgcctatggggtttttccaacttttagaaacaaactagagtcagagtgcggtagtgttaggaatgtgaccactcttaaactcgtgaaggtgttattcttgtcaacatggcaaggaattcttttgtcaggtttatttgcattactatacacgtgtgcttcttatgttggaccctttcttattgaaatctttgttcaatacctcaatggggaacaaaagtttaaaaatgaaggctatgttttggctatggcatttgttgctgcaaagcttgtggaatgtctttcacagaggcactggatgtttaggttccagcaagttggggttaggatgcaatcaaagttggtcgcaatgatctatgctaaaggtttgactctttcatgtcaatccaaggaggttcgcagcactggggaaatcatcaacttaatgactgttgatgcagaaaggattggtgaattttgttggtacatgcatgatccatggatgtgtgttttgcaagttgctttggctttgttaattctatatagaagtgtaggggttgcttcaatagctgctcttgctgccactgtaattgtgatgttgctaaactttcccgtgtcatcattgcaagaaaagttccaaggcaaggtaatggagttcaaagataaaagaatgaaggctacgtctgagattctgaagaatatcaggattctaaaactgcaagcgtgggagatgaagttcttgtcaaagattattcagcttaggaagactgaggagatatggctaaagaaatttctagctagtacagcaattattaaatttctcttccataacgccccaacttttattgctgtggttacatttggtgcttgtgctcttattggaatcccacttgaatctgggaaggtcttatctgcacttgcaacattcagaattcttcaaatgcccatttacggtcttcctgacacaatttcaatgattgcacaaactaaagtttcccttgaaaggattgcatcatttcttcgtctagaagagttgcagaccgatgtagtagaaaagcttccatggggtagttctgataaggcaattgaattagtagatggatatttctcttgggatttatcttcccctaatacaacactgaaaaacataaatctcacaatttttcatggtatgagggttgctgtatgtggtactgttgggtcaggcaagtctagcttactttcttgtataataggggaagtaccaaagatatcgggaacgctgaagatatgtggaaccaaggcttatgtttctcaatcgccatggatacagggtggcaagatagaagataacatattatttggtaaagagatggacaggggaaagtataagaaggtgctagaagcatgttccttgacaaaagaccttgagattctaccatttggtgatcagactattattggagagaagggaatcaatttgagtggtggacagaagcaaagagtgcaaatagcccgtgctctataccaggatgctgatgtatatctgtttgatgatcccttcagtgctgtggatgctcatacaggatcccatctctttaaggagtgcatgcttggtcttttaaaatcaaaaactgtgatatacattactcatcaagtagaattcttacctgatgctgatctaatattggtcatgagagaaggaagcataactcaatcaggaaaatacaatgacattctcaagacaggcactgatttaatggaacttgtaggtgcacacagagaagctttgtcttcaattaagtccttagagagaaagccaacatttaaaatatcaagtacatccgaggaggacccaaattcattaagtgattttgaacttgagaaaaatgtggaaaacacaaatgatcaaattgataagtcaaatgacacagttgagccccaaggacaacttgttcaagaagaagaacgagaaaagggtagagttgggtttaaagtatactggaaatacatcacaacagcttatggaggtactcttgtacccttcatattactttcacagacactcaccatcagttttcagattgcaagcaattattggatgactgtggcaacacctgtttcagcaactgcagaacctgatattagaagctttacacttatggttgtctatgttgctttggcagttggaagttccattttcacctttgccagagcatttcttgctgcgatagctggatacaaaacagccactgtgctcttcaataaaatgcatttgagtgtttttcgagcaccaatatcattttttgatgccacccccagtggtcgaatccttaatagagcttcaacagaccaaagcacactggatatgtacattgcagatatattatgggcagttaccctcaatctggttactctcttcggaaatatttttgtgatgtctcaagctgcatggcaggtgtttatagtattgattccagtcatggcagcatgcatatggtaccagcgatactattctgcatcagcaagagaattggcacgattagttggtacatgccaagctccagttatacaacatttttcggaaactatctctggatcaacaaccataagaagttttgagcaagaatcaagatttaatgacataaatatgaaaatgatagacagatattcccaacccaaattatacagtgctactgcaatcgaatggctgaatttcagattggatattttatctactctcacatttgcctgctgtttggttttcttgatatcttttccaagttcaatgactgctcctggaattgcgggattggctgtgacatatggacttaatctaaatgctgtacaaactaaagtaatctggttttcttgcaatttggagaacaaaattatatctgttgaaagaatgctccaatacacatccctcccaagtgaagctcctcttgtaataaaagataaccaaccagattattcttggccatcatttggagaagttcatatccgggatttacaggttcaatatgctcctcacttgcctattgttttacgaggtcttacttgcacttttactgctggagcaaaaactggtattgtgggaagaacaggaagtggaaaatcaactcttgtgcaaacacttttccgacttattgaacctgttgctggacaaatattgatagatagcattaacatctctttcattggaattcatgatttgcggtcccgactgagcattattcctcaagatccaacaatgtttgaagggacaataagaaccaacctggatccactggaagagtacacagatgaacagatttgggaggctctatatatgtgccaacttggagatgaagtaaggaaaaaagaagggaagcttgactccgtagttacagagaatggagaaaattggagtatgggccaaaggcaattggtctgcctcggccgtgttctacttaagaaaagcaagatcttggtgcttgatgaagctactgcatcagttgatacagccacagataatattattcagcaaacagttaagcaacatttttccgaatgcacagtcattaccattgctcataggataacttcaatccttgatagtgacatggttttgtttttaaatcaagggttgattgaggaatatgattcaccaaagaaactgcttaagaacaagtcttcatctctagctcaactagttgaagaatacacaaggaggtcaaattctggttttggaaattaa

SEQ ID NO: 3204 - DNA, 1215 bp, Glycine max var. Williams 82
atggcttcttcaccttctttgcacatagcaatggtcccatggtttacaatgggacacatcacaccatttctctacctcgccaacaagcttgcagaaagaggacacagaatctctttcttcatttcaaagcacacacatgcagccttacagcacctaaatcaccaccccaatctcatcacccttattccaatctgtgttcctcacaatgattgtggcctaattccccatgttgctgaatccatcacttcggaagttccttcctccactgcctcactatttgagaaggacattgaagtcctcctccttgagctaaaattaaacattgtgttctttgatcatgcatattgggtaccaagaccatgcttaactcggtgcctaggcattaagtccttagtgtattatgttataagcatttcatcattggcttatgacttatcatgttcataccctttagggatatctaaattaggatgctgcaacatagctgaccatgacctcatacttaatcattcccatgaaccaaaactccttgttggatcaggaataaaacttgagcatggaaaaggcattgcttacattgaaagttgtacaaatactctaactcaatcttatgcaacaggactcaaaggtagtagttgcagagtggttgaaggagcttatgttgattatcataggaggcatgtgttgcttgaagggtgtgttataacaaagggaaccacatgtcatttggatgaaaattgggctaaatggcttggaaattttgaagctggctctgtggtttattgtgcatttggtagtgagtgcacattagaactatgtcagtttcaggaattgttgttggggcttgagctatcaggtatgccatttttggcagcacttaaaccccctaagggttttgagtgtgtggaatcagcttttccactagggtttaaggagagagttgaaggaagaggggttgtctgtggtggatgtgttcctaatcaggagttcattttggagcacccttctgtggggtgcttctttacccgttgtggatcagggtctttgccagaggcagtggtgaacaagtgtcagttggtgctgttgccaaatcatggtgaaatggtgatcaatgcaagggtggtctgctacagcttgaaggttggattggaagtagagaagttgaaggcctttaagatggtttgtgtaccaaagaaagtgtgtgcaaaactgtga

SEQ ID NO: 3205 - DNA, 339 bp, Glycine max var. Williams 82
atgctcatgcatgaacgagaagagaaaaagcgaaggatgagggaccagaaaaagtatcaagaactgcaaaacatagatcaggaatttggttttggtttaagaccaagccctgaaggccacttggcaacaaaaaggttgttggtcctcgcccaaatggaggtgcaaatggtactcctaggcagctatctcttaatgctcatcaaaatggaagcaagtcctcaacaaaagatggaaaaggataataatagactagttgccccccttaactatgtatcaatatcaaaagaagatgctgcttcccatgtttctggtactgaactagtgccaatgtcaccctag

SEQ ID NO: 3206 - DNA, 306 bp, Glycine max var. Williams 82
atgggaaactgcttgaagcaccaatcatccaccaataagtatgatggcagcgatcacgatagcgatgattgggattttctggcaggtgaggaggggtcttttgctgccaccaaggccaaaacggtgacggaggtgaagatcaagatcacaaagaaacagctagaggaattgttgagcaaagtggacgtgagggagttgagggtggagcaggttttgtcacagttgatgaaccatagtagtggagggttccaatcacttcaaagaccatggaggcctgcacttcagagcattcctgaggccaattga

SEQ ID NO: 3207 - DNA, 564 bp, Glycine max var. Williams 82
atggcatggttttgtgctgctaggactttccacattccggcgatgaacagcggcgttcttcgccggcgggcatcatgggctgccggaataggcggagcctcggtggccggcgctgcattcttgcgctcgacttcgtctaagcgctctatgccattcgcttgcatgaacctctctactgatacccggttaaaggaagctgttcagactgaaaaagccccagcggcattggggccgtattctcaagcaatcaaagccaacaaccttctgtttgtgtcaggtgttcttggccttattcctgagacagggaagttcatctctgataatgttgaagatcagacagagcaggttctaaaaaatatgggagagatcctaaaatctgggggtgccagctattcatcagttgttaagacaactattttgttggctgacttgaaggacttcaagaaagttaatgagatctatgctaaatacttcccttcaccagccccggcacggtcaacgtatcaagtagcttccttgccaatggatgccaagattgaaattgagtgcatagcagcactttga

SEQ ID NO: 3208 - DNA, 1983 bp, Glycine max var. Williams 82
atggccaacacctacaagccaaagaacattctcataacaggagcagcaggcttcattgcatcccatgtatgcaacaggatagtgcgaaactaccctgactacaaaatcatagtccttgacaagctcgattactgctcaaatctgaagaatctcattccctcgcgttcatctccgaatttcaagttcatcaagggagacattggaagtgctgatttagtaaactacatcctcctcacagagtccattgacaccatcatgcactttgcagcacaaacccatgtagacaattcctttggcaacagttttgagttcaccaagaacaacatctatggcacacatgtgctcctagaggcttgcaaggtctcaaagggtcaagtgaagaggttcattcatgtgagcactgatgaggtttatggtgagacagatgaggatgctgtggttggaaaccatgaggcttctcaattgttacctaccaatccatattctgccacaaaagctggtgctgaaatgcttgtcatggcgtatggtagatcgtatggtttgccggttataacgacgagagggaacaatgtttatgggcctaatcagtttcctgagaagttgattccaaagttcttgctcttggccatgaaaggaaggactcttccaattcatggggatgggtctaatgtgaggagctatctctattgtgaagatgttgctgaggcttttgagatcattctccataggggtgaggtagggcatgtttataatatagggacaaagaaagagaggagggtgattgatgtggctagggatatatgtaggtttttcaatttggaccctgacacacatgtcaagtttgtggagaataggcctttcaatgaccaaaggtacttcttggatgatgagaagctcaaggatttggggtggtctgagggcactacttgggaagagggtctaaggaaaaccatggattggtatgtcaagaatcctgattggtggggtgacgtttctggtgctttgcttcctcatccaagaatgctcactatgccaggagttgagaagtactatgatggctctgataatgtgaccggaaccgcttccaatggtgatgttaaccattctaatcagaacagaatggtggttgttccagccacaaggaataatgtgtcaccacaaaaggcatctttgaagttcttgatatatggtggtgcagggtggattggggggcttataggaaacatttgtgagaagcaagggataccctttgaatatggcatggctcgcttagatgatagatcacagatcttgtttgattttaggaccattaagcctactcatgttttcaatgcttctggggtgattggagcattaaatgtgaaatggtttgaagctcataagccagaaactatacgtgctgttgttgttggtgtgttaacattagcagatgtctgcagagatcatggtctcctcatgatgaattatgcctttggtggtaacttggaagacaaagcatattccactgatgccttctattttagaacacaagccaaggttgaagagttgctaaaggaatatgaaaatgtttgcaccctaagaatccaattgccagtgtcatctgatctcagcaacccacataacttgatcactatgataacaaggtctgataaagtggccaacattccaaacagcatcactgttttggatgaactcgtaccaatttcaattgagatggccaaaaggaattgcaggggcatttggaacttcacaaaccctggtactgtgacatgcaatgagattcttgagatgtacaaggattatgttgaccctacttttaaatgggttaattttacacttgaacaacaggctcatgtcccttctccaagcactaatgagatggattcatcaaaactgaagaaggaatttcctgagctgttgcctgtcaaggactcattgatcaaatatgtgtttgagccagaaaagaaaagcttggggttttga

SEQ ID NO: 3209 - DNA, 1683 bp, Glycine max var. Williams 82
atggttttgagggtttctctcattctagttctccttgtgttgcactgttcctgcactgtgcaatccatttttgggcatcacaatcacaatgatctcaacaagaatggatcttctcttgctgcagtcaagtttcctgatcatgcacacttcaatgctgtttcttcttccacagaaactgggtgtagcttctccaagtcagagaaatttgagccttcggtagcaaccatgacatcaaatggtgacacggatggtgaagagggagaggcttttgtggcagcaaaacagcacaagcaatctgtgaaactcaatttgagacaccactcagtgagcaaagattctgagcctaaaaggtctgtggctgattctacagtgagagacttgaagagaattcagacccttcacagaagggtcatagagaagaagaaccaaaacacaatttcaaggctggagaaagcaccggagcaatcaaagaagtcctataagctggcggcagcggcggctgctccggctgccccgccggagtatttctccggtcagcttgtggcaaccttggagtcaggggtcagtcttggctctggtgagtacttcatggatgtgtttgttggcacaccccctaagcatttttctctaatacttgatactggtagtgaccttaattggattcaatgtgttccttgttatgcttgttttgagcaaaatggaccatattatgatcctaaggattctagttcttttaagaacataacttgccatgatccaaggtgccaattggtgtcatccccagaccctcctcagccttgcaaaggtgagactcaaagctgtccatatttctattggtatggagatagttccaacacaactggggattttgcacttgaaactttcacagtgaatctcaccacacctgagggaaagcctgagctcaagattgttgagaatgttatgtttggttgtggtcattggaatagaggactttttcatggtgctgctggattgctagggttggggagagggccattgtcatttgctactcagctgcaatctctctatggtcattccttttcctattgccttgtggataggaacagcaattctagtgttagtagcaagttgatatttggtgaggacaaggagcttctcagccaccccaatttgaatttcacttcttttgttggtggcaaagagaaccctgttgatacattttactatgtcctgataaagtccatcatggttggtggtgaggtgctgaagattccagaggagacttggcatttgtcagcacaaggtggagggggaacaatcattgattctggcaccactttgacttactttgctgaacctgcttatgagattatcaaggaggcattcatgaggaaaatcaaaggttttccacttgttgaaacctttccccctctaaagccatgctacaatgtgtctggagttgagaaaatggagttacctgaatttgcaatcttgtttgctgatggagctatgtgggatttccctgtggagaattacttcatccagattgaacctgaagatgttgtttgcttggctattttggggactcctaggtctgcactttcaataattggaaactatcagcagcagaatttccacatcttgtatgatttgaagaaatcaagacttggatatgcaccaatgaagtgtgctgatgtttaa

SEQ ID NO: 3210 - DNA, 1065 bp, Glycine max var. Williams 82
atgggaggaaaagggtatgctctatggctcttcattattgaaatctttgtccatttttccacatcaagcagtagtagtagtggcaacaaagttcctgcaataatagtgtttggagactcctctgtggactcaggtaacaacaacttcattccaaccattgcaaggagcaactttgagccatatggtcgtgactttttcaatggaaaccctactggccggttctccaatggacgcattgcccctgatttcatctctgaggcctttggcattaagcaatcagttcctgcatacttggatcctgcttataacatatctgattttgcctctggggtgtgctttgcttctgctggaactggatatgacaatgctactgcaatggttgctgatgtcatacctctatggaaagaagttgagtattacaaggagtaccaaaagaaattgagggcacatcttggtgatgagaaggccaatgaaataataagagaggctttgtatttggtcagcatagggaccaatgacttccttgagaactactacacactccctgaaagaaggtgtgagttccctattgttcagcagtatgaggactttctcatagggcttgctgaaagcttcttcaaggaaatttatggccttggggcaaggaaaatttctctgactgggttgcctcctatggggtgtctaccactggagagagcagtaaacattttggagtaccataattgtgtggaggactacaataatttggccttggagtttaatggaaagttggggtggttggttacaaagctcaacaaggacctccctgggtttcaattggttgatgcaaatgcttatgatatcatactgcaaatcgttaaacacccttctcgttttggttttgaggtagcagatacaggatgctgtggaacagggagatttgaaatgggtttcttgtgcgatcctaaatttacatgcgaagatgcaagtaagtatgtattttgggatgcattccacccatcagaaaaaacaagtcagatagtctcaaattatttaataaaaaaatatctagcaaagtttcgttga

SEQ ID NO: 3211 - DNA, 1443 bp, Glycine max var. Williams 82
atgggactaaacacatttaagtcttattttctatatatagatgttcgcatgatgcaaagctccaggaagcacataagatccaagccatttacaaaaatggtaaccattaaagcatcttacacagtccttccaaatgaaccaactccggagggccttttatggctatctgatattgatcaagtggcacgtctacgccacacacccaccatctacattttccatgcaaaacacaaccatgatacattaattgagaggatgagaaactctcttagcaagattttggttcactactatccaatagccggtcgattgagaaggatagaaggtagtggtcgattggaattggattgcaatgcaaaaggggtggtgttgcttgaagctgaatccacaaaaacattggatgattatggagactttttacgtgagtccatcaaggacttggttccaacggttgattacacaagccctatagaggaacttccctcgctactagttcaagtaacaacattccatggtggtaaatcctttgccattggagttgccttatgccatatcttgtgtgatggggttggtgccattcagtttatcaactcttgggcaaagttagctcgaggagacacattggagccacatgagatgccatttctggatcgaacagtgctcaagttcccacaccctctgtcgccgccgcgctttgatcacctggagttcaagcctttgccacttatattgggaagatctgacaacacagtagagaaaaacaagaaggttgatgccaccttgctgaagctaacaccagaacaagtggggaagctgaagaagaaggccaatgatgactcaacaaaagaagggtcaagaccttatagcagatttgaagctattgctgcacatatatggagatgtgcctctaaggctcgtaaactagataagaatcaaccaactctagttcggttcaatgccgatattcgcaatagactaattccacctctccctaagaattattttgggaatgctttgtccttaacaacagcatcatgtcacgttggagatgtcatatcaaattctttgagttatgctgctcagaagataagggaagcaattgaagtggttacatatgagtatatatggtcacagatagatgtgattagaggtcaggagcaactggataatgcaagggctttgttctttggacaaaatgaaggaaaggatgccttgttttatgggaaccctaaccttcttattacaagttggatgagcatgccaatgcacgaagcagattttggctggggaaagcctgtgtatttaggtctaggaagtgtatctacacaagatagggcactgattattcaaagccctgatggtgacggctctattattctgtccatacactttcagatggaacatatgcagcttttcaagaaatatttttatgaagatatgtga

SEQ ID NO: 3212 - DNA, 594 bp, Glycine max var. Williams 82
atgggaaatgccgcagtgactccatgctttcatccaaagaattcctcgtcatcgtcatcgtcgaaacttattttttgggatggcaccatgaggtgtctcaagggtaagcacattgctggtgagatcatgtatgagtttccagacaaggtagtttgccatgcagattctttcttcattggacacccaattcctgctttagctttagaggatgagctcattcaaggtgaagcttattttgttctccccattgatagcttcacatgcaaaaccctttctatttcttcactcttgtccttgggatcagaccctagcaagtccaccatcaaatttggggaatgcccttttgagtacttgaaaggttccaatggaagggtgttgataaaggtcatgcccgagttcatcacaaggctaatcaatagaagtaaaagaccttgttgccccagcagcaacgacaacaacaacttcctatgcagcactcctgagttgagaaaacactaccaaatgctagtgaaatccaaggaccaagtttggtcacctaagcttgaaaccatttcggaaaacaaggttaggttttcaccgtgtagatttatatag

SEQ ID NO: 3213 - DNA, 636 bp, Glycine max var. Williams 82
atggaaaccacaccgcctctagccactgatagcttctcatatagctggttaccaaattgcaaaccccttgcaaatgacctcaaggagcctctaagagaatccacttacaattcctgtgaaggcaccaccaattatccattaatggaagaatggcaaaacttcaattttgatatttccatcacacagtcccctgctgttctttctcatgctgatgaactcttctctaatggccttatcaaaccactatttgctggcccttccacattagagtcttgcgataccaccacaaattccacacaatccaagcctatttcttccttttcttcaagaattgtttctccaagaactgtgcaaattcatcatggtttcctcacaaagtggaaaacttctacttgtagaaccttgagaaacctttctaggtatgtcaaccaactatgccagaaagttggaagctcaaggaaaagtactaaagttgatgatattgataaagaagagtggctagttaatagcagctggagcagttcacagcaaccgtctccaaaatcaagcactgtcaatcctgttggtgctttgcttgatcatgagaactcaatctatgaagcagtcctccactgcaaaagatcaatagaaagatga

SEQ ID NO: 3214 - DNA, 909 bp, Glycine max var. Williams 82
atggaaaccacaccgcctctagccactgatagcttctcatatagctggttaccaaattgcaaaccccttgcaaatgacctcaaggagcctctaagagaatccacttacaattcctgtgaaggcaccaccaattatccattaatggaagaatggcaaaacttcaattttgatatttccatcacacagtcccctgctgttctttctcatgctgatgaactcttctctaatggccttatcaaaccactatttgctggcccttccacattagagtcttgcgataccaccacaaattccacacaatccaagcctatttcttccttttcttcaagaattgtttctccaagaactgtgcaaattcatcatggtttcctcacaaagtggaaaacttctacttgtagaaccttgagaaacctttctaggtatgtcaaccaactatgccagaaagttggaagctcaaggaaaagtactaaagttgatgatattgataaagaagagtggctagttaatagcagctggagcagttcacagcaaccgtctccaaaatcaagcactgtcaatcctgttggtgctttgcttgatcatgagaactcaatctatgaagcagtcctccactgcaaaagatcaatagaaagatgatccctcctcaaataaaaagaagaaaattgtagagctatttgaaatgggtggtagctgtttaagcatggcaactggttctttgcatcatttctctcttgttcttgaaagttatttttatttctttgcttaaacaagaagaggtgctttggcagataccaactgtggggtttataagaaatgttggattggatcctactgtttcatggttttgtatagatatgagttatagcacaaactgtgtactgtgttcatattaaagataacgacgttttt

SEQ ID NO: 3215 - DNA, 1620 bp, Glycine max var. Williams 82
atgttggagggtcgttcctgcgtggttccgaggttgtttcccagctcttgccaggcggatgacaagtggcctttcatgacatacctgccagacttggacataaagaatggcaagcgccctttagaccccgatggggaggaagaaccccagtcaaggaaggctaataggagagtggattctcaccatcaaggcaagacaactcagtttttgtttcaacaacaatcatgtcatgctgatgattctgttgttccgcaaatggattgggattggaggaagggttgtgagtcgttgagtaattggcaaagagttgagaagactgaagccttttctgcccagctattggatgaacgagagccgcattgcactggagattcattggtggtgtccactgaccttcaatccaataaacaggaggaggatcaatccgaggattcatcagattctggtgttcagcaatccaatgaacagcagatggagcaggaggtggaaggggatttgttggatgccagtgaccagcagccacttgaagatcaggaagaacatcatggtggggattcatcagattccagttctcttttgccctgcatgaactgggacaactcaattgcttgtctcagccactgttccaggtctgattatggctctctggcctcactgaataggagcttttggaacacaatccgaagtggtgagctgtacaggtggagaagactgaatggcataatagaacactggatttatttttcctgtgccctccttgaatgggaggcctatgatccaattcgtgaacggtggatgcatttaccaaggatggcttctaatgaatgcttcatgtgttcggataaggaatctttagccgtaggaactgaacttcttgtatttggcagggagatgagatcccatgtcatttacagatacagtcttttgactaactcatggacatctggaatgaggatgaatgctccaagatgcttatttggatctgctagcttgggggagattgcaattttggctggcgggtgcgatttggacggtcatatcatggactctgctgaactgtacaattctgagaatcaaacctgggtactactccctagcatgaacaagccgaggaagatgtgctctggggtatttatggatggaaagttttatgttattggtggaattggtggaaaagattctaagcttcttacttgtggtgaggagtacaatttacaaactagaacatggacagaaattcctaacatgtcccctggacgtagtgctaggggagctgaaatgccagcgacagctgaagcaccacccctggttgccgttgtaaataatgaattatatgctgctgattatgctgacacggaggtaaaaaaatacgacaaggagcgaagagtgtgggttaccattgggagactacctgagcgagcagtgtcaatgaatggttggggtcttgccttcagggcatgtggagatatgcttattgtcatcagtggaccaaggactcatggtgagggttttattgaactcaattcatgggtgcccagtgaaggacctccacagtggaatctactcgccagaaaacggtctggcaactttgtctataattgtgctgtgatgggatgttga

SEQ ID NO: 3216 - DNA, 1644 bp, Glycine max var. Williams 82
atgggaagacaaagtcctggaaaatggatcagaaacttacttctggggaagaaatcatcatcaaagtctaagtcttcaagagagaaagatatttataaaccttcaagtaacatggatgttctggtggtgtcttccgagacatccatgtctactccaacatctggagccaatgctattaaaggagtgctatcagaaaaggaagtagttagtgtatcatcaaatgatggggtaattctttcaattgaagacaaacaggacaaagcacaatcactcgctaatattggttctggggaccatcaagaaaaaatcgggcaaatagaagcagctataatagttcaggctgctattagaggctatcaggcgcgtgggacatttaaaactctcaaaagtgtcataccactgcaagcttatattcgtggcctgttggttcgacgacaagctgtttctgctttatattgtgtgcagtcaatagttaaatttcaagcattggctcgtgggtacaaggttaggcactctgatgttgggcttgcagtccagaaaatttttaaggatactaaacttccgaattttattggagtagattcaaccacacaggcagggaagctctcggatagtatctttattaacaagcttcaggcttcatcaccctcttctgtttctccaaatctcaaatataatgctggtgaacctaacttggcttgggagtggcttgatcgctggacgaaatcacacttttgggtacctcttcgagaagcgcggaaacctgattcaatgtctgataagaaaaatggaagttgtcaaatagttgaaactaacaagggtcaagttaaaagaaatgccaggaaagcaccttctgtgagggctggtgatgattcagtttcagattctaacaaacataaatgctatccgaaaaaggattcaaacctcccattgcattcagccaaggaacatccacaaaaggatcttgagaaaaggagttctaaaaaacctcaaattcagaatggttttgataaatccgaggttgctaataagaaaagaacacacatcacaagaaaagtttcagatcatacaacagtcactgatgttcaagaggatgatgctggtgctccttcaaagaagttggaaggtttggcagtgtcagagtcaaaacagtctgatcttgaaaaaagtttaggacagcaaacagaagagcatgatactaatgagtcatgtaatgatactaatgctcccttgcagtctagcttggtgaatggtaaagatggagaattcattgaggacttgaataatgtaaattcaaagaatttccagagaagagcttccctgccggctaattttgcagatcatgaaaatctgttacataataacactccaagacgccctagttatatggctcccactgaatctacaaaagctaagctaagaggacatgaacaaggctctccaaggtctgttagcgatttggcggacgtaagtagtataaccaggcggctttcactttcgtcttcgcttaatggcaagctaggttcattccctccatggtcagatagattggctgccttgagcaacaagataaggaccaacagatgtctatcatcttcaaaggatggcactgataaattgatccaacctaagtggagaaggtga

SEQ ID NO: 3217 - DNA, 1221 bp, Glycine max var. Williams 82
atggagcttgcacctgtgaagtctgaactaagtccaaggagccataggttggtcattatagatggtagtgatgttattagcactaagtgtgccaaaaggcggcgaagagattcgtctatggccgtgttaggtggcaatggacaacaaggtgaacagttagaagaacagaagcaacttggtggccaatcaactgccaccactgtgaagagaagctcaaggttcaggggagttagcagacacaggtggactggaaggtttgaagcacatctatgggataaagggacctggaatcccactcagaagaagaaaggaaagcaagtatatttgggagcttataatgatgaagaagctgctgctagagcttatgatttggctgcactcaagtactggggaacatcaactttcacaaatttccctgtatctgattatgagaaagaaattgagataatgaaaactgtaaccaaagaagaataccttgcttcattgaggaggaggagcagcggtttttctagaggtgtatcaaagtatagaggagtagcaaggcatcatcacaatggaagatgggaagcaaggattgggagagtgttcggcaacaagtacctctaccttgggacttacagtacacaagaagaagcagcccgtgcatatgacattgcagcaattgaatacagaggcataaatgcagtgacaaattttgacttgagcacctacatcagatggctaagaccaggaacacatcctactgcttctcatgatcaaaagcctagcactgatgctcaactttttgcaacctctaactccatgcaaacaagagggaacattgaggtatccaactccaacatgcattcattcccctcaggtgaattggacagtaccaagaagcgagacttttccaagtacatgaaccctttgagtccttgcaacaagccatcttccccaacagcattaggacttctcctaaaatcctcggtgtttagagaactgatgcagagaaatctgaactcttctagtgaagaagctgatgttgaattgaaatatccacaagagggcaatgatggggttggagggatttatgataatgacaacaccagtaactcttacttttgctcttctaatatcagcagattacctaacttggagtcatcagaagagtgtccattgcctatgtatcatggaactatgcaatcactatggaatagtgctttcaacatgtctaactga

SEQ ID NO: 3218 - DNA, 1869 bp, Glycine max var. Williams 82
atgttagctatggagggtaataagaagactaagcaatatggtcttgactctgccacttcttggtttggaagttgcatttcttcatgttcatcatcagaaaaagtgtcaactcacagaaagcttcctagaactgcttccgaatcatcagttaccaaccccatgaagaagcgtggaggatggaaggccataatctttattttagggaatgaaaccttcgagaggttggcagtgtttgggttatttgccaacttcatggtgtatttgacaagagaatttcacttggaccaagtttatgcttctaacattatcagtttatggtttgggatctcaaactttacccctcttcttggtgcctttatttctgatgcctatgttggtcgcttccgaaccatagcttttgcatcctttggtaccctttcgggtttgatcgtggtgagtttaacatcgtggttaccagaattgcaccctccatcttgtactcctcagcaactagcatctcgtcaatgcgtaagagcaagcagttctcaaataggtgtgcttcttatgggactttgcttcttaaccatcggatctgctggggtaaggccatgcagcataccatttggtgttgaccaatttgatccaaccacagatgaaggaagaaaagggatcaatagctactttaattggtactacaccactttcacaatggtattgttggtcactcaaacagtggtggtctatatccaagactctgtgagctggaggatagggtttgggataccaactgtgtgcatgctatgctccataataatgttctttgtgggcacaagggtctacgtgcatgtaaagcctgaaggaagcattttttctggtattgctcaagttttagtgactgcatataaaaagagaaaactcaaccttccaatgagtgaggagaagccagatggagttttttatgatcccccactaattgggatcacagttgtgtcaaagctgcctttaaccaaagaattcagggccttgaataaagctgcattaataatggagggtgagctaaacccagatgggaccagagtaaatcaatggagacttgtcagcatccaacaagtagaagaggttaaatgcttagcaagaattatcccaatttgggcagcagggattcttagtctcatttccatgactcaacaaggaacatttactgtgtcacaagcaatgaaaatgaatagacaccttggagccaaattccaaatcccagctggttctgttagtgtcatatcactaatcaccatagctttatggcttccattctatgaccgaatcctagtgccaaaactcagaaaaatgactaagcatgaaggtggtatcactctcctcctaagaattggaattggcatggtgttctctattctatctatggttgttgctggctacgttgaaaaagtgagaagggattcagcaaattcaaatccaactccactaggaattgctccaatgtcagtgttgtggctagccccacacttgatccttatgggtctatgtgaggccttcaatattataggacaaattgagttcttcaacaggcaatttcctgagcatatgagaagcattggtaattccttcttctcgtgttcttttggtgtgtctagctatgtgagtagcataatagtcaacatagttcatcattctacaagaacacatagccatccggattggttaacagatgatataaatgctgggaggctagactacttttactacctaatagctgggttaacttccctcaacctagttttttttatatatgttgcaagaagatatcagtacaagggaaatgtggacctccttgatgaaactcatcaggtagagcttggatctcacaaagcctaa

SEQ ID NO: 3219 - DNA, 375 bp, Glycine max var. Williams 82
atgaccaacaaagaatacggagacaacaacaagatatcagtttgtgagacgtcaatgttgttggtggcaaacatcatcagattatcgtctctaagattttccggccatagtttcagaaaagaccttgatcctccacaagaggaagcaacctatgtgggcaaaggcaacgaatcttcggtatcaaaattttacaagagtgacagaacacaggagccggagaggatcaaaaggcctcgttcctacctcatgaaaccaccaaaggaggatccaacaaactatgtgagtcaggcactagacgacgttgacatcaacgctgagaactatatcagccatattcgtggaaagattagggacagtggtaatattgaatattga

SEQ ID NO: 3220 - DNA, 1047 bp, Glycine max var. Williams 82
atgaatgcggaatcaccgccggggctcctcatgtcggtttcctgcctctccgactacgacctcctctgcggcgaggactcctccggaatcctctccggagagtcgccggagtgctccttctccgacatcgactcctcacctcctccgccgtcgccgacgacagaggattgttattcgatcgcgagcttcatcgagcacgagcgcaacttcgttccgggattcgagtacctgtcgcggttccaatctcgctccctggacgccaacgccagagaagaatcagttggatggattctcaaggtacacgcgtactatggctttcagcctttgacggcgtacctcgccgtcaactatatggatcggtttttggattctcgccggttgccggaaacaaatgggtggcctctgcaacttgtatctgttgcatgcttgtctttggcagcaaagatggaagaacctcttgttccatctctcttggaccttcagatagaaggtgccaagtacatatttgagccgagaacaattcgtaggatggagctacttgttctcggtgtcttagattggaggctaagatcagtaacaccactttgcttcctcgctttctttgcgtgcaaagtagattcaactggaacttttatccggttccttatttccagggcaacagaaatcatcgtatctaatatccaagaggctagctttcttgcttactggccttcatgcattgctgctgcagccatactcactgcagctaatgaaattcctaattggtctgtggttaagcccgaaaatgctgagtcatggtgcgagggactaagaaaagaaaaagtaatagggtgctaccagttgatgcaagagcttgtgattaacaataaccaacggaaactccctactaaagtgttgccgcagctgcgagtaacaactcggacccgaatgaggtcaagtactgtatcatcattctcatcatcctcttcaacctccttctccttgtcttgtaagaggaggaaattaaataaccgtttgtgggtagatgacaaaggaaactccgagtga

SEQ ID NO: 3221 - DNA, 1113 bp, Glycine max var. Williams 82
atgccatttggtttggtctcagcttggaacaagcgtcgaagaagcaagtctcaagatcattcagacccttggatttataaacctgcagagttttggcagcttgaagatcaaacaccacaacctacaaaaaggaggcatagatcatctgttttcacactcagggagatggaacaggcaacattttcattcagtgatgataatctgcttggaaaaggaggatttggcagggtctacaggggcactttgaagtcaggagaggttgtagcaatcaagaagatggagctgcctgcaattaaagcagcagagggggagcgcgaattccgagtggaggttgacttattaagcagacttgaccacccaaatcttgtttctttgataggatactgtgctgatgggaagaataggttcctagtatacgaatatatgcataatggtaacctgcaagatcatctgaatggaattggagaaagaaagatggattggcctttaagacttaaagtggcactgggagcagcaaaaggacttgcttatcttcattcaagttcttgtcttggaattcctattgttcatagagatttcaaatccaccaatgttcttctagatgccaaatttgaagcaaagatatctgattttgggcttgccaaactaatgccagaaggacaggagacacatgttactgcaagagtacttggcacctttggctattttgaccctgagtatacatcgactggaaaacttactctacaaagtgatgtttatgcttttggagttgttcttctggagcttttgacaggacgtcgagctgtagatctgaaccagtgcccaaatgatcaaaaccttgtactacagaaaaacgtgggattgggaattgtgggaatggtgttaaacggatggagatcgaggatagtagcagacccacaattcccattcgaggtgttaatggaggaactggacttcgttttctcaactcttgttgtgggctccattctcaatttcatcctcatgtatctcttggcaccaacctcctgttcttcttgttccacactatcctggatccttgccacgtgtcacttgatcataaaaatagtagttagaagtgtgtgtttaaattaa

SEQ ID NO: 3222 - DNA, 2247 bp, Glycine max var. Williams 82
ttaaaccgtcacacatttattagtttatcaggaatgtatgtatttactgttctgataagataaaaaagagagaaattttttgcatagctccaaaaatagggatcagatcatgagagagaagcatgttactgatccagttcagtacctatatatagagccatgcagctttatttgactattttctgcgtgcaacagtctctgtgagctgaaggtagtgtgcagccaaaaagatattgaagcaaacactgcagaaggggagataaaggaaactacttactaattgctctcaaaaattaaaaaaaaaaaacgtagcaatacatcaactgaagggtgtctacagttgattttactattatgaggtagacaattcacaagagtccagcttttttaattctgaagcaaaatcaccattgaaattttacatacctcagtgtgttttgggatttaattggtattgaactctgttcttcttcctggcaatttctgtctctgttggctctacttcaggactggaccatagtccaacatatctgctccaatagtttagtatatcatcaaagttaatattaaggtactcatcatagaagtaatctagatccataatttccatgaaacaaaccagagtttgacctagattgttgaactgttttatagaaacctttcctctccatcctgtaacaaacctacatagttgattcaaataagactagatgactgtggatgaagttggtagtagctcccagtggagcaaagaacaggataaagcatttgaaaatgccttggcaattcaccctgaggatgcttcagaccggtgggagaagattgcagctgatgtaccagggaaaaccttggaagagattaaacaccactatgagctcttggttgaagatgttagccagatcgaatctggttatgtgcctttaccatcttataattcttctccagagggctcaacaagccatgctagtgaagaaggagctggcaagaagggaggccactcttggaatagtaataacgaatctaatcatggaactaaggcttcaagatcagatcaggaacgacgaaagggtattgcatggacagaggatgaacacaggttattcctccttggcttggaaaagtatgggaaaggtgactggcgaagtatatcaaggaactttgtggtgacaagaacgcctacacaagtagcaagccatgcccaaaaatacttcattcgtctgaactcgatgaataaagacagaaggcgatccagcatacacgatatcaccagtgtcaacaatggagatgtttcagcacctcaaggaccaattactggtcaaacaaacggttctgcggataattctgctggaaaatcaaccaaaccagccccgccagccccaactgctgccttgggtgtaggaatatatgctggtcctaccattggacaacctataggaggacccctcgtatctgcagttggcaccccagtgatgaaccttcctcccccagcacacatggcatatggtctcggagcaccggttcctggggcagttgttcctggagcaccaatgaacttaggtcctgtgccataccctatgccacatacatctgctcgtagatgaagttatgttcagaggcctaatgtacaaaaagaaaacagcagattagaaggcttatgaatttaatgtaattctttacctattcctatagctgcttatgtgcaacagttttatgctccatcaattatttcaaataagggatactaagaagcattagaatgtatctacattggctgccatggatggaatatctgacagccttgacataccacagcgtgaaagtaatgttgtcgttagtcatataaagtggcccattctgtagatgaaggttctgtggcaggcttatgaatttaatgtaattctttacctattcctatagttgcttatgtgcaagagttttatgctccatcaatttcaaataagggatactaagaagcattagaatgtatctgcatcggcttccatggatggaatatctgacagccttgacataccacagcgtgaaagtaatgttgtagttagtcatataaagtggcccattctgtagaggaaagttctgtggctttggtatgttattgttgtattttgatcacttggtttctgattttccgtagggtcttctaaatttcccatctagcttcccttattatcagattagttgctatgattgattgacatgatatattatagcagatatttgtccattctg

SEQ ID NO: 3223 - DNA, 627 bp, Glycine max var. Williams 82
atgttttgcttcattttttgtgtatcaattaaattcatatctgaaaccgaaaacatcacaggtgtagttatcgtggtcatgggtgtcagcggtgctggaaaaaccacaataggtcggaagctggaaaaagagtcgaaatataagtatcttgatgctgatgattttcactcagaatcaaacaaagaaaagatgcgtatgggaatcccacttacagatgaagatcggatgccatggtttgaatcgctacgcgatgccataaaagaatacttaaataacaaaaagggtctgattcttggctgttctgctttgaagaaggaatatagagaaattcttagatcaggtgaccttagttataaatgggggacttatgcaagtgctgtcaacttcattctgttggatgctcctgctgaagtgctgagtgttcgagtaaataagagagctgcagaaggaaaacattatatgcctgcatctcttctgcaatcacagttagatttgcttgagattgatgagtctgagggagtacttagagttgacgctactttgagaccccaagccattgtaaacaccattctaaacatgaaccagtttcagggatgtttcaatgttgattttgtggagcctcattga

SEQ ID NO: 3224 - DNA, 2493 bp, Glycine max var. Williams 82
aagtgctctccttatataagcatagccgtcacttgttttattggcaacgcaaagaaaagaagcactcttgtgttttgtctctctacctctctcactactctatagtactctctcaatttctgttcacattctaccaaaatgagtggcttgagtttcaggggcttcacatacatgctcctcattgcatttctcatttggtccttcaattttgaagcctgcattgcaagaagaggcaagcactggagacaaagcagggatgtctcagcttctgtgtacaagaaaaaaggcaaaaattatggcaatgctcacaacaagtaccatggtggaggatcaaaatcaaagcctccatcatcacacaaaggcacaccaacattaccaaagcctccgccacaacataaaaacactccctcaccaccatatccaacaccaccaagtgatgatacccccacaactccaccaccaaaggcttacaatggtggtggccattcttccgccaccaccttcaatgtgctagattttggagccaagggagatggaaaatctgatgacaccaaggcatttcaagaggcttgggctgaagcttgtaaaattgaatcatcaaccatgctcgtcccagcagactacgcattctttgtagggcccatttcattctcgggcccatactgtaaacccagcatcgttttccagcttgatggcaccattgttgcaccaacaagccccaaagcttggggcaaaggacttctacagtggttggaattttccaagttggtaggaattaccatccaaggaaatggcatcattgatggaagaggctcagtgtggtggcaagataatcaatatgatgatcctatagatgatgaagaaaagctcattgtccctttaaaccacacagtagggagcccaagtcccccactgccgattcaaagtgagatgggaggaaaaatgccatccgtcaagccaactgcattgcggttctatgggagttttaatccaacagttacaggcattacaattcaaaatagtccacaatgccacctcaagtttgacaactgtaatggggtcatggtccatgatgtgaccatatcatctcctggggacagtcctaacacagatggaattcaccttcagaactccaaagatgtgttgatatacagcagctctatggcctgcggagatgactgtatttcgatacaaactggatgctcgaacatatatgtacacaatgtcaactgtggaccagggcatggaatcagcattggaagtctaggaaaggataacaccagagcctgtgtctccaacattactgtcagggatgtcaacatgcacaacacaatgaatggtgtcagaatcaaaacatggcagggtggatcaggttctgtacaaggagtgctattctcaaacatacaagtttctgaagttgaactcccaattgtgattgatcaattctactgcgacaaaagaacctgcaaaaaccaaacgtcagctgtgtctcttgccggaatcaactatgaaaggataagggggacatacaccgttaagccagttcactttgcctgcagtgataacctaccttgtgtagatgtttctctaacctctgttgagttaaaaccaattcaagaacaataccatctatacaatcctttctgctggcagacttatggtgaattgaaaactccaactgtcccaccaattgattgcctacaaattgggaagccaactaacaatcggattcagacagatcatgatttatgttgatcagatatgaattcaagtgcttagcctgctagataaatatgtatattgtaaaaatcctactatataggaaattttcttcattagggtgatactgatttatcattgtgagaatataccggccctgctattagcaagaggtcgagaatagtataataggcagtcttctagctgtggcatattgcaagagtgtgagatattatacaagttttagcatctatgaataaaatatctttatttatacaatgtcagaactatggaatttcaattaaaggaaaagtcaaaaacaacataatatgctgcagtcagtcagcattttaagttgcagtctgcaatgctattgtggctcacagtttgagaggttacattggccacatttgcctgtaatttttcacaaattaaaaccaaggctgcagtatatagacaatgagaaacatattgtaaagcaaataaaaagtagccacgcataaacacacacacagatgacatcaaacataagtaatggatagtgaggaaaattcaaaatacttattttcaactcctaggaagcaaataaggttagttgagatagataagaactcggtttcctacaagaaaagaggaggtatcttttctagtgtaagatagaaactggttcaggttgagcacacaaagaacacactgttattgatgaacagaaagaatgcacaatttccatggatattcaagagatccaggactctccctagccacaatactaac

SEQ ID NO: 3225 - DNA, 2397 bp, Glycine max var. Williams 82
atggatgcaaccgagacagaaaaaatctacgttgcagttggctatgatattgtagatggatttcaaactttgagttgggcgatgaagaaatggaattcccatccttgctctattgtcattcttcatgtgaattacaacacttccaagaaatatgttcccacactcctcggaaaactccctgcaaaaggcgcgtctgaaaagatactggaacgtatccggaaacatgagcaaaggataatccagaagctcctttccaagtatatagctttatgtgacaatgtgccagctgaaacacttgaagttgagaaatttgatgagccaatggaaaagcgcactatagacttgatccatggtctaggaataacgaaattgatcatgggattttcattcatgaagccttccttgaaatcggaagttgacgttaacggattgttctacgttaatcagcacaagccacccttttgtgagttgttcgttatctttggagggaaacaagttacacctcgagtgaagaatgacgagataatcatggaggatgataatgggttcaagattgccagcatgagagataagataaattgtatagattggctagagagaatgttctttgataaaaccattgacacccaacatagaagttcttgcgcaccatcatcatcttcaacaaatttcgagccgtatcttaaccaaaacgaatggaaatttagtttccaagaaattgaaaattatgcgcaggagttaatgtctttaaatttggaggaaggaagttctggccaagacaaccatgtttcccactttaacccagttgagccatatgtcaaagaacgtaacagttcgaataacatgagtgccgcagaaaatattgacatactcaaagataaagtgaatgaagcttacagaaccatccaattaaaaaggaaagaagacgaggccaattgggagagacatgaaaaagctgaatgggctatttatttgtgtaaccgtcgggaagaagaacttgaatatctaataaaggaagaagtgacaagaaaggaagaactgaggaaggatctggatgcagaaaaagaacaatttcacaaaattaaaatggatattgaggatagcaagaaaaagcttagtttagtggcagagcaacaatcagagctcctaaacaggcttcatatttacacattggcagtgccacaagctgaaaccaaactagggaaggcattggctgaaaagacagagatgcttatggagatggatggtctaaggaaacaaaggaatgcaatgaatagaagcattgaattttttcagagaaaaagatgccacaagaatgagtgtaggctgatagaaaagggttgtggtttgagggagtacacaaaggaggagatcaccttagccacccaaaacttttcagagcaaatgaggttgaaatcggatgggaattggaccaatgtgtacagaggacaaattaatcattccactgttgcaatcaagatgctcaatcatgttcctgacttgtcccaactagatttccaagccaaggtgaggaatcttggtaaaattcggcaacctcatctggttgctatgttgggcttttgctctgagcccaaatgcttagtattggaatacatgaacaatggcagcttggaagaaatgctattttgcaagagcaaaaaccgggtcttaagttggcgtgattgcataaggatagccatagaagtttgctcagggttgggctttctaaatgcagctcagcccaagcccattgttcattgtcatccttctccatccaaaatcctcctagattgcaatcttgttgcaaaaataacaggttttgggcttcatgggtgcagtgaagagtgtaatgataattcatcagatatgaaggcaataggggttttattgcaaaatctattgaatggaagaagaaatttggtgacaatggatacagaggcttgttttgatgagattggtgagcaatggccatttgatgtggcaagagatgttatgggcttagctatgcggtgcatgtccatgaattgtgagcccaatggagaaatgagcataacaagagtcgtggaggagctcaatgagatcagaaaaaagggtgatgacatggttgctagggaaggatggaggaatataaatgggggaaacgtacatggacaagattctacccatgtgcctagtgttttcatttgccctatccttcagagaataatgaaaaatccacatatagcagcagatggattttcttatgagctagaagcaatagaagagtggttgcaatcggggcatgacatatcacccaaaaacctgaagctgaagcacaaattacttacccctaatcataccctccgttccctaattgaggactggcaaggcaagagatcagctaaagttgcaaattaa

SEQ ID NO: 3226 - DNA, 2397 bp, Glycine max var. Williams 82; identical to SEQ ID NO: 3225

SEQ ID NO: 3227 - DNA, 615 bp, Glycine max var. Williams 82
atggatttgattgtcaagataggaaatctacctcttgaccttttgtgggctctcaagttactaaaaaaagcacttgattttaggaagaaggggtggcctttgggtttgagactattgaatggaagaaatggtgatttctctggatcagtctccttcagcagaatcagcactatcctcactgcttctcccaccccttcaactgagtcttcctcagatcttgactcacagtcgacaggatcattcttccgcgacaagagtatcactcttggcagccttattggtatttctagcttcctagaactctcaaggagatcaaccaggggaagaatgctaactactgatgcagtgagcgtgaatgttgctccctctcttggtcactatcttgtggcagagagaagagctgaaagtactcacagaaggaataatcaatgttcaaccatttatggacctaatgatttcttcccaattcgagagtcaaactcgctatttgttggtggccaaggtgctcatagttcatcgacttcattaggtgaagattgtggaagagagccaaataaagtattggatcaaagcaatggatatgcagcgccaataatttgttgcgtgtgcagataa

SEQ ID NO: 3228 - DNA, 2040 bp, Glycine max var. Williams 82
atggttttcttcgcctccgtttcaaactctaatcaatgccgaaaacaaaccttgttgtttatatttaccatcttcactttgttccatacactctttaccactgtagtatccctttccttcaactcttcaaccttccaactaaactcaaataatctaatagactttaagggtgatgctttttcctcaaatggtgttcttcagctcacaaagaaccaaattgatgacaaaatcacattcagcgttggtcgagcctcgtataaccaaccagtgaggctttgggatggaagaaccaagaagctcactgatttcacaacccacttttcttttgtcatgaaagctattgacccatcacggtttggtgatgggttagccttcttccttgcaccatttgattctgtcctcccaaacaattcagctggtgggtaccttggcctattcagcaatgaatccgcattcaacactaagaaaaatcagttagttgcggttgagttcgacagcttcaaaaatgaatgggatccgagctctgatcatgtaggaatcaatgtcaactccattcaatctgttacaaatgtcacttggaagagcagcattaagaacggatcggtcgctaatgcctggatatggtacaactctacaaccaaaaatctctctgtgttccttacttatgctaataatccaacttttaatggcaattctagtctttggtatgtcattgacttgagggacgtgttgccagagtttgttagaataggcttttcagcggccacaggttcatggattgaaatacacaacattttgtcttggtcattcagttcaagcttggatgagggtagtaggaaaaaggtgaaggttggtttagtggttggtttaagtgttggtttgggttgtttagtttgtgttgtaggcctattatggtttacgttttggagaaggaaaaataaaggaaaggaggacaacttaggtgttgatgcttctatagatgatgagtttgagagaggaactggcccaaagaggttcacctatccagaactaagcaacgcaaccaacaactttgcagaagaaggaaagctaggagaaggaggatttggaggtgtttacaaaggcatagttgtacactccaaccttgaagtggcagtgaagagggtttcaaaagggtcaaaacaagggaaaaaggaatacgtgtcagaagtgagagtaatcagccggctgaggcatagaaacttggttcaactcatagggtggtgccatgaacaaggtgagctccttcttgtttatgaatacatgcctaatggaagccttgattctcatctgtttggaaatagagtcatgctttcatgggtggtgagacacaaggtggccttaggtttagcatctgctcttctttatcttcatgaagagtgggaacaatgtgtggtgcatagagacatcaagtcaagtaatgtcatgttggatgcaaatttcaatgccaaacttggtgactttggtcttgcaaggctagtagaccatgaacttggttctcaaaccactgttttggcaggcacaatggggtacctagcccctgagtgtgtcaccacaggaaaatccagcaaggagtctgatgtgtacagctttggtgttgttgcacttgaaatcacatgtggtagaaaaccagtggaagtgagagaagaacctagtaaagtaaggcttgtggagtgggtgtggagcctctatggaaaagggaaactacttgaagcagctgatcagaaactgaattgggaatttgaagaacagcaaatggaatgtttgatgattgttgggttgtggtgttgtcatcctgatcataccatgaggccctccattaggcaggtgattagtgtcctcaactttgaagcccctttgccaagtcttccatccaagttgcctgtgccaatgtattatgcacctccaatggatatgtgcaaattctcctacacttcatctggtgttactagcacaaccaaagcatcttccccatactcatcaatctcggaagggtccggaaaatctctattaaagcactaa

SEQ ID NO: 3229 - DNA, 273 bp, Glycine max var. Williams 82
atggctgatacaggtggaggagatgcagtgagaccagtggtaatatgtgataacaagtgtggctgcacacttccatgcactggtggttccacttgcaggtgcacaagtgctggcactgccacaggagggggtgccacaggagggggtgatcacgtgacatgctcgtgcggagagcactgtggttgcaatccatgctcatgtcccaagattgcggctgctggaagtggttgcagatgtggcacagattgtgcatgtgcctcctgccgcacttag

SEQ ID NO: 3230 - DNA, 1404 bp, Glycine max var. Williams 82
atggctatgcttcttctcattccactgttcctatcatccattttactattcccaatatcaagcgcaacaacgttctcaccccaacccggaatctgctacggccagctcggagacaaccttccaccgccgcgagaatctgtctccctcataacctccgtccatgcgaagcgcgtgaagctctacgacgcgaacccatccatcctccacgcgcttcaagacacgcgcctgcaagtttccatcatggtccccaacgacctcatcttgaacatctccacgaaccaaaccctgtccgaccagtgggtctccgacaacgtcgtaccctaccacccccgcaccctcatccgctacctcctcgtcggcaacgaagtcaccagcaccaccgcggccaccgccacgtggccccacctggtccccgccatgcgccgcatcaaacgctcactgaaatcccacgggatccgcaaaatcaaagtcggaacctcatccgctatggacgtgcttcaaacctcgttccctccctcaaacggtgcgtttcgcaaagacctaactgcccccgtcatgaaacccatgttaaaattcctcaaccggaccaaatcgtttttcttcttagacgtgtaccctttcttcacttggtccgctgaccccttgaatataaaccttgattacgctttatttgaatccaaaactgtaaccgttaaggatccggtttcgggtttggtttacactaacctgtttgaccaaatggtggacgcggtttattttgcgatgaagagattaggttttccgggtgttcggatctttatcgcggaaacgggttggcccaatggaggcgacttggaccagattggagcaaatacttacaacgctgccacttacaaccgaaacttcataaagaaagtcactaaaaaaccgcgggtggggacaccggctcgaccgggttcggctcttccgtcttttttattcgccctcttcaatgagaatcagaaaccgggtccgagtacggagcggcatttcgggttgttgcacccgaacgggtcgagggtttacgacgtggatttgtccggggaaacgccggaggcggagttccggccgcttccggtgccggagaataatgaaaagtttaaggggaggatatggtgcgtggcggcgcgccgggataacgcgacggcgctgacggcggcgcttgcgtacgcgtgctcgcaggggaatggcacgtgcgacccgatccaatcgaaggggaagtgttttaaacccgattcggttttctggcacgcgagctatgcgtttagtgcttattgggcgcagtttaggaaggttggcggaacttgttacttcaatgggcttgcaactcaaaccgcaaaggatccaagttatggatcctgcaagttccctagcgtgacactttga

SEQ ID NO: 3231 - DNA, 2454 bp, Glycine max var. Williams 82
atgacctccttgacttaccttaacctctcttgtgggggattcaatgggaagattcctcatcagattgggaatctttctaatttggtctatcttgacctgagctatgcagccagtggggaagttccatatcaaattgggaatctcacaaaattgctttgtcttggtcttcaaggtttagactttctatttgctgaaaatcttcactggctttcaggtctttcccagcttcagtatcttgaattgggaagggtaaacctttcaaaatcatttgattggctacagactttgcaagctcttccttctttgatggagttacgcttgtcacaatgtatgatccatcgttataatcatccatcctcaattaacttttcttctttagccactcttcaactttcctttatttcttcaccagagacttcttttgtccccaagtggatatttggactcagaaaactagtttctcttcaattaaatggtaacttccaaggcttcattcttgatggcattcaaagccttacacttcttgaaaatcttgacttgtctcagaattcattctcatcttctatacccgattcgttatacggtcttcatcgtctcaagttcttgaacctacgatccagcaacttgtgtggcactatttctggtgtcctgagcaatttgacttctttggtcgaacttgatttgtcatataatcagcttgaaggaatgattccaacttatttgggaaatttgacttctttagttaggcttgatttaatggatttttctaacaactcaattcatggtgcacttcctagatcattgggaaaactttcatcattacgcattcttgatctttcccaaaatcaattctatggaaatccatttcaggttcttagatcacttcatgaattgtcatatctttcaattgatgacaatctgtttcaaggaattgtcaaagaagatgatcttgcaaatcttacaagtttaaaagcttttttggcatcagggaacaatctcactttagcagtgggtcccaattggctccctagctttcagctatttgaattgggcatgaactcgtggcaattgggtcctaattttccatcatggattcactcacaagaggctcttctatcattggaaatttctaacacagggatatcagattctatccctgcttggttttgggaaacatgtcatgatgtttcttatttgaacctctctaataataatatccatggcgagcttccaaatacattaatgattaaatctggtgttgatctaagctcaaatcaattacatggaaaattaccccatctaaatgattacatccattggttagatctttcgaacaattcattctctggatccctgaatgatttcctatgtaaaaagcaagagtcgttcttacaatttctcaatcttgcatcgaataatttatcaggggaaatacctgattgttggatgacgtggccatatctggttgatgtaaatttacaaagcaataactttgatgggaacttacccccatccatgggttcattaactcagctacaaactttgcaccttcgtagtaactccctctcaggaatatttcctacctttttgaagaaaacaaatatgttgatttgcttagaccttggggaaaatagccttacaggaactattccaggatggattggagaaaagctcttaaacttgaagattcttcgccttccatcaaatagatttaccggtcatattcctaaagaaatatgtgatatgatttttcttcgggatttggaccttgcaaaaaacaatttgtttggaaacataccaaattgtttaaacaacttgaatgccatgttgattaggagtagaattagttcactcatatgggtgaaaggaagaggtgtagagtacagaaatattcttggcttggtgacaaatgttgatctttctggtaataatttatctggtgaaattccaagagaacttacagatctagatggacttatttttctaaacttgtccatcaatcagttgagtggccaaatcccactaagtatagggaatatgagatcattggaatccattgatttctcattcaataaactttcaggagatattccttcaaccatatcaaacttgagctttctcagcaagcttgacttgtcttataatcatttagaaggggaaattccaacaggcactcaaattcaaacctttgaagcatcaaactttgttggaaacagtttgtgtggcccaccactacctatcaattgcagttctcattggcaaatatctaaggatgatcacgatgaaaaagagagtgatgggcatggagtgaattggctctttgtgagtatggcatttggattttttgcgggatttttggtagtggttgctcctttgttcatttttaaatcatggaggtatgcctattatcgtttccttgatgatatgtggctcaaaatggagtcttgttggtga

SEQ ID NO: 3232 - DNA, 1893 bp, Glycine max var. Williams 82
ttgcttctttctttcaaatgttcatcttccctattgtcactgaacaaggggtctttcctctcagtggagaaacacgcagaagacgttattgtttcccaaaatcaaatgttctgtgctggcttctctcaagttcgtgaaaatgccttctcctttgatatatggttcaacgagtcccacactcataacaacagcaacaccgtggtttggattgcgaatcgcgaacaacccgttaacggaaagttatcaaagatttccctcttaaacagtggtaaagttgtcttggttaatgcaggtcaaatcatcacttggtcatcaaacacagcaccacatgccccagttgagttgcatctccaagatgatgggaatcttgtgttacgtgagctccaaggaaagatttgtggcaaatttcgattccacaaccgatactcttcttcccgccagactaacctttcttctggtttctataagctgctctttgacgatgacaacgttcttcgtcctgtttatgatggttctgatgtttcaagcacatattggccacatccttggctaagaagttgggaagctggaaggtttaattacaacagcagcagagttgcagtgttagattctcttggaaatttcaattcttcggatagttatgccttttccacggatgatcatggcagggtgatgccaagaagattaacacttgattctgatggtaacgttcgtgtgtacagtagaaatgaggctctaaagaaatggtacgtttcatggcatttcatatttgatacttgcaccattctcgggatctgtggcgctaacagctctagtaattatgatcctcaaaagcaaagaagatgctcctgtctaccaggttacagagtaaagaatcacagtgattggtcttatggagatgatggggacgaaggctatagctgctatacaaagatactgctgctgaatgggaggcgttctcaaagatttaaaggaacaatttacttgagactgcctaagaacaaaaacttctccagggaagaatctgtgagtgcagatgatcatgtttgttctgtgaagcttcccagagacaatgttagaaagccagcaaatcctttggaactgatttgctttttcatgatttggagtttcttgatttggaaccgccaaaagtccggtgcagatcagcaaggcctccatcttgcagaagtaggaatcagaaaatttagtcattttgaattgaaggaggcgataaaggggttcagccaagagattggagggggtgcaggaggggttgtgtacaaagacattttatctgatcaaagacatgctgcaattgaaagactctatgataccaaacaaggagaaggagaattccttgctgaagtgagcatcattggaaggctcaacctcatgaacttgattgaaatgtggggatattgtgctgagggaaagcatagattgttgcccaaggtagcagattttggcttgtccaagctacttaacaaaaataacctcaataacaattcaagcttttcaatgatcagaggaaccagagggtatatggcacctgagtggatttacactttaccaatcacctcaaaggttgatgtttccagctttggaattgttctcttggagatgataactggaaaaagtccaacaatggacattgaaacggttgatggaacagagccacacgatggtaggctggtaacatgggtgagagagaaaaagaggagaacatcttggatagagcaaatattagatccttcaattgaaccaagttgtgatgtgaataagatggaaattttggctacagttgctttcgactgtgttgaggaagacaaagatgttaggcctaccatgaagcaagtgattgagatgcttcaaagctatgaaagtgatgcataa

SEQ ID NO: 3233 - DNA, 777 bp, Glycine max var. Williams 82
atggctgctattgttttcctccacattgcatcattggcctctctttttgttgcaacaagtgcaagaatccctggagtttacaccggtggcccctggcagagtgctcatgccaccttctacggtggcagtgatgcctctggaacaatgggtggtgcttgtgggtacggaaacctgtacagccaaggctacggagtgaacactgcggcgctgagcactgccctgttcaacaacgggctgagctgcggcgcgtgcttcgagataaagtgcgaccaggatccgcggtggtgcaaccccgggagcccatcgatcctaatcactgcgaccaacttctgccctccgaacttcgcccttccgaacgacaatggcggatggtgcaaccctccccgcccgcacttcgacctcgccatgcccatgttcctcaagatcgcccagtaccgcgccggaatcgtccccgtcgcttaccgccgggtgccatgcagaaagacagggggcatcagattcacaatcaacggtttccgttacttcaacctggtgctgatcaccaacgtcgcgggtgcaggggatatcgtgcgcgtgagcatgaaaggaagcaaaaccgcgtggatgagcatgagccgcaactgggggcaaaactggcaatccaacgcggttttggtgggtcaggccctctcctttagggttaccggcagtgaccagcgcacgtcaacctcctggaacgtggcaccacctaattggcagttcggacaaaccttcacaggaaagaatttccgtgtctaa

SEQ ID NO: 3234 - DNA, 1731 bp, Glycine max var. Williams 82
atggatttcccccactttccttcatttgcatctctcagagttcttctgttttgtttctgcgttatgacattgtttcctgagtttgtagtgagcataacaaggcactacacctttaacgtcgagtacctgaacgtcactagattgtgccacacaaggaatattctgagtgtgaatggaaaattcccaggacctcgcttggtggcaagggaaggcgatagggttgtggttaaggtggtcaaccatgtctcaaacaatgtaaccattcattggcatggcatccgtcaaatgacaactgggtgggctgatggaccagcatatgtgacacagtgtcctatacaaaccaaccagtcatacacatacaacttcaccatcgttgggcagagagggactctgctttggcatgctcacatatcatggctaagagcaaccatttatggacccatcatcatcctccccaagcagaacgagtcttatccattcgagaagccacacaaagaaatccccattctttttggggaatggtttaatgttgacccagaagctgttataagtcaagccttgcagacaggagggggacccaatgtttcagatgcatacaccattaatggacttcccgggcctttgtataattgttcttctaaagatacatacacactaaaggtgaagccaggcaagacatatctgctaagactaatcaatgctgcactcaacgaagagcttttcttcagcatagctaaccacaccctaactgtggttgaagcggatgccaaatacaccaaaccatttgacacagacacactcctcatagcccctggccaaaccacaaacgtgtttctcaaaaccaagccatattttcccaatgccacattccaaatggctgctaggccttatttcacaggccgtggcacctttgacaactccacaaccgcaggtaccctcatctacaagcaacattccaatgtcaaaaatctcacccttctcaaaccaactttgccaccaataaacgccacaagctttgtggcaaacttcactgcaaaattcagaagcttggcaagtgctaaattccctgtcaaggtacctcaaaaagtggacagaaaatttttcttcactgtggggctagggactaatccttgccccaaaaacacaacatgccaagggccaagtaataacaccaaatttgcagcctcagtgaacaacatttcttttgcacttccatcatctgtttccatcatgcaggcatactattctagccaggccaatggggttttcaagactgattttcctgccacccctttgaaccctttcaactacacaggaacacctccaaacaacacaatggtcaccaatgacacaaagctggtggtgctcaagtttaacaccagtgtggagttggtgctgcaggacactagtattcttggggctgagagccatcccttgcatcttcatggttatgacttctttgttgtggggcaagggtttggaaactatgatcccaacaatgaccctgcaaggtttaatctgattgaccctgttgagaggaacactgctggtgttcctgctggtggttggattgctattcgattctttgcagacaacccaggggtgtggttcatgcactgtcacttggacctccacacaagttggggattgagaatggcatggctagtactagatggacctgagcccaaccagaagcttcaaccacccccttctgatcttccaaaatgttga

SEQ ID NO: 3235 - DNA, 801 bp, Glycine max var. Williams 82
atggcagaaacaaagttgagctccttcaaagacaaaagatggtcactccatggcatgacagctctagtgacaggaggcacacgaggcatagggtacgcaatagctgaagagttagcagaatttggggcagctgtgcatatttgtgcacgtaaacaacaagatattgataaatgtttagaagaatggaataagaaaggacttcccataacagggtcggcatgtgatgtactatctcgtgaccaacgtgaaaatttaatgaaaaatgttgcttcaatctttaacgggaagctcaacattctgataaacaatgctggaacaactacacctaagaatctcatagattatactgcagaagatgtaacgacaataatggaaactaattttgggtctagttaccacttatgtcaactagcacatccacttctaaaagcatctggatatgggagcatagtgtttatatcctccattgcaggtctgaaagctttgccttacagttctgtgtatgcatcctctaaaggagctatgaatcaattcactaagaacatagcattggaatgggcaaaggataatattcgcgcaaatgctgtggcaccggggactgttaagactgtacttctggattctatcatgaaagctgctgctgaagctgataaagccgttgagtatatagtgtctcaaacaccagttggtagacttggagatcccgaggacatatcaccactggttgctttcctttgccttccagctgcttcatacatcactggccagattattactgcggatgggggttacataatttaa

SEQ ID NO: 3236 - DNA, 678 bp, Glycine max var. Williams 82
atggcagctggtcaggaagatgtgaagcttttgggagttgtgggaagcccatttgtgtgtagggtccagattgccctcaagttgaagggaattgaatacaaatttgtggaagaaaatttggccaacaagagtgatttgcttcttaaatccaacccagttcacaagaaagttccagtttttattcacaatgagaagcccatagcagagtctcttgtgattgttgagtacattgatgagacatggaagaacaaccccatcttgccttctgatccttaccatagagccttggctcgtttctggtccaaattcattgatgacaaggtttttggtgctgcatggaaatctgttttcactcttgatgagaaagagcgtgagaagaatgttgaagaatcattggaggctcttcagtttcttgagaatgagttgaaggacaataagttttttggaggagaggaatttgggttggtagatattgcagctattttcatagcattttggattccaatttttcaggaaatagcagggttgcagatattcacaagtgagaaattccctaagctctacaaatggagccaagagttcatgagccaccctgttgtgaaagaagtccttcctcctagagacccactttttgccttcttcaaggcccgctatgaaagtctttctgcttcaaaatag

SEQ ID NO: 3237 - DNA, 765 bp, Glycine max var. Williams 82
atgattgcactcaaatcccttcatcctttcttcactcctaccaatatcaaatatggtatcaaccgaagcagatgcctcaacacaaaaggttctgttttgtgcctctgcaagtccaatgaatctgaatctcaagctccccaaccaggagatattcgtaaacaagaactgctagcccaaattgccatgcttcaaactcagaaagtccgtctcacagattattttgatgagagatctgaatacttaacccagtttggtgaagaagccaaggccgagtttgacaagattggaaaagatgccctccaaggattagatgaagctagtgccattataacagcaaacatagagagccagatggtggagtttgaggaatctgcagaacttaacagacaagagattcaggagcatgaaaaagaactaggtgaatttgaagttcaaatggaggatggaagaaatgaagggctgttctttaagaacctcagaaggaggacacctgttgacaaatcaaaagccaaggaggaggcagagaaaatcaaagatgtagccagagaaaaagctggtagcagaacaaggaaaggcttttacctcctctttattggcctactgacctttgcaatagttgattctattgcctcatcatcaactgattggaaaaaaatagcagttcttggagctactcttgtggctttagtttctcagttcatctacgaacagaatgtcattagaaactggagaaaaaagaaagaccgacacagaagaggaaaataa

SEQ ID NO: 3238 - DNA, 3291 bp, Glycine max var. Williams 82
atgatgttcatatttcctacccttcaatccatgaagcttccatcattttggcttcttctgattgtaatgttgttttgtgcattcactgtggccacttctcgccatgcaactataccatcctctgcatcactcacattacaacaaactgaagcaaatgctttgttgaagtggaaagccagtcttcacaaccaaagtcaggctttgctatcttcatggggtggcaatagtccttgcaattggcttggaattgcttgtgaccacaccaaatccgtctccaacataaatcttacacgcattggattaaggggtacgcttcaaactctcagtttttcatcacttccaaacatcctcactctagatatgagtaataactccttgaatggaagtattcctccccaaattaggatgttgtcaaaactcactcatcttaatttaagtgacaatcacctctctggggaaattccatttgaaataactcagttggtcagtcttcgtattttagatttggcacataatgctttcaatggttctattcctcaagaaataggtgcattaaggaatttgagagagctcactattgaatttgtcaatctcaccggtactatcccaaattctattgaaaacctatccttcttgtcatatctttctctttggaattgtaatctcacaggggcgatcccagtttctataggaaagttgaccaatttgtcatatctagatcttacacacaacaatttttatggacatattcctcgtgaaattgggaaattgtcaaacttaaagtatttgtggcttggaacaaataactttaatggttctattcctcaagaaatcgggaagttgcaaaacctagagattctacatgttcaagagaaccaaatatttggccacattcctgtggaaattgggaagctagtcaacttgacagaattatggcttcaagacaatggtatttttggttccattcctcgggaaattgggaaaaatttaatccaattttctgcttatgccaatcatctatctggttccattcctagtgaagtgggaaaactccattctcttgtcacaatccaattgttagataataatctctctgggccaatcccatcttccataggtaacttggtcaatttggactcgattcgccttgaaaaaaacaaactctctggatcaattccttccactgttggtaacttgacaaagctcaccactcttgttttattctcaaataagttcagtggaaaccttccaatagaaatgaacaagcttaccaacctggaaattttgcaattatctgataattatttcacaggtcatttacctcacaacatttgctatagtggaaagttgacacagtttgctgccaaggttaactttttcacgggcccagtaccaaagagtttgaagaattgctctggccttacaagggttaggcttgaacaaaaccagctgacaggaaatataacagatgattttggtgtttatccgcatctggattacatcgacctgagtgaaaataacttttatggccatctttcccaaaactggggaaagtgctataatctcacaagcctcaaaatctccaacaataatttatcaggcagtattccaccagagctaagtcaggcaaccaagttacatgtacttcacctgtcttcaaaccatctgacaggaggcattccagaagattttggtaatttgacctacttgttccatctttctctcaataacaataatctttctggaaatgtccctatacaaatagcatcattgcaagatcttgcaaccttagaccttggagcaaattattttgctagcttaattccaaatcaacttggcaatttggtcaagttattgcatttgaatttgagccaaaataattttagggaaggtattccatccgagtttggtaaattaaagcatctccaaagtcttgatcttagcagaaactttttgagtggaacaataccaccaatgctcggagagttgaaaagcttagaaacattgaatctctcacacaataatctttcaggtgatctctccagcctcggcgagatggtaagcttgatatcagttgatatatcatataaccaattagagggttcacttccaaacattcaattcttcaagaatgctacaattgaagcgttgagaaataataaaggcttgtgtggcaatgtctctggcttggaaccatgcccaaaattaggtgacaaatatcaaaaccataagactaacaaagtcatattggtgtttttacccattggtttaggcactttaatactagcattatttgcctttggggtctcatactatctttgtcaaagttcaaagacaaaagaaaaccaggatgaagaatcactagttcggaatctatttgcaatatggagttttgatggaaaactagtgtatgagaacatagtagaagccacagaagattttgacaacaaacatctcattggggtcggaggacaaggaagtgtttacaaagcaaaattgcacacaggtcaaattcttgccgtgaagaaactccatttagtccaaaatggggaattgtccaatattaaagctttcacaagtgaaattcaagctttgataaacattcgacatcgtaacattgtgaagttatatgggttttgttctcattcacaatcctcatttttggtgtatgagttcttggaaaagggaagcattgataagattttaaaagatgatgaacaagcaatagcatttgattgggatcccaggattaatgccattaaaggtgtagcaaatgctttatcttatatgcatcatgactgttcacctccaattgttcatcgagatatatcaagcaagaatattgttttggatttggagtatgtggctcatgtctcagattttggagcagccaggcttcttaatcctaattcaaccaattggacctcatttgttggcacttttggatatgctgctccagaacttgcatacacaatggaagtgaaccaaaaatgcgatgtgtatagctttggggtattagcattggaaatacttcttggagagcaccctggagatgttataacttccttgttgacatgttcatcaaatgccatggcgtcaacacttgatattccttcattgatgggtaagttagaccgacgcctcccttatcctataaagcaaatggctacagagatagctttgattgcaaagacaacaattgcttgcttgactgaaagccctcattctcgtcccaccatggagcaagttgccaaggagcttggaatgtcaaagtcatcttcagtgcattaa

SEQ ID NO: 3239 - DNA, 3309 bp, Glycine max var. Williams 82
atgcataaacttcataccaatctcggaaaccatatctttgattgtattagacaatcattgattgttgaatacccaataccaccaatgatgttcatatttcctacccttcaatccatgaagcttccatcattttggcttcttctgattgtaatgttgttttgtgcattcactatggccacttctcgccatgcaactataccatcctctgcatcactcacattacaacaaactgaagcaaatgctttgttgaagtggaaaacaagccttgacaaccaaagtcaggctttgctatcttcatggggtggcaatactccttgcaattggcttggaattgcttgtgaccacaccaaatccgtctccagcataaatcttacacacgttggattaagcggtatgcttcaaactctcaatttttcatcacttccaaacatcctcactctagatatgagtaataactccttgaaaggaagtattcctccccaaattagggtgttgtcaaaactcactcatcttgatttaagtgacaatcacttctctggacaaattccatctgaaataactcagttggtcagtcttcgtgttttagatttggcacataatgctttcaatggttctattcctcaagaaataggtgcattaaggaatttgagagagcttattattgaatttgtcaatctcaccggtactatcccaaattctattgaaaacctatccttcttgtcatatctttctctttggaattgtaatctcacaggggcgatcccagtttctataggaaagttgaccaatttgtcatatctagatcttacacacaacaatttttatggacatattcctcgtgaaattgggaaattgtcaaacttaaagtatttgtggcttgcagaaaataacttttctggttccattcctcaagaaattggaaatttgagaaatttaatcgaattttctgctcctcggaatcatctatctggttccattcctcgggagattggaaatttgagaaatttaatccaattttctgcttctcggaatcatctatctggttccattcctagtgaagtgggaaaactccattctcttgtcacaatcaaattggtagacaataatctctctgggccaatcccatcttccataggtaacttggtcaatttggacacgattcgccttaaaggaaacaaactctctggatcaattccttccactattggtaacttgacaaagctcaccactcttgttatatactcaaataagttcagtggaaaccttccaatagaaatgaacaagcttaccaacctggaaaatttgcaattatctgataattatttcacaggtcatttacctcacaacatttgctatagtggaaagttgacgcggtttgttgttaaaattaactttttcacgggcccagtaccaaagagtttgaagaactgctccagccttacaagggttaggcttgaacaaaaccagctgacaggaaatataacagatgattttggtgtttatccgcatctggattacatcgacttgagtgaaaataacttttatggccatctttcccaaaactggggaaagtgctataatctcacaagcctcaaaatctccaacaataatttatcaggcagcattccaccagagctaagtcaggcaaccaagttacatgtacttcacctgtcttcaaaccatctgacaggaggcattccagaagattttggtaatttgacctacttgttccatctttctctcaataacaataatctttctggaaatgtccctatacaaatagcatcattgcaagatcttgcaaccttagaccttggagcaaattattttgctagcttaattccaaatcaacttggcaatttggtcaagttattgcatttgaatttgagccaaaataattttagggaaggtattccatccgagtttggtaaattaaagcatctccaaagtcttgatcttagcagaaactttttgagtggaacaataccaccaatgctcggagagttgaaaagcttagaaacattgaatctctcacacaataatctttcaggtgatctctccagcctcggcgagatggtaagcttgatatcagttgatatatcatataaccaattagagggttcacttccaaacattcaattcttcaagaatgctacaattgaagcgttgagaaataataaaggcttgtgtggcaatgtctctggcttggaaccgtgcccaaaattaggtgacaaatatcaaaaccataagactaacaaagtcatattggtgtttttacccattggtttgggcactttaatactggcattatttgcctttggggtctcatactatctttgtcaaagttcaaagacaaaagaaaaccaggatgaagaatcactagttcggaatctatttgcaatatggagttttgatggaaaactagtgtatgagaacatagtagaagccacagaagattttgacaacaaacatctcattggggtcggaggacaaggaagtgtttacaaagcaaaattgcacacaggtcaaattcttgccgtgaagaaactccatttagtccaaaatggggaattgtccaatattaaagctttcacaagtgaaattcaagctttgataaacattcgacatcgtaacattgtgaagttatatgggttttgttctcattcacaatcctcatttttggtgtatgagttcttggaaaagggaagcattgataagattttaaaagatgatgaacaagcaatagcatttgattgggatcccaggattaatgccattaaaggtgtagcaaatgctttatcttatatgcatcatgactgttcacctccaattgttcatcgagatatatcaagcaagaatattgttttggatttggagtatgtggctcatgtctcagattttggagcagccaggcttcttaatcctaattcaaccaattggacctcatttgttggcacttttggatatgctgctccagaacttgcatacacaatggaagtgaaccaaaaatgcgatgtgtatagctttggggtattagcattggaaatacttcttggagagcaccctggagatgttataacttccttgttgacatgttcatcaaatgccatggtgtcaacacttgatattccttcattgatgggtaagttagaccaacgcctcccttatcctataaatcaaatggctaaggagatagctttgattgcaaagacagcaattgcttgcttgattgaatctcctcattctcgtcccaccatggagcaagttgccaaggagcttggaatgtcaaagtcatcttcagtgcattaa

SEQ ID NO: 3240 - DNA, 498 bp, Glycine max var. Williams 82
atgactgttcacctccaattgtttcatcgagatatatcaagcaagaatgttattatggatttggagtatgtggctcatgtctcagattttggaacagccaagcttcttaatcctaattcaaccaattggacctcatttgttggcacttttggatatgctgctccagaacttgcatacacaatggaagtgaaccaaaaatgcgatgtgtatagctttggggtattagcattggaaatacttcttggagagcaccctggagattttataacttcgttgttgacatgttcatcaaatgccatggcgtcaacacttgatattccttcattgatgggtaagttagaccaacgtctcccttatcctacaaatcaaatggctaaggagatagctttgattgcaaagacaacaattgcttgcttgactgaaagccctcattctcgtctcaccatggagcaagttgccaaggagcttggaatgtcaaagtcatcttcagtgcattaa

SEQ ID NO: 3241 - DNA, 3033 bp, Glycine max var. Williams 82
atgggctcttcttatgtattccaatttctttgtggaattcttctcttattatgcatgagcacatgtcaagactcagcaactgcagcatcaacccttcaaggaaacgaaactgatctacacactttacttgacttcaagagtaggatagttcatgatccattccacatcatgagtttgtggaatgattcaatccatcactgcaattggttaggaattacctgcaacaactccaatggaagggtcatgtacttgatcctttcagacatgacattatctggcactcttccaccatctataggaaatctcacattcctcaccagactcaacctcagaaatagtagtttccatggagagtttcctcatgaagttggacttctacaatacttgcaacatataaacattagttacaattcttttggtggtagtattccaagtaatctaagtcattgcactgaactaagtatattatctgctggtcataacaattacacaggaacaattccagcatggattggaaactcttcatctttatctttacttaaccttgctgtgaacaacttgcatggaaacataccaaatgagatagggcaattatcaagattgacacttcttgcactgaatggaaattacttgtctggaacaattcctggtactatttttaatatttcttccttgttcttcttcactgtttctcaaaatcatctgcatggtaacataccagctgatgttggttacacttttccaaatctcgaaacatttgccggtggagtcaacagcttcactggaacaattccagaatcactgtcaaatgcttcaagactagaaattcttgactttgctgaaaatggcctaactggcacacttcctaagaacataggaagattgccccttttaaaaagactcaattttgatgacaatagacttggaactgggaaagctggtgatctgaattttcttgcttccttggttaattgtactgctcttaaagttttaggcctttctgataatagttttggaggagaactgcctagtacaattgctaatctttcaactcaattaacttcacttactttaggtggcaatggaatacatggaagtgtcccaattgggatcagaaaccttgttaacttaacttttcttggattagaagagaacaacctaagtggttttgttcctcatacaataggtatgcttcgactattaaatggtttggatttgaatggcaacaacttttctggggtaatcccttcatccattggaaacttgacaaggttaacaaggctacagatggaggagaacaactttgagggaagcataccagccaatctaggaaagtgccaaagcttgttgatgctaaatttaagccataacatgctcaatggtaccataccaagacaagtccttaccttgtcttctctttcaatttacttggacttgtctcataatgctttgacagggcctgtgcttgctgaagtgggcaagttggtcaatcttgcccagttggacctctcagagaacaaattgtctggcatgattccatcttctcttggcagctgtattggtttggaatggatacatttgcaaggtaacttttttgagggaaacattccttcaactatgcgttatttgcgaggcttacaagatatagatctgtcatgcaataacttctctgggaagattcctgaatttcttggtgagttcaaagtgctagagcatctcaatctttcttacaatgatttcagtggaaaattaccaatgaatggaatcttcaagaatgcaacttcctattcagtgtatggaaacagcaagctctgtggtggtgccccagagttagatttacctgcatgcaccatcaaaaaagcctcttccttcagaaaatttcatgaccccaaggtggttatctctgtaatagttgcacttgtttttgttctcttactattttgttttctagcaatctctatggtaaaaagagcaagaaagaaagcttctagatcaactactacaaaggatttggacttgcaaatttcatactcagaaattgcaaaatgcactggtggattctccccagataaccttgttggctctggaagttttggttctgtgtacaaaggaaccctttcaagtgatggatcaagtgttgcagttaaagtattgaatcttgaacaaagaggagcttcaaagagcttcattgacgagtgccaagtcttaagaagtataaggcaccgcaaccttctcaagatcataacagctatctcaagtgttgatcatcaaggtaatgacttcaaagcattggtgtttgagttcatgccaaatggaagtttggaagattggttgcatcctgtagataatcagcaaaaacagacaaagactttgtcatttatccaaagactgaacatagcaattgatgttgcttgtgccctggaatatctccaccacttttgtcatactccaattgttcattgtgatataaagccaagtaatgtgcttcttgacaatgatatggtggcacacgttggtgactttggattagctacatttctgtttgaagaatcaagcggttctccccaacaatcaaccatgtcaggtgtgctaaagggctctattgggtatatccctccggaatatggaatgggtggccacccttcagcactgggagatatttacagttatgggatactattacttgagattttcacaggaaaaagaccaactcatgagatgtttgaaggtgtcagcatgggaattcaccagcttacagccttgtctttaccaaaccatgccatggaaataattgacccattattgctccctaagcgagaatttgatgatagaaatgaacaagtttccacagaggaggaagcaatattgagggagaatgaacctgaagtaatagagggttgcttggtttcagtgttgcaaataggagtgtcatgctctgtaacttcaccacgtgaaagggtgcctatgactgaggtcgtcaacaaacttcatgcaattaaaagctcctatctaatactaaatcagttaaaatag

SEQ ID NO: 3242 - DNA, 1305 bp, Glycine max var. Williams 82
atggtgtctcgccccaatctagataatgcgaatatgaagatgccgtcatattttaattttccagcacttgatgtttctgttgcatttccacaggccactccagcctctacttttcctccttgtgcttcagattattttcatttcaatgacttgttgaaaccggaggagcaggccgtgaggaacagagtgagagagtgtatggaaaaagaaattgctcctataatgactgagtactgggagaaggctgaattcccatttcatgttatcccaaagtttgctgccctgcgtattgctggtggcacaattaagggttatggttgtcctgatctttccatagctggaagtgctgttgctgcagcagaagttgctagagttgatgcaagctgctcaactttctttttggtccattcttccttggcaatgctcactattgcattgtgtgggtctgaagctcagaagcaaaagtatctaccttctttggctcaaatgaaaactatagcatgttgggctttgactgaacctgactatggaagtgatgccagtgctttgaagaccacagcaacaaaggtggaaggtggttggatccttgatggccaaaagagatggataggaaacagtacatttgctgatttgttggttatctttgctaggaatatgacaactaatcaaataaatggatatattgtcaaaaaggatgcgccaggtttaacagtaacaaaaatggagaacaaaattggacttaggatcgtacaaaatggagacatagttatggggaaagtttttgtccctgatgatgacagactagaaggagtcaattcttttcaggatacaaacaaggtacttgctgtttcccgtgtaatggttgcttggcaacctattggtttatcaatgggcatctatgatatgtgtcataggtacctaaaggagaggaaacagtttggagcaccattagcagctttccaaatcagtcaacagaaacttgttcaaatgctaggtaacattcaagcaatgattcttgttggttggcgcctgtgcaagttgtatgagagtggtaaaatgacaccaggtcatgctagcttggggaagtcgtggattaccctgagggcaagagaaacagctgccttgggaagagaattgcttggtggcaatggaattttggctgattttctagtggcaaaggcattctgtgatatagaacctatctatacatttgaaggcacgtatgacataaacaccttggttacaggcagggaaattactggttttgccagctttaagccggttgctcaaaaaagtagactgtga

SEQ ID NO: 3243 - DNA, 339 bp, Glycine max var. Williams 82
atggaatctcagcaagcaaaccgtgaagaacttgatgagaaggcaaggcaaggtgaaactgttgttcctggaggaactggtgggaagagtcttgaggctcaagaacatcttgctgaaggaaggagccgtggagggcagacgaggaagcagcagctagggtcagaggggtatcatgaaatggggaccaaaggagggcagacaaggaaggaacagatggggagagaagggtaccaagagatgggacgcaaaggaggactcagcaccatggacaagtctggtggagaacgtgctgaagaggaaggcatagaaatagatgagtctaagtttaaaattacctaa

SEQ ID NO: 3244 - DNA, 483 bp, Glycine max var. Williams 82
atggaagacggtggaagcttagtttcagaagatggatccaaaatagaagatacaacctcagagaaagttgagaaggtgaaagaagaagaagatattggcaaagaagagagtggtggtggccttatcaacaacttggtttccactttgatcacacccttgagtccaggcattgggaaagccactgaaaatgaaagtggtgctgatgctgatgaagatgaaggagagaatgaaggagggatcatcagcaaaatggtttctaatttcttccatcaaagtgaaggtgaaggtgtggtggaagctgaagaggacaaagaacaagaggaggaaatcatggctggtggtgaaaaaatcaaacggttgaagacagagaatggaggcatcattcataacatcttttctcatttacctgcttcaatcccagatggtgcggttcctacagctgatgaggccacttttttaattaactctcttgttcgtgactaa

SEQ ID NO: 3245 - DNA, 1308 bp, Glycine max var. Williams 82
atgcagagattccatctgggtctccctcattcaccaccaatggacaccagcacacccttccaagaccttccagaagcatctccaaagcccttcttcaagaaaaccacactcacttccttcatcatgtcttcaacaccttccttcaaggaagacacctactacatctcccacctcaaatcctccgagaaaaaagccctccaagacctcaagaacaaactccaatcttcttattcttccaccccttccatgtggggcgttcctttactcaacaacaacaacgccgacaacgccgacgtcatcctcctcaagttcctccgagcccgtgacttcagggtccacgacgccctctccatgctcctcaagtgcctctcatggaggaccgagttcggagctgacaacattgtcgacgaggagctcggtgggttcaaggaacttgaaggggttgtagcctatacccatggctatgacagagagggacaccccgtgtgctacaacgcctacggggtgttcaaggatagggagatgtacgagaatgttttcggggacgaggagaagctgaagaagttcttgcggtggagggtgcaggtgctggagagaggggtgaggatgctacacttcaagcccggtggggttaattctctcattcaggttacggaccttaaagacatgcccaagagggagctaagaattgcttctaaccagattctgtctctgttccaggataactatcctgaaatggtggctcgcaagattttcatcaatgtgccatggtacttcagtgtgttgtattcaatgttcagtccgtttctgacccagagaactaagagcaagtttgtgatctctaaggaaggaaatgctgccgagacactctacaaatttataaggcccgagaatattcctgttcggtatggtggattgagtcgaccaagcgatttggagaatggtcccccaaaacctgcttctgagttcacagttaaaggaggagagatagtgaacatacaaatagaaggaattgagagtggtgcaactatcacttgggatattgtggtgggaggctgggacttggagtatagtgctgaatttgtcccaattgcacaaggtagctacaccttagcagttgataaggcaaggaagattgaggccacagaagaagcaatccataactctttcacatcaaaagaagctggcaaaatggtactctctgttgataactctgcctcaaggaagaaaaaagttgctgcttatcgctattttgtgcgcaaatccagcacaccaacaccatctgaggtgcaattaagccctaaatga

SEQ ID NO: 3246 - DNA, 1449 bp, Glycine max var. Williams 82
atgacgggatccctcgcggcaaggctcgtccttcgtcgttgccgatcgccggcaagtcaattcttcttccgcagggaagcctcctggccggcgacggagcgaacgacaaaggacgtcgttacgtcgccgccgaaggaattgccggcgttcgactactctccgccggcgtactccggtccctcccgcgacgagatcatcgcgaagcgccgggagtacctcagcccttcgatcttccacaactacaaatctccgctgaacgtggtggaggggaagaggcagtacctgttcgacgataagggaaggaggtatctcgacgcgttcggagggattgctacggtgtgctgcgggcactgccaccccgatgtggtggaggccatcgtggaacaaacgaagcggttgcagcactccacagttctgtacctgaaccatgccataacggattttgctgaggctttggctgctaagcttcccggtaatcttaaggtggcattttttacaaattctggaacggaagcaaacgaattggcaatactgatagcaaaattgtacactggctcccatgacataatatctctaaggaattcttaccatgggaatggtggtggaacgatggggaccacagctcaaagcatttggaaatataatgttgtgcagagtggtgttcatcatgcggtgaatccagacccttatcgaggccttttcggttctgatggagagaagtatgtaagagatgttcaagaaatcattaattttggaacttccggaaatgttgcagctttcatatctgaagcgatacagggagtagggggcatcgttgaactggctcctggttacttgcctgctgcctacgatattgttagaaaagctggaggtctttgcattgccgacgaggttcagacgggaattgctcgcaccggtagccatttctggggatttgaggcccatggtgttgtacctgacatagtaacaatagcaaagagcattggaaacggcattcctcttggtgctgttgtgacaactcctgagattgcgaaggcattgactcgccggagttacttcaacacctttggtgggaatcctgtttgcactgctgcaggattggctgttttgagagtgatagagaaagagaagcttcaagaaaatgcttttgtagtgggttcctatttgaaagagagactcaatgcactcaaggacaaatatgaattaattggtgatgttagaggaagaggcatgatgcttggagttgaacttgtcagtgatggcaaacttaaaacaccagcacaaagtgaaacactgcatgtgatggaccaaatgaaagaattaggagtgctgattggaaagggtggctattatggaaatgtattcagaattacaccacccctatgtttcaccaaagaagatgcagacttccttgtggatgcgatggactacacattttccagaatgtga

SEQ ID NO: 3247 - DNA, 2140 bp, Glycine max var. Williams 82
tctcatttaccataaccacaacatcgcctatatttaccgcagtgaaatacgcagcagtaattctcaaccaatcacttctctccacgtcatcatttctcccacattccctatataagcctcgctcattgctccttcatcccttcaaattcgcctcttccttctcaatttctctccctccctctcaacacattttctcgggtcgggtcgtgcattctcggagcatcgccggaatcctttccgaccgaaaaagaaaaataatgacgggatccctcgcggcaaggctcgtccttcgtcgttgccgatcgccggcaagtcaattcttcttccgcagggaagcctcctggccggcgacggagcgaacgacaaaggacgtcgttacgtcgccgccgaaggaattgccggcgttcgactactctccgccggcgtactccggtccctcccgcgacgagatcatcgcgaagcgccgggagtacctcagcccttcgatcttccacaactacaaatctccgctgaacgtggtggaggggaagaggcagtacctgttcgacgataagggaaggaggtatctcgacgcgttcggagggattgctacggtgtgctgcgggcactgccaccccgatgtggtggaggccatcgtggaacaaacgaagcggttgcagcactccacagttctgtacctgaaccatgccataacggattttgctgaggctttggctgctaagcttcccggtaatcttaaggtggcattttttacaaattctggaacggaagcaaacgaattggcaatactgatagcaaaattgtacactggctcccatgacataatatctctaaggaattcttaccatgggaatggtggtggaacgatggggaccacagctcaaagcatttggaaatataatgttgtgcagagtggtgttcatcatgcggtgaatccagacccttatcgaggccttttcggttctgatggagagaagtatgtaagagatgttcaagaaatcattaattttggaacttccggaaatgttgcagctttcatatctgaagcgatacagggagtagggggcatcgttgaactggctcctggttacttgcctgctgcctacgatattgttagaaaagctggaggtctttgcattgccgacgaggttcagacgggaattgctcgcaccggtagccatttctggggatttgaggcccatggtgttgtacctgacatagtaacaatagcaaagagcattggaaacggcattcctcttggtgctgttgtgacaactcctgagattgcgaaggcattgactcgccggagttacttcaacacctttggtgggaatcctgtttgcactgctgcaggattggctgttttgagagtgatagagaaagagaagcttcaagaaaatgcttttgtagtgggttcctatttgaaagagagactcaatgcactcaaggacaaatatgaattaattggtgatgttagaggaagaggcatgatgcttggagttgaacttgtcagtgatggcaaacttaaaacaccagcacaaagtgaaacactgcatgtgatggaccaaatgaaagaattaggagtgctgattggaaagggtggctattatggaaatgtattcagaattacaccacccctatgtttcaccaaagaagatgcagacttccttgtggatgcgatggactacacattttccagaatgtgaagcttaaaataagaactaagtgtaaataaatctctattttacataatcatgttaagtaaactgtattaggttgatgcttggtttcatgctggcgccacaaaagtcacattttttatgtagaaatctggaggctacaaagagttgtggtgagattgaatgtgaaaaaaataattgtatccctttcaccacaccgcaggaaccaaacacaccagtataccatctatttagattgtagcaagtcaagtttataaattttacatggaagcttagtcccataatagctcactgtcattgcagaatgtgaatgagccaacaattcgttgtctcgtttatcttatctcgtcctatttttgttggctgctccttttcttttaggtctatatgccttgattttttttcctcttttttcatttgttcatatcatatctgttttt

SEQ ID NO: 3248 - DNA, 1647 bp, Glycine max var. Williams 82
atggggtgcttcactgtattgaagagcaaaaagaaaaagtccgatccaattacatacataaaacatgtaagccataatgagaacgtacctacagtactgcctgaacctcaaactcgtactcgctcactgcagtctgctcctcctagttttaggaccagagtgaaacccattcaacccattaataaagccagtaacaacagaacgcgaacattatctgctccatcaactcttgatgcagcagaacaagatgctttggcttcaattgagtatgaggaacaagaagagtcaagacaccgagctggatcaatgaaggagcagcgttcatctagtccccaacctttaccacttccatcccctcagggaggtagtgcattgaaggctattggcagctttaagtcagtggcctcaagcagtcctctccatgcttctggacctttgccactcccacctactggatcacttcggaattttctgtatgaggaaattgctgctgcttgccaccatttctcttctgatagatgcatgtcagaatgtctttcgtccaccatatacaaggcttcctttggtgacgacgtttcaagttcgaagaagtttgaagccactgtcacacggcttcacccatcatctcagggcttgaaggaattcataaatgaagttaatactcttgcatctttgcaacatccaaacctctgtaaattgctaggatttcatgcacgagagggttcagaacatagaatgttggtttatgaaaggctataccatggaagcttggatcgcttattgtatgggagatctgatgggccatcaattgattggaatacaagaatgaaaattgctatatgtgctgcacaaggtctaaccttcttgcacgaagaggggccttttcaggctatgtataatgagttctcaacagccaacatacagattgacaaagatttcagcgcaaagctttcaggatatggttgtgttggacatattcccgaagaagagatttcaagcagctcatctgctgttggaaacctatcaatggaaacactggagaaaggaatgctcactccaaagagcaacgtatggagttttggaatttttcttctggagctacttactggaagaaagaatcttgatagccgtcaccccaaggaagagaggaatttagtcaagtggagccggcctttcttagccgataactaccgtctgtcgttgatcatggatcctcaactcaaaggccgctttccttctaaagcagcaagaacaatagctgatattgcacaaagatgccttcaaaaggagccatcagacagacctaccatgaggactgttgttgagcatctcaagataatacaggatttgaaatattcgtgccggttccctctgcaagaaccagcatcaaactctggaaaacatatgtcaagatcaccaagtctcaatggcatcatctgccctgcaccaaggttgagtttctcaccatcaccaccatcaggagttccggtatctgtttcgcctccaagatggtctggtggagggcccattctcctcccgccgccacgtgcttgtgcttcgagcctctctttggaggagcttgataggcaggaaagccgcaagtcatcatcctcagcctctagaagggctagtgttgaaggattttga

SEQ ID NO: 3249 - DNA, 2751 bp, Glycine max var. Williams 82
atgcataaccatcatgatatgataatgttaatgtggagcattaacagaataaccatgccttggaaatccttcaagcttatctttctttgtatctttgtttgcttcttcttcaattttgcaactactactaaagcacaggacgccgaccctcttattattggccaaatttgcagcgcaaacagaaccactgccaacagcgcttatgaaaagaacctcaacaccctcctgtcttccttatcttccaacgccaacgcaaccttattctacaacaacacagtcctcggcagcacaaactcctccgacaccgtgtacggtctgttcatgtgcaggggtgatgtaccctctcagctctgcgcacgctgcgtggtaaacgcaaccgagagattatcttcagacccagagtgttccctgtccataaagggtgtgatttggtacgacgagtgcatggttcggtattccaacgtcactttcttctccaccgtggacacaagaccctcttactatatgtggaacctggcaaatatctcctccaacccagaaaacttcaataatttgttggccagcacctttaggaaaactgcagaagaagcagcaaattctggtaacaggtactccacaaagcaagcaaacttatcagaatttcagaccctttactgtctggctcagtgcacacaagatctttcaccccaacactgcagagactgtcttgattcagcagagtccaaaatccaaatatgctgcgatggaaagcaaggaggaagagttttctttccgagttgtaacattaggtatcaactgtaccctttctaccgcaacctcacgtatgaggcatcagaagcactggttcctgaaacgaaatatccagaaagagactcagaatattcagaagatcctggctatatttaccacaactgctcaacaaaccaaaacgtgaatgatactgctttccaatcagaccgcaagaccctcttctctgacttgtcttccaacgccaccagtggcgacagatactcggtaaaagccggaacactgcgaggccttttccggtgtcgcggcgacctttctcgttacctttgtggacaatgcgtccaaaacgcgacggagaaaatcctctccgagtgtggttgggctacggacgttacaatttggtacaatcactgctggcttcgctattcgaatcggtccttcaccatggaaacaagtcctagctatcagaaatggaatgccagcaacaccaattcggtgccattctctgaagccttgacattcatatccactagattatctgttgttgctagcgaaacaggggacactagtaacaaatatcaaaccgtaccattgaaattgaatgatcgtcaatggctgtatattcttgctcaatgcaccttggatatatctaacgaagattgcagcgcgtgcctaaatgatatgattggagtaattccatgggctcgtttgggaagcgtaggtggacgaatgttgtatcctagctgtattctccgctttgaattgttccagttttacaacctctcgcctacgacaccaactaatacttcaccttcaggaaataactcacgaactattatcattatccttatccccaccttcattgtattgggaatactttctaccctttgtttctatctgataacaagaaaggcgagaaagaataataagattattctcagagaaaattttggacaggaaagttcaactattgagtcattacaattcaattttgcaacaatcgaagctgcaacaaacaacttttcacacgagaacaagattggtagaggtggatttggagaagtttataagggaattcttattgatggaagacctatagctgtaaagagactctcaagaaattctaagcaaggtgttgaggagttcaaaaatgaagttctattgatagccaagcttcaacatagaaatctagtagccttcataggattttgtcttgatgagcaagagaagatacttatttatgaatatgttccaaacaaaagtcttgattacttcttatttgatactaaactagaaaaggttttgagttggtctgatcgtcacaaaatcataggaggaattgctcgaggaattttatatttacatgaacattctagacttaaagttatacatcgtgatcttaaacctagcaatgtattgttggacgaaaatatgaatccaaaaatttcagattttggtcttgctagaattgttgaaatagatcaacaggaaggaagtacaaatagaattattggaacatatggctatatgtctccagagtatgctatgtttggacaattttcagacaaatcagatgtttatagctttggagttatgattctcgagattattagtggaaaaaagaatataggctcctacgaaccacatcgtgttgctgatggtcttctaaattttgtttggagacattggaaggatgaaacaccattgaacacattggaccccaaattaagagataattattctaacattgaagtcatcaaatgcattcgaattggtttattatgtgttcaagaaaatccggatgctagacctacaatgttgacaattgtctcatatctcagtagtcactcaatagagttgccatctccacaagagccaacatttttcttataccatagaatggatccaactgttgcacatgaatcaagttcgaggcaatctaccaataattccataccatcatctataaatgaaatgtctataagtaaattttatcctcgatag

SEQ ID NO: 3250 - DNA, 1251 bp, Glycine max var. Williams 82
atggctcacattctccctttcctcctcctcaccctcctcgccgccaccgcctccgcccacaatatcaccgacattctcgccgccaaccccgactacagcgacttcaacggcttcctctcccaaaccggcctcgccggcgaaatcaacacccgccagaccatcaccgtcctcgtcctcaacaacgccgccctctccgccgtggccgcaaaacaccccctctccgtcgtcaaaaacctcctcagcctccacatcctcctcgactacttcgacaacacaaagctccaccagatccccaacggcaccacgctctccaccactctctaccaaaccaccggcaatgccaacggcaacgtcggctccgtcaacatcaccgacctcaaaggcggtaaggttggcttcggctccgctgctcccggctccaaactcgactcctcctacaccaaatccgtcaaacaaatcccctacaacatctccgtcatggaaatcagcgcgccgatcatttcgccggggatcctcgcggctccgcctccctcagccgacgttaacataacggcactcatcgaaaaagccggatgcaaaacgttcgcctcactcatctcctctaacggactcattaaaacgtttcagtcaacggcggataaaggtttgactattttcgctcctaacgatgaagcgtttaaggcgaaaggcgtacctgatttgagcaagctcacgaacgctgaagttgtttcgctcttacagtatcacgccgccgctaagtatcttcccgttggatctctgaaaacgacgaaggattcaattaacacgttggcctccaacggcgccggaaagttcgatttgaccgtttccgtcgccggagattcccttacgctccacaccggagtcgattcctcgaggatagcggagacgattctcgattccactccgctttcaatttattctgtggacagcgttcttcttccgccggagctgttcgcgaagtcgccgtctcctgccccggcgccgggaccggttactgcgccttctccctcgccggtgtcaactccatcggaagcaccttcgccgcttccggcatcgcctccggctccagcgggagagactcctgccggtgctccggcggatgcaccgtcctcggaggctgagcggagcacttccggcaagagtgacggtgttcacgtgaaagcttctgcgactctcactgttgcagtgattgcattgtctgcctttgtgatttctgctacctttatgtaa

SEQ ID NO: 3251 - DNA, 3624 bp, Glycine max var. Williams 82
gtattttttgaatattcaaagcatatgatccttgtcgattaccttgagacaacgggtgttaggcacggcaaacctgcttttctgaagaatttctttggcggtttaaagaaattagaatttgatggggagattaagagagagatcgtaattccatctcatgtacttccttacttgaagaccttagaagaattgaatgtacatagctccgatgctgtgcaggtaatatttgacatagatgacagtgatgccaacaccaagggaatggtccttccattgaaaaagcttactctaaaaggcttgtcaaatttgaaatgtgtatggaacaaaaccctccgaaggattctcagctttcccaatttgcaagtagtgtttgttacgaaatgtagaagcttggcaacattgttccctttgtcccttgccaaaaatcttgtaaatcttgagacacttacagtatggaggtgtgacaagttggtagaaattgttggaaaggaagatgcaatggaacttggaagaactgaaatatttgaattcccttgtttgtcgaagttgtatctttataagctgtcactgcttagttgcttttatcctggaaaacaccatctggaatgccccgtattagaatgcctggatgtgtcctattgtcctaagttgaagctattcacatcagaatttcataatagtcacagagaagcagttatagagcaacctcttttcatggttgaaaaggttgatcccaaactgaaggaattgacactcaatgaagaaaacattatcttgttgagggatgcacatttgccgcaagacttcctttgcaaattaaatattcttgatctgtcctttgatgattatgagaataagaaagatactttgccttttgatttccttcacaaggtaccccgtgtagaatgtcttcgagtgcaaagatgctatggtctcaaggagatatttccctctcaaaagctccaagttcatcacggaatacttgcacgattgaatgaattatacttatttaaactaaaagagttggagtcgatagggttggagcacccatgggtaaagccatactctgcaaagcttgaaacattagaaattcgcaaatgctctcggttagagaaagtagtgtcttgtgcagtatctttcagcagtctcaaagagttgcaagtgagtgagtgtgaaaggatggagtatttattcacatcttcaactgccaaaagtttggtgcaacttaagatgctatatatagaaaaatgtgaatcaataaaagaaatagtaagaaaagaagatgaaagcgatgcttctgaagagatgatatttggacggctcacaaaattaaggttggagtccttaggaaggctagtaaggttttattcaggggatggcaccttgcaattctcatgtttggaagaagccaccatagctgaatgccccaatatgaatactttctctgaaggattcgtaaatgcgccaatgtttgaggggattaaaacttcaagggaggattctgatttaacattccaccatgatctcaactccacaatcaagaagttgtttcaccaacatgtggaaaagtctgcatgcgatatagagcatttgaaatttgatgatcaccatcacctagaagagatatggcttggtgcagttccaatcccaagtaaaaattgtttcaacagtttgaaatctttaactgtggtggaatttgaatctttacccaatgtgattcctttttatttacttcgatttctatgtaacttgaaagagatcgaggtaagcaactgtcactctgttaaggcaatatttgatatgaaaggtgcagaggcagatatgaagccagcatctcagatttctcttcctttgaagaaactgattctaaatcagttgccgaatctggagcatatctggaatcctaatcctgatgaaattctcagccttcaagaagtgtgcatttctaactgtcaaagcctcaaaagtttgtttccaacatcagtggccaatcatcttgctaagcttgatgtgagatcttgtgcaacattggaagaaatttttttagaaaatgaagcagccttgaagggagaaactaaaccgttcaatttccattgtctgacctcattaacattatgggaattaccagagctgaagtatttctacaatggaaaacactcgctagaatggccaatgctaacacaactagatgtatatcattgtgacaagttgaaattgtttacaactgagcatcatagtggtgaagttgcagatatagagtatccacttcgtgcttcaattgatcagcaagccgttttctcagttgaaaaggttttcccaaacttggtgcaactatcactcaaaaaggaagatgccataggaattttgcaaggacagtttcaggtcatgcctagcttagagcatcaagcaaccacttgcgaagacaatatgattggacaaggacaatttgttgcaaatgctgcacacctcctgcaaaatttaaaagttctcaaattgatgtgctaccatgaggatgatgagtcaaatatattctccagtggattacttgaagagatatccagcattgaaaatcttgaagtgttttgtagttccttcaatgaaatattctcctctcagatacctagcaccaattataccaaagtcctttcaaagctgaaaaaattacatttgaagagtctccaacagctgaattccataggattagaacactcatgggtagaacccttacttaaaacactagaaacattggaagtgttttcttgccctaacatgaagaatttggtgccgtcgaccgtgtctttttcaaatcttacctctttgaatgtcgaagaatgccatggattggtatatttgttcacatcctcaacggccaaaagtctaggtcaactgaagcacatgtccatacgggattgccaagcaatacaggaaatagtgtccagagagggagatcatgaatccaatgatgaagagataacatttgagcagcttcgtgttttgtctctcgaatctttaccaagcatagtaggaatttactcagggaagtacaagttgaaattcccatccttggatcaagtgactttaatggaatgccctcaaatgaaatattcttatgtacctgatttgcatcaattcaagcttcttgagcaaatttaattggaagagcagaagttttagggaatccatcatgcagtactcattatacagtcacaatgacagtagtgggtgaacgttgggaattcttcttcccgtatgatgttgatgcatcatgggacggaatcttccaccttaggctttgttgggagaaggactactctgatggatcatgctgctactcttctctttcatctcatcccagtggtattgtcgtagtaattaatagttatggccagcctgggaagtggtttatgttgttagccccactccttgttttggatgtttacatggatttttatgtatttattttgggcaggcacatatattttattttctagttttcgttcttatgtttagagtttgaatcatgttggttttatattggtcatgaaacttatggcatacatgtagacttactttatgtacgtttgaggtttatttgcagatttgtatgcagtagcttccttatgc

SEQ ID NO: 3252 - DNA, 2094 bp, Glycine max var. Williams 82
atggttggctactgtaaaaagttgagagaattacaaattcaagaatggaaaggatattacatcaactataagttaatgaagaagaaagtcaagagatatgtagaacaaatggaggttggagctcaaaatcgccataatgttctaagagacttctcaatgctgctagacaatcagatagaaaaaattgttttatttctgcttgaacaacaaggagtacttgcacataggctgtcaaatattggacaagatcaccatactcttttccagcagtcaaatagtataaacatctctgaacttcaagaagcatatagagacgttggacgagatcttttaaggcttcttaattttgtggaaatgaatgctattggtttgagaaagatcttgaagaagtttgataaacggttcggctataaattcacagactattatgtcaagacacgtgcaaatcatccttattcccaattaaggcaggttttcaggcatgtgggcattggggctgttgttggagtcttatctcatggtctggctgaccttcaggatttacaacaatctctaggaagctacatttctatatatgaccagccttcttatactcatcaggatcctattcttgattccatcaaagaagctgtagccagattgtcaaactcaacaaacttccttcagtttttgggaagacatgcttttatcatgaaagaggagctgccatttccaagtgaagatcatattgttgatgaaagatatcatttcatgtcgcttcttttgaacttggcaaatacatttttgtatatggtgaacacctacattattgtacctacggcagacaactataccttgagccttggagctgcagcaagtgtgtgtggtgtggtcattggtatgatggctgttgcacaggtgttttcttcagtttatttcagtgcatggtcgaaccgttcatatctacgaccactcatcttcagtagcattgttcttgtagttgggaacaccttgtatgcattggcttttgatatgaattcaatagtagttctactgatgggacgtcttttctgtgggttaggctctgctagggctgttaataggcgttatatcagtgactgtgtaccattgaaacttcggatgcaggcctcagcaggttttgttagtgcaagtgctctgggaatggcttgtggtccagctcttgcttgtttgttacagacaaattttaggatttacaggttcaccatgaaccaagacactctgcctggctggataatggctcttgcttggcttgtctatctactgtggttgtggatttgtttcaaggaacccgcacatgagaatcaaggaaatcttgtgctatatcatgcagatacagaaccagtagtacaagttgcagtagggaacgagcgtacacaaccattactaatgaactcagaagaaaaggagctggatgaagatggagaagaagaaaatgacaatactgaagaaactaagaaacctgtgacttctattgtggtggcatataagttacttactccatcagtaaaggttcaattatttgtgtattttatgcttaagtatgcaatggagatcattcttgctgaatcaagccttatcacagaatactattttatttggacaaccagcaatgtatccatttttctcgcatgccttggtcttactgtgcttccagtaaatattgttgttggaaactacatcagcaatatgtttgaagaaaggcaagttctactgacatcagaaatcatggtttgcattggactactcctaagcttccatataatgattccttactcagtgactcaatatgttggatcagcccttatcacatttgtgtctgctgaagttcttgaaggagtgaacctttcacttctatcaaaaatgatgtcatcaaggctttcacgtggaaccttcaatgggggattgctgtcaacagaagctggaactctagcccgagtaattgcagatggaacaataacaatctctgggtatttcagtgaaagtaaactcctgaataccaccttactccctgcactcctcatctgcatctcatccattattgctacctgctacagctacaactctctttattag

SEQ ID NO: 3253 - DNA, 354 bp, Glycine max var. Williams 82
atggagttgagcatgaaagtgttggtgaaagttgcttcgttgcttttcctattggaattcactgcaacagttgttgatgctcgcttcgatccaagttcattcatcactcagtttctccccaatgctgaagccaacaattactatgttaaatccacaacaaaagcgtgctgtaacagctgtccttgcacaaaatcaatccctccacagtgtcgttgttcagatattggagaaacatgtcactctgcatgcaaaacttgtatttgcactcgctcaattcctccacagtgtcattgcagtgacataaccaacttctgttatgaaccttgcaactcctctgaaaccgaagctcactag

SEQ ID NO: 3254 - DNA, 691 bp, Glycine max var. Williams 82
ataaatgaatggtcttctattcatattctagtcgtaaaactaagagacattacagtttgtattattgtagaagagagagggagagagatggagttgagcatgaaagtgttggtgaaagttgcttcgttgcttttcctattggaattcactgcaacagttgttgatgctcgcttcgatccaagttcattcatcactcagtttctccccaatgctgaagccaacaattactatgttaaatccacaacaaaagcgtgctgtaacagctgtccttgcacaaaatcaatccctccacagtgtcgttgttcagatattggagaaacatgtcactctgcatgcaaaacttgtatttgcactcgctcaattcctccacagtgtcattgcagtgacataaccaacttctgttatgaaccttgcaactcctctgaaaccgaagctcactaggaatattgagcatgttccagtgactaacatgtttgacagagtcactaggctttgttttcatctagctagtacttatgatgtatgggaataaataactactgaatgaataaaagctactaggccaagcagtttgttttctacaaattgctggtcgtggtgtttgttttatttttagtcttgttttagtttattctcacatctgaaatatttttttttaaaggccaactaaatatatcattaatgagaagaa

SEQ ID NO: 3255 - DNA, 810 bp, Glycine max var. Williams 82
gttttggtaattgctgttcaggtttgtgtagagtatagcttggatttgacgttaaagctgagatttttggacgattcaagtgggcacaaagagcttgaaatgagtgtcacagaaacaccaaagaaaaccggtgccccccaaattgttaagttggacaaggcattgaaattggcagagttatgggtaaataatatgagcaaagatgcagatgatgatagaacaaatgcggatgtagagggtcgaccttctaggcttggtctaggtgcaaaagtttcacgccaatcaaaatttgtgccttcagatgaccctgttgaaaggaaattgtatgccaagttgaatgctgaaaaaagaaaagcagctaatattgctaaagagtctgccacaattgcaagagatgctttagatgacgatgaagacaatgaagacttagatagcagagctaatgcatttaccaagaggaaggcaacagctcctttgatctcgtctatgttgcgaaataagaagcagaagtgacatttaataatgagttatttttttctgtaaggctgtaaattatcacatagtttgcatttgccttgcaggaatttttccttcaaccaagtgtaatacatgggaatttcatcgaacatagttatgtacttgaggaaaaaaagataattttactagtttatggcctattctattcccatccacatttttttacattaaatactagatgaatatttgtgttgttttatgagttatagtgacttggctaattacatattgtcacacaatttgtttatttattaactgaatgaacatttgttc

SEQ ID NO: 3256 - DNA, 768 bp, Glycine max var. Williams 82
atggtgttaatgggaggagttggagtaccctcaatctcaatctgttttttgttccaaacaagacccaccagacatttgtgtctcaaattcagattgaaacattcactttcatattcaatcactagcatggcattgaccaacaacaccaccaccaacgaaaggaagcttccaattctgctgtttgatatcatggacacccttgttcgtgaccctttttaccaagatgtccctgccttcttcggaatgtctctgaaggagctcatagattgcaagcaccccactgcttggattgagtttgaaaagggtctcattgatgagatggagctagcaagaaaattttttaaggatggaagggattttgatttagaaggccttaaaacttgtatgagaagtggatattcatacatagaaggcatcgaacagttgcttctttccttaaagctaaataactatgagatgcatgcttttacaaattatcctatatggtaccagttgattgaagacaagttaaaactatcaaaatatttgtcgtggacgttttgttcgtgggcttttggtaagaggaagcctgatactgaattctataaggaagttgtcaggcatcttaaagttgatccaacaaattgtattttcgtagatgacaggcaaaaaaatgtggaggcagcaattgaagttggcatcagaggggtacatttccagaatgtcaattcactgtgtgaaaaactgccattgatggggattgacatctcaacaaatgaagatagatag

SEQ ID NO: 3257 - DNA, 759 bp, Glycine max var. Williams 82
atgccggtttacatcatgggagatcatgtaactgtctcgaccactcaacaacacattgcaatccccattgagaaattgaatgcattatcacttgaagttgcaaaggaagaaaaacatgtaaccgatgatgcctatgtggacaatgtccaaaaacctgaagagaaagatgaagaaactcaagaaaagggagattgtcgctactgtcaagaagaggactttatttttaatatggaatcaccctgcaattgcaatggtagcgtgaagtatgttcacaagagatgcattgatcaatggtacaattccaaaggccgcatgatattatgtgagatttgcaggaagccttacaatccaaatgattacccacttccggaacttcattatgatgatgatgacaccgagataactatattaagggaggaatggactattcctggaaccagcattgaaatttggtcacctttggtgctggcagaccgtgccaccaagggcctcattgattcaatgaacaaagacttcagcttgaaaaaccctagtggaggtgtgatatttggcatgtcactcgtcatctttatcgcggtgctacttataaaggatgcctatgaatgtgcgccacccaaggaggagaaatttgctcgttttttgtactgcgctgtgatgactatctctgtgccagtttacattttatcgtgggttttacagtgccaagcctatagaaaaagcgagagagggagggaaagagaaagacatcgcaatgcatag

SEQ ID NO: 3258 - DNA, 2176 bp, Glycine max var. Williams 82
gctacaattttaataaagaacaaaaacaacaacgttgttgtttatttatggtttaagccatttttattaatggtttttcccctctaaaatacatcatacatcgtacaagacgtgtcgtttgccgttgaaaccgcgaaaattccctcttttctctctttctctttcacacgtctttgttttacaaagcggcttcgatttatttttgtgtttgtttcttcccctttccctcttctctgttttcaccgacccttgttttctatctgggtcggcaaatggttttcaattagtgtttctgtgttgtttcttcattgttgctttctctcgaagctagctcaacccgagatggatctgagagaaagtttggtacttcttcttgtggggtcgttcgtcgtgcaattttgttgcaatgccaatgcgaatttggtgttccccgttgtgcgcaaattcaaaggtcccgttgaaaacctcgctgctatcaaagctcatgatgctggtcgccgaggtagatttctctctgtcgttgatgtcgctcttggtggcaatggccgtcctacttcaaatggaatccgaggtatcccacaagcttcgaccctttggataggcaataagactaatcctcggtccgaggcttagtcacatttaaagctccttgcccctccccgagaatgtattctgtggggatggaatccaggctgtattataccaaaattgggcttggccccaaggactactatgtgcaagttgatacaggaagtgacactctgtgggtgaattgtgttggctgcacagcatgtcccaagaaaagtggtcttgggatggacttgaccctctatgaccctaacttatccaaaacttcaaaggcggttccttgtgacgatgaattttgcacttccacatatgatggtcaaatttctggctgcacaaaaggcatgtcctgcccatacagcataacttatggagatggaagtacgacctctgggtcctatattaaggatgatcttacatttgatcgagttgttggtgatctccgtactgtgcctgataataccagtgtgatttttgggtgtggttctaaacaatctgggacattgagttcaactactgatacatcccttgatggaataattggttttggacaagcaaattcttctgtgctttcacagcttgctgcagctggaaaggtgaaaaggatattttcacactgccttgacagcattagtggaggaggaatatttgccataggggaagtggtgcagccaaaagttaagacaactccattgttacaaggaatggcacactacaatgtggttttgaaggacatagaggttgctggggaccctatacagctcccctcagatatattggattcttcaagtgggaggggaacaataatagatagtggtacaaccttggcttatcttccagtctcaatttatgaccagctattggagaagattttggctcagaggagtggaatgaaattatatcttgttgaggatcagtttacttgtttccattattctgatgaagaaagtgttgatgatttatttccaactgtaaagtttacctttgaggaggggcttactctgacaacttatcctcgcgattacctattcctgtttaaagaggacatgtggtgtgttggctggcaaaaaagtatggcacaaactaaggatggaaaggaactaattcttcttggagatttggtgctggcaaacaaattagtcgtatatgatcttgacaatatggccattggatgggctgattacaattgctcttcaagcatcaaagtgaaggatgacaagactggatctgtatatacaatgggtgcacacgatctttcttcagcttctaccgtgctaattggaaaaatattaacgttctttgtgttgcttattaccatgctaagcacttaactgatatcgagagatggcatttatttcatttcgttgtaacataattccttcattccttgaatggtggtgagcttgatgtgaataaattaaccatttctcgtcgtgttcatagaaatatagaagtgagaaagggaagagttttcaaagttcttttcaatttcctccttcctgtataatgttttaaatggggaaggcaaaatattctaatggatgcgatatcatttttttattagatatagctgcatacgaaaattgttaaa

SEQ ID NO: 3259 - DNA, 1107 bp, Glycine max var. Williams 82
atgctcaggagcagcacgctaacacagagtgttacagtcacctgtgttcatcacagtcacagacaatggttccaatcaattcccgtaaattatagattctgtgacgctgctcggaactctctatcatccaactccgccatcttcaagtggaaaagaacggctaattataatcgtaaccgttctggaatgggaaccttcaccacgcgcgcgttggcgcagccgctccagaacgccgacgaactcatcgattccgtcgagacatttattttcgattgtgacggagttatatggaaaggtgacaaattaatagaaggggtgcctgaaacgcttgacatgcttcggtcaaagggcaaaagattagtttttgtcaccaataactcaacaaagtctaggaagcaatatggaaagaagtttgaaacacttggcctgaatgtcagcgaggaggagatttttgcatcatcctttgcagctgctgcatatctgaagtccattgatttcccaaaagataaaaaggtttatgtcattggagaagatggtatcttgaaggagcttgagcttgctggatatcagtaccttggtgggccggaagatggtgggaaaaagatagaactgaagccaggatttttgatggagcatgatgaagatgttggagcagttgttgttggatttgatcgccacttcaactactataaaatccagtatgggacactctgtatacgtgaaaaccctggatgtcttttcattgctacaaaccgagatgctgttactcatctcacagatgctcaagaatgggcaggtgggggctcaatggttggcgctatcagtggatctactcaacgtgaaccattagttgttggaaaaccctcaacgtttatgatggattacttggcaaacaaatttggcatttcgaagtcacagatatgtatggttggggacagattagacactgatatcttgtttggacaaaatggtggttgcaaaactcttcttgtgctctcaggcgtcaccacactggccatgcttcagagccctaacaactccatacagccggacttctataccaacaaaatttcagattttctttccctgaaagctgcagctgtatga

SEQ ID NO: 3260 - DNA, 573 bp, Glycine max var. Williams 82
atgggcatcgccacaatcaaaatgggaggcaactccgactccaactgttccatcactccacgccattacaacacccacaaggtgttccttttctgcaactacattctcttgggtgcagcctccagctgcatcttcctcaccctctccctgcgcctcattccctctctatgcggcttcttcttcatccttcttcaggtcttcacgattgcgggtgcagtctcgggttgtgctgctgtgggggctaataggtggtactctgcacacatggtggccactgttctaacggctatctttcagggttctgtttcagtgttggtgtttacgcggactggcgattttctgggtcagttgaaatcttacgtgagggaggaggatggtgctgtgattctcaaattggctggtggactcaccattttgatctttgtcttggagtgggtagttttgactcttgcatttttcttgaagtattatgcttgtgttgaggggaatagtggcgctgttgtgcctgtgaggagtgggaaggtgcagcaggatgaggacttgaaggattggccttggccttttcaagtttga

SEQ ID NO: 3261 - DNA, 915 bp, Glycine max var. Williams 82
atggaggattcgttggagaattggatttcactgttggaaatggaagaatatcatgatgggtcatttgatgaggaagagttcctaagagagatccttaaggaggagcagcagccagaaaatttgtggcctcaaagagatcaaaagctctccaacaccagccccactgtgtcctttgatgaggcaattagcttttgtgggagtggcactctacataaaagcaacagctccaactccatcaagtctttgaaaagatcatcatcaagtgtctcaccagccaccactacataccttctttcttttgatacctcaagtgctaaaccaatcacacttaaaccttcccctaagcttgatttggcacttggatcatccaataaaaggagtactagtactgtaactgtggtgaaagatgggtgtgaatttgaaccattgatgatgccccaaagccaagcaaggaagaaggttagaaggtcatgtgagacacagcatcacattattgctgagaggaaaaggagacaggaactgacagggagcattatagcacttgcagcaactattcctgggctcaagaggatggacaaggcttatgtgcttcgtgaagctgtcaattacacaaaacaacttcaagagcgagttaaagagttggaaaatcaaaacaaagtagattcagcaacattcataaggaaatctcaagcttcctcacattgtgaaacgaacaaagaaatatcactatttgaggttgaagcaagagtcttagatgaggaagtactcattggaatccattgtgagaaacaaaaggacatagtgttcaaaatacatgccttgcttggaaagctccatctctctacaaccagtagcaccgtactgccatttgggacttctactcttataatcaacattattgctcagatgaattag

SEQ ID NO: 3262 - DNA, 1029 bp, Glycine max var. Williams 82
ggatttgggatagttggagctgtttttctcactcaaaatatgttcgtcaatagtatatactaccatgtacagcaagggaagttgcgtgttcccctcacaaaaaatgagatttcccttcctttgttgcccaaacttcaacttgaagacatgccctcattcctctcctccactgatggggagaatttagttttgctcgatttggcagtggctcagttctccaatgtcgacaaggctgattggatcctttgcaattcattctacgagttggaaaaagaggtaaataattggacattgaagatttggcctaaatttaggactataggaccatgcataacatctatggttttaaacaagcgacttacagatgataatgatgaagatgatggtgttacacaatttaagagtgaagaatgcatgaaatggttagatgataaaccaaaacaatctgttgtttatgtttcttttgggtccatcgcagcactcaacgaagagcaaataaaggaaatagcttatagtttgagagatggtgaaaattactttttgtgggtggtgagggcctcagaagaaactaagcttcccaaagattttgaaaagatatcagagaagggtttagtgataaggtggtgctcgcaactaaaagtcctagaccatgaggctatagggtgttttgtaacacattgtggttggaactccacattggaagccttgagtttaggagttccagtggttgcaatgccatattggtctgaccaaagtacaaatgcaaagcaaattgtagatgtctggaaaatgggaatcagagccacagttgacgatgagaaaaaaattgtgagaagagaagtattaaagcgctgcataatggaaataatgaagagtgagagaggcaaagaggtgaaaagcaatatggtgcaatggaaggctttggctgcacgagctgttagtgaggaaggaagttctcataaaaacattgcagaattcgtgaatagcttgttcaatttacaacagagaattgcaaattatcctgattaa

SEQ ID NO: 3263 - DNA, 1073 bp, Glycine max var. Williams 82
tccagtcatagaatttgattctctaaagtaagtccaaaaaataaaataaaataaaaaagtgaagccagtgaaaacaaacaagattatccatattccttatcatcacttcactggtctaacctgcgacatacatttcccgctaagccgaaacagaaatgctcctcagttactctctgcacctcccaattacatcttcttactcacacacctccaaccgcagtcccaactcgagcggttacataaagttccgaacaaggtaccgcgaaaacctgcgatacctgcgagccttaaccataatcgacccaaaaaccaaaccagaggaccttcctctccccaacgacgtcgaccacatcatcgacactctcacattcctcaagtcgcactctttctccgacgccgacatccctcgcctcaagttcctgacccctgagctcttcaccaccgccgtcgtcccctccgacgtctccgccgtgttccgcttcctcgccgacgacctcgccgccacgaaatccgagtcccgcgacctcatcctccgatgccccaaactcctcttctcacacgtcgacctctgcctccgacccacgctccaatttctccggcaggggctgaaccggccaacgacaaggaacgcgcacctgctgaacacgcgcgtagacaagctgcatgcgaaagttgagttcttgcaagagttggggttttcgtacgaggaggctgtcagggcttgtgctaggttacccgcaatttttgggtatgacgtggagaacaatttatggccaaagtttgtgtatcttgtcaaggaaatggagagggatttggaggacttgaagaggttccctcagtactttgggttcagtttgaaggagaggattgtgccaaggcacttgcatttgaaaaaaaggggtgttaggattcccttgaatagaatgttgatgtgggctgatcaaaagttctacgccaagtggaagtgattagtcaactcacatatttgctcataaccttatatgattcaacaagatattatcttctttttaattgtctaatccaaatagactgttatatttccataaactagt

SEQ ID NO: 3264 - DNA, 372 bp, Glycine max var. Williams 82
atgggcgttcttttttctagcaccctggaggaggagagtcctgacgtgaaagcgttccactccgcggagcgctgggagagctacttggaaaagatcaaagagtcccctaagctagttgtgatatatttcacggcgtcctggtgtggcccttgcaaattcatcgctccagtgtttaaccacatggccgcagagtttgcaaacgctgacttcgtcaagatcgacgtggacgaattatctggtgtggcgaaggagtttaaggtggaggcgatgccgacgttcgtgtggtggaaggaaggaaaggaagttgagagggttgtgggagccaataaggacgagctccagaacaagattaagaaacattatcaattgtga

SEQ ID NO: 3265 - DNA, 867 bp, Glycine max var. Williams 82
atggggattgggaagaacctgtctgagacaaaagggagggagttgtgtgaattgcgtgaagagaccaataccaacaccaccaacagcaataacaacaaatcgaggaggaaccggagacatcgtcagaggaagatgtcgcctggtcagaaattgtttcaaacgtgtaatgaagtgtttgcttctactggccctgggattgttccttcccctcaaaacattgaaatgcttctctctgttttaggtgaaataaaacaagaagacgttggcttaaagcctgaaatggcatttttcagttcaaataatcctcgaagaactccaaaaattacatacctgcacatttatgagtgtcaacaattttcgatgggaatattttgcttgccaccttctggagttattcctcttcacaatcaccctggaatgacggtttttagtaagcttctttttggaaccatgcacatcaaatcttatgattgggtcgttgacttgcctcctcacatgcctaccatagtcaaaccatcatcagaaaccgaggcttcggatatgcgattggctaaagtcaaggttgatgctgatttcaatgctccttgtgacccctccatcctttatcctgctgagggcaacatgcattggttcacggcagtgacagcttgcgcagttttagatgttcttggtcctccatactctgatcctgatggaaggcactgcacatactaccagaatttccctttctccagctattcagtagatggactatccataccagaggaggaaagaacagcatatgaatggcttcaagagaaggagaaacctgagaatttaaaagtagttgtaaagatgtacagcggcccaaaaattgtggagaactaa

SEQ ID NO: 3266 - DNA, 279 bp, Glycine max var. Williams 82
atgtctagccgaagatccagacaacattcagggtctacaaggatctccgatgaccaaatcatcgaacttgtttccaaattgcgccaacttgttcctgagattcgcaataggcgatctgataaggtttcagcgtcaaaggtcctacaagagacctgcaactacatcagaggcttgcacagagaggtgagtgacttgagcgagcgactgtctcagttgttgaccacaattgatgctgatagtgctgaggctggaatcattaggagcctacttaatcaatga

SEQ ID NO: 3267 - DNA, 2304 bp, Glycine max var. Williams 82
atggatcctttttgggagtgcttttggatttttctctctaagcttttgaatactctgctttgggtattcaccaaagccatcgtgagattatatggttctgattcttataaatcgatgaaaccgctttgttcttctgagtttgtatgtgacaatgagaaagctgagtcaattcattccaagtctgaatattttggggcactaaatgatactctctcacatggaagtgatcaaattgattctaatggtttccagaaagaagcagagtccatggaaaaatgttgttccgaaactgttcatgatagtgggaattctggacttgaagaagaggaaacaccaaagttggttttcaaatttgaatatcaaaagtggaattgcaattatgatgaagaattcaaaggagggaatggtgaaagtggtgattttgtgaaggggggtgatgctgtttctgctagcaccaataaatatgagttcatgtcaggcacgagtttcagccacttcttggatgaacccgaggctgaaaatttcacgttcaaagaatgttttgttcattcaaatgatgctttggaattggaaaatcatgttgacaatgattttgggttcttatcaaggaagaaattcattccagaaaattgtgatagagggattatgtcagaaaatcttaacagtttcacagaaagtccacacaaagaggtgtcagagaagttcaaagctgaggaaccaatggggcagtctgtagagccagttgttcgcaattttctttccggggatgattttatttgttcaagttctgactcagattctgttgtcagttctttgggggaggggtttttgtcagacacagactttggaaccactactgagtttgacacattgggaagcaatgcaacagaagaggatttggactttggggatgagaaaaactatgaggatttggatgttggatatgaccctgatgattttactgaagaggatgaagatataatggatgagcttggaaacttggaagaagaatgtaggctggagaagtcttcaggtaaaaattctgaagatagcaatagcatcaattccaaacatgaacaatctgtgaagcctaattcacaggctttagcaactattgatcttgaggattccaaccgttttgacacactatgggagcatcaagatttgatagaacaattgaagatggagctgaagaaggtcagagccactggtcttcctaccatccttgaggattctgagtctccaaggataatggaagacttgaagccatggaaaattgatgaaaaattacagcatggtagcaccacaaatgaacttccaaaattctacaggagttaccgagaacgaatgcgaaaattcgatatcttgaattaccaaaagatgtatgctttaggtgttttacagtcaaaggacccactccaatcattttcaacccgtaagaacccttcaccagcattcacatccattcttacacgcggctttcgcctttctagacgtaaaaacactgaagttgacccaatgaggaagttcataagagagttgtacagtgatttggaaatggtttatgtggggcagttgtgcctttcttgggaatttcttcagtgggaatatgagaaggccttgaagctatgggaatctgaccaatacgggttgctaaggttcaatgaagtagcaggggaatttcaacaattccatgtccttctccaaaggtttatagagaatgaaccattcctccaaggtccacgggttgaaaactatgctaggaatcgttgtgcaatgcgcaatcttcttcaagttccagtaataagagaagacaatgccaaggataaaaggaaattcagaaaaagagaggctgataaagatgcaatcacaagtgacatgctagtggagattttggaagaatccatcagaacaatttggcgtttcataagagctgataaagatgcatccagcttggcacttaaaggtcaaagagaaaaccaagtagagctccaagacccttcagattcacagattttggtggagattagaacggatcttcaaaagaaggaaaagagactgagagagcttttgaggagtggaagctgcatattgaagaagttccaaaagcatcatcatgaagatggggcagatcaagtgctttattttttctctcaagtggacatgaaattggtttggagagtgttgaacatgtcaagaataacgaccgaccaactcgcatggtgtcgtagcaaactaaacaagatcaattttgttaacagaaggatacatgtagagccatcattcttacttttccctagttaa

SEQ ID NO: 3268 - DNA, 1133 bp, Glycine max var. Williams 82
gttaccatgtgcaatgcaagtgatgtgaagaaggtatttgcggaggttatagggacatttctgttagtgtttgtggggagtggttctgctgggcttagcaagattgatgaaagcatggtgtcaaagcttggagcttcacttgcaggaggactcatagtgacagtcatgatttactcaattggacacatctcaggggcacacatgaacccagctgtttcgcttgcttttaccgccgtgaggcatcttccgtggccacagctcccattttatgtagcagctcaactcactggagccatttctgcttcatacacattgcgagagctgttacggccatcagatgagattgggggaacttcacctgctggatcacacattcaagccctaatcatggaaatggtgagcacatacaccatggtgttcatttccatggccgtggccaccgactcaaacgcgacaggacagctatcaggagttgcagtaggttcttctgtttgcatagcaagcattgtagccggaccaatatcagggggatcaatgaacccagcaaggacattaggtcctgcaattgcaacatcatactacaagggactttgggtatattttgttggaccgattactggggcagttttagcagcatggtcttacaatgtgattagggacactgaacaccctggttttcccatttcactatcctccatttcatccaaggtgcgccaaagcattggtggaaccgaacaaaaaagcgaccaaagatgcttggtgtgaatgaaaataataaacatcaatgttttttctgacaccacacccttgaatgtcttgtcttggaggatctcaagtttccacatgtattatcatgtatatcaataataccatgccgagatcatatggtattattagctaggccatgtatcgagttagtttcagggctatgagctagccatgtataatgcaaaagtgtgtagtgtgattttcctacattaatgaaatgtcagcttcatatgaaatgcaatatggacaacaaatcggatgctattaatgatgattaaatgcagcccaaaactggtatgtgattaatagtcacaaaatattctcaatttaacatcaataatatatacacctacacattcaaatcc

SEQ ID NO: 3269 - DNA, 1794 bp, Glycine max var. Williams 82
atgggttgtttgtattttcttagaaaggacacgatggaagaaaaggtaaataaggagcaccaggtttgcacatcggatggagctattgatagccagggtcatcctgcagttcgagagaaaacgggtgactgggttgctgcaattttgattttagtgaatcaagggcttgctactttggcattctttggaattggagtgaatttggtgttgtttttgacgagagtgatgggtcaagacaatgctgaagcagccaacagtgtgagcaagtggacagggacagtttacctcttctctcttcttggagccttccttagtgactcttactggggaaggtacatgacctgtgccatcttccaggtcatatttgttattggtttggtgtcattatcactatcgtcttacatattcctactgaagccaagtggttgtggaaataaagagttaccatgtggatcacactcatcataccaaacgattttattctatgtttccatatacctaatagctctaggaaatggaggataccagcctaacattgctacatttggggctgatcaatttgatgaaggagataccagggaacaacattcaaaaattgtatttttcagctatttttatttggctttgaacattgggtcactcttctccaacaccatattgaattattttgaggatgatggactatggactttggggttctgggcttcagctggctctgctgctctggcattggttttgtttctttgtggcacacgaaggtatagatactttaagcctaatggaaaccctcttcctagattttgccaagtttttgtggctgctacaagaaaatggaaggtcaaggtgttacaagatgataaactttacgaggttgatgaattctcaaccgatgaagggagaaaaatgctccatactgaaggatttagattcttagacaaagcagcatttatcacatcaaagaatttcaaacaaatggaagagagtaaatgcagtccatggtatctatccactgtgacacaagtagaagaagtgaaatgcattctaagactactcccaatttggctatgcaccatattatactctgtcgtttttgctcaaatggcatcactttttgtggagcaaggcgatgccatggacactagaatatcatctttccacattcctccagcaagcatgtccacctttgacattctaagtgtagcaattgtcatcttcatttataggcgagttctcgaccctcttgtggccagaacaatgaaatcaaaaggactcactgaacttcaaaggatgggaattggtctagtcctagcaattatggccatggtttcagcaggattggtggagcactttaggctaaagaatgcaatagaagactgcaatgaatgtaaagggtctagttcactttccatattttggcaagtgccacaatatgtgtttgtgggggcatcagaagttttcatgtatgtgggtcaattagagttcttcaatgcacaaacacctgatggattaaagagttttggtagtgcactttgcatgacttcaatatcacttggaaactacgttagtagcttgcttgttgcaattgtgatgaagatttctgccacagatgagatgccaggatggatcccaggaaacttgaacaaagggcatttggatatgttttacttcctcttagcagcactcaccgcagctgatcttgtaatatatgtactgatggctaggtggtataaatatgtcaaatttcaaggaaacaatgagaatgacaccaacaaagaagaccctgaagtagtgtag

SEQ ID NO: 3270 - DNA, 798 bp, Glycine max var. Williams 82
atgttgactcacatctatttattccttcccaatttcctcctccatttccacaaacaacttctttcaaggaaaatggctcttcttggatttcttctgggacttttctacatgatctcacatgtcaaggggtatggttttggaggttggaccaatgcacatgccaccttctatggagggggtgatgcttctgggacaatgggtggggcttgtggttatggaaatctgtatagccaaggttatggaactgatacaacagcactgagcactgcactgttcaacaatggcttaagctgtggtgcatgctttcaaattaaatgtgcgaatgacccacaatggtgccttcctggctccatcatagtcactgccacaaatttctgtccacctggtggttggtgtgaccctcccaatcaccactttgatctttctcaacctgttttccagcacattgctcaatatagggctgggattgtgcctgtagtttacagaagggtgaggtgcaggagaaaaggtggaatcaggttcaccatcaatggccactcttacttcaatttagtccttgtaaccaatgttggaggggctggtgatgtgcatgctgtgtccatcaaaggttcaagaactagatggcaagccatgtcaaggaactgggggcaaaactggcaaagcaactcctacttgaatggtcagagtctttcctttgtagtcaccaccagcaatggacacagtgtggtgtcatacaatgttgccccagctggttggtcctttgggcagacctacactgggaggcagttcaactactaa

SEQ ID NO: 3271 - DNA, 1242 bp, Glycine max var. Williams 82
atggcaaggaagagaaaggttactgaagcagttgaagagaggaatccatgtgaggcaacaatggcatgggaagaggtgatgaaggaagctgctgaactaggaagtgccaggagattgaggaagaagtttgttggggtgagacaaaggccatcaggaagatgggtggctgagataaaagataccattcagaagataagagtgtggttaggaacctttgatacagcagaagaagctgcaagagcctatgatgaagctgcttgccttcttcgcggcgccaacactagaacaaacttctggcctagttctcaatcttcctcaactcctgctcttccctcaaagattaccaatctcctccttcaaaggcttaaagcaagaaacaacaataacaataacaacccttgttctctttcttcttcctcctcctccagttctcttttcatcaatcaccaacaaaagcagctagaagatgtatgtggaactgagtcaacatttttctcaatggacctgttctcggatttccttaatgaccctgaagattacagcacaagcaacgatgagtttagcaatgatagtgcacaaattgattacatcacaagtagtcttgaatcatgtttaaatggaaatgatgattgcagggaaaaagaaaaagaaatggaaatggaatttgacttcagcagtgtgacaccaacatcaagtgctgatgtaaattcaggaggggagagagaggaagagagtgaagaagccactgatttgagtgctcaggattttcagtttcttgacaatgatgttccacccggttacttttattcaccttttgagattgctgaagatattgaggagcaattggagccagagaactatggtgatgagccttcaatgctgagagaagtaatgaagagaatgaaatatgagaggaagttttcagcttctctttatgccttcaatggaatacctgagtgcttgaagttgaaacttgagtcaggaaacacaaatggaagaggggtttctatttctaatcaactaaccaacctcaagatggcttgtagcaaaaacaaaaatgaggctaataagaagaatgaagaatacattgaagcaatggataggaaagaggaagaaaacccacaaacatcaattggcatggaatgctcttccctctctttctcatccaggattgatgatgatgatggagaactgttgctatggaattcacttgatcttcctactctttgctttgttaactag

SEQ ID NO: 3272 - DNA, 1347 bp, Glycine max var. Williams 82
atgagttacccacactttcttgttatgccttatccaattctaggacacatgaatccacttctgcagttctctcaggttttggccaaccatggctgcaaaataacctttttgatcactgagttcaaccaaaagagaatgaagagtgaaattgaccacttgggagcacagataaagtttgtgacactcccagatggtttggatccagaagatgacagaagtgaccaaccgaaggtgattttgtcactcagaaacaccatgcctactaagcttcacaggctcatacaagacatcaataataataataatgctttggatggtgacaacaacaagatcacttgtctggttgtttctaagaacataggatgggccttggaagttgcacacaaattgggaatcaaaggggctcttctgtggcctgcttccgctacttcgctggcctcttttgagtccataccaaggctcattgatgaaggaattatagactctgaaactggacttcctaccagaaaacaggagattcagcttttaccaaattcgcctatgatggacacggcaaatctaccatggtgtagccttggtaagaactttttccttcacatggtagaagatactcaaagtttgaagttaggagaatggtggctttgcaacaccacttgtgatcttgagccaggagcacttgccatgtggccaaggttcctttcaattggcccattgatgcaaagtgacaccaacaaaagctcattctggagagaagacacaacttgcctacattggttggatcaacatccaccccaatctgttgtgtatgtttcttttggaagtttggcaatagtggaaccaaaccaattcaatgaattagctattgggcttgatctccttaacaagccttttctttgggttgtacgtccaagtaatgagaataacaaggtaaacaatacatacccaaatgaattccatggatctaaaggtaaaattattggatgggctccacaaaagaagatattgaaccaccctgccatagcttgcttcattacccattgtggttggaattctatcatagaaggtgtatgtggtggcatacctttcttgtgttggccatttttcagtgaccaatttattaataagtcatatatttgtgatgtgtggaaggttggactgggattagaccaggatgagaatggattaataatgaagggagagataaggaagaaggtggagcaactgcttgggaacgaagatataaaagcaagatcagtgaagctgaaggaattgaccgtgaataactttgacgaaggtggtcaatcttcacagaatatcgaaaagtttatcaattgggccaaggattaa

SEQ ID NO: 3273 - DNA, 1539 bp, Glycine max var. Williams 82
ttttggttaaagtctaggaatattccatgaacaaagtcgatcgcctcctatgaatttccttagttttctcagccgatcgagatagaaaatccgtcattgataattcattcatatataattagatcctcctttcgtgattctattctccttggttgttattttctttatcattgtccaaatgagttctcttccgggcttgcttgtggttattcttccacttttttacaatgttgcagctgcttgttctgatggaacgtgcaagcttcttgatgagtgctcgtccgatggagattgtggcactgggctctattgcttttcctgtccatttgggtttttaggctctaggtgtgtgagatctactgtcacaaatcaattcaagctcataaataattctctgccattcaacaaatatgcatttttgacaacgcacaacgcttatgccattgatggggagccatctcacacaggcgtgccacgagtaacttttaccaatcaggaagacagtgtcacccaacagctaaataatggagtacgtggactaatgctagatacatatgattttgacggagatgtgtggttatgccattcatttgaaggccaatgccatgacttcacagcttttgaacctgccctagacacattgaaggaaattgaagcttttctatcagcaaatccaacagaaattgtcacactcatcttggaagattatgttcatgcaccaaatggtttgacaaaggtcttcactgatgccggtctgatgaagtattggtttccattgacaagcatgccaagaaatggtcaagattggcctctagtgagtgatatggttgccaaaaaccaaagattactagtgttcacttctattgcttctaaggaacaaagtgaaggcattgcttaccagtggaatttcatggttgaaaatcagtatggagatggtggtagaaaagcaggaagttgtccaaatagggcagaatcatctccccttaacgacaaaagcaaatccttggtgttggtaaactattttcgatcaactccaattaaaccaatcacatgtgaagataactcaggagaactaattaacatgctacaaacttgttttggtgctgctggcaaccggtgggccaattttgttgctgttgattattataagaggagtgagggaggaggatcgtttcaagcagtagacactctcaatggaaagctactatgtggatgtgatgatgttcatacatgcgtgcctggatcaacatcagaagcttgctctcaatcataggaaaaatcatagtaacaagaccaaccatctggaaataattcaggcattagattgttgtcaattttcagttgttaaaaccattattgcttgtcatgatcttgttggtaaggatttctaatccaaggcagcattaattagaacatccattacattgacgaaatgaccttggtattaaattcaagagcagtgctatttcgtatgaaaaagtatttattttattggctatttgtgattaaaaaaatattactagtaatttgacagaaatc

SEQ ID NO: 3274 - DNA, 381 bp, Glycine max var. Williams 82
atgaattggatcaaaacaatcctaaaatttaggccccaacaatgccgccgccaagcgacgcacctcctctgcgaagcgcgtgttcttcgtgtccgctacggtggcgtcgaaggtgtccgccccgcagcggaagaaggacccaaagaagcacgtgattatcacgggatggggctcgcgtcagtgttcgggaacgacgtggagggatactatgagaagcttctcgccggccagagtagcatcatcgctcctgcgcgcaggtgcaggccaccaggatctcagatctattctctctttccacatttccttcttattttgttagtttacatttctgtgagacaatcctttttgaggcaccgtgagagcgtgggtttggttgattaa

SEQ ID NO: 3275 - DNA, 1395 bp, Glycine max var. Williams 82
atggctttattcatggcagttcttggtgttgttgccttggtgctctgtttttgctctgctctcttgaagtggaatgaattgaggtataggaggaaaggtttgcctcaaggcacaatggggtggcctgtttttggggagacaactgagtttcttaagcaaggtccaagcttcatgaagaacaagagggcaaggtatggcagttttttcaaatcccacatcctggggtgtcctaccattgtatccatggatccagagcttaataggtacatactcatgaatgaagcaaaagggcttgttccagggtacccacaatccatgttagatatcttaggcacacgcaatattgcagctgttcatggctccactcacaagtacatgagaggagcacttctttcaatcattagccccaccttgatcagagaccagcttttaccaaaaattgatgagttcatgagaacccacttgagtgattgggataacaaagtcattaacatccaagagaaaactaaagagatggcatttctctcttccctgaagcagatttctggtatggaatccagctcaatatcccaacccttcatgacagagttctttaaacttgttttaggaactctatctttgcctattaaccttcctggcacaaattatcgccgtggattgcaggcaagaaagagtattgtcagcattcttagtcagctgctagaggaaaggaaaacatctcaaaagggccacgtggacatgcttggttgcttgatgaataaagatgaaaatcgatacaaactaactgatgaggaaatcattgatctaattattacaattatgtattctggttatgaaactgtttcaaccacatcaatgatggcagtgaagtacctccatgatcatcccaaagttcttgaagaaatcagaaaagagcattttgccattagggaaaggaaaaatcccgaggatccaattgattgtaatgatctcaagtcaatgaggtttactcgtgcggtgatttttgagacctccagattagctacgatagttaatggggttctaagaaaaacaactcatgacatggaactaaacggctatttgattcctaaagggtggaggatatatgtatatacgagagagatcaattatgatccatttctgtatcatgatccactaacattcaatccatggagatggctgggtaacagtctagagtcacaaagccacttcttgatatttggaggagggaccagacaatgtccagggaaggagttggggatagcagaaatttccactttcttacactactttgtaaccagatacaggtgggaagaaataggaggagataaactgatgaaatttcctagagttgtggcaccaaatggactgcacataagggtctcgtctaactaa

SEQ ID NO: 3276 - DNA, 2007 bp, Glycine max var. Williams 82
gcgagaaaactgatggcacagctcttgtattattattgttgtttactactttctaaaaaccggaaaagtctcctaaaaagcgtttgatacccgccactgcctctgagtctaccgttctgttcttcatttgcgtgcgttaagcattcttctttctttccttctcatttttcacccattcattttcaggtaaacaaattatggatattgatgcaatttttgggaccattcgacccgtgagtgttccaaggaagagtgccatttatgtgtgggggtacaatcaatcagggcagacaggtagaaaggggaaagaggatcagttgaggattcccaaacagcttcctcctgagctgtttgggtgtccggctggcaccaatgcgcgctggttggatgttgcctgtggtcgggagcacacggcggcgatagcctctgatggctcactcttcacttggggcactcaaagggatactgaataaataaatttctaatgaattatttgtactttagaggggctaatgactttggtcaattgggtgatggaactgaggagcgaaggaaacttccagaaaaagtaaagcaattagagtcagagtttgtaaaatctgtatcctgtggagcacattgttctgcttgcattgctgaacctcatgaaaatgacggtaccatctccacaagaaggctctgggtgtgggggcaaaatcaggggtcgaatcttccaaggttgttctggggggcattcaaacctaatactattattcgtgaagtgtcctgtggagctgtccatgtggttgctttgtctgaggaaggcctactacaagcttggggctacaatgaatatggtcaacttggccgaggtgttacttgtgaaggactacagggggcttgtattataagttcttatgctaaattccttgatgaagcccctgagcttgtgaagattgccaaagtgtcatgcggggagtaccacacagcagtcatttctgataagggcgaggtctacacatgggggctaggaaatatgggccagcttgggcattcttcactccagtatggggataaagagttactgccaaggagggtggttacccttgatggtattttcataaaggacgtggcatgtggcggtgtacacacatgttctgtaactcagggaggagcactttatgcctggggtggtggtcggtctgggcagctagggcttggcccccaaactggattattctcgtgtgttgctaatgactctcagacatttttccgaaacattccagttttagtagttcctaaaggtgtgcaacttgttgcatgtgggtattctcacacccttatctctatgagtgatggtcgaattcatggatggggttacaataattatggtcaggcagcaaatgagaaatgtacatatgcttggtatccatcaccaattgactggtgtgttggggaggttcggaaactagctgctggtggtggtcattcagctgtgttgactgatgcttattcattaaaggagttatgcgagtttgtacttgcagatagtatgactttatctaatgctgctaaggttgaggatattgcatatagaactggatcagatgctttggcgcgcctttgtggaagacttagagagtatatgcttgctggtggagctcttgaacaaaaggaggagatgaactgtaaaatctgactaagcatataaagttagtattagtaattatttatgtatactcatgttgtatgatacaagtattcataaggggaatgtcgtcattattgaacaaaagcaatcgcacgattgacgcaagcaagaaatcacttgctacgtagacaatgaatttgtccatatcgaatcaacagatcactaactcttgtagggtgaacatcgtaaacattctgaataactcttgatttaaacgagactccagttatgttgattagctacttttatcttgtgcatagctactgtagatgagtttctacttttgtatatttcttaatctaagacaaaacaattct

SEQ ID NO: 3277 - DNA, 192 bp, Glycine max var. Williams 82
atggattctcagaaggcaagctacaacgctggagtgaccaagggccaaactcaggaaaaggccagcaacatgatggacaaagcttctaatactgctcagtcagcaaaagactccatgcaagagactggtcaacagttgaaggccaaggcacaaggagctgctgatgctgtgaaggatgcagtgaacaagtga

SEQ ID NO: 3278 - DNA, 261 bp, Glycine max var. Williams 82
atgatcacacctttgtggaacttgctacgtcgttttgtaacactaggcctcgtcatgctccttcttcttgcgggcataatcatcactgttttcatcctttcaatgcctctgttgatgatcgtgacaagccctatatggattccaactggtacggttttgtttctcgttactgcagcgttgttatttgtgtgcggattcgttgttgttttggtggctatggtgttaagggcttttcgctcctttgggggacacaacctttga

SEQ ID NO: 3279 - DNA, 768 bp, Glycine max var. Williams 82
atggcagcctactcaagccatgctttgaaaaccatccctttttcttcctttgtgaagcctgtcagtaccaaaccaacatcattcttcacaccttcacctaccaaacctttcttacccttcacctcaccaaaccactctctcaccaaaaatctcaagctgaactccactttgccacacttttgcttgtcttcagttcccaagaaatctttcacttgtagaagccaggctgagcctgttgactcagaaaaagtccaagaactgagtgtgtatgagatcaacgagcgtgaccgtggaagccccgtttatcttcgattgagctataaaagtgtcaattcccttggtgatttagtcccctttagcaacaagttgtacactggagatttgcaaaagcgcattgggataacatctggtatctgtattttgatccaaaacaaagctgaaaagaaaggggacaggtatgaagcaatcttcagcttctactttggagactatggtcacatagcagtgcagggaccttacctgacctatgaggacacatatttggctgtgactggtgggtctggcatatttgagggtgttaaaggtcaagtgaagctgcgtcagattgtgtatcctttcaagattttgtacacattttatctaaagggtatcaaggatttgcctcaggagcttcttgtcaagactgttgagccaattccatctgttgaaccttcccctgctgctaaggcccttgagcccaatgctaccattgctggcttcaccgactaa

SEQ ID NO: 3280 - DNA, 1227 bp, Glycine max var. Williams 82
atgtttaggaaaaggcacaccctttcttctcttgcaagggaattgttggcatttcagccactttttcttctcttcttgttcagcttgcaccacaacactatgcagtgtcaaggaaggttgagtaaacatgtttcttctgagcctccctcaccttctaggtcaacaccatcaccaccatcttcatcaggatacaaggatgaccctaggaagataattttgagcatggttttaggagcagtcactggactagtttcttctgctctctttgcacttgtggttcgttgtgttgttcagtatctgaaccgcacaccaatcctcaagggacctgtcatattctcccccaaaattgcccccatgacactccaatcagctttggcaaaggaaaaccacttgctcggttcgagtcctaatgggaagtactacaaaactgtgcttgacaatggactcactattgcagtcaaaaggctaacaccctttgagagtaattccccggaggctaagagaaaatcagtgaagaggcagatacaaactgagcttgagcttcttgcaagccttaggcataggaacttgatgagtttaagggcctatgttcgtgagcctgatgggttctcattggtttatgattatgtttccactgggagtcttgctgatgtgttgagtaaagtgagggagaatgagttgccctttggttgggaagttaggctcaggattgctgttggtgtggtgaagggtcttcagtatcttcatttcacttgtgtgcctcagattctgcactacaacttgaagcccacaaatgtgatgttggatgctgagtttgaacctagattggcagattatgggttggctaaacttctacccaatttggatggaggaagttctctctacactcctcctgaatgtttccataattgcagcaggtacactgacaaaagtgacatctttagttttggcatgatactaggtgttttgttaactggtaaggatcctacagatccattctttggagaagcagccagtgggggaagtttgggatgttggctgagacacttgcagcaagcgggcgaggcgcacgaagctctagataagagcatgttaggggaagaaggtgaggaagatgagatgctaatggcggttaggattgctgctgcatgcctctctgatatgcctgcagataggccttctagtgatgagcttgttcacatgctaacgcaactgcacagtttttga

SEQ ID NO: 3281 - DNA, 1098 bp, Glycine max var. Williams 82
atgaagttactaggctggatgcacaggaaacttcgccagaatagtagtgaaccattcaaggacttggtcattgggaattcttgcaattgtctttcagggcaggcaccacttgatgatgaacaagtctatcagaaaccaaaccttgggatcagactttccaaacatgctcagaaaggtcacaacaaccttagaaactcttttgctggcctagaagcagcaagagtagatgaagactatgagggagaatacttccctggcttccttgcaattggaactcttggttcagaacgagtatctgacccctcaacaacaccatcatttcccatttctgttgagagcataactgaaaaagaagatgaagtcactgagaatgatctgaagctcatcaatgatgagctagagaaagttctaggagctgaaaccaaggatgatgttagcattgactcctcaaggaggactagccatgttagcactgggagaagcagccatgtcagcactgggagaagcagccatgtcagcataataacactcagtggaaagccaatagaaggcacagaaccaaatggaaatggtgctgcaatttgtccactccagggatatctctttggaacagctattgaactgtctgaaactactgcagcagcagcaaagaaagaacataggacttcgctcggggagctgtttcagagaagcaaatcagctgaggagaatttcagcgcaaaatgtgaaaaggaggacaaaagagctgagaaggaagtggacaagtctgccatgaacctgatgaaagaaaagctgaagaaaagaatgctccatgcttattctaagaattctacttcaataaatggtgggcctattgattctgcttctgctgagacaaaactgaataagattctccatatgttccgcaagaaagttcaccctgaaagttcaacagctgcacaaaaatctgctaaacaccacaagaaccagaagaagaagaaaacaatcaatgatggaggctacaacaaaagtgacctggtgcatccagaggaagattcatctgtcaacagggagtactggatcaaaacagatgcagattacttagttctagagctgtga

SEQ ID NO: 3282 - DNA, 606 bp, Glycine max var. Williams 82
atggaagtagagatcaagcttcgtctcccagactcagccactcaccagaaactatccaacttgcttgcacctttccacaccaaaaccttaatccaagaaaacatcttcttcgatggcatgaacaaagagctcacttcaaacctcgccgttctccgaatccgcttctacgacttggaacactgcgtcctttccttgaaggccaagccagtgatctcggccggtataagccgcatggaggagcacgaggagccgttcgacgtcgcacttggccgtgcatgcattgctgagccatggaggctcttatccgtggagtcctcagagatactcaagagggtgagggatgagtaccgtgttggagaaaatggggtggtgtgcttaggtgggtttaggaatgtgagggctgtgcatcagtggaaaggcttgaaactggaacttgatgagaccaactatgatttcgggacaaactacgagttagaatgtgagagtgacgacccagagagacacaagagattgcttgaggagtttcttcaggggaatggaatcaattattcttattccaaactttccaaatttgctgtttttcagtccaggaagttgcctgaatga

SEQ ID NO: 3283 - DNA, 711 bp, Glycine max var. Williams 82
atgacgtccctgcagaattcaccaacgcttcaccgaactatgctccacaactctttccctcagaagcatgccactcgttcatctcgaagagatgccatttccttcattgtcaaagctgcccaagaaccctctgcttctttagcttctcaagatagacaaagaaggcgccaagtgattgcctttggaaccactgccccattagtttttctgttcaaccaacactcgaactcttttgctgcagaaaataagaagggatttttgcctgttttggacaagaaagatggatattcatttctctaccctttcgggtggcaggaagtagtaattgaaggtcaagataaggtgttcaaagatgtcattgaaccactggagaacgtcagtgtaaatgtgataccaactggcaaacaggatattacagaatttgggtcccctcaagaggttgctgaaactctaataaaaaaggttttggcacctccaaaccagaaaaccaagatagtagaagcaaaagagcaagatgttgaaggaaaaaagtactatcaatttgagttcattgctaaggctccaaactatactcgtcatgctctcagcacagtctccattggcaatggtaagttttacaccttaacaacaggagcaaacgagagaagatgggacaagatgaaagacaggctgcagacagtcatagaatccttcaaaattttcgatgtttga

SEQ ID NO: 3284 - DNA, 528 bp, Glycine max var. Williams 82
atgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtattga

SEQ ID NO: 3285 - DNA, 852 bp, Glycine max var. Williams 82
atgaaatccttgagtagtgtaggtcttggtctcagtattatttttggttgcctcttgttggctctggtagctgaggtatactatttgctatggtggaagaagaggataaccaacagagagattgagaataattatggcaaccctgtgaaggagttattctacatgttttgttggaaaaggccatcatcatcttctttgaggcaaacaagtttcactcctcctgagctttgctcttccatgagaattggtgacacccttgttcataacccagaacaagttcagtctcaaagtggcaaggactttgttttcaaaccctttggggaagatggcatggatgcagaatacatgagccagcaggacctcttaggtcctccaagattcttgttcaccatagtagaagaatcaaaggaagatttagaatctgatgatggcaaattcaaatgtgacaagagtggaaaaggttcaaggggtagaagcttgggtgatttgctagttgtggagacaccatatatgacacctactacttctccacctttctttactcctcctttcactactcctatcagtccctataaccagcgtggattcaatcctctatttgaaacagcaactgatgctgagttcaacagattaaagtcctcacctcctccaaaattcaagttcttacaggaagcagaagagaagcttagaagaaaactacaacaggatgaaaataagggaaatggagatgaggttgatggttctttcatcacaatagttgttgacaagaaaacagaaagagaggttaatcaccagcctcgtccaccacagtaccattcaggcacttcacaggtacttcccttagcatcttga

SEQ ID NO: 3286 - DNA, 507 bp, Glycine max var. Williams 82
atggataacactactaccacccactcaacaagttccacctattcaattactctcctccttttgagggtcttaacctttatcttccttgttatggcgctcattttcatttctataaacaagctaacatttgatgaaattgatgcagaaatcaagtttcatgatgtctatgcttatcgatatatgctctctacgatagtcattgggtttgcgtataacctcttgcaaatgggcttttcaatcttcacagtggtctcaggaaagcgtgtattaagcagtaatggtggttatctatttgatttctttggtgacaagatcatagcataccttctgatttccggttcagctgctggacttggtttcaccgtagagctgctgcaacatattccctcagattccttcactcaaaaggcaaatgtttcggccagccttcttctagttgggtttttgttcactgccatagcatcaattttcacttcctttgctttgccaaagaaagatattaattaa

SEQ ID NO: 3287 - DNA, 1006 bp, Glycine max var. Williams 82
aacccatttttgcctatttacttttttttttgggaaggctagctttacctaattacttaatggccggccaatttaaattaaccttgttgtccttaagtactccttatatatacgagtacctagtaaacgaggaatattattagaacacctggccagaaactgcaccaaatctgtctacagaaacattaattaggagaagcctgcgatggataacactactaccacccactcaacaagttccacctattcaattactctcctccttttgagggtcttaacctttatcttccttgttatggcgctcattttcatttctataaacaagctaacatttgatgaaattgatgcagaaatcaagtttcatgatgtctatgcttatcgatatatgctctctacgatagtcattgggtttgcgtataacctcttgcaaatgggcttttcaatcttcacagtggtctcaggaaagcgtgtattaagcagtaatggtggttatctatttgatttctttggtgacaagatcatagcataccttctgatttccggttcagctgctggacttggtttcaccgtagagctgctgcaacatattccctcagattccttcactcaaaaggcaaatgtttcggccagccttcttctagttgggtttttgttcactgccatagcatcaattttcacttcctttgctttgccaaagaaagatattaattaatgagttgtataattcattacaacaatttctacaacaatacccattttctctttctcattgttgtaaaaactgttgtacgaattatatttctcttaactaattagcttgatgcagaaataatgaacatggattatattatgatagtactttttgattcccttctctagttaatttgctttagttcaattcctttggtggtcaatcaatatttgtcgtggtcatctttgtgtaccagtgtgtatgcactaattagttaattacaccaaaaaaaaactctctgatcacaaactctct

SEQ ID NO: 3288 - DNA, 414 bp, Glycine max var. Williams 82
atgagtgtagaaattttggatggtgccaccattgtcaacttccttcaggatgaagaagcattcagtgcctcagttcttaaccggttcgcctaccttgacacagacaatgatggccttctctcgtatgcggagatgttgaaggagctccaaagcttgagggtgttggaaacgcactttggtattgatgtggagccagacccagatgagcttgctcgtgtttatgaatccttgttcgtacaattcgatcacaacttgaatggcaccattgatctcgacgaattcaagaaggaaacgaagcagatgatgcttgccatggcaaatggattgggcttcttgccggttcagatggtcttggaagaagacagcatcctcaaaaaagctgttgaaagggagttcccaaaagtggcttcttaa

SEQ ID NO: 3289 - DNA, 1809 bp, Glycine max var. Williams 82
atggccaaaaaccagggatttgccgtaggaatcgaccttggtacaacctactcgtgtgttgcagtgtggcaggggcaacaaaatagagtagaaataattcacaacgaccaagggaacagaactacaccttcttttgtcgctttcactgacgatcaaaggttgattggtgatgctgctaagaatcaggctgcagccaacccagaaaacactgtctttgatgccaagaggttaattggtaggaaatacagcgatcccactattcaaaatgataaaatgttatggccattcaaggtcatagctgataataatgacaaacccatgatcaccgttaaatacaagggccacgagaagctcctttcagcagaggaagtgtcatctatgatcctcatgaaaatgcgggagattgctgaggcatatttggaaacaccggtaaagagtgctgttgttacagtgcctgcttatttcaatgattctcagcgtaaagccaccatagatgctggaaccatagctggccttaatgttatgcggataatcaatgaacccactgcagcagctattgcatatggccttgacaagagaattaactgtgttggagagcgtaacatttttatctttgaccttggtggtggtacttttgatgtttctctccttacaattaaggacaaggtcttccaagtcaaggctactgcagggaacacccaccttgggggagaggacttcgacaacagaatggtgaattacttggtgcaggagttcaaaagaatgaacaaggtcgacattagtggtaaccccagagctttacgaaggttgagaactgcgtgcgaaaaggtgaaaaggacactctcgtttgctgttacaaccacaattgaggttgattcattatctaaaggcattgatttctgcatttcaatcactcgtgcaaagtttcaggaacttaatatggatctctttgaggagtgtctgaagactgttaataagtgtcttacagatgcaaagacggacaagagcagtgtacatgatgttgtccttgttggtggttcttcgaggattcccaaagtgcaggaactattgcaggaattctttgagggaaaggatttttgcaagagtatcaaccctgacgaggctgtcgcttatggagctgccgtgcaggctgctttgttgagtgacgacattcagaatgttccaaatttggttttgttggatgttgcaccgctgtcacttggtatatccacaaaaggagatctcatgagtttaagaggactcaaggaagataaccaaacctctgcgcgtattgaggtttatgaaggcgagagaaccagagcaaatgataacaatttgcttggtttctttagtcttttgggtttggttcctgctcctcgtggccatcctgtggatgtatgctttacaatagatgtaaatggcattctatctgtttctgcggaggaaacaaccactggttataggaatgagattaccataaccaatgaccaaaaaaggctttcagctgagcagattaaaagaatgattcatgaagctgagaaatatcaggttaatgatatgaagttcatgaagaaggctaatacaatgaatgctttggatcactatgtttacaagatgaggaatgcattgaataataagaatatcagttcaaagctttgtttacaagaaaggaagaaaatcaaatctgtaattacaaaggtgactgatttgcttgagggtgataatcagcgggataaaatagaggtgtttgaggatcatctaaatgagcttgtgaacctctttgatcgtgtcattggcaagtttgcttag

SEQ ID NO: 3290 - DNA, 2847 bp, Glycine max var. Williams 82
atgaatgattctactgtgaagaatttggccatcacggagaagaaggtgcagcagcataaacctggtggttgtgttggcattttctttcagctcattgattggaagaggaaactctccaagaagaagctcttctccaagaagcttcttcctcctgctcgtgcgaaaaagtttaagggagatgaaaaaatgccaaattccaagcttcacttgattgctaatgagaacagtggaggttttcctggtgctaaaaaagttgggaatcatggtctagatgtagaacaaaagagtgaaatgcgagttccgagtctggtagctaggttgatgggtctcgaatctattccggcagctcagcgagacaagtccaagaaagccttgtgtgctgatgggaagaaggaatctttgggtgaccattgtgagttggataggcaaggcgtggatttggaaatgggagttgtaaagcatgattcaagacctcagaagcttcagaaaactgggtcatatgagagaagggcggtgaccaggtttggagccgaggcactgcaaattaagagtgttttgtcacgagcaagaaaatataatcaccatcatcatcagaagcttgcttctttgagaaccccaagaattccttccggaaagagtgcttctcgaagctctaggttaataggagcagctacaaaaattttggaacctggactgcaaagcagaagtagagctaaaaattctcttacatatcctgcttccatgtatcctcccaagactggcattgtgacaaatggtgtggaagatgggtcagcgattatgcaaaatcaatcttgttttgaaaccagctcatgcaagcaattgatggggcagacctcttgcaaaaactgtggtaatttgctagatgttcttgactgcaagcttgaggttgggagacagtcattggttcctccacccattgtttcagatgtgatcactgctacctctatggtatcattagagaagaagggaaagtcattccctcctcatggacatgaaagagatgtagttcttccgagaagtcaggaaaagctcatatctcttgttactgaaggaaaaggaaaaaataatgcacaacaatcatggagtgaacccactgccagaagaatgccaatgccccatgacggtccagctaaatggaattcatcttgccaaccatcaagggccctagaggatgatgcatcttcttttgccttaaaacacaaaactcaaacacaagaacagatgttaagcagtgaaagatattcatctgggtctacaacgagtgatatgcaagtaaaaagggtatcatcatctatgagtgctgtgaatggaactaaagattttgttgctatgaatagaagtctaagtggtcgatcaaggataaggtcacttaccaaagcggatggttccaaatttgacctagagaaaaaaccttacaatcgacaacagagttccttatctcacgtaaggacattagagagaaaaagaaggattcctaatgtcacacaactagaaggtacaggttctgtttattcagttggtacaaaacaaagaaatctccattctggtggaatgggtggcaaaagaagggacttcaatgcttcttccttgaacaattctattgtaaaaaataaacaagatggtcaaggagaaagagttattaaggttaatgacaataagatcaatgatgtagtgtcatttacatttaattcctccttgaagcaaaagatagaaatacctggcaagagggaagagacaagcagcgacaatgagagtatggtgtatttccaaaggccttcgcccttgagagttgatgctttaggtgcctttcttgaacaaaaattgatggaattgacctctcaaagagatgaggagttggctacaggtgctccacctaaaaaatctagtgccatgattcttcaagagctgatatctgctctaagttccgagcatctgatctgtcatgatggtcatcacatgtttaatgaaaatgtttgttttcattatggagcaaaacaagaaaggttattaggaacctgttgcaatggtaatcatctgagtcctggatccgttttggaagcttctttttcttccagtagtctggatgaaagctcagggcatggttttcaccctgaccccatgaattactcttattatggtcaaccggaacatgatactgaactttcagattctgcaacatcctttaacaaaggaaggatggatgagatactgagtgatgttgtcaaccaaattccccgggcattagaaagtttgctcacttttgggacagaattgacacgaagcaagctcaaccatatgaaggatattctcttgaattctgagttggtgcttagaattgcaactgaccgcagagaggatcaagggccacaacttctaatttatcagtttctcgttgatgatcttgacagtatggtgagtgatgctatgtggacagatgctaatggcatcgtgggttgtgaggattctaaacagagaaaggagctaaaggggtttcttcttgattgtgttatagaatatctagaatcaaattgctgccaatattttaactctggattcaagaaatggacgaagctgcccttgtgcatggaagctgagatgttggctcaagaggtgaagagggagatcaacaagtggttatctatggttgggatggtgcctgatgaaataatagaatgggaaatgagccactccttggggaaatggactgactttgacattgaagcatttgaggctggtgttgatatagatggggatatacttcaaattttggttgatgaagttgttcaagacctgcaggttgcaagcaggggcaccatttacttctaa

SEQ ID NO: 3291 - DNA, 1266 bp, Glycine max var. Williams 82
atggaggatgccaatcttcagaggctccattgctccgtcaaaaactacgattggggtctcccaggtcgcgtctccgaggttgccagactccacgcgctcaattccgcgtctgaattccacgcggaggacccttacgccgagctttggatgggtacccatgattcaggcccttcctttttagcttcctccaatggaaatgagaatggtgtctccctcaaggcttggatttccgagaaccctgatgtgctcggtcacaaggttcttcacaaatggggttctgatctccctttcttgttcaaggtgctgtctgtggggaaggccttgtcaattcaagctcacccggataaggagttggcaaggactctgcataagttgcaccctgatttgtataaagatggcaatcacaaacctgagatggcccttgcactcactaattttgaggctctctgtggattcatcactctcaaggagctcaagggtgtgcttcatactgttcctgaaattgtggaactggttggtgctacaaatacaaacctggtcttacaaactaatgatcaggatggtgaagagaaggtcaaacctgttctgcaggcagtgttcaccgacctcatgtcagctagtaaagatagagtaacggatgcagtaaacagattgaaaagccgtctgcttaaggagagtgaggtgaggcagttgacagataaagagcagctggtgctgcggttggaaaaacaatacccagctgatgttggtgtcatagcagccttctttcttaaccatgtaaaactcaatcctggtgaagctttgttcctcggggcaaatgaaccacatgcatatttatctggggagtgtgttgaatgcatggcaacttctgacaatgttgtgcgagctggcctaactcccaaacacagagatgtccagaccctttgctccatgctcacatacaaacagggttctcctgaaatcttgcgtggagtatctgttaatccatatgtaaataaatatactccaccatttgaggaatttgagattgatcgttgcattcttcctcaaggggaaacagtggtgttcccagcagttccaggtccttcgatctttttggtcacagttggtgaaggaacaatgaatacaggattacccaaaggacatgtggtcaccgaaggtgatgttctttttgccgcagctaacactgagattagtgttactagtgcatccgagttgaatttgtacagaacaggggtaaatagcaagttttttcaagcttcataa

SEQ ID NO: 3292 - DNA, 3270 bp, Glycine max var. Williams 82
atggcttcatctttagaggagcttcttgcaaaggaggggttcaaaggaatcagaagagtgacaaggtctagatcctccttccactatggcgcttcaagtgagcctcttcactctttggatgggagattttctgtatcaagtgaaagaattcgaactcagagaacaaagtctgatgcctcacgatatcagatttcaagtggacagttaaaaactgacaacgatactgctatgaaccggaggtcaagggataatctttttttgagagacaaaatggatcaacggttgaagaactcttctatcgatacagattcaggcagaggagttgataccaattcatcagaatacatgccaaggaatgagattactgaggtgactgagcaagaagctaacatagtcaaagataattgttcaacagaagtttcttcgaaaagaggcaaagagaagaatttcaatgaacttgtggaggaggaaaatcctgtcaaggatgcaaaggcacgcagcagaagttccagtatacatatgcttggacactctagtgaaactagaaacaatataaaaccccagaaggactcatacactagatcaaatagcagcaggaataaagatagcaatcatgctattcaagctgcttctagtcttgctcttgatgaagttgctgtccaagcagtagtttcaattctaaatggctatataaagagttttccaaaagatgcggatttccggtcaacattgcgtcacaaatgtttctcctccttgaattttattgaactggaagaagagaacattacggggaccaaagtcataagaagtcttgagcaagcaatcgaggccattgaacaaactgctgaggagcctatatctaccatgtatctgaaaagaaccatgatgcagcttagcattattacaggtttgagtttaaatgatttgaagtacgagtgtacgtgtgggattccaaattttaagttgtcagcctgtgctcatctttacctcagtgtggtatacatgatgcagaaaaaaaataaggtgtcagcgaagcatctcttgcaagtgttttgtgattcaccttttcaggcacggacagtattgttgcctgaactgtgggagcatctattttcttcacaattttctcatttgaaggcatggtacagcaagcaggcagaatttctagtagatgcaccaagcaaaacaagaaagctaaaacttcttcaaaaagtgtataatgaacatttggattctggaactcatatatttgctgtatactacaaagattggctcactgaaggagtagaatctccgccaactccttcaattggcattccatcagcttctgtaatgggcagtcaagagggaagttcacttggttattcttttgagtctgctagctccattgacccactctcaccacagccaatggtcagcaagaaactgtatgattctatgtttggtagcttgagcaaacccagagtttaccaagtcaaagatattaaggatgatgataacatagacaactgcatgaaagactcttatggttcaactattgttagacagacattaacatatgagtctgaaactgttaaatttacagatcaagatattgaaaatttctctcaaggtgtagcaattgatacaatcaagcctcagaaaggaaattcaatgacagcttcagaagaatggcagaaaaggaatctcagcaatgacattaataactctttctctatggaaactaatttaaacagccacagtattgatgctctatcacatgaaaaagcgagtgaacctgttcttataaagccaaataagacatgttcttctcttgaaggaccatattttccaagtattcctcatgaatttatttgtcctcttactggaaatctctttgaggaaccagtcaccctagagactggtcagacctttgaaagagaagccatcaaagcatggtttgaaaagggaaatagaacatgcccagtaacaggaaatactttggaatgtgtgaccatgccatttaccaaccttattttgaagcgtttgattgatacttggaagtcagaactttttgattaccttattgatcttccttctcaaacagtggagaatccggaggagcttaagttgaaaaagagggatgaggctgctgttttcaagttagagagtcttttctcctctttgaaagaagaggacaaatcaacttatgctaagcatctgatctctttaggatttcttccatttctttttaggaggtttgaacagggaaatgtggaagaaaaatcacatgtgatgtcactcttgctaaactgtattcaagtggactctggttgcatatatcagatagcaacaagtgttaacaaaaaatgtcttcttgagcttcttcacagtaagaaggctaccccgacaacaaatgcaatactattccttactgaaattttatcaatgaagaggagaaaggatgttacctcattcataagtggcttggcgggtgaaaaagtatttaatataatgcatattctgctcatgtatctcaagaaatcttctccatttgaaaagcccctaatcgctgtccttctgttacactttgatctgctggttgagcctcaaaagtttagcatatacagagaggtggctgtgaatgctattgcagaggcacttgatgccagcttaaatgatgagaagggcagagaaaagtgttgcagagcactagtaatcttgtgtagccatttttcttctactggaaagataccaaccaagactagcatcttaaaacaagcaggttataataatgatagcttagaagttaaacctcctggccatgaagaagagggtcaacggttatatgtagccatttcatcggaaggtgaagaaaaaaggggtgaagagttgctaaagaagttgttagagtcattgattggtgatggagaaagcccgtttttgaagaacatatctagatgtttagattctaagcacttagatttggtgagagcgtgtctaataactgtgacatggttgagctcctcactgtctatgctatttagtgctggattgcatcttcccgccttcttatccatcatctctcagttgaaaggaatcctggaaaatggagaacttgagctcaagactcttgcttctctgtctttgcttaatttcagtaaaatatcagagtgcaaaacgcttttgaagactatggcagaagatattggtccccttcttcatgaacttgatgatgtaacatggactgcaaaacagcttcatgccattgtgtcgagggagaatctgtag

SEQ ID NO: 3293 - DNA, 690 bp, Glycine max var. Williams 82
atggagaaggtgagttttgtgaagaatggagagcttagattgcctccggggtttcgtttccacccgactgatgaggagctggttttgcagtacttgaagcgcaaggtcttctcctgccctctgccagcctctatcattcctgaggttgatgtttgcaagtctgatccttgggatttgccaggtgatttggagcaagagagatacttctttagcaccaaagaggccaaatatcccaacggaaatcgctctaacagagccacaaattcgggttattggaaggcaactggcttggacaaacaaattgttacttcaaaagggaaccaagttgtggggatgaagaagacacttgttttctacagaggcaagcctcctcatggatccagaactgattggatcatgcatgagtatcgcctcaacatccttaacgcctctcagagccatgttcccatggaaaattgggttctatgtcgcatatttttgaagaagagaagcggtgctaaaaatggggaggagagcaacaaggtgaggaactctaaggtggttttctatgacttcctagcgcagaacaagactgattcctcatcctcggccgccagtggaattacacatgaacatgaatcagatgaacatgaccatgaagagagcagtagctccaacaccttcccttatactattagaacgaaaccttaa

SEQ ID NO: 3294 - DNA, 2729 bp, Glycine max var. Williams 82
ttatggccgttttagatttacattggattatttaaaattacgtttatatatattagttaacctcaagtgtataacacaaaatgacttttcttttatgtaacggcaaaatgacattactgttgatcacagccagaaagtattacagtttgtttgtctgtataatgttttttcatgttaaaaaaatggtcgttattttgcgcataaaaataaagacatagcatcaacttgtataatggacagctatttgccctaacgcggcaatatcttaagatacaccaagaccaaacatccattaacaacagaaatcttgatccgcttgtgaattactaattaactttccgtcgcaaatgaggaagctgcatccacttttagcagttagaaattgagcacttggcgtttgtagtacctgcagagtcgcatgattttaagcctgaacaactcaccatgcataactaggttcgaacaagtcatactttgtcgatatctttttcaatgttttgctggcattcttaaatcttaatattgtggttataaaagtgggtcctcaagtaatattaaattgaaagttgattcatctgaaaggctgtgtgtagaatcattgatgtattttcttaaatctttgccttgacactccactccataattagaggaaaagaaaagaaggggtggggtggggtgttcatcttttcctttttcctgtccgttcttttttatacattgaaattaaccttccgtaaattcctctctatttggtatgtatagagaaagagagaatgaatgggtaaaatataaatgtagtagctccgttccgtcaatttctctttctctctccaaaattaaaacggggagcgaggatccaacggtcccaattgggtgtgatggttgttatattcatttgaattaatttggttcattttgtgtgtttctcagagaatcgctcttcttccatcctttcctctcctctctccgcatttcccaagagcagatattagaagatggcagacgctgaggatattcaaccccttgtttgcgacaatggaacaggaatggttaaggcaggatttgcaggagatgatgccccacgtgctgtgtttcctagcattgttggtcgtcctcgtcacactggtgtgatggttggtatgggccagaaagatgcatatgttggtgatgaagcacagtctaaacgtggtattctgactctcaagtatccgattgagcatggtattgttagcaactgggatgatatggaaaagatttggcatcataccttctataatgagcttcgtgtggccccagaagaacatccagttctgttgacggaggctcctcttaaccctaaggctaaccgtgagaagatgacccaaattatgtttgagacctttaatgcccctgctatgtatgttgctattcaggctgttctttcactgtatgccagtggccgtacgactggtattgtgttggattctggggatggtgtcagccacacagtgcctatctatgagggttatgccctcccacatgcaatccttcgtcttgatttgggtggtcgtgacctcacagatttcttgatgaagattttgactgaacgtggatattcttttaccacctcagcagagcgtgaaattgtgagggatatgaaggaaaagctggcttacatagccctcgactatgagcaagagctagagacatccaagaccagctcttcagtggagaagagctatgagttgcctgatgggcaggttatcactattggcgctgagcgtttcaggtgtccggaggtcttgtaccaaccatccatggtaggaatggaagcatcaggcattcatgaaacaacatacaactccataatgaaatgtgatgttgacatcaggaaagacctgtacggtaacattgtcctttcaggaggtacaaccatgtttcctggcatcgctgatagaatgagcaaggaaatttctgctttagccccaagtagcatgaagatcaaggtggtagcacctcctgagagaaagtacagtgtctggattggaggttctatcttggcatccctgagcaccttccagcagatgtggattgcgaaggcagagtacgacgagtctggaccatcaattgttcatagaaagtgcttctaaattgtttggttgatagggttattgaagaaaaagatagctgttttattcctcgggaagaagtgctgcttgcttgtaaccctttcattctattctaacttttgttatctgtttacgttattctctggagtaatgatttggagaaggcgaggagtttgttttgtcaaaacggtgcaattcttcagtattattatatattttgattttgattttttgagattcattatgcgtctgaattagcataaactatcaaatgaactatggtatgcaaaattatgatcccaatattttgcattagatatttttatagccgaggagggtacggctaatatgatcattgctattgagatatgggattatattctaggttcgcggacacgggatatgaaaattcggttattcttcccacttgattgacatttagcaatgggaattcaggaagaatttctctgcataccagttctgtacccccatggacatgagcacaagctctctaatcaaagattcaccttggaacccgaaatttggaaccagttcataggattactaatgatggagcaacgataagagcaaccaaaactgagggttgctgtataatattac

SEQ ID NO: 3295 - DNA, 1098 bp, Glycine max var. Williams 82
atgccgttgttatctcatacaataatcactcccattctctctcgtaacaaccgtcgttgcttttctctcatggctgcttccgccgcattcgacgacgccaagcacggcttttctcggccggagatgtacaaggaaaacctcgccggcaccttggacgcctacgaccgccacgtgttcctctgctacaagaaccacctcgcctggccgcctcgcctcgaggcctccgacgccgatcctcttcccaagcgcgtcgccaccgtctggagagctcgcaaaaacgacatcgccgtcaagcagacgaaaatcacggtgtgcgaggcgcgtgaggaggcaggtttctccgacggtgatgcgttgattttccccgacatgatcaaatacaggggtgtggaggagtcaaacgtggatgtgttttttaatgatgtgatagtgagtggtaaagagtggagtggtggaaagcaagggaagggggtgttgaagggttcgcatatatttgtatgtgctcatggaagtcgtgatgtgcggtgcggtgtttgtgggccggttctgatggacaagttcaatgaggaaattcagctgaggggattgaaggatcagatatctgttttggcctgttctcatatcggtggccataagtatgctgggaatgtaatcatattctctccaggatcagatggaaaaatcatgggtcattggtatggctatgttactccggatgacgtggcagccttgttggaccgacaaattgccaagggagaggtcataaaaaaactttggaggggtcaaatggggccacccggtgccgaaatcaaggtagcagatgaccataaacttgctaacggagtttataataacaaggccaatctaagcaacaatgaaaatgttacaggatgctgtcagggtgttaatggggtttcttgctgcaggactgcaagttttgatgataaaaccgcagaagcatataaaaagcaagggagcaataatataagttggtgtttgcctgtattaaagaagcgtgacattcttacggctggtggtatacttggagctttggcagctgttgctgtagctttcagattttacagaagggcaagttga

SEQ ID NO: 3296 - DNA, 1227 bp, Glycine max var. Williams 82
atgtctccttattctctctctttgttagcctctgtctcccccaaaatgcacacccttctttctttctcctcatcacactctccacatcttccaaaccacaacataaccaaatccaataataaactctctcattccatcaatggactttcatcatgcccttcttctcctttgctccccagtgccacaaaatcttctccctttctcatttccacttcaaaaattgcatctttcagggtccttgctgcttcctctatacctgatgctagaagtgatgaaccagccaaaactagtgatttcttaaaaactcttcagcttggggccatgtttgcaacttggtaccttttgaacatctactacaacatctacaacaaacaggttctaaaagtctatccatttccagcaacaattacagcatttcaatttggctttgcatcgttggttattaatctagtctggactttgaatctccatcccagaccaagcatcagtggttcacagtttgcagcaatccttccactggctgtggctcacacaatgggaaacctcttgaccaacattagtcttggcaaggttgctgtatctttcactcacacaatcaaagctatggagcctttcttcactgtagttctttctgcccttttactgggtgagatgcctactttctgggtggtttcttcccttgtaccagtagtaggtggagtggcactggcatcaatgactgaagtctctttcaattggattggattcactactgctatggcatctaacgttactaatcaatcgcggaacgttttgagcaaaaaactgatgactaatgaagaggaaactttggacaatatcaatctctactcagttataactatcatttcctttctgttgttggtcccatgtgctattcttgtggagggtgtcaagttttctccttcatacttgcaatctgctgcaagtcaagggctgaatgtcagagagctatgtgtcagatcagttcttgctgctttttgcttccatgcataccagcaggtatcatatatgatattacagatggtgtcacctgtgacccactctgttggaaactgtgtgaagcgtgtggttgtcattgtttcttcagttatattcttccaaattcctgtctcacccgttaacacacttggaactgggcttgcacttgttggagttttcttgtactcaagggcaaagaggatcaagtcagtccaaaagacaaattga

SEQ ID NO: 3297 - DNA, 1026 bp, Glycine max var. Williams 82
atgtcgacctcttccattaacgggtggtgcctctcttccatctccccagccaaaacctctctcaagaaggccacattaggcccttctgtcttcgcaaccgttagcactccttcttctccttcttcttcttcttcttcttccttcccttctctcattcaagacaggcctgtctttgctgcccctgcccccatcatcaccccaactgtgagagaggatatggcaaaggaatacgagcaagctattgaagaactccagaaattgttgagggagaagagtgaactcaaagccacagctgctgagaaagtggagcagataacagcttctctgggaacatcatcatctgatggcatcccatcatcagaagcctcagacaggatcaaagctggtttcattcacttcaagaaggagaaatatgacaagaatccagctttgtatggtgaacttgccaaaggccagagccccaagtttatggtgtttgcttgctcagactcaagggtgtgcccatctcatgtgctagatttccaaccaggagaggcctttgtggtcagaaatgttgctaacattgtcccaccatatgaccagtcaaaatacgctggaactggggcagcagttgagtatgctgttttgcatcttaaggtgtctgagattgtggtcattggacacagtgcttgtggtggtattaaggggcttctgtctttcccatatgatggaacctactctactgattttattgaggagtgggtcaaaattggcttgcctgcaaaggcaaaggtgaagacacaacatggggatgcaccttttgctgagttgtgctcacactgtgagaaggaagctgtgaatgtttcccttggaaaccttctaacatacccatttgttagagatggcttggtgaacaagacattgtcactaaaaggaggatactatgactttgttaagggatcttttgagctctggggccttcagtttggccttgcatcctctttctccgttaaagatgtggccaccattctgcattggaagctatag

SEQ ID NO: 3298 - DNA, 1411 bp, Glycine max var. Williams 82
aaaatggggatacccaattggacatgccactatacaccccattgctacgaagggctatatagcataaacatttgagtcttcattgcacaatgtcgacctcttccattaacgggtggtgcctctcttccatctccccagccaaaacctctctcaagaaggccacattaggcccttctgtcttcgcaaccgttagcactccttcttctccttcttcttcttcttcttcttccttcccttctctcattcaagacaggcctgtctttgctgcccctgcccccatcatcaccccaactgtgagagaggatatggcaaaggaatacgagcaagctattgaagaactccagaaattgttgagggagaagagtgaactcaaagccacagctgctgagaaagtggagcagataacagcttctctgggaacatcatcatctgatggcatcccatcatcagaagcctcagacaggatcaaagctggtttcattcacttcaagaaggagaaatatgacaagaatccagctttgtatggtgaacttgccaaaggccagagccccaagtttatggtgtttgcttgctcagactcaagggtgtgcccatctcatgtgctagatttccaaccaggagaggcctttgtggtcagaaatgttgctaacattgtcccaccatatgaccagtcaaaatacgctggaactggggcagcagttgagtatgctgttttgcatcttaaggtgtctgagattgtggtcattggacacagtgcttgtggtggtattaaggggcttctgtctttcccatatgatggaacctactctactgattttattgaggagtgggtcaaaattggcttgcctgcaaaggcaaaggtgaagacacaacatggggatgcaccttttgctgagttgtgctcacactgtgagaaggaagctgtgaatgtttcccttggaaaccttctaacatacccatttgttagagatggcttggtgaacaagacattgtcactaaaaggaggatactatgactttgttaagggatcttttgagctctggggccttcagtttggccttgcatcctctttctccgttaaagatgtggccaccattctgcattggaagctataggggccatgcttagaggtcgtgtgtatctgcaatgaagaggcctagccaccttcatcaccatatgatatttataaaaatatatatatatgaaactatgaactgcgtttatgcatgtcggaaaatcttcttttgataagagtttggaaatcctcttgtaacaaaattttcattattcaaccttgatctttatatagcccgcaacaccgagagagatgacaaattaatcttagttaattatataagcaatgctaaattgtatgaagattcaaagttttaaatacagtcgcattgcagtt

SEQ ID NO: 3299 - DNA, 1374 bp, Glycine max var. Williams 82
aaaccttctaacccttacaccaatcttctctaaattaaagcaaaaccctccttaagcttaagcagattcaattttgttggcattaatctctccaagttggcttgcttcttgatcatgattcattacattacaatgactaaggagcagttctgtcatgttgattggccaatgaatctggtgcagccttgggtgagaatagagaggatatggcaaaggaatacgagcaagctattgaagaactccagaaattgttgagggagaagagtgaactcaaagccacagctgctgagaaagtggagcagataacagcttctctgggaacatcatcatctgatggcatcccatcatcagaagcctcagacaggatcaaagctggtttcattcacttcaagaaggagaaatatgacaagaatccagctttgtatggtgaacttgccaaaggccagagccccaagtttatggtgtttgcttgctcagactcaagggtgtgcccatctcatgtgctagatttccaaccaggagaggcctttgtggtcagaaatgttgctaacattgtcccaccatatgaccagtcaaaatacgctggaactggggcagcagttgagtatgctgttttgcatcttaaggtgtctgagattgtggtcattggacacagtgcttgtggtggtattaaggggcttctgtctttcccatatgatggaacctactctactgattttattgaggagtgggtcaaaattggcttgcctgcaaaggcaaaggtgaagacacaacatggggatgcaccttttgctgagttgtgctcacactgtgagaaggaagctgtgaatgtttcccttggaaaccttctaacatacccatttgttagagatggcttggtgaacaagacattgtcactaaaaggaggatactatgactttgttaagggatcttttgagctctggggccttcagtttggccttgcatcctctttctccgtatgaacatcaaccattatcaatgacctcatcttggttccctaagttaaagatgtggccaccattctgcattggaagctataggggccatgcttagaggtcgtgtgtatctgcaatgaagaggcctagccaccttcatcaccatatgatatttataaaaatatatatatatgaaactatgaactgcgtttatgcatgtcggaaaatcttcttttgataagagtttggaaatcctcttgtaacaaaattttcattattcaaccttgatctttatatagcccgcaacaccgagagagatgacaaattaatcttagttaattatataagcaatgctaaattgtatgaagattcaaagttttaaatacagtcgcattgcagttagtcacgtttgttgaaa

SEQ ID NO: 3300 - DNA, 1455 bp, Glycine max var. Williams 82
aaaatggggatacccaattggacatgccactatacaccccattgctacgaagggctatatagcataaacatttgagtcttcattgcacaatgtcgacctcttccattaacgggtggtgcctctcttccatctccccagccaaaacctctctcaagaaggccacattaggcccttctgtcttcgcaaccgttagcactccttcttctccttcttcttcttcttcttcttccttcccttctctcattcaagacaggcctgtctttgctgcccctgcccccatcatcaccccaactgtggaatacgagcaagctattgaagaactccagaaattgttgagggagaagagtgaactcaaagccacagctgctgagaaagtggagcagataacagcttctctgggaacatcatcatctgatggcatcccatcatcagaagcctcagacaggatcaaagctggtttcattcacttcaagaaggagaaatatgacaagaatccagctttgtatggtgaacttgccaaaggccagagccccaagtttatggtgtttgcttgctcagactcaagggtgtgcccatctcatgtgctagatttccaaccaggagaggcctttgtggtcagaaatgttgctaacattgtcccaccatatgaccagtcaaaatacgctggaactggggcagcagttgagtatgctgttttgcatcttaaggtgtctgagattgtggtcattggacacagtgcttgtggtggtattaaggggcttctgtctttcccatatgatggaacctactctactgattttattgaggagtgggtcaaaattggcttgcctgcaaaggcaaaggtgaagacacaacatggggatgcaccttttgctgagttgtgctcacactgtgagaaggaagctgtgaatgtttcccttggaaaccttctaacatacccatttgttagagatggcttggtgaacaagacattgtcactaaaaggaggatactatgactttgttaagggatcttttgagctctggggccttcagtttggccttgcatcctctttctccgtatgaacatcaaccattatcaatgacctcatcttggttccctaagttaaagatgtggccaccattctgcattggaagctataggggccatgcttagaggtcgtgtgtatctgcaatgaagaggcctagccaccttcatcaccatatgatatttataaaaatatatatatatgaaactatgaactgcgtttatgcatgtcggaaaatcttcttttgataagagtttggaaatcctcttgtaacaaaattttcattattcaaccttgatctttatatagcccgcaacaccgagagagatgacaaattaatcttagttaattatataagcaatgctaaattgtatgaagattcaaagttttaaatacagtcgcattgcagttagtcacgtttgttgaaa

SEQ ID NO: 3301 - DNA, 1475 bp, Glycine max var. Williams 82
aaaatggggatacccaattggacatgccactatacaccccattgctacgaagggctatatagcataaacatttgagtcttcattgcacaatgtcgacctcttccattaacgggtggtgcctctcttccatctccccagccaaaacctctctcaagaaggccacattaggcccttctgtcttcgcaaccgttagcactccttcttctccttcttcttcttcttcttcttccttcccttctctcattcaagacaggcctgtctttgctgcccctgcccccatcatcaccccaactgtgagagaggatatggcaaaggaatacgagcaagctattgaagaactccagaaattgttgagggagaagagtgaactcaaagccacagctgctgagaaagtggagcagataacagcttctctgggaacatcatcatctgatggcatcccatcatcagaagcctcagacaggatcaaagctggtttcattcacttcaagaaggagaaatatgacaagaatccagctttgtatggtgaacttgccaaaggccagagccccaagtttatggtgtttgcttgctcagactcaagggtgtgcccatctcatgtgctagatttccaaccaggagaggcctttgtggtcagaaatgttgctaacattgtcccaccatatgaccagtcaaaatacgctggaactggggcagcagttgagtatgctgttttgcatcttaaggtgtctgagattgtggtcattggacacagtgcttgtggtggtattaaggggcttctgtctttcccatatgatggaacctactctactgattttattgaggagtgggtcaaaattggcttgcctgcaaaggcaaaggtgaagacacaacatggggatgcaccttttgctgagttgtgctcacactgtgagaaggaagctgtgaatgtttcccttggaaaccttctaacatacccatttgttagagatggcttggtgaacaagacattgtcactaaaaggaggatactatgactttgttaagggatcttttgagctctggggccttcagtttggccttgcatcctctttctccgtatgaacatcaaccattatcaatgacctcatcttggttccctaagtattctcctatctaaaatgttaaagatgtggccaccattctgcattggaagctataggggccatgcttagaggtcgtgtgtatctgcaatgaagaggcctagccaccttcatcaccatatgatatttataaaaatatatatatatgaaactatgaactgcgtttatgcatgtcggaaaatcttcttttgataagagtttggaaatcctcttgtaacaaaattttcattattcaaccttgatctttatatagcccgcaacaccgagagagatgacaaattaatcttagttaattatataagcaatgctaaattgtatgaagattcaaagttttaaatacagtcgcattgcagtt

SEQ ID NO: 3302 - DNA, 1140 bp, Glycine max var. Williams 82
atgaattgtaggaggttggtttatgtagttgtgtggttcaatctgtatgtggcatgcacattcattcaagtttcaggtctggacgcctctaacttcagcaagtgttggttcccagcaatttacaactttggtgactcaaattcagacacaggagctgtttttgcagcattcacaggggtgaagcctcccaatggcataagcttctttggaagcctctcaggaagggcctctgatggtcgtctcatcatagattttatgactgaagagttgaagctgccatacctgaatgcatatttggactcggttggatcgaattacaggcatggtgcaaactttgcagtaggaggctcctccattcggcctggtggttttagtccattccctcttggccttcaagtagctcagttcctactgttcaagtttcacaccaacactctcttcaatcagttttctaacaacaggacagaacaaccgttcaagaatagtcttccaaggccggaggacttttccaaggccctatacacctttgatattggacaaaatgatcttgcctttggtcttcaacacacttcacaggaacaagttataaagtcaattcctgaaatcttaaaccagttcttccaagcagtgcagcaactatacaatgtaggggcaagagtgttctggattcataacacaggtccaattggatgcttgccctacagttacatttattatgagcccaagaagggtaacatagatgcaaatggctgtgtgaaacctcagaatgatcttgctcaggaatttaacagacagctcaaggaccaagtgtttcagctaaggagaaagttcccacttgcaaaatttacatatgttgatgtgtacactgccaaatatgaactaatcaacaatacaagaaaccaaggttttgtgagtccattggagttctgttgtggcagttactatggttaccacataaattgtgggaagacagccataataaatggaacagtatatggaaatccatgcaaaaatccttcccaacatgttagttgggatggcatacactactctcaagcagcaaatcaatgggtcgctaaaaaaattctctatggatccctctctgatccaccagttccaattgggcaggcatgtttctga

SEQ ID NO: 3303 - DNA, 1165 bp, Glycine max var. Williams 82
agcttttaccctagcttgaatgatttctttccatgtccctttgcagatcaagagtggttcctccacttagtttctccatagcatccaaaatcatgttcattgggatgataggaacctcatctcagataatgtattatgttggagttagctacagttctccaacacttgcttcatcaatcgccaatctgggccctgctttcaccttcattcttgccatcattttcaggatggaaaagatagctgccaaaagcagaagtagtcaagctaaggtagttggaagcataatatcaataacaggagcatttgtattgactttgtacaaaggccattcaatcatcaaagctcattcccatgatctttccataccacttcaacatccatttagctttcttaaatctggggatgcagattgggtcattgctggcattctgctcacagctgaatgtttaataggttcattatgttacattgtgcaggctgatgttctaaaagtgttcccggatgaagtgacaatagtcctcttttacaacgtgacttccacagtcatgtctacacttgtagctttatttgcagtgccaaacgcaaatgcttggaaagtaggactgaatatttcattaatctccattatttgcactgtaagatacctttctaagttaactgctgctgcactttgacatgggctatatactttccacgtgggcactgcgcttaaaggggcctgtgtatctagcatcattctcacccctccaaattgttttttctattgccatgggtgtcatcttccttggtgactctcttcatgttggaagtatagttggagcggcaatagtatcatttggcttttatgctgtgttgtggggcaaagcaacagaggagatagaggaagaagttgattacccggaatcaccagctactgagaatgttcctttattgcaaagctatggaaccgaaaacttgtgaaaagaaaacagatggaaatgtctaaaaactagtgaaaactcaacagccattaatttatcttttagcatcttaagaacatgttcttttgtacctcataacaaagtttgtttatcttttattttcttgtctcctttcaccattaaggaaaactggtgatatggaggacgacaacaaaccaaaccaattctaatataattcgagtctc

SEQ ID NO: 3304 - DNA, 1932 bp, Glycine max var. Williams 82
atgtggtctgcagtaacagatcccattagagctttttttgcaaattttctccgccatttcatccacaaagacttccatgaagcagtggccagaatgaccataatagatgctttcctcttcgttattgtgcactccattgataagttggggatatggccacgcttgccggttttcttagggctattgtacctggcgattcggcggcggcttcatcaggagtacaacctcttcaacgttggaacaacaccggtgggggttaggtttaaccattctgattttccatacagaacagctgatggaaaatataatgaccctttcaacgaagttgctggcagccatgggactttctttggcagaaatattctccctgtggatcagaaaaaaaagctattgaaacctgatccaatggtggtagccacgaaactacttgctaggaggacatacaaggatactggaaagcaatttaatgtgatagcagcttcttggattcaatttatgattcatgattggatcgatcatcttgaggacacaaaccagattgaactcatcgcaccaagagaagttgcaaggcaatgccctctcaaatctttcaaattctacaagacaaaggaaattcccactggcttctttgagattaaatccggatcatcaaacatccgtacaccttggtgggatgcaagcgcagtatatggaagcaatggagaagttttacagagagtgagaactttcaaagatggaaagataaagatatcaaaggatggccaccttcttcataatgaaaatggaacagcaattgcaggtgacatccgcaatagttgggctggtgtttcaaccttgcaggcccttttcattcaagaacacaatgcagtttgtgacaatctcaagaaacattatcctcaattgggagatgaagaactttatcgccatgccagattggtgacctcagctgtgattgcaaaggttcataccattgattggactgtagagctccttaaaactgatactttacttgcaggcatgcgtgccaattggtatggattattagggaagaaatttaaggatacatttgggcatgttggtggagtcatcttgggaggattagtgggtcttaagagaccagaaaatcatggtgtcacatactctctaacagaggaatttgtgactgtttatagaatgcactcactcctacctgataacctacagctaagagacatatccgctactccaggacccaacaaatctcctccattagtcaaagaaattcctatgaagaatttgattggactgcaaggagaaaaaacattatctgaaataggagttgcaaggcaacttgtgtcaatgggtcaccaagcttgtggggcattagagctttggaactacccagagtggctcagagacctcgtaccacaaaacatagatggcacagataggcctgatcatgtggatctagctgctcttgaaatttatagagatagagagaggagtgtggctagatacaaccaattcaggagggcattactgttgatacctatctccaagtgggaagatttaacagatgacaaggaagcaattcaagtattggaagaggtatacggtgatgatgttgaagagcttgatgtactggtaggcctcatggcggaaaagaaaataaagggttttgcaatcagtgagacagcttttgttatattcctactcatggcaaccaggaggttagaagctgacaggttcttcacaagcaactttaatgaagagacatataccaagaaaggactggaatgggtgaatacaactgagagcctaaaggatgttattgatcgtcactatcctgaaatgtcacacaagtggttaaactcttctagtgctttctctgtttgggactcaccaccaaactctcaaaatcatatacctctctatcttcgtgttcctcactaa

SEQ ID NO: 3305 - DNA, 3747 bp, Glycine max var. Williams 82
atgagtggtgatcataacagttctgtttccatggttgggaagaagaaaaagaatggctctcttcggtctattttcatgcatgctgatggcttagactggttcctcatgatttttggtctctttggggccattggtgatggcataggcacccctttggtgttgtttatcaccagcaaaattatgaacaatattggtggtttttctagcaacataggcagcactttcatccacagcatcaatgagaatgccgtggttttgttatatttggctggtgggtctttcattgcttgtttcctagagggttattgttggacaagaacaggagaaaggcaagctgcaagaatgagagttaggtaccttaaagcagttctcaggcaagaagtagcatactttgatttgcatgtcacaagcacatcggaggtcatcaccagcgtctctaatgatagcctcgtaattcaagattgtcttagtgaaaaggtcccaaactttttgatgaatgcgtccatgtttgttgggagctacatagtggcttttgcattattgtggagattggccattgtggggttcccttttgtggccctacttgtgatccccggtttcatgtatgggaggacattaatggggttggctagcaagataagagaagagtacaataaagcaggcacaatagcagaacaagcaatatcctccatcagaaccgtttattcttttgtgggggaaagcaagactattgatgctttctctgaagccctacaagggtctgttgagttgggactgagacaaggcttagcaaaaggtttagctattggaagcaatggtgttgtctttgctatatgggcattcatgtcctattatggtagcagattggtcatgtaccatggagctaaaggtgggactgtatttgcagttggagcagccatagctcttggaggattggcactaggtgctggtttgtcgaacgtgaagtacttctcagaagcaagtaccgcaggagaacgcataatggaagtgataaaaagggttccaaagattgattctgatagcatggctgaggagattctggagaacgtttcaggggaagttgaattcaaccatgtggactttgtgtacccatcaaggccagacagtgttattctgaatgatttctgcctaaagattccagcagggaaaacagtggctttggttggagggagtggctctggaaaatccactgtgatatcacttttgcagaggttttatgacccaattgagggagagatatttcttgatggtgtggccattcacaagttgcaactcaagtggttgaggtctcaaatgggtttggtcagccaagagcctgcactgtttgcaactagcattaaagagaatatactttttggaagagaagatgccactcaagaagaggttgtggaggcagcaaaagcttccaatgctcataatttcatttcacagttgccacaaggatatgatactcaggttggggagagaggagttcaaatgtcaggtggacaaaagcaaagaattgcaatagcacgagcaataataaaaaagccacggattcttctattagatgaagcaacaagtgcactagattctgaatctgaacgagttgtgcaagaagcattagacaaagcagcagtagggcgcacaacaatcatcattgcacatagattatccaccataaggaatgcaaatgtgattgctgttgtgcaaagtgggaaaatcatggagatgggatcacaccatgaactaatccaaaacgacaatggcctttacacctcactagttcgtctccaacaagcaaaaaatgaaaaagaagacaccatttttcatcctactcctccttcgtccatatcgaacaaagacaatcacaacacgagtagccgtaggctctctgttgtgatgatccgttctagctccaccaactcgatacctcgtattggtggtggtgacgataacaatattgttgaagaagtagtggaagataacaagccaccacttccctcgtttcgaaggttgctcgcactgaacattcccgagtggaagcaagcatgtttagggtgtttgaatgcggtgttgtttggtgcaattcagcctgtgtatgcatttgcaatggggtcagtgatatctgtttacttcctcccagaccataatgagataaagaagaaaactatgatctattcactttgtttcctagggttggctgtgttctccttagtggttaatatcctccagcattacaactttgcttacataggagagtacttgactaaaaggatcagagaaagaatgttttccaagatactcacttttgaagttggatggtttgatcaagatgaaaattccacaggtgctgtttgttctagacttgccaaagaagccaatgtgaatggtctagtggtacaaaccatttcagcagtggtaatagcttttacaatgggcctaatcattgcatggaggttggccattgttatgatagcagttcaacccattatcatagcatgtttctacacaaggcgtgtccttctcaagagcatgtctagtaaggccatcaaggcccaagatgaaagtagcaagatagctgttgaagctgtttccaacctcagaacaatcacagcattttcttcccaagataggatccttaaaatgctcgaaaaggcccaagaaggcccgagccgtgaaagcattcgacaatcatggtttgcgggcattgggcttgcatgttcccaaagccttacattttgcacttgggctttggacttttggtatggaggcaagcttgtgtttcagggcttcataaacgccaaagcattgtttgagaccttcatgattttagtgagcacaggtagggttattgcagatgctggtagcatgaccaatgacctagctaaaggggctgatgctgtgggctcagtttttgcaatcttagataggtacacaaaaattgagccagatgatgacatagatgggtacaagcctgaaaagctaacagggaaaatagagcttcatgatgtccattttgcatacccagctaggcccaatgtgatgatcttccaaggcttctcaatcaaaattgatgcaggcagatcaacagcattggttgggcaaagtggctctggaaaatcaacaatcataggcttaattgagagattctatgaccctatgaaagggattgtgaccattgatggtagagacataaaatcataccaccttaggtcactaaggaagcatattgctcttgtaagccaagagccaacattgtttggtgggaccataagggaaaatattgcatatggggcatctaataataataacaaggttgatgaaactgagatcatagaagcagctagggcagctaatgctcatgatttcattgcaagcctaaaggatggttatgacacatcgtgtagagatagaggagtgcaactctctgggggtcaaaagcaaagaattgcaatagctagagccatattgaagaatccagaagtgttgttgttggatgaagccacaagtgccctagatagccaatcagaaaaattggtgcaagatgctctagaaagggtgatggtggggagaactagtgtggtggtggctcacaggttaagcacaatacaaaattgtgacctaattgctgtgttagataagggaaaagtggtggagaaagggacccactcatctttgttggctcatggaccaggtggagcttattactctttgataagtttacaaagaagaccagcaaattaa

SEQ ID NO: 3306 - DNA, 1566 bp, Glycine max var. Williams 82
atgagcgttcgtgatcacacacagaagatcgatctggtagaaacgatgaaggaactatgggcacaaatggggtcactaatggccactattgtgttcatgtacacaatctttgagcgcttcttccctccacacttgcgtgaaaaacttcaagcctatactcaaaaactcaccaaccatttcaacccttacatccaaataagcttccctgagttctcaggggaacgactgaagaagagtgaagcatacacagccatccaaacctacctgagtgcaaactcatcccagagagccaaaaggctcaaagctgaagttgtgaatgatagccaaacccctcttgtcctcagcatggatgacaacgaagagataactgacgagtttcatggcatcaaactatggtggagtgcaaacaaagtaagcaacaatccacaaagatacaaccctttttcttattacggttcctcagacgagaaaaggttctacaagctaacattccataagcgccaccgtgatattgtcaccatgtcttacataaagcatgttttggatgagggaaaggatattgagatgagaaacagacagttgaagctttacaccaacaatcctagtagtggttggtatggttacaagcaatcaaagtggagccacattgtgtttgagcaccctgccacttttgaaacactcgctatggatcggagaaagaaggaggatatacttaaagaccttgtgaagtttaagaagggaaaggattattatgcaaagataggtaaagcttggaagcgtggctatcttttgtacggtcctccggggactggtaagtctaccatgattgctgctattgctaatttcatgaactatgatgtgtatgatcttgagttaaccgcggtgaaggacaacactgagctaaggaagctgttgattgagactccgagtaagtctatcacggtgattgaggacattgattgctcactcgatcttaccggccagaggaagaagaaaaaggaagagaatgaggatgaagaacaaaaagatcctatgaggagaaatgaggaggagagtagcaagagtagtaaggtgactctgtctgggttgttgaattttatagatgggatttggtctgcttgtggaggtgagaggatcattgttttcacgacgaattatgtggagaaacttgaccctgctttgattaggagagggaggatggataagcacatagagatgtcttattgttgctatgatgcattcaaggtgctggccaagaactacttggatgttgagtctcatcatttgtttggtgcaattgggggattgttggaagaaacagatatgtccccggctgatgttgctgagaatctgatgccaaagtctgtggatgaagatgtggagatttgcctgcacaaattgattaaggctcttgaagaggccaaggaggaaaaagcaaggaaaaaggcagaagaagaagaagaagcacggttgaaggaggagaaagtgaaggaagagtctactcagatggaggaaaaacacaaaggaaaaactggggaggatgtgaaggaaaatggttttcattga

SEQ ID NO: 3307 - DNA, 1449 bp, Glycine max var. Williams 82
atgaagccaggtgaaatgtttgctcacataggatccatagttgcttccttgatgtttgtttgggccatgtttaagcaatttttcccttatcaactaagcaaccaaattgagaaacactcccaaagattggtgaccttagtctacccttacatccaaatcacattccatgagttcactggtgagagactcatgagaagtgaggcctattctgccatagagaactacctcagctccaaggcatcaacacaagcgaagaggctcaaagctgacatagggaagaacaaccagtctcttgttctcagcatggatgaccatgaagaagtagctgatgagttcaatggtgtaaagctttggtgggcctatgggaagcacatttccaagtcacaatccacaatttccttccaccaccctatgtcagatgagaaaaggtactataaactcacttttcataaaagcaatagagatttgatcttagggagataccttagtcatgtgctgaaagagggtaaagcaattaaggttaaaaacaggcaaaggaagctttataccaatagtggtgcttattggagccatgtagtgtttgagcaccctgcaacatttcaaacactagctatggatccaaaggagaaggaaatgatcattgatgatctcataacattcagcaaggcaggggagttctatgcaaggattggaagggcatggaagagagggtatctgctttatggtcccccagggaccggtaagtccacgatgattgcggccatggcgaatttcttaggctatgatttgtatgatcttgagttgactgctgtgaaggacaacactgagttgaggaagctcctcattgagacatctagcaagtctataattgtgattgaggatattgattgttcacttgatttaaccggtcaacgaaggaagaaaaaggaagaggtggaggagaaggatcaaaggcaaaaacaacaaggaatgcaagaaagagaggttaagagtagccaggtaactctttctggtcttttgaatttcattgatgggttatggtctgcttgtggaggagaaagactaatagttttcaccacaaactatgtggagaaattggaccctgcattggttaggaaagggagaatggataagcacattgagttgtcatattgtggctatgaggcattcaagttgttggctaggaattatctcaacattgaatcacacaatctgtttggcagaatatgtgaattgctcaaggaaaccaaaatcaccccagctgaggttgcagaacatctgatgccaaagaatgcttttagggatgcagacctttacttgaagagtctgattcaagcacttgaattggcaaaggaagatgcaagaaagagccagcatgatcctcattggactgaaaatgattcagaagacaaagcaacagaaaagtcaacaaactacacatcaacttga

SEQ ID NO: 3308 - DNA, 276 bp, Glycine max var. Williams 82
atgtctagcagaaggtccaggcagcaatctgcatccacaaggatctccgatgaccaaatcatcgacctcgtttcaaagttgcgtcaacttgttcctgagattcgcgataggcgctctgacaaggtatcagcatctaaggtcctacaagagacctgcaactacatcagaagcttacacagagaagtggatgacttaagcgaacgactgtctcagttgttggccacaatcgatgctgatagccctgaagctgccatcattaggagcctaattaactaa

SEQ ID NO: 3309 - DNA, 333 bp, Glycine max var. Williams 82
atggctgtggctaataagttactttctgttttgatcattgccctcattgccatttccatgcttcaaacagtggttatggcatctcatggacatggaggccaccactacaatgacaagaaaaaatatggacctggcagtctcaaaagcttccaatgcccatcacaatgctcaaggaggtgtggcaagacccagtaccacaagccctgcatgtttttctgtcagaagtgttgtaggaagtgcctatgtgtgccaccggggtattatgggaacaaagcagtgtgcccttgctacaacaactggaagaccaaggaaggaggacccaaatgcccttaa

SEQ ID NO: 3310 - DNA, 780 bp, Glycine max var. Williams 82
atgaattgtgaacactatactcttcttctgcatttatgcaggaaaaaaatggttcatcttggcttcttccttctggggtgtctctccatgatctcatatgctaatggttatgtcagcaatgggggttggaccaatgcccatgctacattctatggtggaagtgatgcttctgggacaatgggtggggcttgtggttatggaaacttgtatagtcaaggatatgggactaacacagcagcacttagcactgccttgttcaacaatggcttgagttgtggctcatgctaccaaatcaaatgtgcaaatgacccacaatggtgcctccgtggcaccattgtagtcactgccactaatttctgcccccctggtggatggtgtgaccctcccaatcaccattttgatctttctcaacctgtgtttcagcaaattgcccaatacagagctggtattgtgcctgtagtttacagaagggtacggtgcatgagaagaggtggaatcaggttcaccatcaatggtcattcatacttcaatttagtccttgtgactaatgttggaggtgctggtgatgtgcattctgtggccataaaaggttcaagaaccagatggcaacccatgtcaaggaattggggccaaaactggcagagcaactcctaccttaatggacagagtctttcctttttggtcaccactagtgatggtcgcagtgtgctctcatacaatgctgcaccaccaagttggtcctttggacagacctacactggaaggcaattccgctactaa

SEQ ID NO: 3311 - DNA, 1380 bp, Glycine max var. Williams 82
agtgtgctagctccatttgtacatcacattgctgaatgaatgaattgtgaacactatactcttcttctgcatttatgcaggaaaaaaatggttcatcttggcttcttccttctggggtgtctctccatgatctcatatgctaatggttatgtcagcaatgggggttggaccaatgcccatgctacattctatggtggaagtgatgcttctgggacaatgggtggggcttgtggttatggaaacttgtatagtcaaggatatgggactaacacagcagcacttagcactgccttgttcaacaatggcttgagttgtggctcatgctaccaaatcaaatgtgcaaatgacccacaatggtgcctccgtggcaccattgtagtcactgccactaatttctgcccccctggtggatggtgtgaccctcccaatcaccattttgatctttctcaacctgtgtttcagcaaattgcccaatacagagctggtattgtgcctgtagtttacagaagggtacggtgcatgagaagaggtggaatcaggttcaccatcaatggtcattcatacttcaatttagtccttgtgactaatgttggaggtgctggtgatgtgcattctgtggccataaaaggttcaagaaccagatggcaacccatgtcaaggaattggggccaaaactggcagagcaactcctaccttaatggacagagtctttcctttttggtcaccactagtgatggtcgcagtgtgctctcatacaatgctgcaccaccaagttggtcctttggacagacctacactggaaggcaattccgctactaatttatcaacccttttcatggagggtgcattttctctcaggtacagaaactttctagtaggagaaagaaacacaaagaaaattgtattttttttctctctctctctcctactgaacgacagtttcagtaaccagagacaaggcagaggagccaattcctttcatggaacatcaatttcataatgttggttacccacatgataatatggttgcattataaaaaagaactaaagccgtaatttaatagtgtacatgatgtgtcaatattgggccacaaaataggtggcttagtttagtccctttaatatattttggtttgtgttgcaagtttttttgcagatgaattgctggtaccttagtttatgctaagctatagtctcaagggtacttctgtttgtttgcctgctgaaagaaaagtaggttagaggtgggattttgtgagccttattgcactttggcaaatgggattcttgccttgttcagaaagatcaacttaaataataattgagtatattcttgttgtgctttagttattgttgactgagcaatgtcaaatatttatg

SEQ ID NO: 3312 - DNA, 699 bp, Glycine max var. Williams 82
atggcaagctttctcatggttccttgccagcatctattgctaaagaagttgcaaaagcattgccatagaaagacagcatcaacctccatcaggagtgagaaaacttcctcattccgtttcagaagcaatgccaatgttcctcttcatgaattgccaggggcttcctttgatcaatacatggatgacaagcacagagtactaagagctgttttttctgatgacaaaggaacaactaaacagctcaatgaggaagagtggaggatcaaaatgcctcccatgcaatgcttatttttgagtgtcaatccaacagcagatgtcaagttaacattcaagtctaatggagaagattatccacctgaaattcctcatcatgtccccaaagttcttgagcttcactttataaggtgggagttacagggcctggataccttctacaaggatcattaccaaatcaacatagatgttagaggctctttatacccagaaaggaagggaaaacatagttggctaaagaatcaaatggtgatgaagataaccttttgtccaaaagtagctttcattcctgaaaatctcttacaagatgccatagagctgattttcaaagcagtgtgggatcaaacgaagcatgaattccatgatagactattggaagattataacaggttcaagagaaacaaatcagggaagaactatgtctaa

SEQ ID NO: 3313 - DNA, 786 bp, Glycine max var. Williams 82
atgggttactcatcagcaacaagaaagccacatgcggtgttgaccccatttccatttcaaggccacatcaacccattgttccaactagcaaagctgcttcacctcagaggcttccataccacctccgatggacatggtgatgcagatgttgctcaagacataatctctcgttgtgaatcaattagagaacacatgttcctccccttttatgatcttcttgttagacttgaagattcttccactaagggtcttgttcccccagttacttgcttggtttctgattgtgccatgtcttttactatacaagttgctgaagaactttcactccctattgttctatttcaaccggcgagtgcatgctcgttattgtctggtttgcactttcgtgctatttttgataaaggtctcatacaactcaaagtgattttgtcatctgagtttgttaatgaaacttcagatagaggcctaatagcaagctggcgtccacaagagcaagtgctgaaccagacttcaattggtggattcttgactcattgtggatggaactcaacaattgaaagcatttgtgcaggtgtgccaatgttgtgttggcctttttatgttgatcagccaacaaactgtatatatatatgcaatgaatggaacattggggttgaaattgacactgatgtgaagagagaggaagtggaaaagctggtcaatgaattgatggtgggagagaaaggaaagaaaatgaggcaaaaggttacggagctgaagaaaaaggcagggcaggacactatttga

SEQ ID NO: 3314 - DNA, 396 bp, Glycine max var. Williams 82
atgacaacaatcacaaagcacagttacaaactctccctcaagagagccacaaagagaataacaagaaggagaagaagacacccacagcacaaccacccaaaaagcaccaccacaattgtgcacagaaagtgcagcaacaacaacaataataataagctttgtgaaaagcttgaggctttgaagaacttaatccccacaacaacaacaacaacaacaacccacgatggagaagaagaagcggtgaaacccgaccagctgttcaaggaaaccgcagagtacatcgtgttgctgcggacgcgcgtcgtggttctccagaaactcattgagtattatggaaacaacaacgacaccacccaagatgagaatgaacatgaagatggtgtcttgtttacatag

SEQ ID NO: 3315 - DNA, 459 bp, Glycine max var. Williams 82
atggtaggtgttttgcagtctcagcccttcaatgttggagttcgttccctcatctctgcagaaagttactatattcagaatcgcttagtctatataacatcaccaggcatagttaaatgttttagttcttcaatccatcagagactgcctcgagttacaggtgattgcagaagtaaaactaaggtttttgcattgaggcggagaagaagggcaaatgagagaactgaaacgtatgtgctactagaaccagggcaggatgagagatttgtttctgaggaagagttaaaggcaacgttgaaagagttgttggaaaattggcctggcaaggttcttccccctgatctttcaagatatgagaacattgatgatgctgtttctttcctagtgagatccgtttgtgaacttgaaattgatggagatgttggctcaatccaatggtatgaagttcgtttggagtga

SEQ ID NO: 3316 - DNA, 1392 bp, Glycine max var. Williams 82
atggcagagtcaccaaccttcaaagtccatgaagtctgctccatttcgccgccacaagaaaccccaccaacaactcttcccttcaccctcttcgacgtcctatggcttcggttccccccagtggagcgtctcttcttctattccttcccaaacccaacaacaacatcatttttcgacaccaccgttctcccaaatctcaaacactccctctccctcactctccaccacttccctcctctcgccggcaccatcacatggcccaatcactcacccctccctctcataacctacactcccggcaacaccatccccttcacaatcgcccaatccaacgcagatttcaacaccctctcttcaaacctctctcaagtcaaccaccacctccaaaacctaataccccacttaaccatttcccatgaagaagcttccgtgttagcacttcaactcaccctcttccccaaccaaggcttttcgattggaatcacaacccaccacgctgcacttgatggaaagtcttcgactttgttcatcaaatcgtgggcgcatttttgttctcagcttaatacctccccagaagaaccgttatcactaccaaagcatctaataccctcgtttgatagatctgttataagagacactttggggatcggtgagatttacgcgaactcatggatgaacttcggtggagccaccaatgaccgaagcttgaatgtgtgggattccctcggtggaagtcaaaccgatttggttaaagggttgttcgagttgacaccgttggatatcaagaagctgaagaaattagcggagtctaaggttgttgtcggagacaacaagaagaagattagggtgacatcgttcacggtcacgtgcgcttacttgttgtcatgcgcggtgaaagcggagcaacccaactgcgaaagagtgccttttattttcagcgtggactgtagggcgcgtttggatccaccaattccgggaacgtactttgggaacagcgtcgtgtctttgttggtgatagcaaagcgagaagagctattgggggaagaagcgttttttaaaagcgttttagggataagcgaagagttgaacaggatagagggtgacgtgttgaacggtgcggacaggtggatgccgaagattcaatcggtgatgtcggagaggccgaggttgttctctgttgcggggtctccgaggtttgaggtttacgatgttgactttgggtggggaaggcctaagaaagtggatgttacttccgttgataaaacgggtgcgttttcactttcggagactagggatcacagtggaggcattcaaattgggttggcgttgaccaagagtcaaatggaggcgttttctacggtttttgctcaagggcttgagtccttggaataa

SEQ ID NO: 3317 - DNA, 1395 bp, Glycine max var. Williams 82
atggagcaaccaactagtgtgaaagttcttgaattttgttcattggcaccaccacagaaaacaacaacaaccaatcccaccactccaacatctttgcctctcacattctttgacctactatggttaagaagtcccccagttgagcgtcttttcttctatgaattccccaaccaaaccatttcattctttgacaccattcttccaaatctcaaacactctctttccctaacactccaacactttctccttcttgctggcaccatcacttggccccttgactcaccccaccccatcatcaactatgtccctggcaatgttgtttccctcaccatagctgagtccaacaatgatttcaacgtgctttgttccaatacctgtgatgcttctctacgcaatcccttgataccccacttgaacacttccaatgaagaagcttctgtgatggccctccaacttaccctctttccaaaccatggcttttgtcttggaatctccacacaccatgctgctatggatggaaaagcctcaactttgtttctcaaagcatgggcctatgcttgctccaataatactaacctcacagaacaatcattgtcatcatctttgtcattaccacaacatctcacacccttctatgataggtcaatgataaaagacacaacgggaattggtgcaatgtatctgaacagttggttgaacattggtggaccgaacaataggagcatgaaggtgtgggatcttggaggtgcaaatgcagtgacaaacgaagccattagagggtcgtttgaattaaccccgtctaatatccaaaagcttaagcaacatgcaaaatccaagctcaaagagaataatgctcatgtgtcaacatattctgttacgtgtgcttatgtgttgcaatgtttggtcaaaacagaacaaccaaaggccaatggagtggcctttttgttcagtgtggattgcagggctcgcttggagccaccaattccttccacatattttggaaactgcattattggccgtagggttatggatgagacaatgaagttgttgagagatgatgctttcatcaatgctcttgagggaataaatgaagctatgaaaaagttggaggatggagtgttgaatggggcagtgactttgtctacaatgatgcaaattgcaagggataatagaatacttaccactgctgggtcgccacggtttgaggtttatagtattgattttggatggggaaggcctaagaaggtggatatgacttctataggcaaaacaggagcatttggtgtttctgaaagtaggaatgacacgggaggaattgaggttagtttggtgctgaacaaacaagaaatggaaactttcacggctcattttacccaaggacttgaatccttatga

SEQ ID NO: 3318 - DNA, 1395 bp, Glycine max var. Williams 82; identical to SEQ ID NO: 3317

SEQ ID NO: 3319 - DNA, 2967 bp, Glycine max var. Williams 82
atgtctaaaaaggttttgacatcaatgaaggatgaaaatccagatttgcagaagcaaattgggtgcatcagtgggttttttcagctgtttgaccgccacagtttcctcacgggccaaagcaatagcagccacaatcagaacataccaactaataaaggtggaatcagcaaccgtatcaaagaggtgaataatacaactcataaggcaacggcaaaaaatgtgaagctcacaagagagaatcaacaattctccacagaatcatcaggaacttcagtgacttcatcatctcgttcatctagcatgtcgtccctcgagtttaatagaacaattcagatagagccaccatcaatcagtcaaatgaaaattccagaaaacactaattcagaagcagcaatgaagcaaggcaaccaaggccaccaaccccttgatttctatgatattgtcaaagactcaatgcatagagatgttcatggattgtcagtaaaaactgtagctaaagaggaaaggaagggtcgtatcttgaaatacatggactctcccaggcctttggagccctcaaaatctgtcaatacaggagttacggttgcttgggattcaccaagactctcctacgatgggagggacacacaagatacattcaaatctgctacaaagcccaaggaactcccaaggctttccttggacagcagacaaggatctatcaaaagtttcaatgaaggaacaaaatctcgcatccttttgaagggttcacagaaagggtatggtagttccagaacaatgcagctgcaggaaccagaaacttctagaagaccgtccggcgttgtagcaaagttaatgggactagaagccttcccagactgcacagaaactagtgatactccatcacagatgtctagctgcaccaccaacaaaaatgagacaattgcaggacctagcacaaatgatgagtacaagcaacaccaaagtgcagcatcatcccagggaacaatcaaggggtctagcttgcttcagtttaggagggatgcttcaatcctgaatgtgacaccgtattcacggttttctctagaaccaattccatggaggcaacctgaagcaagccaaggttctcaattacaggattccaaaagaagtgaatcttcagcaaaagcatcaaacctgaccatctctgtatatggggaaattgaaaagaggatagcagatctagagttcaaaaattctggaaaagatctcagggcccttaaacagattcttgatgcaatgcagagatataaagaatcattggatattccaagagatcaggtgtctaattctctatctgacaataggagtagcagcagtctcagtgaaagctcaatagttaaaagcccaagaatacggcagaaggacccaacattcaccgtggttgagatgtcaaattcaacccagggtagtaagtcaccaattttcatcatgaaaccagcaaaagctgcaagaaaaaccaatagtcctgcttccacagaaatgtcatttcagggtaaatcaagcctgggcaagtttagctctgcaaactgcgcaaatggaataatgggtggcaagcttgacgggcaaacagcaaagggtattggcccagcaatcagacatgccaaggattccatcagccaacccttgcactcagtggataagagtaataagatgagaacttctaaattgatgcaatcctcaaaagttcgtcaagtaatcaatggagaaaatgccaccaactccagcaatacagcagaggccaagagcccaagactacaaaagaagtttggtttggagaggcgttcccgaccaactagcccatcatcagatttgagcagtaacagaagacaacacaataggcaatcaggggaattgtcttcctcaagtacaacacccagacaaaaattcagtgagatcagcaatcaaaggagggattttaggcatgaagttgtcgtagaagtcattcacactgttcattctgataggatcaatggtaactccactcagctaaagggcatgaaccaaaataatgcagcagaagagttgagcaaggaaagctttatggctgagaaaacaattacagcagaacaaccaagtcctgtgtctgttcttgatgcttctttctacagagaagaaccaccttctccagttaaaaagaaatcagacatgtcaaaagatttagatgatgctctgaacacttatgatagtagtgaggagaactcagaaaatcttcagctttcatcaagcactgcaaaagccaagttcggcagtgaaatcagtgatactgacttgagaactcaaaagttggtcagaattctccaacaaattgactacaatgatgagagattcaccaatttcagagatgataaagatcctaaccataaatatatatcagaaatactgttagcatcggggctgctcagcagtcaaagctctagccaggtttttcattcatcaagttacccgataaacccaaatttgttccttgcactggagcaaatcaagacaaacatgacgtgtttcaatattgaatgcaacgccaagaagattgctgcactgaatagtcctgagcaaatacaaagaaagctaatatttgatgttgttaatgacattctagctcagaaaataatactggaaagttttactctgtggtgccaaccaaatcagccagcaggtagaaaactaagaggacagctgcttttggatgagctttgcacagaaattgataagttacaacataaaaatacaaatgccaacctgaatgatgaggatgagaatttgacaagtctcctgtgggaagagttgatgcactgtcccacaatttacacaaacagttacagtgaaataccaaatgtcgtgttggatattgaacggttgatcttcaaagatttgataactgaagttgtgagaagtggactagctaaccattctggtaagcattgcagacaactgctgttttccaagtag

SEQ ID NO: 3320 - DNA, 1470 bp, Glycine max var. Williams 82
atggcaacaatatctccaatgtggttcatacttcttggaataacttgtttctgtgtgactgattcttatggggcgaacatgcctctaaggactctttatggtggcactcatcaagaagcattgcttggacttgaggcattcaaggcctctataactaggcgtgactccattgcttcaacaccaccttcattctcaccctctcctagtccttctcctcttccatcacaggatctcaagaaatcacatgtgtaccttgtgacatcttatggtgcagatccaacaggcaattcagacagcactgaagctcttcttgcagccatagcagatgcagccaaaggtccaagtgtagggttcttaatgaaggacatcaaagaccttggaggtgctcagattaatcttgagggtggaaagtacataattagcaaaccactgcagttgccactggccggggttggaaacctcatgatacatgggggaactataagagcctcatataattttccaccagatgggcatctcatagacttgtccacctcaggagaaagcaactcctacaattatgagtacataactctcaaggacctcttgctagactcaaacttcaggggagggggcatttcagtcaaaaaaacacttagaatcaacatagaaaattgttacatcacacatttcaacaccactggaattttagtccaaggtggccatgaaacctacataagaaacaccttccttggccagcacatcactgctggaggggacaaacatgaaagggacttctcaggcactggaataagccttctgggaaatgacaatgcagtaacagatgttgtgattttctctgctgaaataggaataattgtcactggccaagccaacactctttctggagtacattgctacaataaggccaccggcttcggtggcaaagggatttatttgaagcttcctggtttgacacaaactaggattgtgaattgttacatggattacaccaatattgtcgccgaagatccagttcagctccacatctctagcagtttcttccttggtgatgctggtattgtgttaaaatcagtcaatgggattgtaagtggtctcaatattgttgataacatgttctccggcttgaataaaggggttgatatagtcaagttggaccaatcaaatagtccttttaatcaaattgatcaagtttttgtggctagaaatgttgtgaggggtatgaacttaaaggccacaactgcaaaaatgtctttgcttggtaatggaaccacatggacttctgattttaccaaagttttgcttttccctaaccttatcaaacatgttgtgtactccttaagtgccaatggcaacaccttcccaaatcatgctctcagaaacgtttctcagaatcgtgttgtgatcgaaacggatgaggctgtgaatgcaaatgtttttgtcacagtggatcaaggtaatgcaagttga

SEQ ID NO: 3321 - DNA, 936 bp, Glycine max var. Williams 82
atggcctcctccgagattaactgggacaggctagataaaaagaagttctttgttgtgggagcaggactcttcacgggtgttacagcggcactctacccggtttctgttgtgaaaactaggctgcaggttgcctcaaaggatactttggagagaagtgcgttttctgttgtgaaaggtttacttaaaacggatggcatccctggtttgtataaagggtttggtacagttatcattggagcgattcctaccagaatcatattcctcactgccttagagacaaccaaggtggcttccttcagggtggtggagccgtttagactatctgaaactactcaggctgccatagcaaatggaattgcaggcatggcatcatcatttttgtcacaaactctatttgttccaattgatgtggttagccaaaagttgatggtgcaaggattatcaggccatgcccaatatagtgggggtttggatgttgctcgtaaggtgttaaggtctgatggcatcaggggattatatagaggatttggtctatctgtcatgacttatgtaccatctaatgttgtatggtgggcaagctatggttcaagtcaacgctacttatggagattcttgggagataacagtgaggaatatactcctagtctaccaaagattatttttgctcaggctactggagggatcattgctggtgctactgcatcctgcattacaaacccattggatactatcaagacacgattacaggtgctgggacttgaaaagaaaatccctgtaaaacaagttgttaaagatttgatcgctgaggatggttggaaaggtgtatatagaggattaggtccaagacttttcagcacgtcagcatggggtacttcaatgatattggcttatgaatatctgaagcgcttgtgtgcaaaagatggaggaggcaattga

SEQ ID NO: 3322 - DNA, 1365 bp, Glycine max var. Williams 82
atgtttttccgtttcagctcccccttcgcgatccgatccttcctcaaatcccctccatgcattctgcttttcgttctcttctctttcacagaagcttatgatccacttgatccatatggaaatatcacaatcaaatgggatatcataagttggacccctgatggttatgttgctgttgttacaatgaacaactttcaacaatatcgccatatctcggagcctgggtggtcgcttggatggacatgggcgaagaaggaggtaatatggagcatggtgggagggcagaccactgaacaaggggattgttcaaaatataaaggaaacatcccacattgctgtaaaaagaaccctgtagttgtcgatttacttcccggaacaccttacaaccaacaaattgcaaactgctgcaaaggcggtgtactcagctcgtgggcacaggatcaatccaaggcggtttcagcatttcaagtcagtgtgggtagtgctggtaccactaacaaaactgtcaaactgccaaaagacttcacactgaaagcgccaggacccggttacacatgtgggccggcaacaattgtgaaaccaactctatttatacaaccagacaaaaggagagtgacacaagcactcatgacatggaatgtaacatgcacatattcacaatttcttgctcagagaacacccagttgctgcgtctcgctttcatctttctataacgatactgttgtaccctgcactacatgtgcatgtggctgccagggcaactcatctcaattaggggaatgtgtagatccggactcgtcaccacatttgcaatcagttgtttccaaccctggacctggaaagagtagtattacacctttggttcgatgtactcgtcatatgtgcccaatccgagttcactggcatgttaagcttaactacaaggagtactggcgtgtcaaggtcactgttactaatttcaattacgggatgaattattctaattggaatttggttgttcaacatccaaatttcgacaatctgacccaacttttcagtttcaactacaaatcaattactccctacggatcaataaatgatacagcaatgctttggggagttaagttctacaatgattttctcatgcaagctggccctcttggtaatgtacaatcagaactactattcagaaaggataaatcaactttcacttttgacaagggttgggccttccctcggagagtctatttcaatggcgacgtttgtgtgatgccgccacccgattcttatccatggttacctaatgctggttccaagcaagaggtttccctgcttgctttggtgatgtcctctttggtagccttggtattatatgcatatgcttaa

SEQ ID NO: 3323 - DNA, 1398 bp, Glycine max var. Williams 82
atggctttcttgatggcaattgtagtagtaggtgttgtcttggtgctctgtttttgctctgctctcttgaggtggaatgaagtaaggtacaggaagaaaggtttgcctcctggcacaatgggttggccactttttggggagacaactgagtttcttaagcagggtccaaacttcatgaaaacccagagagcaaggtatggcagttttttcaaatcccacatactgggttgtcctaccattgtttccatggatccagagcttaacagatacatcctaatgaatgaggcaaaagggcttgttcctggttaccctcaatccatgttagatatcttaggcaaatgcaacattgcagctgttcatggctccactcacaagtacatgagaggagcactgctttccatcattagccccaccttgatcagagatcagcttttgccaaaaattgatcagttcatgagagcccaccttagcaactggggtgacaaagtcatcaacattcaagagaaaaccaaagagatggccttcttatcatctctgaagcagattgctggcatggaatctggctcattatctgactcattcatggcagagttctttaagctagttctaggaaccctttctctccctattgatcttcctggcacaaattaccacagtggattccaggcaaggaagactatagtgaacattctgagtaagctcttagaggaaagaagagcatcacatgaaacctaccatgacatgcttggttgcttgatgggaagagatgaaagtagatacaaactaagtgatgaagaaatcattgatctagtgattacaatcatgtattctggctatgaaactgtttcaactacatcaatgatggcagtcaagtacctccatgaccatcccaaagctcttgaggaactcagaaaagaacatttggccataagagagaggaaaaagccagatgaaccacttgactgcaatgatctcaagtcaatgaggttcactcgcgcggtgatttttgagacctctagattggccacaatagttaatggggtcctaaggaaaaccactcaagacatggaactaaacggctatttgatccccaaaggatggagaatatatgtgtatacaagagagatcaattatgacccttttctatatcctgatccactaacattcaacccatggagatggatggacaagagtttagaatcaaagaactacttcttcatatttggaggaggcacccgacagtgtccaggaaaagagttgggaataaccgaaatttccactttcttacactactttgtaactagatacaggtgggaagaagtaggaggagataaagtaatgaaatttcctagagttgaggcacctaatggactgcacataagggtgacatcttactaa

SEQ ID NO: 3324 - DNA, 1645 bp, Glycine max var. Williams 82
cactctttaggtaactacaacacaagagactgtaccttctttttgaagtctctgtgggttggggttttggagtgggagcaccaatggctttcttgatggcaattgtagtagtaggtgttgtcttggtgctctgtttttgctctgctctcttgaggtggaatgaagtaaggtacaggaagaaaggtttgcctcctggcacaatgggttggccactttttggggagacaactgagtttcttaagcagggtccaaacttcatgaaaacccagagagcaaggtatggcagttttttcaaatcccacatactgggttgtcctaccattgtttccatggatccagagcttaacagatacatcctaatgaatgaggcaaaagggcttgttcctggttaccctcaatccatgttagatatcttaggcaaatgcaacattgcagctgttcatggctccactcacaagtacatgagaggagcactgctttccatcattagccccaccttgatcagagatcagcttttgccaaaaattgatcagttcatgagagcccaccttagcaactggggtgacaaagtcatcaacattcaagagaaaaccaaagagatggccttcttatcatctctgaagcagattgctggcatggaatctggctcattatctgactcattcatggcagagttctttaagctagttctaggaaccctttctctccctattgatcttcctggcacaaattaccacagtggattccaggcaaggaagactatagtgaacattctgagtaagctcttagaggaaagaagagcatcacatgaaacctaccatgacatgcttggttgcttgatgggaagagatgaaagtagatacaaactaagtgatgaagaaatcattgatctagtgattacaatcatgtattctggctatgaaactgtttcaactacatcaatgatggcagtcaagtacctccatgaccatcccaaagctcttgaggaactcagaaaagaacatttggccataagagagaggaaaaagccagatgaaccacttgactgcaatgatctcaagtcaatgaggttcactcgcgcggtgatttttgagacctctagattggccacaatagttaatggggtcctaaggaaaaccactcaagacatggaactaaacggctatttgatccccaaaggatggagaatatatgtgtatacaagagagatcaattatgacccttttctatatcctgatccactaacattcaacccatggagatggatggacaagagtttagaatcaaagaactacttcttcatatttggaggaggcacccgacagtgtccaggaaaagagttgggaataaccgaaatttccactttcttacactactttgtaactagatacaggtgggaagaagtaggaggagataaagtaatgaaatttcctagagttgaggcacctaatggactgcacataagggtgacatcttactaactaggccgtgactgtatgtacagtaatgagatgagatgtaacagattgtagggtatgtgtgtatgacaattatctaacaaatatatttagtaaaagaaagaaattaaattttcttcttcctcttcctttctttgttttgtatcttcttaattgaacttttgacc

SEQ ID NO: 3325 - DNA, 1410 bp, Glycine max var. Williams 82
atggaaagatttcatgaggaagaaattgaagagccagtgagtccaacagggcaatacttgacaagctcttcactaagtgtgtacattcttggtgtcttggaaagtgaggttcccattgatgactctcaaaccgtgccacttcttcagaatctcttccttcccatcaactcacgtttctcctccatcatgattagggacaaaaatggggagaagaagtggaagaaagttgaagttaagctggaggaccatatcaaagttcctacatttcccaatggcaagtcatccaacttgttcttatatgatgaataccttgatgagtacatgtccacaatagctgtggaacatttaccacaaaataggccactatgggaacttcacattataaaatacccaacaagcaatgctaagggtaccttggtgttcaaactccaccatgcccttggggatggtttttctctcatgggtgcccttctttcatgcatgcaaagagctgacaacacctctcttcccttcacactcccatcaagccaaaggcccaaagcatcatcaatttccaacaccaaagggtttttcaagaaattgccctccattttcttccaaactatatccgaatttggatggagtttcttgaaaagtaagttgattgaagatgatcaaacaccaataaggtcttgtgcggaagacttcaagactcgccaaatgaccatctcagatgtcaccttctcattggatcttatcaaagacgtgaaatccaaacttggagtgagcataaatgatgtgcttgctggagtaattttttttggcattcggctatacatgcaagaaattaatctgaaatcaagccaaacccaatccacagcattggtgttgctgaacacaagaaacattgaaggttacaagtctgttaaggagatgattgagaagaccaatagtcgttctgcatgggggaatcaatatgcctttttgcatgtttcaattccagagcttagtgactccaaatatgcaaacccacttgagtttataagggaagcccataaggatatgaccaaaaagaaaaattctttggccactcctctcactggcatgcttctagatatgctcagaaaactcagaggtcctgaggctgcagctagctacttacgcagtactttgagaaactcaagcacaacaatctcaaacatcattggaccagtggagcaaatggctgtggctaatcatccaattaaagggttttacttcatggtagctggttcacctgagagtctcaccatgacgatcatgagctacatgggaaagataagaattgcatttggagtagagaagaacttcatcgacaagcaattattcaagtcgtgtttggagaattctcttgagatgataaaggaagcagcaaaaaagatttccgcataa

SEQ ID NO: 3326 - DNA, 882 bp, Glycine max var. Williams 82
atgcgaatgagttgtaacggatgtcgtgttctgcgcaaagggtgtagcgaagattgtagtataagaccgtgtttgcaatggatcaagaacccggagtcacaagctaatgcaactgtttttcttgccaagttctatggtcgtgctggcctcatgaacctcatcaacgctggtcctgaaagccttcgtcctgccatttttcgatccttgttatacgaagcatgtggtcgaattgtgaacccaatttatggttcggtgggtttgctatggtccgggagctggcagctatgtcaagccgccgtggaagccattttgaaaggcgagccgatcacgccgataacatccgaagccgcggctaatgggcgggccccaccactcaaggcctacgacatacgccatgtgtcaaaagacgagaactcggcaaacgaaactccaaaggccaagacccggtcccggttcaaccgaaccggtagcacactcattaaaccaaaggctagcaagggaaccccaactgggttcgttccgattgaaccggttgaaccggagacagcaaaccggaccacaagccacgagtcggggctgagccacttgtcggaagccgccgtgatggtggagggagaaagcaaagaaagcgaaagcgatgtgtcagtggaaacttcgaatctatttcacgaagaaccggagtcggttgcgaagacgagtgatcgaaccggtgaaagtggtaatgaaatcggcttggaattgacgctcgggtttgaaccggtctcacgtgtgcatcacgtggttccaatgaagaagagaaagataattgcgtcgaagagttatggtgactcggctgagaaagactcgtgtaagatggagctggggcttgagtacccggcttga

SEQ ID NO: 3327 - DNA, 537 bp, Glycine max var. Williams 82
atggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaa

SEQ ID NO: 3328 - DNA, 962 bp, Glycine max var. Williams 82
atgctgtaatgtcatcacttattcaatccaacggttgtaacttctcagcaaccaatcccctccatttcacaccatcggattagtactacacaaatcacactattatatatagtaagtttgagcagaagcttggatatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactacattcccatttgtttttgctttttgagatttcatcatcctgtatttttggtttctgttttcggacttcaatggaaattaatggatgagaactaatgaataagctattgtgttgtgttgctttgtttcaaaataacttcaataacccatcgtccttgcatttctctctactgggctgaaattaatcatttctaaatttaagttaattaa

SEQ ID NO: 3329 - DNA, 537 bp, Glycine max var. Williams 82
atggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaa

SEQ ID NO: 3330 - DNA, 318 bp, Glycine max var. Williams 82
atgttggtgttggcatggttattccattcacaagccttaaatccatggctggcttcccccaccaggaaaaccaacaatgacattacctccattgctatcaacaatggaagagtgaaatgcatgcatgtgtggcaaccaattggcaagaagtttgagactctttcctacctgcctaaccttgatgatgcacaattggcaaaggaagtagagtaccttcttaggaacggatggattccttgcttggaattcgagttggagcacggtttcgtgtaccgtgagcacaacagatcaccaagatactatgatggacgctactag

SEQ ID NO: 3331 - DNA, 942 bp, Glycine max var. Williams 82
atgagcgtcccaaaaaagagaagctccaattccaaagaatttgatttttatgaatcggatgattgttatgcacccccagcaaaggagcaccgtgtagtatggtcagaagaactgcatcaagaatttgtcaatgctgtgatgcaaattgggcttgataaggcagagccaaagaggattcttgaagtgattaatatccctggtttgacaaaagagaatgttgctagtcatttgcagattgatcgcttggggcagactataaaaccttgtggtacagttgagaaggggcaaaagttttctttccctatcagaagtaatggtggtgagcttgaactttgttaccagagtcaacttaatcagagaagtagagtcaacctaatcagagattggagtttcataggaggatcaagaattgttgttaaaccaaatttcgtgagattggttccttttcgaaaagccagtcgtgtctatgcttcatggttgtcaggatcacaacttgctagcagcgcctttacactgggaacaacagcagtgctaccattttacacactcatggttctagctccaaattctgagctaactaggaagtctatggaaagtagtgtaccatatgtagtgcttggcattctatatgcatatttgttgtaccactcttggacccctgagacagttggacttatttttgcaagtaaatacttgctaccagagctgactagtatagggaaaatgttctccagtgagatgactttagcatcagcttggattcaccttttggttatggatctctttgctgcaaggcatgtttttcttgatggattagagaatcagatagagactcggcattcagtttctctgtgcttgttcttttgccctattggggttcttagtcatgccatcaccaaagaaatgactaaaagtgccagaaaaaacaagcacagcttatag

SEQ ID NO: 3332 - DNA, 1491 bp, Glycine max var. Williams 82
atggggggtaacaattctaaggaggataataacaattggaggcagaattcatctgtgcgttcaagttcctctgcgtcttcttggggttcatatcctgacccccaatcaggttatggtcacgggggttacgcgtatgagccacaacagccttcttatcctacacagcagccgtattatgcccaaccgccgccgccgccgccaaactatggcaatgaacctcagcctcatgctagcggcagagtggccggccacagaaatgagaagcggttagacaggaaatactcgagaatcacagataactacaactccatagatgaggtgactgaggctcttgcacgtgcaggccttgagtcttcaaatcttattcttggtattgatttcactaagagcaatgagtggacaggaaagcattcatttaacagaaaaagtttgcatcacattgggaatggtccaaacccctatgaacaagcaatatcaattattgggaagaccttggctgcatttgatgaggataacttgattccttgttttggatttggggatgcatcaacacatgatcaagatgtctttagtttctatccagatgaacgaatttgcaatggatttgaagaagtgttgagtcggtatagggaaattgttcctattattcgacttgcaggtcctacttcatttgcaccaatcgttgaaatggccatgacaatagttgagcagactggaggccagtaccatgttttggtgatagttgcggacggccaggtaacaagaagtattgacactgagcatgggagactaagtccacaggagcagagcactgtggatgccattgttgaggccagtaaatttcctctttcaatcatattggttggtgttggagatggtccttgggacatgatgaaggagtttgatgacaatatcccagcccgggtctttgataattttcagtttgtgaatttcacagaaattatgtcaaagaatattcctccttctcgaaaagaggcagcatttgcgcttgcagcactgatggaaattccttctcagtataaggcaacaatagagcttaatctcttgggtggtcgaaatgcaaatgctcctcagagagttgctctcccaacaccatcatatggttcagcatctatgggcatttcaaaaccttatggttcagcatcttttggcgcttcaaaaccctatggttcagcatcctttgatgccccaaaaccttatggttcagcatcttttagcagttcaaaaccttctcatgctgctagctttgagcagagtgccccttcttattatgacaacacggaccctgttggcacagctcctcctgccccaagttcctcatatgacaatcagctttgccccatatgtctgaccaattcaaaagacatggccttcggatgtggacatcagacatgttgtgaatgtggacaagatcttcagtcgtgtcccatctgtagaagccccattaacaccagaattaagctttactag

SEQ ID NO: 3333 - DNA, 2899 bp, Glycine max var. Williams 82
gtttcgtttcatttaacgattttcacaaattacaatttacaacctacgtttcttattttcggatattcatgagttagtgtaaggtttccgcaatctattgtggccactgagcgtgcgtgttaattgatatgcatgcacgacgacagtgagagttcgtgtagaaattgaattgatatttctggcaatttctttttttttttgtttttaatttctcactttccatttatcgttcagcgagattttgtcacgttattgttattattattattgcgttcggtgtggaaccaaaccgagatgccgtgtgttgaatatgtttgaagacacatggcggcggttacagggttacttaataagcctttgtttctttgagtcgattggtgtttttctttttttaataaattggtccttgtctcttgaattgagcatttgctgcgaaattttgaagattcaagtattcaacgttccagaagagttctttgtttacatttatatatagcacctgaaattggctttggagttcttatactgtttgtttgtttggttttgaaattctggattttggattgtgttctgctcagttttgttaaggagaaagtggggtttgagagttttggcattatttattattagcgtgtttggttccacattccagataccccagacgtggtttttcgcgtcagctaagaagctggtagttgtaactttcacatccctgacgtgatttcttacttctcaacagagaattgagttgatggggggtaacaattctaaggaggataataacaattggaggcagaattcatctgtgcgttcaagttcctctgcgtcttcttggggttcatatcctgacccccaatcaggttatggtcacgggggttacgcgtatgagccacaacagccttcttatcctacacagcagccgtattatgcccaaccgccgccgccgccgccaaactatggcaatgaacctcagcctcatgctagcggcagagtggccggccacagaaatgagaagcggttagacaggaaatactcgagaatcacagataactacaactccatagatgaggtgactgaggctcttgcacgtgcaggccttgagtcttcaaatcttattcttggtattgatttcactaagagcaatgagtggacaggaaagcattcatttaacagaaaaagtttgcatcacattgggaatggtccaaacccctatgaacaagcaatatcaattattgggaagaccttggctgcatttgatgaggataacttgattccttgttttggatttggggatgcatcaacacatgatcaagatgtctttagtttctatccagatgaacgaatttgcaatggatttgaagaagtgttgagtcggtatagggaaattgttcctattattcgacttgcaggtcctacttcatttgcaccaatcgttgaaatggccatgacaatagttgagcagactggaggccagtaccatgttttggtgatagttgcggacggccaggtaacaagaagtattgacactgagcatgggagactaagtccacaggagcagagcactgtggatgccattgttgaggccagtaaatttcctctttcaatcatattggttggtgttggagatggtccttgggacatgatgaaggagtttgatgacaatatcccagcccgggtctttgataattttcagtttgtgaatttcacagaaattatgtcaaagaatattcctccttctcgaaaagaggcagcatttgcgcttgcagcactgatggaaattccttctcagtataaggcaacaatagagcttaatctcttgggtggtcgaaatgcaaatgctcctcagagagttgctctcccaacaccatcatatggttcagcatctatgggcatttcaaaaccttatggttcagcatcttttggcgcttcaaaaccctatggttcagcatcctttgatgccccaaaaccttatggttcagcatcttttagcagttcaaaaccttctcatgctgctagctttgagcagagtgccccttcttattatgacaacacggaccctgttggcacagctcctcctgccccaagttcctcatatgacaatcagctttgccccatatgtctgaccaattcaaaagacatggccttcggatgtggacatcagacatgttgtgaatgtggacaagatcttcagtcgtgtcccatctgtagaagccccattaacaccagaattaagctttactaggcggcctcttccgttgtgaattaattattttgttgtgtaagctaaaattctttgatttttttaaccttctctggttgtatacaaacgttagatcagctgtgtctattgatgaaaaatggtacaacaaaaaaatatccaaaccaattaaattatttggttttatttggtttggacttgtaaaaaaattcttcaaaccccaaccgaacaaatgtgaacaagaatttgtttggtttgtttcttgggttgtccaaacaaaaagaaaatgttaattcgaccattttagtatccagagtaaattggtgaaagaaaagcaatatttcagcacatgtagtcaactaattcttatcataaataacaaatcctaaagttatacctatacgaacacagcagggagaaccacaagtcaagcaatctttcttagacctgcgggttcctaccatgaaatctgacgcttgaaccaatggttatcggttttgaatagtttggttggactcaaacttatgaacgtaaattaaattgaccggttaataaaaaaagttggcgtaatgggataaaataaaattttgttatgttaagataaatgagaatgatttatttagtatgagaatttgtgttcaattatccctgagttgaaaagatgcatgtgatttttgatcc

SEQ ID NO: 3334 - DNA, 1530 bp, Glycine max var. Williams 82
atggcagttcttagttctggagaattccttggggcatttcttgttttcgttgtaatccactactggaggctcaacagacacaccccaattgctaagtggcccattcttggcatgttacctggtgtattcctcaacatgcccaccatctttgattatataacttctgttttgaaacgtgaaggaggcactttcatgtttgaaggaccatgcctatcaaacatgaacataatgtttaccagcgacccaatgaatgtgcaacacatcaccagcacaaaatttcaaaactatgggaaagggaatgattttagagagatttttgaaattctgggagatgggattttcaggtccgattcccagttatggaattataacagaactatacttcattcagtttttaggaaggcaagttttcagttgtttgttcaccaaacaatcatgaacaagattgagagttgtctacttccatttcttgatcgtggatggaaagaaggaatggaagtggacctgcaagatgtattccaaaggttaacctttgacaacatctgttccattgttttaggatttgatccgaattgcctttccatggaattcccagaagttgcatgtgagaaagccttcactgaagctgaggatgctctgctctaccgacatttcaggccaaaatgtttatggaagctgatgaaatggcttcatgttggaaaagagaagaagctggaagaaagccagaaaattgttgaccaaatgttgtatacagaaatcagatccaagtgcaaagtgcaaggcgaaagcaataacagtagcaccccggtagatgagtcacagtttagcttgctaaatgttctaataaatgaagtaggaaagggaaaagcagatgacaactttctgagagacacagcaataaatctccttgcagctgggagagacaccattagttcaggtctcagttggtttttctggctggtggcaacacacccatctgtagaatctaagattcttgaagagatccgaaaaaatttaccagcaagagaaggtaattggaagaatttaggcgtggaatcgattagcaggttaacttacctccatgcagcaataagtgaagcattaaggctttatcctccaataccaattgagcacaagtgtgccttaaaatctgatatgcttcctagtggtcattggataaattcaaataccatgatactatattctctatacaccatgggaagagcagaggaaatatggggcgaagattgcttgaagtttataccagagaggtggatttctaagcaaggagggattattcacataccctcttacaagttcattgcattcaacgcaggaccaagaagttgtttgggtaaggacataagctacactgagatgaagatggttgctgtttctatattatcgaattatcatgtccacttggtggaaggccaaataatatccccaagagtttccattgtccttcatatgaaacatggcttgaaggttagagtaacaaaaagaagcttctgtgacttagggatctaa

SEQ ID NO: 3335 - DNA, 597 bp, Glycine max var. Williams 82
atggaggaagcgctcgagctcgcacgcgcgaaggacgcgaaggagcgaatggcgggcgtggagcgcctccacaaggtgctggaagcttccagaaggagcctcagctccagtgaggtcacttctcttgtcgattgctgcttggatctcttgaaggacaacagcttcaaggtctcgcagggcgcgctccaggctctcgactccgctgccgtgcacgccggtgaccacttcaagctccacttcaacgcgctagtccctgccgtcgtcgaccgcctcggtgatgccaagcagcccgtccgcgacgctgccaggcggttccttctcactctcatggaggtttcatctcctacaataattgttgaaagagcagggttctttgcctggacaagcaaaagctggagagtcagagagaaatttgcacgaacagtcacatctgtaattggtctgttttcatctactgagcttccccttcaacgtgctattctttctcctattttgcagttgctgaatgatctgaatcctgctgttagggaagcaactattttgtgtattgaggaaatgtatacacaagctgggtcccaatttcgtgatgaactttag

SEQ ID NO: 3336 - DNA, 942 bp, Glycine max var. Williams 82
atggcaacccaaactttgtgtgaatctcctcttcctgttgttgacttcatcaatgaaaacatgaagccgggcaccgatacatggcttggagcctgtcaattggtgcggagaggatttgaggattacggttgtttcctagcacgcttcagtaaggttggtccagagcttctcaactccgtttactatgcaatggaagaactctttagtcttccattggaaaccaaaaggagaaaaacaagtgataaaccaaaccatggctacactggacaagtacccacatcgcctctatttgaatcttttgcgattgacaatccatccagtattgaagattgtcaaaaattcgcacgcataatgtggccaacgggaaatgaccatttgtgtgaaagcgtcaacgagtatacaaagatgttaaaagaactagaccaaaccgtgaagagaatggtatttgatagctatggcctggacaagctgaaatgcgagtcattcctcgagtcaaccaattatgcttttcgaagctacaaatataagatacctgcgacagatgagagcagcgtgggagtgaattctcatacggactcaaccttcataaccatattgcatcagagggtagatggcctagaagttaaattgaaagatggagaatggtttggtgtggatgcctcacctttgttttgtgtcatggctggtgatgcatttatggtatggagtagtgaaaggataagagcttgtgaacatcgtgttattctgaaatcaaaggtaaccaggtactccttgggattactttcatacagtagtaagatggtacagacattggaggatctagtcgatgaggaacatccaatacgctataagccattcgaccattatgcatatgttggttttcgtttcacagaggaagccgtaaaatatacaagtcgtatcaaaacatatagtggtatttaa

SEQ ID NO: 3337 - DNA, 660 bp, Glycine max var. Williams 82
atggagaaaatgggagtgatgctaattactctattcctctttatagctgcaacagttgcagaagatgctgataatattggtgaagccattattcccgagaaccctaaattcaaaaagtttgtgacagattgcacatcgcatgttgctgaaagatgtagtagtggaagcgaagcattgcatggcgagggagggttggctctttgccttttcgattctatggaaaattgcttggtagagcatggagcggccaaagttaaccaacgatcattattcgtgctaccaaaaggatccacacccattgaaccaaaagattcattaccttcatttattccatcaccacccatacctcccaagtccaaatttgaatgttggtgtgaaagtttaatatcttgtgtgtgtacttggacgtccatggtgccgagtacaaggttattaaataaccaacaattaggtcaaggtttctattatttccaatatgagccactcctacaattcagaaccgtcttgagaacatgttctctggaaagtgcaaggacttgtctcaatgctcctaatgttgctacatcacctttagccgcttgtctcattccatccatgaatcaatgtgtctatcccagtggagctgaatccggtactggtagcctacctattaaggcgtaa

SEQ ID NO: 3338 - DNA, 1356 bp, Glycine max var. Williams 82
atgggaagtttggaagttgaatcaacaaatggtcacacctcaagtcctcacaaaaaaactgaaaaatcggagagagagaggagaattgatgagtggcttccaattacttctaaaaggaatggaaaatggtggtattcagctttccacaatgttactgccatggttggagctggtgttctcggtcttccctatgccatgtcagagcttggatggggtccaggtgtaactatacttatcctctcatggatcatcaccctgtacacactatggcaaatggttgagatgcatgaaatggttccaggaaaacggtttgatagataccacgaactgggccagtatgcctttggtgaaaagctaggcctttatattgtggtgcctcaacagcttgtggttgaaattggggtgaacattgtgtacatggtcactgggggaacatcattgaagaagttccatgatactgtgtgttcaaactgcaaaaacatcaaattaacgtttttcattatgatctttgcctctgttcactttgtactgtcccatctccctgacttcaactccattactggtgtatccttggcagcagcagtcatgtccttaagttactctacaattgcttgggtagcttctgtacataagggtgttcaagaaaatgtacaatatggttacaaagctaagagtacttcagggacagtgtttaacttctttaatgcccttggcactgtggcttttgcctatgctgggcacaatgtggtgctagaaattcaagcaacaatcccatccacaccagagaagccatccaaggttcctatgtggagaggagtggttgttgcctacatagttgtggctatatgctacttccctgttgctcttattggctactggatgtttggcaatgaggttgattctgacatcctcatctctttggagaaaccaacttggcttattgcaatggctaacttgtttgttgttattcatgtaattggaagctatcagatttatgcaatgccagtgtttgacatgattgaaacggtgatggtcaagaaattgaatttcgaaccaagcagaatgcttcgttttgttgtacgtaatgtatatgtggcattcactatgttcattgctattaccttcccatttttcgatggtctcctaggattttttggagggtttgcttttgctccaacaacatactttctcccctgcatcatgtggcttgcaatccacaaaccaaagagatacagcttgtcttggttcattaactggatctgcattgtgcttggcctatgtttaatgattttatcacctattggaggattgaggacaatcataattaaagccaagacctacgaattttactcttga

SEQ ID NO: 3339 - DNA, 1898 bp, Glycine max var. Williams 82
ttttgaaccattttctgcctataaatactcatacattcgacgtttttcaaaggtgagagccaccctttttctcttacaagctactagaacaccgtttgctttgctctcccttcattttgcaaaacctctgggtatctaactctgcagccatgggaagtttggaagttgaatcaacaaatggtcacacctcaagtcctcacaaaaaaactgaaaaatcggagagagagaggagaattgatgagtggcttccaattacttctaaaaggaatggaaaatggtggtattcagctttccacaatgttactgccatggttggagctggtgttctcggtcttccctatgccatgtcagagcttggatggggtccaggtgtaactatacttatcctctcatggatcatcaccctgtacacactatggcaaatggttgagatgcatgaaatggttccaggaaaacggtttgatagataccacgaactgggccagtatgcctttggtgaaaagctaggcctttatattgtggtgcctcaacagcttgtggttgaaattggggtgaacattgtgtacatggtcactgggggaacatcattgaagaagttccatgatactgtgtgttcaaactgcaaaaacatcaaattaacgtttttcattatgatctttgcctctgttcactttgtactgtcccatctccctgacttcaactccattactggtgtatccttggcagcagcagtcatgtccttaagttactctacaattgcttgggtagcttctgtacataagggtgttcaagaaaatgtacaatatggttacaaagctaagagtacttcagggacagtgtttaacttctttaatgcccttggcactgtggcttttgcctatgctgggcacaatgtggtgctagaaattcaagcaacaatcccatccacaccagagaagccatccaaggttcctatgtggagaggagtggttgttgcctacatagttgtggctatatgctacttccctgttgctcttattggctactggatgtttggcaatgaggttgattctgacatcctcatctctttggagaaaccaacttggcttattgcaatggctaacttgtttgttgttattcatgtaattggaagctatcagatttatgcaatgccagtgtttgacatgattgaaacggtgatggtcaagaaattgaatttcgaaccaagcagaatgcttcgttttgttgtacgtaatgtatatgtggcattcactatgttcattgctattaccttcccatttttcgatggtctcctaggattttttggagggtttgcttttgctccaacaacatactttctcccctgcatcatgtggcttgcaatccacaaaccaaagagatacagcttgtcttggttcattaactggatctgcattgtgcttggcctatgtttaatgattttatcacctattggaggattgaggacaatcataattaaagccaagacctacgaattttactcttgaactctttctcctcttgactcagtcatggaaagttaactatatggaaatgtgtgtgatttatcataggtcgctctttaatttactattgcaaaagattgcttgtatagtattgcgtgttggtggaaggggaaattattcccacggaatctcatgaaagaggaatttctagatgtttttttcctttggcattttcattataggaatgtaccattttctctttgctctacattattctcgtaatgatacctattttgtaaagcacatatagcatgtttggctttgattaatttttggaaacaagcaagatttgttttccttttaagcacattttgtataaacttttgatgtaaattattttgaacaaaataaatgaaaaatgagattttttttctg

SEQ ID NO: 3340 - DNA, 801 bp, Glycine max var. Williams 82
atgcaacctatctcagcacctcatgtcagaacttcaatcaaaattgttagcacattaaacgaaagctaccacaccaatcaaccacccttggcaggcaaaataaaacgccttgttctcacccaggaaggtagaacaaagctcaacatttacccagatagagagttctatgcatttccacgctttgtaaaacatgtagatgatggttttgtttctacactgaccaatctttacagagagaggttgagatctgacatggagattcttgacctcatgagctcctgggttagccatctaccaagtgatgtcaagtacaaaaaggtggtggggcatgggttgaatggacaagagctttcaaagaatccaaggttggatttttttgttgtgaaggatctcaacaaggatcaacagtttgaatttgagagttgcagttttgatgcagtgttatgcacagttagcgtgcagtatctccaacaaccagagaaggtatttgaagaggtgttccgggtactaaagccaggaggggcattcattgtgagttttagcaacagaatgttctatgagaaagccataagtgcatggagggaagggactgcttatagtagggtacaacttgtggttcagtacttccaatccgtggaaggtttcacagagccagaggtagttcgaaagctgccaaatgctcaagagaacaacatgtcaccaattggttggatcatgaggctttttggattgctttcagggtcagatcccttctatgcagtgattgcttacaggaattataagcccatacatgatgcctga

SEQ ID NO: 3341 - DNA, 3213 bp, Glycine max var. Williams 82
atgaaaggaaagaacaggagaagtggtggtgttgtccatatggaatacctcattcacattcaggagattaagccttggcccccatcacaatctctcagatcgcttcgttctgtgttgatacaatgggagaatggtgatcgctcttcagggtctactggtgttgtttcaccttcgcttggtcctaattctgctcctggtgaggcaaaactcgagtttaatgagtcatttaggcttcctgtaactctgtcaagggatatgtctattcgaaatagtactgctgctgtgttccagaagaattgtttggagtttcacttgcatgaaactcgaagagataagaccactaaagggcagttgctggggactgccatcatagacttggcagattgtggtgtacttagagagaccttgagcattcgtacgccattgaactgccagaggaactacagaaacacagatcagccacttttgttcattcaaattgagcctgttgaaaagagtcgccctaagtcctccttgaaggacagcttgacaaagggaaataatggcagtgaatctgtatcagcattgatgaatggagagtatgctgaggaagctgagatcacctcttttactgatgacgatgtttcctctcattcatctgtggccgcagtcactacttcctcggagtctagtgcgtgtatgccccccgaacatgaagagaatggaccagctcaaaacagtggtagcaatgacaaggagcatgagcatcccttgacctcagagacaagagttgagaagttgaatgtgatggaacaagatgcatatgagagactggagaggagttcttcctatgtgtcatctatggatgtgtcctctgaagtcgggagtccagtaaatggtcatacctctattacaagcactcccaatcatagatcagcaacaaccccaaagcaggttgcttctttgaatgctgattcttcttccccaaccttggaggaaaattctaagagcaggtccagaatcagtgatgatgaaaatttggatcaggagagttgtgaaaaagttgccaattgtagaaatatgagtacagttgtacaaagaaacaataacgaaagtgattttgacatttattctagcaacactacgtctctagacagtaattacctcgtggacacgaatccaagctttggtttggaaaccaaagacaaattaagtgagagttgtgaggaagttgacaaaagccgtgtgctggaggggggaagtgataactattacagttccattcaagatcagcatggaaatgaaatgtttcattctgataagcaatatcatgtagaagatgaatcagtggcagaaggttcaaaagatcaagttttattgagtagcaattcatattcttttggtgggtcagataatggtatgaaaggcaatgttctgaaaaatgaaagattgaagaatgtgaggtctgtaaggtcatcagcagactcagttaggaatattgggtcacttggtaacaatcatctcattgaggtaaaggaaaatggtgttaatggagatgcccaaaataatggagcgaacattcgaagcagtgacagaaaagatgccaaggtttatccaagggaagccagaaatgccattttagacaacaagattgagcacttggaaaacaagataaagatgcttgaaggagagttaagagaagctgctgctattgaggctgctttatattcagtagttgctgagcatggaagctccatgagtaaggttcatgccccagctcggcgcctttcaaggctgtaccttcatgcttgtaaagaaaattttcaagcaagaagggctggggcagctaaaagtgctgtttctgggttagtccttgttgcaaaggcatgtggaaatgatgtcccaaggttgacattttggttgtctaattctattgtgctgagaacaattataagcaaaactaccaaaggcatgacaccatctaatccttctggatctagtacaagaaggaggaatggagaagggaatggcaaggtaacacaaccattactatggagggggttctctcctaggaaaaacgaaaatacagcttttgaatatggaggtataggtagctgggatgacccaaatatgttcacatcagcattggaaaaggtggaagcttggatcttctctcgcattgtggaatctatttggtggcagtctttgactccacatatgcagcttgctgatgcaaaggccacttgtaaggattcagcgaaaaactataaaaatatgtctagctcatgtgatcaagagcaggggaatttatcactaggtatttggaagaatgcatttagagaagcctgtgaaaggctttgtcctatccgagctggaggtcacgagtgtggctgtttatctgtgctgcctagattgataatggagcagtgtgtggcaagattagatgttgctatgttcaatgccattcttcgggaatctgatgatgatattccaactgatcctgtatctgatcccattagtgatcccaaggttctccccattccacctggtcaatcaagcttcggagctggtgcgcagctaaaaactgcgattggtaactggtctagatggctgactgacctatttggtatggatgatgatgacccacttgaggatagagatgaaaatgaccttgatagcaatgatggaagtcaaaataccttaaagtcctttcatcttcttaatgcattaagcgacctcctgatgcttcctaaggatatgctcttaaatgcatccatcaggaaagaggtgtgtccaatgtttagtgcatcactaatcaagaagattttagacaattttgtcccagatgaattttgccctgatccaattcccactgatgtttttgaagctctggactcacaggatgatcttgaggatgaaaatgagtctatcaacaacttcccctgcaatgcagctcccattgcatattcccctccatcatcaactaccattacaagtattactggggagattggaagtgaatctcagctgagaagaagcaaatcttctgttgttaggaagtcatacaccagtgatgacgagctcgatgaaataaactatccattatcttccatattgaatagtggctcctcctcaccagcatcatcaaagcccaactggaagtggaaagacagtcgtgatgaatctgccgtcagatatgaactcctcagggatgtttggatgaacagtgaatga

SEQ ID NO: 3342 - DNA, 333 bp, Glycine max var. Williams 82
atggaggcatacagaaagagccacagagggtccatgagaggaaaatcgttgcctttttatagaaatgcaccaaaaccagcttcctcaaccgccgtgcaatacacagctacagatattaagccaaatcactattcttcttctcctgcctctgtagggttcgtggtccacgaggactatgcaaccacaaagcgaaatctgaaggttcgcattgtggttgcagatagtaggagcaatttggatgagttgtatcgccagccagcagatgaaagcgtggacaccaaagctgaaatatatatcgctatggttcagaaacgtttgatgcttgagcgataa

SEQ ID NO: 3343 - DNA, 814 bp, Glycine max var. Williams 82
gaaattcacaccgtgcaatctcctttaatacccttttgttctcaaaacttgctggtgaaaatggaggcatacagaaagagccacagagggtccatgagaggaaaatcgttgcctttttatagaaatgcaccaaaaccagcttcctcaaccgccgtgcaatacacagctacagatattaagccaaatcactattcttcttctcctgcctctgtagggttcgtggtccacgaggactatgcaaccacaaagcgaaatctgaaggttcgcattgtggttgcagatagtaggagcaatttggatgagttgtatcgccagccagcagatgaaagcgtggacaccaaagctgaaatatatatcgctatggttcagaaacgtttgatgcttgagcgataaaacgcataagcagataccctgtttcaaaaaaacaaaaaaacgcgtacgttttaagagatcaagtgatcatcaaccatgctatatatattttagtgataacatgattatagttgcagggcctagcatttaataaaataatagtaccctttttaaatttgtgcgattttggcacttcgtgtagagataattatgttatgctgtaataagtatgaattttacatagtagtagtttgtttggcttatatataaatatgtttggcaaattaaagctatggttgtatagtgattaagtattattttgggttatcagatcataatgagtagaaattgaaaattgttgctttctcattgtatcaaactataggttccaaattgtaatccaaacatgatagtatatatttgaagcaaatccaattgagtt

SEQ ID NO: 3344 - DNA, 567 bp, Glycine max var. Williams 82
atggagaattattccatgttgttctctgtttccaattcctcaagctacccaattggagttggaagctctcaaattggttatagtggtcaaagctccaatgcgtttcttggtctaaggcctagtaatgaattagctagtgatgatcatgagaagagacaaggtggtggtgatggcaatatgttaatgtctcagatcagtggtggtagcattaatgtgagtgatgagttaggtggttcgggaaatagtaacaataataaaaagaaaggagagaaaaaggttagaaagcctagatatgcttttcaaacaaggagccaggttgatattcttgatgatggttaccgatggaggaagtatggccaaaaagctgttaaaaacaacaaatttccaaggagctactacaggtgcacgcatcaagggtgcaatgtgaagaagcaagtgcaacgcttaaccaaagacgaaggagtagtggtaaccacttatgagggagtgcacacacacccaattgagaagacaacagataactttgagcacattttgagtcagatgcaaatatacactcccttctga

SEQ ID NO: 3345 - DNA, 522 bp, Glycine max var. Williams 82
atgaattccataaccctcttggttcttttgcccctctttactcagtttttggaagttgagcctgaaagacccaagcttccagggaaaaccaggttccccatctcacaaatcagtgtgatgggttttgtgtattgtgatttctgctccaacaacagcttttccagacacagctacttcttgccaggtgctgaggtcaaggtagattgcatgttcaaagcactttcagagaaaacctctgagcagatttcactttcagtgaacagaactaccaataagtatgggatgtacaagctggaaatcccttcagtggatggagtgaaatgtgcagaagattctgcagttgtgtcttcttgccaagcaagcttaataggtagttcatcctctgcttgcaatgttcctggctacaaaaccacttctaatgtgatagcaatcaaagcaagaagagccaatctctgcatatacagcttcaatgctttgactttcagaccatccaagagggacatcaccttgtgtggtaattaa

SEQ ID NO: 3346 - DNA, 2046 bp, Glycine max var. Williams 82
atgatgaattcattgtgtggaagctcactgtccctcaagagtgagaacaacaactctagaaccaaactccaacaacccacttcttcaaatgactcagttttgcaatccaagaaaaacaatgccactcaatcctctggtgatctagaccaaaccagcctaaccccaccaagcctaaaccttccatcactcaaatttgacttagatggagatgtggaagttcaatcaccagatagttcaatgtgggaatctttttttgctgaccatatagatggtgatttcatgatctcttccccagtgaggaccccacaagcagcctcttcctacaattgcaactacaactatgctcagggaatgcaaggccagagtctctcagggtgttccccacctcgtttttcatcatcacaaattggagccttcaacagcagcagcagcctcaacaaagggaaaggactcagccccctccacagggtgttcaactcacccaacaatcagtacatgcagcatgttgagaacctctcactgccagcaatagaagagttcttggaggactaccaaaccaaggtgtcttcttctgatcacaacattacaagttcatctgagtgctttgacttgtcatctcatcaaatcccttcgtccattttggatggcttggcactgcacaattcctcgaggtaccatcgtggatcggtcgtcgacgaagaatcgacggtgcacggtggtggcggtggtggtggtggctcttctcagttgtcacaagagagtgacatctatcaccagatggggtccatggctagtgcttctctttcacaggctctacaacaagaacgctaccaagagaaacagcaaaagcaacaagcacaacaactgcaacaacaacaacggcagcaccagcaagagaatctgatggtgcctattccgatcgaaatcgagcaggagcaagacagcgggcttcaactggtgcacctgctcctggcttgcgcagaagcagtagccaaagaggaatacatgctcgcaagaaggtacctccaccacctcaaccgcgtcgtcacccccttaggcgattccatgcagcgcgtcgccgtctgcttcaccgactccctaagcgccaggctcaactccaccctcacacccaaacccgcaacgccgtccaaacccctaaccccctccaactccctcgaggtcctcaagatctaccagatcgtctaccaggcctgcccctacgtcaagttcgcccacttcactgccaaccaggccatcttcgaggctgtcgagatcgaagaacgcgtgcacgtcatcgatctcgacatcctccagggctaccagtggcctgctttcatgcaggccctcgcggcgcgcccagcgggcgcaccattcttaaggattactggagtgggtcccttgttagacgccgtccgtgaaaccggacggtgtctcacagagctggcccactccctacgtattccttttgagttccacgcggtcggggaacaacttgaagatctcaagccacacatgttaaaccgccgtgtcggggaggcgctggcggttaacgcggttaaccacctccaccgcgtcccaggcaaccacttgggcaatttgctgaccatgctacgtgaccaggcacctagcatagtaactctggtggagcaagaagctagccacaatggaccttactttctagggcgttttcttgaggccttgcattactactccgccattttcgactcattggacgccacttttccggcggaatccgcgcagcgggcgaaggtggagcagtacatattcgcgccggagatacggaacatcgtggcgtgcgagggggcggagaggttcgagaggcacgagaggttggagaagtggcggaagataatggaggggaaggggttcaagggggtggcgctgagtccgaacgcggtgactcagtcgaagatattgttgggattgtattcgtgtgaggggtataggttgacggaggataagggttgcttgttgcttgggtggcaggatagggccatcattgctgcgtctgcatggcggtgttga

SEQ ID NO: 3347 - DNA, 2136 bp, Glycine max var. Williams 82
atggagaatcatgataataaccttgcagagaatgagaattcgggcactaacgaaaccgaagagacgctaccttcttcttcttcttcgatcaccgatcatgaagaagccgatcccaaacctgatgatgatgttgctgctgctaccaccgccgaagcagaatcaccatctccaaagaaagatgatgaggaggcagaggaagagaagaaagaagaaactgctgcatctcctgcttctcctccgccaagcctcgagaatgtttcagaggagattgaccagtttctcgtgactctgaagcagaaaaatgatgaaaatgctgcggagaagatggattttgagattcctggcttttttgagaggtactcggatctggtggagaagaagatagcgaaatacgatgcgaaagggaaggcaaaatggggagaggtggcggaggaagattcgtggttgcttgaaaccgcgaatcggatttcgaagctgatcatgttgatgaaagatcatcatcatgttgaaccagaggagaaagagatcgacggtggaaatggaaatggaaaagactcgctggtgaatcgcgttacctcgattcaccagcgtgtgatgtcgtatttggaggaggacttcagatttctaatggaagaatgtagaatcccaaccgaattggatccaggaggcaataataataacaacaacgacaccaaagggaaacaacaacaacaggtgccatcatcggaacaagaagaagtgaaagatcaagaaggcgaaatcgacgaaagtttcccgggttattctgatgagaccattgccagcctgagcaagatcgccggcgagatgatatccggcggctacgaatcggagtgctgccaggtgtacatcatctcgcggaggaacgcgttcgaggaggttcacaagaagctagggctggagaggatcagcatcgacgacatggttctaaaggtgcagtgggagactctggccgggaacatgattccagcctggatcaacacgctcaagcagtgcgcggcggtgtacttccccggcgagcggaagctcgccgaggccgtgttcgccagctgcccctcggtcgcggcggggctcttcggcagcctctcccgcggcgtggtgatccagctcctcaacttcgcggagggagccgctatgacgaagcgcgccgccgagaagctcttcaagctcctcgacatgtacgagaccctccgtgagatcatccccaaggtgaacgggctattcccggaggagtctgtcgaggagctgaagacggagatgaatatcgccaagtcacgacttggcgaggcggccatctccatcttctgcgatctggagaaccagatcaaacaggagaccgcgagaaccgcggtcccgggtggcgcagtgcaccccctaacacgctacataatgaactacctcagcgtggcgggagattacaaggaaaccctagagcaagtcttcaaagaccactccaagatcgaacgtgcagactccaccagtaggccacacaacgagaacgacggcgtgccggagaagcaagcatcgtcgccgttcgcggcgcaggtgctgagagtcatggacttgctagactcaagcctagaaggcaaagctcgtttatacaaagacgtggcgcagaacaatttcttcatgatgaacaacggaaggtacattctgcagaagataaaaggatcaagcgagatgagccaggtgatgggtgacacgtggatcaggaagaaatcctctgagctgagaacataccacaagaactaccagagagaaacgtggaatagggttctggcgtgtctgaacccggaagggttgaacgtgaacgggaaggtgcagaagccggtgctgaaggagaggttcaagagcttcaactcgttgtttgatgagatacacaggacgcagagctcgtgggtggtgaaggacgagcagcttcagtcggagcttagggtttcgatctcgggagtggtggttccggcgtacagggccttcattgggaggtttgcgcagatctttgacccgggaagacagactgagaagtacataaagtaccaacctgaagatattgagacttacattgatgagttgtttgatgggaagcctcatcagtccattgctaggaggagaacataa

SEQ ID NO: 3348 - DNA, 2725 bp, Glycine max var. Williams 82
acttccagtttcagattcagattttcatttttgtcaatcattgagtcctcattcaaacatttccgcaaactataatcatttccgattcgccttttttttttcctagtaacttcctcaaacgctactcacgttcgaatctcccgccgccatggcggccgccggagcatgtctcttctccgccgcgctcttccgccgtgagccgccgtctcctgccgggaaaccgagctcccaccggatctcgagtacgactccgcgactcgccgtgtcggtggaccgagttccggcatcgacggcagcggtggagagcggagaaggaaacggtgcggtggtgagagagaagcgtatggaagagaaggaggagaaggagaatcgacgcatgaacggttggaaggagtatttggagcaatcgaaggagctgatagaaccggacggtggaccgccacgttggttttcgccgttggagtgcgcttcccgattggactattctcctcttctgctcttcttgccggggattgatggcgtgggacttggacttattttacatcatcagaaactggggaggatttttgatatgtggtgcttgcatattccagtcgctgatcggacaccgtttacagatcttctaaaaatagttgagagaacagttaggtcagaacatcaacgttcaccaaatagacccatatatcttgttggggaatctttaggagcatgccttgcactggctgttgcggcacttaaccctgatattgatcttgttctaattttggcgaacccagctacatcattcaggaggtcaagcttgcaacttctaacaccattattggaagcgttgcccaatccactctctcctggcctgcctaacattctcaggtcgacagaaggtgaatctctgaggatgctgttggataatgtggtccaaggacttcctctacaaaatacagctggagagctagtgaaggattttactgctttctcattatctctgcctgttcttgctgatatattaccaaaagaaacacttgtgtggaaactaaagatgcttaagtctgcttcggcttatgcccattcacgcctttatgctatcaaagctcagactttgattctttgcagtggaaatgatcagttactacctagtcaacaggaaggtgaaagactactgaagttactgcctaaatctaaatgccagcttcgtaaatttgatgacagtggacatttcctattcctggaagacagcattgacctggtaacaatcatcaaaggcacttcatactaccgccgtggcaagtatcatgactatgcatcagattttatacctccaacacttgatgaggccaaaaacataatagaatcaaacagtttgtttaaccttattgcaagtgctgtaatgctctcaactttggaggatgggacgcttgtaaaaggccttgctggaattccttcagaggggcctgttttgtttgttgggtaccacatgctactcggattagaaaaaattcccctggtttctcgaatttttttggaaaggaatatccttcttcgaggggtagcacatcccatgatgtttatgagatctaaaaatggaaggttaccagatttatcttcttttgacaaattcagagttatgggtgctgtccctgtagcaccaactaacctcttcaagctcttttcttctaagtctcatgtcctattatatcctggagggatgcgcgaggctcttcatagaaagggtgaagaatacaagttattctggcctgaacaatctgagtttgtaaggatggcagcaagatttggagctaaaattgtaccttttggtgcagttggagaagatgaccttggtgaagtagtttttgattatgatgacttggtgaagattccttactttaggtcggaaatagaaagcctcacaaatgaggctacgcagttgaggagtgatgctggtggtgaggtggcaaatcagccagtgcatatgccgttgattttgcctaaagttcctggtcggttctactattattttggaaaaccattggaaatggaagggaggaaacaagaactgagagacaggaagaaagctcatgagatttatttacaagtgaaatctgaggtagagagatgtattgcttatttaaaggtgaaaagagaaagcgacccctacagaggtatagggcctcgactattataccaggctacacatggttttgagtcagaagttccaacatttgaaatttgattgttttgcacaaaaaataaggcaattttctaattggttctgaggcttgttttgcattccctaggttagaggcaaactatgaatattgccagtagtttcaggattgttttcgggccgaaaaggcatgatttcttaatagaaacattgtacaattttaccaagtttaaatcaataagagataaaatacaaataatagattattggggaaggagaacaactaccgaagttctatttaaaagagattttctattttgtgtgcatgacacatgataaaaaattcttgggtgtatcaaattccactcggtgcaactgaaaaaattaaaatttgacagaggtctacgattgaaagtttttggtagcatatttgttcttgtataccttcgtatggtgtccatgggaatgtcacttgtacttgtaaaatagacaaatattatagtattaaaggttccctccatcttctctccagcagcatcctagaccattggaatcacaaaagtt

SEQ ID NO: 3349 - DNA, 2602 bp, Glycine max var. Williams 82
ctggtgacgaacaaagtacgcaacagagacaccggacacacccatggaagaatcgttgctcttcctcaaacctcgtgtctgatttttccacaattactaacttcctcaaacgctactcacgttcgaatctcccgccgccatggcggccgccggagcatgtctcttctccgccgcgctcttccgccgtgagccgccgtctcctgccgggaaaccgagctcccaccggatctcgagtacgactccgcgactcgccgtgtcggtggaccgagttccggcatcgacggcagcggtggagagcggagaaggaaacggtgcggtggtgagagagaagcgtatggaagagaaggaggagaaggagaatcgacgcatgaacggttggaaggagtatttggagcaatcgaaggagctgatagaaccggacggtggaccgccacgttggttttcgccgttggagtgcgcttcccgattggactattctcctcttctgctcttcttgccggggattgatggcgtgggacttggacttattttacatcatcagaaactggggaggatttttgatatgtggtgcttgcatattccagtcgctgatcggacaccgtttacagatcttctaaaaatagttgagagaacagttaggtcagaacatcaacgttcaccaaatagacccatatatcttgttggggaatctttaggagcatgccttgcactggctgttgcggcacttaaccctgatattgatcttgttctaattttggcgaacccagctacatcattcaggaggtcaagcttgcaacttctaacaccattattggaagcgttgcccaatccactctctcctggcctgcctaacattctcaggtcgacagaaggtgaatctctgaggatgctgttggataatgtggtccaaggacttcctctacaaaatacagctggagagctagtgaaggattttactgctttctcattatctctgcctgttcttgctgatatattaccaaaagaaacacttgtgtggaaactaaagatgcttaagtctgcttcggcttatgcccattcacgcctttatgctatcaaagctcagactttgattctttgcagtggaaatgatcagttactacctagtcaacaggaaggtgaaagactactgaagttactgcctaaatctaaatgccagcttcgtaaatttgatgacagtggacatttcctattcctggaagacagcattgacctggtaacaatcatcaaaggcacttcatactaccgccgtggcaagtatcatgactatgcatcagattttatacctccaacacttgatgaggccaaaaacataatagaatcaaacagtttgtttaaccttattgcaagtgctgtaatgctctcaactttggaggatgggacgcttgtaaaaggccttgctggaattccttcagaggggcctgttttgtttgttgggtaccacatgctactcggattagaaaaaattcccctggtttctcgaatttttttggaaaggaatatccttcttcgaggggtagcacatcccatgatgtttatgagatctaaaaatggaaggttaccagatttatcttcttttgacaaattcagagttatgggtgctgtccctgtagcaccaactaacctcttcaagctcttttcttctaagtctcatgtcctattatatcctggagggatgcgcgaggctcttcatagaaaggtagtttttgattatgatgacttggtgaagattccttactttaggtcggaaatagaaagcctcacaaatgaggctacgcagttgaggagtgatgctggtggtgaggtggcaaatcagccagtgcatatgccgttgattttgcctaaagttcctggtcggttctactattattttggaaaaccattggaaatggaagggaggaaacaagaactgagagacaggaagaaagctcatgagatttatttacaagtgaaatctgaggtagagagatgtattgcttatttaaaggtgaaaagagaaagcgacccctacagaggtatagggcctcgactattataccaggctacacatggttttgagtcagaagttccaacatttgaaatttgattgttttgcacaaaaaataaggcaattttctaattggttctgaggcttgttttgcattccctaggttagaggcaaactatgaatattgccagtagtttcaggattgttttcgggccgaaaaggcatgatttcttaatagaaacattgtacaattttaccaagtttaaatcaataagagataaaatacaaataatagattattggggaaggagaacaactaccgaagttctatttaaaagagattttctattttgtgtgcatgacacatgataaaaaattcttgggtgtatcaaattccactcggtgcaactgaaaaaattaaaatttgacagaggtctacgattgaaagtttttggtagcatatttgttcttgtataccttcgtatggtgtccatgggaatgtcacttgtacttgtaaaatagacaaatattatagtattaaaggttccctccatcttctctccagcagcatcctagaccattggaatcacaaaagtt

SEQ ID NO: 3350 - DNA, 2684 bp, Glycine max var. Williams 82
ctggtgacgaacaaagtacgcaacagagacaccggacacacccatggaagaatcgttgctcttcctcaaacctcgtgtctgatttttccacaattactaacttcctcaaacgctactcacgttcgaatctcccgccgccatggcggccgccggagcatgtctcttctccgccgcgctcttccgccgtgagccgccgtctcctgccgggaaaccgagctcccaccggatctcgagtacgactccgcgactcgccgtgtcggtggaccgagttccggcatcgacggcagcggtggagagcggagaaggaaacggtgcggtggtgagagagaagcgtatggaagagaaggaggagaaggagaatcgacgcatgaacggttggaaggagtatttggagcaatcgaaggagctgatagaaccggacggtggaccgccacgttggttttcgccgttggagtgcgcttcccgattggactattctcctcttctgctcttcttgccggggattgatggcgtgggacttggacttattttacatcatcagaaactggggagtcgctgatcggacaccgtttacagatcttctaaaaatagttgagagaacagttaggtcagaacatcaacgttcaccaaatagacccatatatcttgttggggaatctttaggagcatgccttgcactggctgttgcggcacttaaccctgatattgatcttgttctaattttggcgaacccagctacatcattcaggaggtcaagcttgcaacttctaacaccattattggaagcgttgcccaatccactctctcctggcctgcctaacattctcaggtcgacagaaggtgaatctctgaggatgctgttggataatgtggtccaaggacttcctctacaaaatacagctggagagctagtgaaggattttactgctttctcattatctctgcctgttcttgctgatatattaccaaaagaaacacttgtgtggaaactaaagatgcttaagtctgcttcggcttatgcccattcacgcctttatgctatcaaagctcagactttgattctttgcagtggaaatgatcagttactacctagtcaacaggaaggtgaaagactactgaagttactgcctaaatctaaatgccagcttcgtaaatttgatgacagtggacatttcctattcctggaagacagcattgacctggtaacaatcatcaaaggcacttcatactaccgccgtggcaagtatcatgactatgcatcagattttatacctccaacacttgatgaggccaaaaacataatagaatcaaacagtttgtttaaccttattgcaagtgctgtaatgctctcaactttggaggatgggacgcttgtaaaaggccttgctggaattccttcagaggggcctgttttgtttgttgggtaccacatgctactcggattagaaaaaattcccctggtttctcgaatttttttggaaaggaatatccttcttcgaggggtagcacatcccatgatgtttatgagatctaaaaatggaaggttaccagatttatcttcttttgacaaattcagagttatgggtgctgtccctgtagcaccaactaacctcttcaagctcttttcttctaagtctcatgtcctattatatcctggagggatgcgcgaggctcttcatagaaagggtgaagaatacaagttattctggcctgaacaatctgagtttgtaaggatggcagcaagatttggagctaaaattgtaccttttggtgcagttggagaagatgaccttggtgaagtagtttttgattatgatgacttggtgaagattccttactttaggtcggaaatagaaagcctcacaaatgaggctacgcagttgaggagtgatgctggtggtgaggtggcaaatcagccagtgcatatgccgttgattttgcctaaagttcctggtcggttctactattattttggaaaaccattggaaatggaagggaggaaacaagaactgagagacaggaagaaagctcatgagatttatttacaagtgaaatctgaggtagagagatgtattgcttatttaaaggtgaaaagagaaagcgacccctacagaggtatagggcctcgactattataccaggctacacatggttttgagtcagaagttccaacatttgaaatttgattgttttgcacaaaaaataaggcaattttctaattggttctgaggcttgttttgcattccctaggttagaggcaaactatgaatattgccagtagtttcaggattgttttcgggccgaaaaggcatgatttcttaatagaaacattgtacaattttaccaagtttaaatcaataagagataaaatacaaataatagattattggggaaggagaacaactaccgaagttctatttaaaagagattttctattttgtgtgcatgacacatgataaaaaattcttgggtgtatcaaattccactcggtgcaactgaaaaaattaaaatttgacagaggtctacgattgaaagtttttggtagcatatttgttcttgtataccttcgtatggtgtccatgggaatgtcacttgtacttgtaaaatagacaaatattatagtattaaaggttccctccatcttctctccagcagcatcctagaccattggaatcacaaaagtt

SEQ ID NO: 3351 - DNA, 2716 bp, Glycine max var. Williams 82
ctggtgacgaacaaagtacgcaacagagacaccggacacacccatggaagaatcgttgctcttcctcaaacctcgtgtctgatttttccacaattactaacttcctcaaacgctactcacgttcgaatctcccgccgccatggcggccgccggagcatgtctcttctccgccgcgctcttccgccgtgagccgccgtctcctgccgggaaaccgagctcccaccggatctcgagtacgactccgcgactcgccgtgtcggtggaccgagttccggcatcgacggcagcggtggagagcggagaaggaaacggtgcggtggtgagagagaagcgtatggaagagaaggaggagaaggagaatcgacgcatgaacggttggaaggagtatttggagcaatcgaaggagctgatagaaccggacggtggaccgccacgttggttttcgccgttggagtgcgcttcccgattggactattctcctcttctgctcttcttgccggggattgatggcgtgggacttggacttattttacatcatcagaaactggggaggatttttgatatgtggtgcttgcatattccagtcgctgatcggacaccgtttacagatcttctaaaaatagttgagagaacagttaggtcagaacatcaacgttcaccaaatagacccatatatcttgttggggaatctttaggagcatgccttgcactggctgttgcggcacttaaccctgatattgatcttgttctaattttggcgaacccagctacatcattcaggaggtcaagcttgcaacttctaacaccattattggaagcgttgcccaatccactctctcctggcctgcctaacattctcaggtcgacagaaggtgaatctctgaggatgctgttggataatgtggtccaaggacttcctctacaaaatacagctggagagctagtgaaggattttactgctttctcattatctctgcctgttcttgctgatatattaccaaaagaaacacttgtgtggaaactaaagatgcttaagtctgcttcggcttatgcccattcacgcctttatgctatcaaagctcagactttgattctttgcagtggaaatgatcagttactacctagtcaacaggaaggtgaaagactactgaagttactgcctaaatctaaatgccagcttcgtaaatttgatgacagtggacatttcctattcctggaagacagcattgacctggtaacaatcatcaaaggcacttcatactaccgccgtggcaagtatcatgactatgcatcagattttatacctccaacacttgatgaggccaaaaacataatagaatcaaacagtttgtttaaccttattgcaagtgctgtaatgctctcaactttggaggatgggacgcttgtaaaaggccttgctggaattccttcagaggggcctgttttgtttgttgggtaccacatgctactcggattagaaaaaattcccctggtttctcgaatttttttggaaaggaatatccttcttcgaggggtagcacatcccatgatgtttatgagatctaaaaatggaaggttaccagatttatcttcttttgacaaattcagagttatgggtgctgtccctgtagcaccaactaacctcttcaagctcttttcttctaagtctcatgtcctattatatcctggagggatgcgcgaggctcttcatagaaagggtgaagaatacaagttattctggcctgaacaatctgagtttgtaaggatggcagcaagatttggagctaaaattgtaccttttggtgcagttggagaagatgaccttggtgaagtagtttttgattatgatgacttggtgaagattccttactttaggtcggaaatagaaagcctcacaaatgaggctacgcagttgaggagtgatgctggtggtgaggtggcaaatcagccagtgcatatgccgttgattttgcctaaagttcctggtcggttctactattattttggaaaaccattggaaatggaagggaggaaacaagaactgagagacaggaagaaagctcatgagatttatttacaagtgaaatctgaggtagagagatgtattgcttatttaaaggtgaaaagagaaagcgacccctacagaggtatagggcctcgactattataccaggctacacatggttttgagtcagaagttccaacatttgaaatttgattgttttgcacaaaaaataaggcaattttctaattggttctgaggcttgttttgcattccctaggttagaggcaaactatgaatattgccagtagtttcaggattgttttcgggccgaaaaggcatgatttcttaatagaaacattgtacaattttaccaagtttaaatcaataagagataaaatacaaataatagattattggggaaggagaacaactaccgaagttctatttaaaagagattttctattttgtgtgcatgacacatgataaaaaattcttgggtgtatcaaattccactcggtgcaactgaaaaaattaaaatttgacagaggtctacgattgaaagtttttggtagcatatttgttcttgtataccttcgtatggtgtccatgggaatgtcacttgtacttgtaaaatagacaaatattatagtattaaaggttccctccatcttctctccagcagcatcctagaccattggaatcacaaaagtt

SEQ ID NO: 3352 - DNA, 852 bp, Glycine max var. Williams 82
atgaataccaacaacgacaccgaaaaaaaccaatcatttccagaagcacaaggagcatcatcatcatcatcttctccacccaatgttgggactgagaattggggaactcacataatgggcacccctgctgttccaagcagccacccagataacaaaaaagcagctttacaaagtggacaacctcaaccagttcaatactaccatgaccaacatcaacatccctacgtgcaacatagcccagttgacaaaccaagcaacagtcccatggagtcaatccttaacatgttcgattcatggagcaaaaaagctgaagccaccgcacacaacgtctggcacaaccttaaaactggtccatcagtgtcttcagctgcactggggaagatgaatctgactgtgaaagcaatatcagagggtggatttgagtccctttacaagcaaacattcacaacctatccaaacgagaagctcaagaagagctttgcttgttacctttcaacatcaacaggtcctgttgcaggaaccctttacctgtccaatattcatgtagcgttttgcagcgatcgccctttgtgtttcactgcaccctctggccaagaaacttggacatactacaaggtaatggtgcctttgggaaaggttggagtggtcaacccagtgaccatgagggaaaacccatcagaaaagtacattcaggttgtaacggtggaagggcatgatttttggttcatgggttttgttaattttgacaaagcagttaagaacatctcagaaggtatctcacattttgtagcgccaggagtggccgtgccatccactagtggttcggaagctaatcgaaagaactttcagtga

SEQ ID NO: 3353 - DNA, 351 bp, Glycine max var. Williams 82
atggctgctactatgatcaagttattattttaccttgccattttggttatcttgcttaccaattcaaagggtgtgagttcaagttcaactagtgagcctacaatttcagcttctcctggtgttttgccttatgtgactgccccagatatttcctcatttttccccactccaagagccaatcaaccaatgagttctggtgctccttttgaggccgaggcaccagcaccggcacccagttcaggagagtttgagggcaagaagtcttctgcttcagctaggttgaattgtgcaggtgccattgttggtgttctactatgttgtgccttcttaagtagcatagttgttgtttga

SEQ ID NO: 3354 - DNA, 1653 bp, Glycine max var. Williams 82
atggatcatgagataaaagagccaccacctctctcatccacactctgttctcaaccctctcaattcagtcaaaacactcaagaaacttatccccgttacttccaacaagacttgaacgaaagaaagaaaaaaggcacgtgcatcacgtgcggccagaaggatcactggtaccgggagtgtcccttcaaatcctctaataacgattcccaaaatgccaacagcatatggtgccgctgtggccatggccgttgcgaaaagagaacctcaaagagtgagaaaaaccccggcaggatgtactacgtttgccccatcaaaaggggggaaaaatgtactaacggttttgttaaatggtgcgatgatcccgatgtcgagagtgattggtcgcagcctccgccgtttaagtatcctgagtgtaagtgtcctgctggagtgtgtaaaagggagaaggcaacacataatggcgttgttaaatactattttacttgccccgttaaagagggccatggaaattgcggttacaaggtatgggaggatgagctgctacatataagaactaatgatcaagatgaccatgacttcgatgagggtgttaatttggcagtaaatcattccaaaaagatgagaatcatggacagttccgaggaggatccaacaccaatggctgtatccgaggctgagctttcacagagtgaagatgaagcactcgagaaagcatcgcagctatcttgcctatcagaatcaacaccttcaaggatcggtggggatcgacagcatgtgtttccaaggcacatttttgctggtgctggtgctggcgctggcgctgatccatcatttggtcggttaggtcgccttctcttcagtccaccacaaagcttgaaatccccctcatctcagacacctcagtcaattttctgctgtgttttcccatcctttaatcccatagatgtcccaaaacaaccaagtattactaatgttccttgtgctgaacataaccagcttgatgttattcgtctcagccaacaaagccaactttcaagcagtgaaagaaaactaatgtcaagggcacaaaggcaaagacaattggcctttgctgcacaaaagcagctcctcaatgatctagaaacctcgaagcctcacgagcatgagtccatgaaagaggcagcacaagacacttttgctatattagacaacttgggtgcaaatgacacacaattctttgagcatgttttgtatttcataaaactcacatcatcggttgtacaaatgactaaatccatcgaatgtcttgaggaggacaacaagcgtcttgaggacgagaatgccaaactcgcccacattcgtgacctctacgccaagaccgaagatcagttccaagcctctgatcaacgaaggcaattactttccaaagagatctctgactttgaggccatgcttgttgagaaacgaaaccaattgaagtcgtgtgaattggaaacttcaaacatgcgaatcgaacttggtggtttgagaagaactatgttggaagctgatacagccttgaaggctagaatgaagcaagcagagattgcaggtaaacttaggaaagagagagaagccaaacaaattgcagccaaaacagcactcgagaaggccaggcttaaatcagagtattaa

SEQ ID NO: 3355 - DNA, 1212 bp, Glycine max var. Williams 82
atggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcaccttctcaaatacgattccatcctcggaaccttcgatgctgatgtcaagcctgttggcagcaatgtcatctccgtggatggaaaggaaatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtggtggacctcgtcgttcaggtctcaaagaagacctttgcagaagaagtgaatgcagcattcagagagagtgcagacaatgagctcaagggaatcctctctgtgtgtgatgagccacttgtgtccgttgacttcaggtgcactgatgtgtcctcaaccgttgactcctcgttgaccatggtcatgggagatgacatggtgaaggtcattgcttggtatgacaatgaatggggctactcccaaagggttgtggatttggctgacattgttgccaacaaatggaagtga

SEQ ID NO: 3356 - DNA, 1425 bp, Glycine max var. Williams 82
atgaaggtggcatgttgcaccccagacattaatgttccctacttggaaaccccaagaacaaggtttgggtctgaggaagcccttgtcttgcttaaaaaatgtagcaatttcaagcagctcaagcaagtccatggcaaaataatccgttatggtctcacctatgatcaattgcttgtgaggaagctaattcagctctctccctcttatggcaaaatgaaatatgccactttggtatttgatcaactcaatgccccagatgtcttcacgtggaatgtcatgattagagcttataccattggcggttctcctaaaatggcctttcttttgttcaaggccatgctataccagggctttgcccctgacaagtttacatacccttgtgtgatcaatgcttgcatggcctataatgcccttgatgttggaagagtggcccatgctttggccatcaagatgggattttggggtgacctctatgtgcagaacaccatgatgaatctctacttcaagtgtgagaatgtggatgatggatggaacgtgttcgataaaatgtgtgtgcgcaatgtattcgcgtggaccaccgtcattgctggatttgttgcctgtgggaaattggacactgccagggaactatttgagcagatgccttccaagaatgttgtttcatggactgcaattattgatgggtatgtgaaacacaagcagcccattgaagcctttgatttgtttgaaagaatgcaggctgataatgtgagaccaaatgagtacactttggtgagcttggtcagagcatgtaccgagatgggtagcctcaagttgggtagaagggttcatgattttgctctcaagaatggttttgagcttgagccattcttgggtaccgcgcttatagacatgtacagcaagtgtggcaatttagatgatgcaaggacagtgtttgatatgatgcagatgagaaccctggctacttggaataccatgatcactagcttgggtgtgcatgggtatagagatgaagccttatccatttttgaagaaatggagaaagcaaatgaggttccagatgctatcacttttgttggtgtgctgagtgcttgcgtttatatgaatgacctggaactagctcagaagtatttcaatcttatgacggatcattatggtataacacctatcttggagcactatacatgcatggttgaaatccatactcgtgctattaagttggatgagatttacatgtcagggaacacaatggaagctaatcatgatgttgcagaattactccacaagaacaaactcactagtttcgacgacattaaaaaacttatacacaagaaatacggggatttggatttctcagaactagttttagaccattcctccacgagctcaagtgggatgcagattgatatcagcaaaataagatga

SEQ ID NO: 3357 - DNA, 1293 bp, Glycine max var. Williams 82
atggagcagaagggaagtgtgcttatgcaaagatatgaacttgggagattattaggccaaggaacctttgctaacgtctaccatgctaggaaccttataactggcatgagtgtggccattaagattaagcgtgaaatttcagtgatgagattaatcagacatccacatgtggttgagctttatgaggtaatggccagtaaaaccaaaatttactttgtcatggagcatgcaaaaggtggtgagctcttcaacaaggtagtcaaaggaaggctcaaggtggatgttgcttggaaatattttcagcaactgattagtgcagttgactactgccatagcaggggtgtgtgtcatcgagatttaaaacccgaaaatctactattggatgaaaatgagaatttgaaggtttctgactttgggttgagtgcacttgctgaatctaagtgccaagatggattgctccatactacatgtgatacccctgcctatgttgctccggaagtgataaacagaaagggctatgatgggattaaagctgatatatatggtcatgatacaaatctgatggagatgtacaggaagattggtagaggggaattcaaatttcctaaatggtttgcactggatgttcgctggtttttgtccagaatattggatccaaacccaaaggccaggatatcaatggccaagattatggaaagttcttggtttaaaaaggggttggagaagcctgctattactgtaaccgaaaacgaagagctagctcccctggatgctgatggaatatttgaagcgtgtgagaatgatggtcctattgccgagcctaagcaagaacaggccaagccttgcaacttaaatgcttttgatattatctccttctcaactggttttgatttatctggtttgttcgaggacacttttctcaagaaagagacacggtttatgtcaaagaagcctgcctcaatcatagtcttgaagttggaagaaatttgtaagcagctttgcttgaaagtaaagaagaaagatcgaggcttgctcaaattggaagtttccaaggaaggcaggaaaggaactttgggtgttgatgctgagatttttgagattaccccacacttccatatggtggaacttagaaagtccaatggtgacaccatggagtaccagaagctttttaaacaggacataagaccagcgcttaaggacattgtttggacctggcaaggagaaaaaccacagcaagagcaacagcaacatgaagtagtccaggaagagcaccaaccttctcatactgcttag

SEQ ID NO: 3358 - DNA, 180 bp, Glycine max var. Williams 82
atggaggcatcaaagatgaagtttttcttggttttggtggtttccgtgttggcgatggcagcaactggggtttcagctgctgaggcacctgccccaggtccttcatccgatgccaccaccctctttgtgcccactgcttttgcttctctctttgttcttgcatttggctttctcttctaa

SEQ ID NO: 3359 - DNA, 846 bp, Glycine max var. Williams 82
atggaggcaagtttggtggagaggggtagagagagagctggacatgttaacaaggttggttatgttagaagggtcattgcaaagaagaagaaacagctttatcgaagggttaggagacctgagttgagtgtttcaaagacacttcaccaattatttgattcatgcagagaagctttcaaaggccctgggactgttccttcaccacaagatgttaagagattgactcacatacttgataacatgaagccagaagatgtggggctaagtagagatctgcagttcttcaagcctggaaatattgtcaaagagaaccaaagggtcacttatacaaccgtgtacaagtgtgacaatttctcactctgcatctttttcatacctgaaggaggagtcattcctctccacaaccacccggacatgactgttttcagcaagcttttattaggactaatgcacattaagtcctatgattgggttgagcctgaggcctctgatgataacatgttgcaaccacaatctcaattgagattggcaaggttaaaagttgataaggtgttcacatcttcatgtggcacttctgtcctgtatccaacaacaggaggcaacatccatgaattcacagccataaccccatgtgctgtgcttgatgtcattggccctccttattccaaagaagatggaagggactgttcctactacagagatcacccttatacttgttttcctaacgaaaggattattggtgaggcaaaagaggaaaatgatagttacacgtggctggaagaaattgagatgccagagaactctgaaatgaatggcgttgagtacctgggtccaacaccctcttag

SEQ ID NO: 3360 - DNA, 417 bp, Glycine max var. Williams 82
atgtcaatggcactctctcagctaagccagtctctggaaaatgaactgaaaggtgctgaagactccgaattccctgtgaaggaaattggaaatgaaggtctcacaaaacggattctcagaaaaggagtcacttggcaaagtccattctctggagatgaagtggaagttcatttcagaggacaagttgaaaacggagcagctcttgaatcgagttatgataaagggtcccggtttcgtttcaaattaggccaatttatcaaaggttgggatgaaggagttgccaccatgaagaaaggggagagtgcaatcttcaaaataccacctaacttggcatatggggaagaagggtcccctccattgattcctcctaatgctactctcattttgacattgaaatggtgtcttggagtaccataa

SEQ ID NO: 3361 - DNA, 783 bp, Glycine max var. Williams 82
atgtcaacctttgcattcacttctttattccaaatcacagtctcatcttcatcttcatctttgcatgctatcagagcctcagcttctgagtatgttccctcccaacacacccttagaagggaattcttgaagggtgttgctgctttgatgcctcttccacttgttgtgctgatagagccacccccttcagatgctagagaagttgaggttggctccttccttccaccttcaccctctgacccttctttcgttctcttcaaggcctctgccaaggacactccagcccttcgtgcaggaaatgtgcagccatacaagtttatcctccccccgacgtggaaacaggctcgtgtagcaaatatactatctggaaattactgccagcctaaatgtgcagagccctgggtggaggttaagtttgaagatgaaaaacaaggaaaagttcaggtagtggcttcgcccttgatacgccttaccaacaaaccaaatgcaacaattgaggacattgggagcccagaaaaactgattgcttctcttggaccatttgtcactggaaacacttttgatccagaagagctccttgagacttcagttgaaaagcttggtgatcagacatactacaaatacgtgctcgaaacaccatatgctctcacaggcacacacaatcttgcaaaagcaacagcaaagggaaacactgttgttttgtttgtggttagtgccaatgacaagcagtggcaaacttctgaggagactctaaaagccgtgcttaattcctttgaagtttag

SEQ ID NO: 3362 - DNA, 1353 bp, Glycine max var. Williams 82
atgagggagatccttcacgtgcagggagggcaatgcgggaaccagatcggttccaagttctgggaagtggtgtgcgacgagcacggcatagatccgacggggaagtacgtcggaaactcagatctgcaactcgagcgcgtgaacgtctactacaatgaagcctcgtgcgggcgcttcgtgccacgcgcggtgctgatggacctggagcccggaaccatggacagcgtgcggaccgggccgtacgggcagatcttccgccccgacaacttcgtgttcgggcagtccggcgccggcaacaactgggctaaggggcactacaccgagggcgccgagctcatcgactccgtcctcgacgtcgtgcgtaaggaggccgagaactgcgactgcctccaggggttccaggtctgccactcgctcggcggcggaacgggctccgggatggggacgcttcttatttccaagatcagagaggagtatcctgacaggatgatgcttactttctccgtttttccttcgcccaaggtctccgacactgttgttgagccttataacgctactctctctgttcaccagttggtggagaatgctgatgagtgtatggtgctggataatgaggcgctctacgatatctgcttcaggactctcaagttgaccactcctagctttggtgacttgaatcacttgatctccgcaaccatgagtggtgttacatgctgtcttcgtttccctggtcaactcaactctgatctgaggaaactggccgtgaatctcatccctttccctcgtctgcacttcttcatggttggatttgcgcctctcacctctcgtggctctcagcagtaccgtgcattgacagttccagagctgacacagcaaatgtgggatgccaagaatatgatgtgtgccgctgatcccaggcacgggcgttacctcacggcatcagccatgttccgtggcaagatgagcacgaaggaggtggatgagcagatgataaacgtgcagaacaaaaactcttcgtactttgtcgagtggattcccaacaatgtcaagtcgagtgtgtgtgacattgctcctagagggctctccatggcgtccacattcattggaaactcgacctcgattcaggagatgttcaggagggtgagcgagcagttcacggccatgtttaggaggaaggctttcttgcattggtacactggtgaaggcatggacgagatggagttcacggaggcagagagcaacatgaatgaccttgtgtctgagtaccagcagtaccaggacgccactgctgaggacgaaggggagtacgaggatgaggaggaagaggatggtgaagcagacgaccatatgtga

SEQ ID NO: 3363 - DNA, 1275 bp, Glycine max var. Williams 82
atgggttgctcagcctcaagaaccatcaccatagtggccaacaacaataaccaattagaggatccatcttctgcttctcttgcttcttctttctcttcctcttctgcctcacacaaatccattaactctacttcttcaccagcagcagcaccagttagaagaagagctctttctctcccaatgcctcttgttcatcaccctcccataaaaaagggtgacacacaccaccttgtctccctcacctccaccacctatggctcccttctcctcattgaccaaaaagacccaaacttgacccaaaaaaaccaaccccgcctcaccaaaacctcaaaccaaactgacccagcacactcactctccccagactcagtcatcaacacttgggaactcatggatggcttagatgaagaagaagaagaagaagaagaagaaattgccaatgccaagaagaagcctccttacacttccattttggacaaaccaagttcatgcaggtacacagcatttgatggttctgcaaggaagaaactgcttgattcctttgaatcactgaaaacttcacagacagcaatggaaaaggaaaactcttcttcttctccagcaccaaccaagaagccactttggcagcacttatccgaggaagctttgcttgctaagttggatccgagtgtggcttggagttacagaagagcattatcatcaaggaatctaggtagaaacaccttatctagagatgtaaggtcaatggggtctagccctttgatatttcattcttcttctttttcatttggtaagaacaatagtttgtgccgtttgtctggcactgaggacagaatagtgctttattgcactagtttgagagggatccgaaagacctatgaggattgttgttcggttaggatgattctgaggggcttcagggttgcggttgatgagagggacatctcaatggactcgtcctataggaaggagttgaaggatgctcttggtggaaaagcagtgacattgccacaggtctttatcagagggaggtatgtggggaatgctgagcaaatgaagcatctgaatgagtctggagaattggcaaggcttttggagggtttccccactcaggatcctgggtttgtgtgtgacaactgtggtgatgccaggtttgtgccatgccccaattgcaatggtagcaggaaggtgtttgagcatgaggaaggagggttgagaaggtgccctgattgcaatgagaatggcttgataagatgtccaggttgctgcccatga

SEQ ID NO: 3364 - DNA, 2523 bp, Glycine max var. Williams 82
atggatcatattagtaatgaggctagtattgaccgttttccaattggtccttctgacattcttggtaggacaattgctttcagggttcttttttgcaagtctatctcacattttaggcaccacatatttctagtgttgttagatctcttctatagatttaggggggggttggcatcctttatatcatggttgcatcccaggaaccctcaggggatattggcaatgatgacaattgttgctttcttgttgaaacgatacacaaatgtgaaagcaagggctgaaatggcatataggaggaagttttggagaaacatgatgagaagtgctttgacctatgatgaatgggctcatgcagctaagatgcttgataaagagacaacaaagatgaatgaatcagacctttatgatgtggaattggtgaggaacaagcttcaagagctccgccaccgtcggcaagagggatctcttagagatataatgttttgtatgcgtgccgatcttattagaaatttaggtaatatgtgtaaccctgaactgcacaagggtaggcttcaggtgcctaaattaatcaaggagtacattgatgaagtaacgactcaattgagaatggtctgtgattctgattcagaggagctatcattggaagaaaagcttgctttcatgcatgaaacaaggcatgcatttgggaggacagctttgctgttaagcgggggtgcctctcttggagcttctcatgtgggtgtagttaaaacaatggtagaacataaactcatgcctaggataattgctggttcaagtgtgggatccattatgtgtgctgttgttgccactaggacttggcctgagctccagagcttttttgaggattcatggcactcgttgcaattttttgatcaaatgggtgggatttttgcagttgttaagagagtcacaacattgggtgctgttcatgagatcagacagttgcaaatgatgttgaggcatctaacaagcaatcttacatttcaagaagcttatgacatgacaggtagaattcttgggattacagtttgttccccaaggaagcacgaaccacctagatgtcttaactacttgacttcaccccatgtggttatatggagtgcagtcaccgcttcttgtgccttccctggcctttttgaggctcaagaattgatggcaaaggatagaagtggagagattattccttaccaccctccttttaacttaggtcctgaagagggctccacaccagcacgccgttggagggatggtagcttggagattgatttacctatgatgcagttgaaagaactattcaatgtcaatcattttatagttagtcaggccaaccctcatattgcaccattattgagattgaaagaatttgtgcgcacttatgggggcaacttcgctgccaagcttgctcatcttgtggagatggaggtgaaacataggtgtaatcaaatactggaacttggttttccattaggtggacttgctaagttgtttgctcaagactgggaaggtgatgtgactgttgttattcccgcaactcttgctcagtacaccaaaattatacagaacccttcttatggagagcttcaaaaggcaaccaaccaagggagaagatgtacctgggagaaactttcagccataaaagcaaattgtggcattgagcttgctcttgatgagtgtgtggtgattctcaatcatatgagaagactaaagaggattgctgagagagctgcttctgcttctcaaggtttgtccagcactgtaaggttcagtgcttcaaaaagaattccttcatggaattgcattgcacgagagaattcaactggttcccttgaggaccttactgatgttgctgcctcaaagcatcaaggcattagcagttcctgtggaaccaatggcaaaacttggaagacctaccgtggcatacttgatggaagtgacagtgactctgaaagtgttgatttgcattcttggacaagatctggtgggcctttgatgagaactacttcagcaaatatgtttgtcgattttcttcaaaacttagacgttgataccgatcaaaacaataaaggcttagtgagtcgtgctaaccctaatgattttcagtatcgtagccccaggctcgcaacactggataggaactctgatagcacagaatctgagccaagggaaattggcaacagggttttcaatgtgtccagcatacttgtgaccgaaggtgatcttttgcagcctgaaaggatccataatgggattgtgtttaatgttgtcaagaaagaagacttgtcacccttaagtggtagcagtcatgattttgaaaattacaacattgaagttgctgaatgtgtccaagatgagtgtccagggaaggagatagatgctgctagctcagcttctgaacatggagatgatgaagaatccacagtagctaggtccttaactgaaactcaagactacaattccatggatcatcattcgggtatggatcagagcattgttgacagttag

SEQ ID NO: 3365 - DNA, 1751 bp, Glycine max var. Williams 82
acttcaaaggaaacgcttcgaaggcgtgtgacaagaaacctcagagagcgtttcctctgtctggggtccattcacaatttcacatttcattcatattcattacttcatggtccttcaacaagctccttaatttcattctctccttccaccttttcctcacgcatcaccgtttcttttgtttctgtcttagtgtgccgtgtcccaatacatacataatagaacaacaaacacacacacataactctctctctctgctgaggtaattactgaaatccgtgcctgcttccacccttttgccgaagtttgcaaatttttctcttatattgtgtctctgctctgcttgcaaccaaagctttccaatttcctctactgggtctttctcttttgcctctgggaaatggctaattggagaaaacaacaaggtgagagtcatcatcaagtgggtcagtggcgatcctcctacaacagaaagccaccgttgggttggtgaaggtgaagcctagggtaaactaaatttcctatgatagtctctttttcacaggagataagtggcattcaacagtgcctgcctgggaaaggaaattctgcacttcaattggctcagttccatggcgaaagctagtagaaagcaagaagtacatgcacctgtttgaacatgtggtaaattgggatgactctgccggcaaagaggcatttgacaatgcaaaaatgaggtattgggctgagatcaacggtgttccctgcaacatatcattgcctgatcccaacatttacaccgatgaagtagattggaatgcaattgttgaccctcaacttattctggatatggaaatggaattagcaaaggtccccaatgaggaactaaggaatgatcacgagattgtgatgattggtggcgctctcttcctgaacgagcaacagcttccgtgtaccggatgggacgacgattatgctgccgaagcaccaaatccaaattctgctgtccaaggctgggcagcaaatctgcaagcaaataatggagtagaatctgggcaacagaatcatgctcctgccgaacatgtagaagaacattttgctcctgccgaacctgcaaaagaagattttgctcctgctgaacatgctaaaggatatgaatggcaagattggaggaatgattcttggggttggaatcaaagggagaacaatggtggtggtggtgacttgcacaaaatgggaagagggagaaatggtcgagggtatggtaattggggaacatgggatggctataacagaaggagggaaaacatgtcatggtctaagacccctactaatggtaataatgagtatcatgtgaataataggggaagaagaaactatagagaaggaggaggaagaaggggcaattttgtttatgtgcctaaggaggtgcctcctactcctactcctgctggatggtaagtgagtgcaaaggcgaagtgtcaaagaccttaggctgagactgcaacaaggggaccccaatgaaactgctgaggtggctgaagatatataaattttggtatcttggtaaaacatgtaagatatggtagtatataagaagacaaagacagcatcctatattctaatacatttctatgaaaggtttatggtatattttggagtttatagtttaagaatagtagtacctgccgtgttgataggtttatgtatatgcagagaaaatatgcatagacaattttaaatgaagctaaatagtgcattcttgtctccttgat

SEQ ID NO: 3366 - DNA, 1599 bp, Glycine max var. Williams 82
acttcaaaggaaacgcttcgaaggcgtgtgacaagaaacctcagagagcgtttcctctgtctggggtccattcacaatttcacatttcattcatattcattacttcatggtccttcaacaagctccttaatttcattctctccttccaccttttcctcacgcatcaccgtttcttttgtttctgtcttagtgtgccgtgtcccaatacatacataatagaacaacaaacacacacacataactctctctctctgctgagctttccaatttcctctactgggtctttctcttttgcctctgggaaatggctaattggagaaaacaacaaggtgagagtcatcatcaagtgggtcagtggcgatcctcctacaacagaaagccaccgttgggagataagtggcattcaacagtgcctgcctgggaaaggaaattctgcacttcaattggctcagttccatggcgaaagctagtagaaagcaagaagtacatgcacctgtttgaacatgtggtaaattgggatgactctgccggcaaagaggcatttgacaatgcaaaaatgaggtattgggctgagatcaacggtgttccctgcaacatatcattgcctgatcccaacatttacaccgatgaagtagattggaatgcaattgttgaccctcaacttattctggatatggaaatggaattagcaaaggtccccaatgaggaactaaggaatgatcacgagattgtgatgattggtggcgctctcttcctgaacgagcaacagcttccgtgtaccggatgggacgacgattatgctgccgaagcaccaaatccaaattctgctgtccaaggctgggcagcaaatctgcaagcaaataatggagtagaatctgggcaacagaatcatgctcctgccgaacatgtagaagaacattttgctcctgccgaacctgcaaaagaagattttgctcctgctgaacatgctaaaggatatgaatggcaagattggaggaatgattcttggggttggaatcaaagggagaacaatggtggtggtggtgacttgcacaaaatgggaagagggagaaatggtcgagggtatggtaattggggaacatgggatggctataacagaaggagggaaaacatgtcatggtctaagacccctactaatggtaataatgagtatcatgtgaataataggggaagaagaaactatagagaaggaggaggaagaaggggcaattttgtttatgtgcctaaggaggtgcctcctactcctactcctgctggatggtaagtgagtgcaaaggcgaagtgtcaaagaccttaggctgagactgcaacaaggggaccccaatgaaactgctgaggtggctgaagatatataaattttggtatcttggtaaaacatgtaagatatggtagtatataagaagacaaagacagcatcctatattctaatacatttctatgaaaggtttatggtatattttggagtttatagtttaagaatagtagtacctgccgtgttgataggtttatgtatatgcagagaaaatatgcatagacaattttaaatgaagctaaatagtgcattcttgtctccttgat

SEQ ID NO: 3367 - DNA, 1593 bp, Glycine max var. Williams 82
atggtccactaccatcgctcccatcaacccagaaagaccaacactgacgaagagtcacagaacaccgtcatgttggattgctcaacctctgcttactacaagagaaccaggcccaagttgttgtctttcctcttcctcatcaccttcctctcttgctgctacgtctttgctcctcttttccttggcccttctttccctctatctctcttgtactctcctgcaaccgaaaatgatgtgaaccgagatggagttgatgcaaatgattctccttgctcttctgtttctactggaactatatgttgtgatagaagtggttatcgttccgatgtttgtgtgatgaaaggtgatataaggacacactctgcttcctcttcagttttcctctacaattcaaggagcaacaacaatgtttcgagaaattttgaagaggaacttcaacatgaaaagatcaagccttatactagaaaatgggagacaagtgttatggacaccattgatgaattaaacctcgtcccgaagaatctgaatttgggtggtgttggtggttgtgatgtccaacatgatgttccagcagttttcttctctaatgggggctacactggcaatgtttatcacgaattcaatgatggaatcatacctttgtacattacttctcagcatttcaagaagaaggttgtgtttgtgattcttgagtatcatagttggtggatcatgaagtatggagacatcctttctcgtctatcggattttccaccaattgattttcgaggagacaataggactcattgcttcccagaagccatagttggtctcagaatccatgatgagctaactgtggattctgcactgatgaggggtaacaagagcattgctgattttagaaaccttttggataaagcttattggccaaggatcaaggggctaattcgagacgaagaaaggaaagcacaagagaagttgagagaacaagtctcatcatctgaatcatcagaagcctcacaacaacagtatataattaggcaacaagtgcaagaaaatccaacgaagaaacctacgttggttattctctctagaagtgggtcaagagctataactaatgagaatttgcttgtgaagatggcaaaggaaattgggtttttggtgcaagttttgaagcctgacagaacaacagaattggcaaaggtttataggtctcttaatgcaagtgatgtcatgattggtgttcatggagcagctatgacacattttctgttcctgagacctggttctgtgtttattcaagtggttcctcttggtaccacatgggctgcagaaacttattatggggaacctgcaaggaagcttggcttgaaatacattggctatcaaattctgcctagagagagcactttgtatgaaaaatatgataaaaatgatcctattctgagagaccctacaagcattaacaagaaggggtgggaatacacaaaaaagatctatcttgacagccaaaatgtcatgttagacctcaggagattcagaaaaaggttacatcgagcttatgagtatacactctccaaatcaaaactgagtctccaacaccaacaaatgtga

SEQ ID NO: 3368 - DNA, 204 bp, Glycine max var. Williams 82
atggcaaaacttggagactgtgcagctcatttttttattgcagcaatggttttgagcacgttttacgtgaccaaaactgtggcacaatcagaaattgcacccacatcgcaaatggagactggtgcagggtttgctttgtctgtttctggggtgaccttatgttcttctgtgttggtttctattgtggcatttatgatgcagtga

SEQ ID NO: 3369 - DNA, 1956 bp, Glycine max var. Williams 82
atgtcaacaatgccaatgcaccatcttctcatttccttccttatcttctctctcactcctactccgacaacctccctcaactccgacggcctctccctgcttgccctgaaagccgccgtggactccgaccccaccggagttctttcctcctggtcggaaaccgacggcaccccatgccactggccgggagtctcctgctccggcgacaaagtaagccaagtttccctcccaaacaagaccctgagcggttacatcccctccgagctgggcttcttaacctccctcaaaagactaagccttccccacaacaacttctcaaacgcgattcccccttctctcttcaacgccacgtcactcatcgttctcgacctctctcataactctctctccggttccctccctacagagcttcgctccctcaagttcctccgccacgtggacttatccgataactccctcaacggttccctccccgaaaccctctccgatctcacctccctcgccggaaccctcaatctttccttcaaccacttctccggcgggattccggcgtccctcggtaaccttccggtgtccgtcagccttgacctccgcaacaacaacctcactgggaaaatcccacagaaagggtcccttttgaaccagggtcccaccgcgttttctggtaaccctggattgtgcgggttcccgttgcagagcgcttgccctgaagcgcaaaagcctggaattttcgcgaaccctgaagatgggttccctcagaaccctaatgcgcttcaccctgatgggaatgatcagagagtgaagcagcacggtggcgggtctgttgctgttcttgttatctccgggctctccgtagcggttggggcggtttcgctttctttgtgggttttccggcgacggtggggcggcgaggaagggaaattgggagggccaaagttagaaaatgaagtggatgggggagaggggcaagagggtaaatttgttgttgtggatgaagggtttgagttggagttggaggatttgctgagggcgtctgcgtatgttattgggaagagcaggagtgggattgtgtacaaggttgtcggtgtcggaaaagggtcctcctccgcggcaggggcggcgaatgtggtggctgttcgaagactcagcgagggtgatgccacgtggcggttcaaggaatttgagtccgaggttgaggccattgccagggttcgtcaccccaatgttgtacctttgagagcttattactttgcgcatgatgagaagctgcttatcactgatttcattcgcaatggaagcttgcacactgccttacatggtgggccttccaattcattgccaccaatatcatgggcagcaaggttaaaaatagctcaagaagcagcaaggggcttgatgtatatacacgagttcagtggtcgaaaatatatccatggcaacataaagtcaacaaaaatattgctggatgatgagctccatccatacgtgtcaggttttggacttgctcggctcggtttgggcccaacaaagtctactacaatggcaccaaaacgaaacagcttgaaccagtcttctataacaactgcaataagttcaaaggttgcagcttcctctaaccactacttggcacctgaggttcgctttaccggtggcaagttcacacagaaatgtgatgtatattcttttggtatagtgctgttagaacttttgacaggtaggatgccagattttggaccagaaaatgatgataaggtactagagagttttgtaaggaaagcattcaaggaggagcagccattgtctgatatcatagacccagcacttatccctgaagtttatgctaagaagcaagtcattgctgcattccatatcgctttgaactgcactgaactcgatccagagttgcgacctagaatgaaaactgtgtcagaaagccttgatcacatcaaaatttag

SEQ ID NO: 3370 - DNA, 168 bp, Glycine max var. Williams 82
atgatggcaacagaatactattatctcttgtttcttctttggttcctctctagcttaaccttcttattggacaaccacgttgtgtttctacgcgtgaaaatactactcctattgggtgacattcactcctttgcctacagcacaaatgcttgggcttttcattcctag

SEQ ID NO: 3371 - DNA, 1503 bp, Glycine max var. Williams 82
atggatgctgctggtgctacccttttgtgttacatcttcttcatagctttgctcattttcccaatacttttcaagtcccttgtcacacgaagcacaaagaaatttcgaccaccaccaagtccaccaacacttcccatcataggccacctccaccttgtgggctcagtcataccaaaatcattccaagccctagctcgcctctatggccctctcattcagctccgtttaggtgcctcaacatgcgtagttgtctccaacgaccaagttgccaaagaagtgatgaaaaccaacgacctcaatttctgttaccgaccccactttggatcctccgagtacttcttgtacaaaggctctgattttatcaccgccccatatggcccttattggcgcttcatcaagaagctttgcatgacgcagcttctatccagctcgcagctagggcgcttcgtgcacgtccgagagcaagaaattaataaactcttgaaatctgttctagtgtgttccagtgaaggtagggttattgatttgagctttgagctcacttctttgaccaacaatatcttgtgccggatggctatgagcaccagctgtttggatagggttcatgatgctgctgagattcttgacttggtgagggagtttttgcatgcaggagctaagttgagcatgggtgaggtgttgggacctttggggaagtttgatttgtttgggtatgggaagaagcttgtcaaaatagttggcaagtttgatcaggttttggagcgtatcatggaggaacacgaagagaaaaacactgaggttcgtcgaggagaaacaggggacatgatggatattatgttgcaagtttataaagatccaaatgctgaagtgaggttaacaaggaatcatatcaaggccttcttcctagatattttcctagcgggaacagaaacgtcttcagcagcgttgcaatgggcaatggctgagatgatgaacaaggaaggagtgttaaaaagggtgaaggaagagatcgatgaagtggtgggaactaacaggttggttagtgaatcagacattacaaatctacgttacctccaagctgtagtgaaggaagttttaagactccatccaacggcgccgcttgctataagagaatcagcagagaactgcagcatcaacgggtatgatatcaagggccagacacgaacactcatcaatgtctacgccatcatgcgggacccagaagcgtggcccaacccagaggagtttatgccggagaggttcttggatgggatcaacgccgctgatttcagctatcttccgtttgggtttggcaggagggggtgccctggatcttcccttgcattaacgctcatacaagtcacgcttgcatcgcttatccaatgttttcaatggaatatcaaagccggagagaagctttgtatggaagaagcctcatccttctctacaggattggcaaagcctcttctttgttaccctataactcgttttaatcctttttaa

SEQ ID NO: 3372 - DNA, 1698 bp, Glycine max var. Williams 82
gtattgtaagcctgctaaaaatgagataaagaacttcactactgaattactacatcactaagcctgacttatataatgatgctccaagtaacacgtattgtgagtttaaaaacttggtaagcgttcctaaattaatttatggatgctgctggtgctacccttttgtgttacatcttcttcatagctttgctcattttcccaatacttttcaagtcccttgtcacacgaagcacaaagaaatttcgaccaccaccaagtccaccaacacttcccatcataggccacctccaccttgtgggctcagtcataccaaaatcattccaagccctagctcgcctctatggccctctcattcagctccgtttaggtgcctcaacatgcgtagttgtctccaacgaccaagttgccaaagaagtgatgaaaaccaacgacctcaatttctgttaccgaccccactttggatcctccgagtacttcttgtacaaaggctctgattttatcaccgccccatatggcccttattggcgcttcatcaagaagctttgcatgacgcagcttctatccagctcgcagctagggcgcttcgtgcacgtccgagagcaagaaattaataaactcttgaaatctgttctagtgtgttccagtgaaggtagggttattgatttgagctttgagctcacttctttgaccaacaatatcttgtgccggatggctatgagcaccagctgtttggatagggttcatgatgctgctgagattcttgacttggtgagggagtttttgcatgcaggagctaagttgagcatgggtgaggtgttgggacctttggggaagtttgatttgtttgggtatgggaagaagcttgtcaaaatagttggcaagtttgatcaggttttggagcgtatcatggaggaacacgaagagaaaaacactgaggttcgtcgaggagaaacaggggacatgatggatattatgttgcaagtttataaagatccaaatgctgaagtgaggttaacaaggaatcatatcaaggccttcttcctagatattttcctagcgggaacagaaacgtcttcagcagcgttgcaatgggcaatggctgagatgatgaacaaggaaggagtgttaaaaagggtgaaggaagagatcgatgaagtggtgggaactaacaggttggttagtgaatcagacattacaaatctacgttacctccaagctgtagtgaaggaagttttaagactccatccaacggcgccgcttgctataagagaatcagcagagaactgcagcatcaacgggtatgatatcaagggccagacacgaacactcatcaatgtctacgccatcatgcgggacccagaagcgtggcccaacccagaggagtttatgccggagaggttcttggatgggatcaacgccgctgatttcagctatcttccgtttgggtttggcaggagggggtgccctggatcttcccttgcattaacgctcatacaagtcacgcttgcatcgcttatccaatgttttcaatggaatatcaaagccggagagaagctttgtatggaagaagcctcatccttctctacaggattggcaaagcctcttctttgttaccctataactcgttttaatcctttttaactttcagctcaatgcaatttccaagggataatgccatagtgttttaagttagttttt

SEQ ID NO: 3373 - DNA, 276 bp, Glycine max var. Williams 82
atgattataaagagaagagataagcaccaagcaagcaaaattaaagcttctcctatggtcatctttgatctgggtgagagaaacgcgtatcgatggattgggttcagttctggtctcacacggtttgttctaacaatttgtactgactgtgttttgatcgatacgggtcgctctcacctaggccagagttgcccaaactttgataacaccattcattcatcaaaagctcgtaagttcctcatcaattccagtttctccaattctgcttttttttaa

SEQ ID NO: 3374 - DNA, 873 bp, Glycine max var. Williams 82
atgggtcattcttgttttctccatcctctacagcttaattatgctctcatgcaaactaaggatggaaatgctcacaactacttggaaaaaacagtccataggttcaatgggggaggtgtgtttgagtactttaagaaaaatgacgaattcttttgcttttctgggcaatcaaaccaagctgtgacaggaatgcttaatctttatcgagcatctcaagtgctatttcaaggagagaagattcttgaggatgccaagaactactctgccaaatttttaactaagaaactgaagacgagattttaccttgaacattatggtggaagcagtgatatttggattgccaagacccttcacagaatgccctatgtgaacagtggtgtttatctcgagcttacaaaattggattacaacaactgtcaagcagagcattgtgcggaatgggaacaaatccaaaggtggtatactgaagcaggactagagggatttgggttgagcaaagaaagtctactatttgcttactttatagcagcagccagcatatttgagcctacactgaggttgagcataaatgatgaagaaactaagagtgcttttgtagatttgttcaataacagaatctacggacgaaactactcaaacaaagagagagttctcctggagattttgctgacaaaccttgattaccttgggttacaaatgtttcggtgtcatggtcacgaattttctcattattttgaatcaagcaatggaatgcacaccaatgtgaagaattcattcctcacagtggccaagggcttttactatggcgcatattgtgacccagagaccataaactcccatgttgagaaagtgctctttcaaaaagtgatgtaa

SEQ ID NO: 3375 - DNA, 2454 bp, Glycine max var. Williams 82
atggcttctcacttctccactcactgccaccttccctctttctcttcttctaaccatttccctttttcatcttcttcttctatctctcttcaccacttctccaaatcctctctgggtgccgtgttgtccgagactaacgacaaacaagagataagatgcagagcaatatccaaaccacgaacacaagaatattcagacatatttcagggtagtctagcaacgttaaagtttcgtgagattaatgtggaagatgacatagaagaggagcaagacatcgggaaggtttttgtggcaaatgagatcaagaagagagtggacactatcaaatcaatattgggttccatggaagatggagagataacagtatctgcttatgacactgcttgggttgctctgatagaagatgttcatggaagtggtgctcctcaatttccatcgagtctagaatggatagcgaaaaatcaacaccctgatggttcatggggtgataaggaattattctcagcccatgatcggattattaacacgttggcttgtgttattgcattaaaatcatggcatatgcaccctgaaaagtgtgagaaaggaatgacattttttaaggagaatcttaaccagcttcagaatgagaatgtggagcatatgccaattgggtttgaagtagcttttccatcacttcttgacatggctcgtggcttgaacattgaagtgccggacaattccccaatcctgaacaaaatcttcgcaatgagaaacgtaaaactcacaagaataccaaaagcgatgatgcataaagtgcccacaagtctgcttcatagcttggaagggatgtcaggccttgactggaaagagcttctaaaactgcagtctcaagacgggtccttcttgttttctccgtcctccactgcctttgctctcatgcaaactaaagaccaaaattgccacaattacttgaataaagtggtcaagaggttcaatgggggagttccgaacgtgtacccagtggatttgttcgaacatatttgggtggttgataggcttgaacgcctcggaatatctcagtattttcagcaagagatcaaggactgtttgaattatgttcacagatattggactgaaaagggtatttgttgggcaagaaattcaaatgttcaagacattgatgacacggcaatgggtttcagattactaagattacacggctatcaagtttcagccgatgtgttcaagaactttgagagaaatggtgaatttttctgcttcacggggcagactacacaagccgtgacaggaatgtttaatctatatagggccacacaagtaatgttcccgggagagaaaattcttgagcatgggaagcatttctctgccaaatttttgagggataagagagcagcaaatgagctagtagataaatggatcataatgaagaacctggcagaagaggttgcgtacgctttggacgtaccatggtatgcaagcctacctcgagtggagacaagattctacattgatcaatacggtggtgagagtgacgtgtggataggcaaaaccctttacaggatggcctatgtgaacaacaataactatctcgagcttgctaaattagattacaacaattgccagacactgcatctaatagagtgggggagaattcagaagtggtactcagaatctaggttgggagagtttggattgaacagaagaactcttctgttggcctattttctggcagcagcaagcatatttgagcctgaaaagtctcatgtgagactagcgtgggccaaaaccagtgtcttacttgagaccataacatcctatgttagtgatgcagaaatgaggaaagatttcatgaaaaaattcagtgactgcattaacaggcgagactactccatgggctggaggttgaacaggaacagaataggacatggactggctgaggctttggttgccaccatagatcaaatctcgtgggatatactcgtgtctcacggtcacgaaattggatatcacatgcatcgcagttgggaaaagtggctttcaagttggcatcgcgaaggagacaaatgtgaaggacaagctgagcttttggcgcagataataaacctatgtgacgggcattggatttccgaggatcaagtgttcgatccacaatatcagagtctccttcaactcactaacacactctgcaatagactccgttgccaccaaaaggacaaggaactcgagagcggcaactgcggcacgaatgtaaacagcatgatcacccaagaagaagagtcaaaaatgcaagaactcgtgcaattggtgtaccaaaaatctccaactggcattgatttcaatatcaagaatactttcctcacagtggccaagagtttttactatacagctttctgtgattcaaggaccgtcaacttccatattgccaaagttctgtttgataaagtcgtttaa

SEQ ID NO: 3376 - DNA, 2703 bp, Glycine max var. Williams 82
gtctgcttgcctcttcccttccttttaaactctgcctttctctccatagtgaaacaaaaatttgttgaatcaacacaaacgcatcatggcttctcacttctccactcactgccaccttccctctttctcttcttctaaccatttccctttttcatcttcttcttctatctctcttcaccacttctccaaatcctctctgggtgccgtgttgtccgagactaacgacaaacaagagataagatgcagagcaatatccaaaccacgaacacaagaatattcagacatatttcagggtagtctagcaacgttaaagtttcgtgagattaatgtggaagatgacatagaagaggagcaagacatcggggtttttgtggcaaatgagatcaagaagagagtggacactatcaaatcaatattgggttccatggaagatggagagataacagtatctgcttatgacactgcttgggttgctctgatagaagatgttcatggaagtggtgctcctcaatttccatcgagtctagaatggatagcgaaaaatcaacaccctgatggttcatggggtgataaggaattattctcagcccatgatcggattattaacacgttggcttgtgttattgcattaaaatcatggcatatgcaccctgaaaagtgtgagaaaggaatgacattttttaaggagaatcttaaccagcttcagaatgagaatgtggagcatatgccaattgggtttgaagtagcttttccatcacttcttgacatggctcgtggcttgaacattgaagtgccggacaattccccaatcctgaacaaaatcttcgcaatgagaaacgtaaaactcacaagaataccaaaagcgatgatgcataaagtgcccacaagtctgcttcatagcttggaagggatgtcaggccttgactggaaagagcttctaaaactgcagtctcaagacgggtccttcttgttttctccgtcctccactgcctttgctctcatgcaaactaaagaccaaaattgccacaattacttgaataaagtggtcaagaggttcaatgggggagttccgaacgtgtacccagtggatttgttcgaacatatttgggtggttgataggcttgaacgcctcggaatatctcagtattttcagcaagagatcaaggactgtttgaattatgttcacagatattggactgaaaagggtatttgttgggcaagaaattcaaatgttcaagacattgatgacacggcaatgggtttcagattactaagattacacggctatcaagtttcagccgatgtgttcaagaactttgagagaaatggtgaatttttctgcttcacggggcagactacacaagccgtgacaggaatgtttaatctatatagggccacacaagtaatgttcccgggagagaaaattcttgagcatgggaagcatttctctgccaaatttttgagggataagagagcagcaaatgagctagtagataaatggatcataatgaagaacctggcagaagaggttgcgtacgctttggacgtaccatggtatgcaagcctacctcgagtggagacaagattctacattgatcaatacggtggtgagagtgacgtgtggataggcaaaaccctttacaggatggcctatgtgaacaacaataactatctcgagcttgctaaattagattacaacaattgccagacactgcatctaatagagtgggggagaattcagaagtggtactcagaatctaggttgggagagtttggattgaacagaagaactcttctgttggcctattttctggcagcagcaagcatatttgagcctgaaaagtctcatgtgagactagcgtgggccaaaaccagtgtcttacttgagaccataacatcctatgttagtgatgcagaaatgaggaaagatttcatgaaaaaattcagtgactgcattaacaggcgagactactccatgggctggaggttgaacaggaacagaataggacatggactggctgaggctttggttgccaccatagatcaaatctcgtgggatatactcgtgtctcacggtcacgaaattggatatcacatgcatcgcagttgggaaaagtggctttcaagttggcatcgcgaaggagacaaatgtgaaggacaagctgagcttttggcgcagataataaacctatgtgacgggcattggatttccgaggatcaagtgttcgatccacaatatcagagtctccttcaactcactaacacactctgcaatagactccgttgccaccaaaaggacaaggaactcgagagcggcaactgcggcacgaatgtaaacagcatgatcacccaagaagaagagtcaaaaatgcaagaactcgtgcaattggtgtaccaaaaatctccaactggcattgatttcaatatcaagaatactttcctcacagtggccaagagtttttactatacagctttctgtgattcaaggaccgtcaacttccatattgccaaagttctgtttgataaagtcgtttaaatcaaattttatttcttgaatagatattagactccaccatatcattgtgaatattatccctctgtaatgataaaaagaaaggaaaacaaattcagttgttgcggctcgatgtatataactttgcacagtttggctaccatttatgaaatatccacttgttctgttta

SEQ ID NO: 3377 - DNA, 357 bp, Glycine max var. Williams 82
atgataagagcttcatggacaacttgtggtgcccctcttcttgtttcccttcacatgtactccagcctccttgttgtctctttcctcaaggtagatcaagttactcacaaagtcttccttttttcctttaaacacaacccctatatcattggcaatttcacaaattttccttacccccttcaagtcatttttatccaccttatatccttcctcggcctccctgtatttaggcaaccattactaggcatagatactgcctttgtcctacatgttcccttgtctttcccactgggcccactcttcttgatgccccctttctttgcattcttccttctgctggccaaagtctgccaataa

SEQ ID NO: 3378 - DNA, 852 bp, Glycine max var. Williams 82
atgctgctgaggaacagatcaagggcagtgacaaagccaggtttgatggctgatcacggcacccagaattctccaaatcaaaactatgctaaaactattccttctctatttgggtcaccaaaattcagagatttcaccaacaagtgtctctcttcaggaactgaggccttaaggagcccaacttcaattcttgatgccagagcattatccccttttgcctttggaaacccattttcaacccttccaaacaaaacctcctcaccaaacagaacctcctgggacaagcctgattcaaagggtattggccttgctcttgttggtgctctcaaagatgatgataacccaatttgtcacaattctgaacccaagaaaggaaatgttctgcttagagtgagaataccatttgagtctcaatttcaaacatgtgtggatgattttggaatcgccaaaaccaatggttcaaagaactcatcagggtcaggaatttgttcaaaggattgttgtgattctccaagaagtggtggcgttctgtcttggagtgcgatggagctttctgaggaatatacatgcgtgatatcccatggacctatcccaaaagccacacacatattcaacaattgcattatggtggagacatattattctctccccccaaaacaaaactctcactctgctgctacctccgggaatttcctcagcttctgctacacttgcaagaaacatcttgaccagacaaaggacatctttatttatagaggagaaaaagctttctgtagcagggaatgccgccacagagaaatgatgttagatggaatagaaaatcttgagtttgaaagcaatggttattcttga

SEQ ID NO: 3379 - DNA, 651 bp, Glycine max var. Williams 82
atggcttttcaaatacgggtgatactagcaacccttatagtggcttcagtaaatttggtttatggtcaagttagcacgtcctgcacaacatctatgatgagcagtttcacaccatgtgcaaacatcattacaggaagcactaataatggtttagtgccaccaagtacgtgttgtgatttattaaggtctttgatgagcactaatatggattgtgcttgcatggttatctctgccaatgctccatttttccaacaaccccttagccaagctcttgccctctccctttcacaagcatgcaacattaatggagttcctttacagtgcaaagcttctggttcccctttactagttccaggccctgcagttcttggaccgaacagcccaactctcccttcaattgctacatcacccttaagcccacaagattcaagaatggtggctatgggcaaagcacagaaatatgaaaatatgcaattggcacgggaactgtcaccagcatcatcaccagtggaagcagaaacgcccacaagaactagaattccacaaatccgaccagtgttgactccacgtccttcagcatctcattcatcttttgcttccccctcagcttttccattcttcataggaatcctggtttttggcatctattag

SEQ ID NO: 3380 - DNA, 399 bp, Glycine max var. Williams 82
atggcaaccatcatcgccggcatcccaactacatcgatcactcgcgcaggtcttgtgctcaaacgacctgttggagcctcgtcctctaccgttcttggattgccagcaatggctaaggcagggaaagtgaggtgctccatggaggaaaagccttcaagcagctcaaatatagggatgggggcatccttgttagcagctgcagttgccgcaaccatgtcaagcccagccatggctttggtggatgagagactcagcactgaaggaaccgggcttccctttgggcttagcaacaacctccttggttggatcctgtttggtgtcttcggtcttatatgggctctctactttgtctacgcttccacccttgaagaggatgaagagtctggattgtccctctaa

SEQ ID NO: 3381 - DNA, 1539 bp, Glycine max var. Williams 82
atgattgagaacatacttctgaatttgcagcttttagcacctttcttcctcttattcatcttcccagtgcttctgttcttctttttctcgtcttcaggttccaaaaagaaagaggcaagcataaccaccatcccaaagccatacccacttattggtcactacttagacctcaaaggcgtcggtaaccgccgtatccagtggctatccgatatcgtcaaaatctcaccggccgccactttcaccctccaccgccccttgggcagccgccaagtcatcaccggcaaccccgccaccgtagagcacattctcaagacccgtttctccaactatataaagggctccatctttattaacaacctctccgatttcctcggcaccggaatcttcaacgccgacggcaacacttggaagtttcagaggcaagtcgccagccacgaattcaacactaagtctctccgcaaattcgtcgaacacgtggttgatgtcgaactctccgaccgtctcgtccccgtcctcgcttcagcagcacaacaagaccaaaccctcgatttccaagacatcctccaacgtttcgcgttcgacaacatctgcaaaatcgcgttcgggtatgacgccgagtacctgacgccgtcaactgaacagagtaagttcgcagtagcgtacgaagaagcgacggagatcagcagcaaacggttccgcgagccgttaccgttagtgtggaaaatcaagagattgcttaacataggttcggaaaagagactaagaatagcggtgaaagaagtgcgcgatttcgcgaagaagatagtgagagagaagaaaaaggagctgaaggagaaggaatctcttgaacaggttgacatgctatcgcggttcttaagttcggggcactccgacgaggacttcgtcactgacatagttataagcttcatattggcggggaaggataccacgtcagctgcgctgatgtggtttttctggctactatcgaagaacccgggcgtggagaaggaggttttgaaggagataatggagaaaccagagactccggcgtacgatgaagtgaaggacatggtttacatccatgcagcgttgtgtgagagcatgaggctctaccctccggtgtcgatggactcgaaggaagcagtggacgacgacgttttgccggatgggacggtggtgaagaaagggacgttggtgacgtatcacgtgtatgcgatggggaggatggagagtatttggggcgaggattgggcggagtttaagccagaaagatggttggagaaggttgaaacgggaaagtggaagtttgtgggaagggattcgttcacttatccggtgtttcaggctggtcccaggatttgtttggggaaggaaatggcatttatgcagatgaagaggttggtggctgggattctgaggcgcttcacggtggttccggcaatggctaaaggggtggagcctcactactttgccttcttgacctcccagatggaaggtggattccccgtcaagatcatcgacagggaagcttcatgttga

SEQ ID NO: 3382 - DNA, 1815 bp, Glycine max var. Williams 82
atggcagtgatagaagaaaaaggcccttcaagtgggaacgaggattacactcaagatggcacagtggacctaaagggtagacccgttttgagatcaaagacgggaaaatggaaagcttgttccttcatagtagggtatgaagtgtttgagaggatggccttctacgggatacaatcaaacctagtgatatatctaactaataagctccatgagggcactgtgacagcttcaaacaacgttagcaactgggtgggtgcagtgtggatgatgccactggcaggagcttacatagccgatgcccatcttggccgatataagacctttgtaattgcgtcatgcatctatattctgggaatgtgtctgttgactctagcagtttcactaccagctctgaggccatcaccatgtgaccaaggccagaattgcccacgggcatcgtcattgcagtatggtattttcttcttggccctttacatcgttgcaataggcacagggggaaccaagcccaacatttctaccatgggagctgaccaatttgatgagtttgagcccaaagagagatcccacaagctttccttcttcaattggtggttctttagtattttctttggtacccttttctccaacactttcttggtatacttacaagacaataagggttgggccattgggtatggccttcccacccttgggcttgttatttcagtagtggtgtttctggtaggaactccattttatagacacaaattgccatcaggtagcccagtaacaaggatgcttcaggtatatgttgctgctgggagcaactggaagctgcatgtcccagacgatccgaaagagctacatgagctgagcattgaagagtatgcaagtaatgggagaaacagaattgatcggagctcctcattgagtttccttgacaaagcagctataaagactggccaaacatcaccatggatgctttgcacagtgacccaagtagaggaaaccaagcaaatgacaaaactgattcctctcttgcttacaacgattattccaagcaccttggtagttcaagcgagcacactctttgtcaaacaaggcaccacactagacaggagtatgggaccccatttccaaatccccccggcatgtctcaacgcatttgttaccatctccatgctgataaccatcgttgtctacgaccgagctttcgttcccgctatccggcgctacacgaagaaccccagagggatcacaatgctgcagagactcggcattggacttgtgatgcatgtcttcataatgatcattgcatgctttgctgaaagaaggagactcaaggttgcaagagaaaaccacctctttggtctgcatgatacaattcctctcactattttcatcctcttacctcagtatgctttgggaggggttgctgataactttgttgaagttgccaagatagagatattctatgatcaagcaccagatggcatgaaaagtcttggaacagcatatttcacgaccaccttaggtattggaagttttctcagcagttttcttctgtcaactgttgctgatgtcaccaagagacatggccacaatggttggattttgaataatctaaacgtctcccgtttagattattattatgctttcatggctgtacttagctttctcaactttctctgctttttggttgttgccaagttctttgtctataatgttgatgttacacaaaccaaatccggctcggagattaacccctcttcatcacaggaacaggacaatactggaataagcccaagtatcccacaaccagatggcaaatcctag

SEQ ID NO: 3383 - DNA, 1857 bp, Glycine max var. Williams 82
atgagaaagttgtgttttaacccccaaacagagtcgtttgcgttggcccgcagttctccttcttcaccactatccttaacctcaagcccaactcctccgaggctgagcttttccgaagctgaggcactgatactgaaatggaaccctgacacttccgcttacgccaaagtcacttccctcttctacgaggacaaaaccgaagccaaacactacattgactccgttaaccagcttcagaaatccatgcattccttgctctctcagaacccttcctctgagaaactcattctcgctcataacctaatgcagatggctatgaagaggctcaagaaagagttctaccagatcttatccatgaaccgcgcacaccttgatccagaatccgtctccgccagatcctctcgcacctccgccaactccagcgcctccgattacgacgacgacttcgctgctgaggacgacgatatccgcgccgccggcgactctatctccgaagtcgagcaggtttcttccggcgccatggcagatctgaaactaatcgctgactgcatggtatcttccggttatgccaaagaatgcgtcagcgtttacatcttaatacggaaatccataatcgacgaaggaatctaccgcctcggcgtggagaaactgagctcctcgcgcgccaacaagatggattggaatgtgcttgatttgaagatcaagagttggttagaggcgataaggatttccgttagaacgctcttcaacggagagagaatcctctgcgaccacgtcttcagttactcagattctgtcagagaatcctgcttcgccgagatttcgagagacggtgcctctctccttttcggattccctgaactcgttgccaaaacgaagaaatcatcgctggagaagctgttccgagtgctcgatatgcatgctgtggtttccgaactgtggccggagatcgagtctatcttctcctccgattacaactccggcgctcgttctcaagtcctggtttcgcttcaacgactcaccgagtccgcgcaaatcttgctcgcggagttcgagtccacgatccagaaagactcttccaagtcggcggtgaacggcggtggcgtgcacccgctcacgattcagacgatgaattacctttcagtcctcgccgattacatcaacgtgctctctgatatattcccgcgcgactggcttccgccgccaaagtcttcgtcgctgccggaatcttatttatacagtccggagtctgattactcggcgtcgaagccggcgctgacggcgcgttttgcgtggctaattctcgtcctcctttgcaagctcgacggcaaggcgaagcattgcaaggacgtttcgctgtcttacctctttctcgctaacaatctctggtacgttgtcgccagagtgcgaagctcgaacctgcagtacgtgcttggcgacgattggatccttaagcacgaagctaaagcgaagaggttcgtcgcgaactacgagaaggtggcgtggggagaagtggtttcgtcattgccggaaaatccagccgcggcggaggcgagggaggtgttcgagagcttcaaccgcaaattcgaggaagggtatcggaaacagaactcattcgtcgtagctgaccgcgaattacgagacgaaataaaaggttcgatcgcgagaagcatagtgccaagatatcgcgagtggtataatgttgttcttgctacggtgggaacagtgagggatttgacggcgacggagtacgtgacctttacccctgaggatattgaaaattacctggttaacctcttcttttttggaacctcatccagtgctgtatcgtcctcgcctctccggcgttggagctaa

SEQ ID NO: 3384 - DNA, 2317 bp, Glycine max var. Williams 82
ctcatcgacaatgaaaggtcaatacaggttaaaacttacaaaaattctaatcctcctacgtaattttctggaacaagcaagccttgctgcctctatatatattccacacttgcagttccaagcatccattctctccctcagcaaaacattccaagttccatagttggaaccctgaaagcaaaacattaggtcattttgatcgagttgcaaacatgagaaagttgtgttttaacccccaaacagagtcgtttgcgttggcccgcagttctccttcttcaccactatccttaacctcaagcccaactcctccgaggctgagcttttccgaagctgaggcactgatactgaaatggaaccctgacacttccgcttacgccaaagtcacttccctcttctacgaggacaaaaccgaagccaaacactacattgactccgttaaccagcttcagaaatccatgcattccttgctctctcagaacccttcctctgagaaactcattctcgctcataacctaatgcagatggctatgaagaggctcaagaaagagttctaccagatcttatccatgaaccgcgcacaccttgatccagaatccgtctccgccagatcctctcgcacctccgccaactccagcgcctccgattacgacgacgacttcgctgctgaggacgacgatatccgcgccgccggcgactctatctccgaagtcgagcaggtttcttccggcgccatggcagatctgaaactaatcgctgactgcatggtatcttccggttatgccaaagaatgcgtcagcgtttacatcttaatacggaaatccataatcgacgaaggaatctaccgcctcggcgtggagaaactgagctcctcgcgcgccaacaagatggattggaatgtgcttgatttgaagatcaagagttggttagaggcgataaggatttccgttagaacgctcttcaacggagagagaatcctctgcgaccacgtcttcagttactcagattctgtcagagaatcctgcttcgccgagatttcgagagacggtgcctctctccttttcggattccctgaactcgttgccaaaacgaagaaatcatcgctggagaagctgttccgagtgctcgatatgcatgctgtggtttccgaactgtggccggagatcgagtctatcttctcctccgattacaactccggcgctcgttctcaagtcctggtttcgcttcaacgactcaccgagtccgcgcaaatcttgctcgcggagttcgagtccacgatccagaaagactcttccaagtcggcggtgaacggcggtggcgtgcacccgctcacgattcagacgatgaattacctttcagtcctcgccgattacatcaacgtgctctctgatatattcccgcgcgactggcttccgccgccaaagtcttcgtcgctgccggaatcttatttatacagtccggagtctgattactcggcgtcgaagccggcgctgacggcgcgttttgcgtggctaattctcgtcctcctttgcaagctcgacggcaaggcgaagcattgcaaggacgtttcgctgtcttacctctttctcgctaacaatctctggtacgttgtcgccagagtgcgaagctcgaacctgcagtacgtgcttggcgacgattggatccttaagcacgaagctaaagcgaagaggttcgtcgcgaactacgagaaggtggcgtggggagaagtggtttcgtcattgccggaaaatccagccgcggcggaggcgagggaggtgttcgagagcttcaaccgcaaattcgaggaagggtatcggaaacagaactcattcgtcgtagctgaccgcgaattacgagacgaaataaaaggttcgatcgcgagaagcatagtgccaagatatcgcgagtggtataatgttgttcttgctacggtgggaacagtgagggatttgacggcgacggagtacgtgacctttacccctgaggatattgaaaattacctggttaacctcttcttttttggaacctcatccagtgctgtatcgtcctcgcctctccggcgttggagctaagtgcacagtttgaacggcgagttttctacgccgttatttttcttggttgtagtaatagttttgacatagccaacaaaagcgataacgtctttttcagttttctgcgtggtacacgtaagcatgacttcatcgcgtagtttccaccctttgtttcagactttcaggatgctacatttctaaactaaaacctggataaattcgttatttacgtacatttcttttgcgtgctttatttttatttatttata

SEQ ID NO: 3385 - DNA, 3234 bp, Glycine max var. Williams 82
tgttcttcttcttcttctgcctagaaacaaactgagagagtagttcactttctgtattggtttctcacatttctatggtttcattttagcaaagccacacaccctagaaaaaaatggagagtatcttcctctcctccttcaagtttgcactctccctctcactcctactccactcaccttctttttcctctgctcagatcatgcaaggttttgtaagtttggactgtggaggtacagaaaaatttactgatgaacttggtcttcattggactcctgatgataagcttacgtatggacaaataagcactatatcagttgcaaacgagacacggaagcaatacacaacacttcgacactttcccgctgattccaggaaatactgctacactcttgaagttgttagcaggacgagatacctattgagggcaagcttcttatacgggaactttgacaataacaatgtttatccgaaatttgacatttctgttggggctacgcattggtctactatcgttatatctgatgctaatagcatagaaatgcgagagcttatatttttggcttcgagtcctacagtaagtgtatgcttatcgaatgcaacaacaggacaaccatttatatctacactagaacttcggcagttcaacggttcggtttactatacacaatttgagcaacacttctaccttagtgtctctgcaaggataaattttggtgcagagagtgatgctccaattaggtatcctgatgacccttttgatagaatttgggagtcagattctgtgaagaaagctaattatcttgttgatgttgctgctggaactgagaaaatttctacaacagtaccaattgatgtcaacagagatgaaatgcctccagtgaaagtgatgcaaacagctgtagtgggtactaatggatctctaacttaccggttgaacttggatggttttccgggtactggttgggcattcacctattttgcagagattgaagatttggatcccgatgagtctagaaaattcaggctagtacttccgggtcagccagatattagcaaggctgttgtaaatattgaagaaaatgctcaagggaaatatcgcctctatgaaccaggatttaccaatatatctttaccctttgtgctctcttttagatttggcaagacatatgattcttctaggggacctctcctaaatgccatggagataaatatgtatttggagaaaaatgatggctctctagatggagcaacaatttccaatatactttcacactactctgcagcagactggctccaagaaggtggtgatccatgtctgcctgttccatggtcatgggttcgatgtaactctgatccacagccaagaatagtttcaatcttgttatccaataaaaacttaactggaaatattcctttggatatcaccaaattggttggtttggttgaactatggcttgatggaaatatgttgaccggtccatttccagattttactggatgcatggacttaaagatcattcatcttgaaaacaatcaattgacaggtgtgctcccaacctctttgacaaaccttcctagcttgagggaactgtatgtgcaaaataatatgttatctggaacaataccatcagaacttctaagcaaagatttggttttgaactactctggaaatataaatcttcacagagaaagtagaataaagggacacatgtatgttatcattggttcatcagttggagcttctgttctacttttggctactattatatcttgcttatatatgcataaagggaagagaagatatcatgagcaaggctgcattgattctctccctacacaaaggctggcttcttggaagagcgatgatcctgcagaagctgctcactgcttcagttattctgaaattgaaaatgctacaaataactttgagaaaaaaattggttctggtggttttggagttgtatactatgggaagctaaaagatggaaaagagatagcagttaaagttttaaccagtaattcctatcaaggcaagcgagagttctcaaacgaggttactcttctttcaagaatacaccacagaaatttggtgcagctgcttggttattgtcgagatgaagagaatagtatgcttgtttatgagttcatgcataatggcactctaaaggaacatctttatggcccattagtgcatggacggagtatcaattggattaagcgccttgagattgcagaagatgctgccaaagggattgaatatcttcacacgggttgtgttcctgtcgttatccacagagacttaaaaagcagcaatattcttctcgacaagcacatgagagccaaggtctcagattttggtctttcaaaacttgctgttgatggagtttcccatgtttcaagtatagttcgaggaacagtaggatatctggatcctgagtactatatttcccagcagctgaccgacaagagtgatgtttatagttttggtgtaattcttcttgaactcatatctggtcaagaagcaatatcaaatgaaagcttcggtgtaaattgccgaaacatagttcaatgggcaaaattacacattgagagtggagatatacaaggtattatcgatcccttgttgcggaatgactatgaccttcaatcgatgtggaaaatagcagagaaagcattgatgtgtgttcagccccacggacatatgcgaccatcaatttcagaagctctaaaggagatccaagatgcaatatctattgagagacaggcagaagcattaagagaaggcaactcagatgatatgtcaaaaaattcttttcattcttccatgaacatggggtcaatggatctaggtggagctgagagttacctgtcaattgatgaatcaattgcacagcctacagcaagatagatatctcttgtaaacaaaagcaaaattttctctcttttttttcttcctctgattttatttttttctctcattacttcttttgtatgtggaggaggccttgttcatatgtggtttaatgattggttcccctcccaaacaaatgaacagtatatatgtatgtatttggagttaatgcgttctgcctttgcaagcactgatacattgtatacattgaattgccatggcaggatgtcaattttgaataattattgattttttgtttcatagcatgatactaaaattctaaaaccgtggaggggaagtagtagtgattgaggtagaacaa

SEQ ID NO: 3386 - DNA, 1035 bp, Glycine max var. Williams 82
atgggttcactagaaagatcaaagaagaaagttcttctatggaagaaggccatgctccatttttccctatgttttttgatgggggttttcacaggcttagctccaacaggtaaatcttctctcttttccaccaaagttgctgtctcaaataggacagaatttgcaccacaacctagtgaaatgtcaaacctcacaacaaatgtcaatagaatttggatagctccaatgccagataccatgcccgtgaagcctagaatccttgaaaatgaaaagaaaaaaacaacaaagttgcatgcaaaaaaacagccccagttgaagcctagaagactcataatcattgtaacaccaacaagcacaaaactaccccaccaagcagtgtttttgagaaggttggcaaatactataaagctggttcctcaaccattgctgtggattgttgtggaagctaaaaccaattccacagaactgccagagatattaaggaaaactggcatcatgtataggcatgtggttttcaaggaaaatttcacggaattagaagctgaactgaatcaccagaggaatcttgcacttaagcacattgagcaccacaggctcaacggcattgtacactttgctggcctttccaatgtttatgatctccaattcttccatcagcttagagatattgaggtctttggaacatggccaaccgcattgttagctgcacacaggaagaaagtgaaaatcgaaggacctgtatgtgattcatcacaagtcattggttggcatcttaggaatatgaacaatgaaactgatacaatcactcccccaattcatatttcaagttttgcttttaatagctccatcctttgggaccctgagagatggggtcgcacttcctctgttcaagacacttctcagaattcaatcaagttcgtgaagcaagtagttctagaagatgaggctaaattaaagggaattccaccagaagattgctccaaaatcttgctatggcgtttcaattttcgtgcccgaaccatcacaaatcactaa

SEQ ID NO: 3387 - DNA, 780 bp, Glycine max var. Williams 82
atggcaaacaaaaactttctatgcattatagaagaaatggataggctttggtttcaccaagctattcttttctcagaaccaacagcatcagttatttcattaccatctccaccagatgaaaaaaaacctgttcctacatcagaatccgtgtcttgctcatcatccattctttcttcaccacctccaccagatgaagaaacttcaacggatgaatcaccctcttcagagcaacaactctcatcagaatcaatgtcagtgcctcttcaggatggttcaatcaacaatgaagaggaaaggaaggacgggttgactagaatgaaccttttggataacagaactcgttcacattcatcctcaccatcaactcaaaaccgtcacagaaaattgaggaaaccagctactacttgtgcaaggaaactacagaagtccataagttgcagaacacttggggagctagaacttgacgaagtgaagggttttatggatcttggtttcacgttcaagaaagaatgtcttagtccaagaatgatgagcgttataccaggcttgcaaagacttggtgtgatggacgccacagaaacggttgaaggaaatcatatcgaagcagaggaacaaaagagaggcatcatgagaccatatttatcggaggcatggcctataaagagacccgattcaccgctactgaatttgaaaattcccaaacgttgttcatctgccaacatgaagaaacatcttcggttctgggctaaaacagtggcctcagaaatccaccaagaatga

SEQ ID NO: 3388 - DNA, 750 bp, Glycine max var. Williams 82
atggcaaagctattcaatttcctccctctcctcttcctcaacatcttcattcaaacaatttcagcccaagtagcaccagcaccagcgggccccaccaacatcacccaagttcttgagaaagcaggccaattcacaaccttcatcaaacttctcaaggcctcacaaatagctgatagaatcaattcgcagctcaacaactcaaaccaaggcctaaccgtatttgcacccactgataatgcattctcaagcctcaaagcagggacactaaactccataaactcacaagaccaaatgcagttgatacagttccacattctccccactctctacaccatctcacagttccaaaccgcaagcaaccctttgcacacgcaagctgggaacagtgatgatggagagtaccctttaaatgtcaccacctcagggaaccaagtgaatgtaacaactggggtggttgatactacagtgtccaatactatctacagtgataaccagcttgcagtgtatcaggtagataaggtacttcttccaatgaagcttttcggcgcaacggcaccggctgcttcaccggcagaggctccggcaccgaccaagccggagaaaaatgtccgggctggggctgctgattctccttcagggtcgtcggacacgtccgctgatgcttcgagtgcagtgagtttgaaaaggcacacagttgaaggtgttacctttgttgctgcagttgttgtcatgattgtttcttgtttctga

SEQ ID NO: 3389 - DNA, 1527 bp, Glycine max var. Williams 82
atggttttccaaacaagcaataatccccatttcgtattgtttcccctaatggctcaaggccacatcatccccatgatggacattgcaagactattggcgcggcgtggtgtgattgttaccatattcactaccccaaagaatgcatcacgtttcaattctgttctttctcgtgctgtttcatcaggcctccaaatccggctagttcaactccactttccatccaaagaagcaggactacccgaagggtgcgagaatttcgacatgttaacatcaatggacatgatgtacaaagtcttccacgccatcagcatgctccaaaagtcagcagaggagttgtttgaagcactgataccaaaaccaagttgcataatctctgacttttgcattccttggaccgctcaagtagctgaaaagcatcatattccaaggatttcgtttcacggtttttcttgcttctgcctccattgtctgctcatggtacacacttcaaatatttgtgaaagcatcacttcagaatccgagtacttcactatccccggcatacctggtcaaattcaagctaccaaagagcagatacctatgatgatctcaaattcagatgaagaaatgaagcacttcggggaccagatgcgtgatgctgaaatgaagtcatacgggctaatcataaacacttttgaagagttggagaaggcatacgtgacggattacaagaaggtgagaaatgataaggtgtggtgcattggtcctgtttcattctgtaacaaagatgatttggataaagctcaaagaggcgaccaggcctcaattaatgagcaccattgcctgaaatggctagatttgcagaaatccaagtctgtggtctatgtttgttttggaagcttatgcaacttgattccttcacaacttgtagagctggcattggccttggaagatactaaaagaccatttgtatgggttattagagagggaagtaagtaccaagagttggaaaaatggatcagtgaagaagggtttgaggaaaggaccaaagggagaggccttataattcgaggttgggctccacaagtgctaatattatcacaccatgccattggaggattcttaacacattgtggttggaattcaacacttgaagggataggtgctggattgccaatgattacctggcctctatttgctgatcaatttttgaatgagaagcttgttactaaagtgttgaagattggtgtgagcgtaggggtagaggttcccatgaagtttggagaggaagagaaaacaggggtgttggtgaagaaggaagatattaatagggcaatatgcatggtgatggatgatgatggagaagaaagcaaagagagaagagaaagggcaaccaaactcagtgagatggcaaagagagcagttgaaaatggagggtcttctcatcttgacttgagtttgcttatccaagacattatgcaacaatctagtagcaaggaggaaataatgtcgacgcctaaagagtcacaattttcatgtaacgtttga

SEQ ID NO: 3390 - DNA, 354 bp, Glycine max var. Williams 82
atgtggagagcaatggaggtggcagtggcatatgctttggaagatgctcaattgagaatctccatttcacccttttctgttttgtttatgttacctttgacaaaaagtcacccccccacactagctagactgtatagctattatatacataagtcatctcacactttcaattcattctataacacccaatccaacattcattctcgaaccctctccaaactgcaccccttctcgaataatagccctcgctgcctctgtggcagtggaggtggtggagatgcatatggtgcatttttgtcggtgtttccttttggttcaatcatggtggagcatgaatattatgtaataagttga

SEQ ID NO: 3391 - DNA, 2172 bp, Glycine max var. Williams 82
atgacctataataacaacagcttcaacacttttcctcaatcacacactctctccaatcatattctcattgcatttgctaatcccaaatctgaaatttcttttaaattaaaaacaccaccatcgttccctcccttcccacaccataacatgaaacaggtttgtctttgtctcataatcctgacactggccttgtgcttgtgcatcctctgtgtttctgcagaggctgcagggcagaacgatacactcgcacttaccgaattccgtctccaaaccgacacccacggcaacctcctcaccaactggaccggcgccgacgcctgctccgccgtatggcgcggcatcgaatgctccccaaacggcagggtagtgggcctcacccttccttccctcaacctccgcggcccaatagactccctctccacactaacctacctccgtttcctcgacctccacgaaaaccgcttaaacggcaccgtttcacctctcttaaactgcacaagcctggaactcctctacctctcccgcaacgacttctccggcgagattccgccggagatatcctccctccgcctcctcctccgcctagacatctccgacaacaacatccgaggccccatccccacacaatttgcgaaactaacccacctcctcacgctgaggttacagaacaacgccctctccggccacgtccccgacctttccgcttccctccaaaacctcaccgaactcaacgtcaccaataacgaactccgcggccacgtctccgattccatgctcaccaaattcggcaatgcgagcttctccggaaaccacgccctctgcgggtccaccccgctacctaaatgctccgaaacagagccaggcacagagactacaataaccgtccctgcaaaaccgagctcgttcccgcaaacaagtagtgtaaccgttcccgacactccgagaaagaaaggattgagcgccggtgtaattgtggcgatcgtggtggcggtttgcgtggcggtgctggtggcgacgtcgttcgtggtggcgcattgttgcgccagaggttccacctctggctcggtggtggggagcgagagtgccaagaggaagagtgggagtagcagtgggagcgagaagaaggtgtatgggaacggtgaaaacttggatagagacagcgatgggaccaatactgagacggaaagaagcaagcttgtgtttttcgataggaggaaccagtttgagttggaggatctgcttcgagcttcggcggagatgctcggaaaaggaagcttggggactgtttacagagcggtgctcgatgacggctgcaccgtggctgtgaagagactcaaagacgctaacccctgcgagagaaatgagtttgaacagtacatggatgttgtagggaagctcaagcaccccaacattgttagactcagagcttattattacgctaaggaagaaaagcttcttgtctatgattatctccccaatggaagcttgcatgctcttcttcatgggaaccggggaccaggaaggattccgttagattggaccacaagaataagtttggtgttaggtgcggctagagggttggcacggattcacgcatcaaaaatacctcacgggaacgtgaaatcttccaacgtgcttctcgataagaacagcgtcgctttaatctctgactttgggttatcattgatgttaaaccccgttcatgcgattgcgaggatgggagggtacaggacgccggagcaagttgaagtgaagaggctgtctcaagaagccgacgtgtacggtttcggggtgctgctgttggaggttctgacggggagggctccgtcgacgcagtacccatctccggcgcggccgcgtgtggaggagctggctgaggtggatcttccgaagtgggtgaagtcggtggtgaaagaagagtggacttcggaggtgtttgaccaggagttgctgaggtacaagaacattgaggatgagttggtggcgatgctgcacgtggggatggcgtgcgtggcggcgcagccggagaagaggccgtgtatgttggaggttgtgaaaatgattgaggagataagggtggtggaacagtcgccgctcggagatgattatgatgaggctcgctcgcgcacttcgttttctccttcacttgctaccacccaagacatccaatga

SEQ ID NO: 3392 - DNA, 1602 bp, Glycine max var. Williams 82
atggatcgcttttcttccagtaccattctccccgaagcgtttcaaggtgccaaagatgacttcaccatgcagcttgcattggtgtggaaccaaatcaaagcgccactgattgtcccgttgctgagactagcagtgtttctgtgcttgatcatgtcggtgatgatgttcattgagagagtctacatgggcattgtcatcactctggtgaagttgtttgggagaaagccagagaaacgttacaagtgggagccaatgaaggacgacattgagttgggaaactcttgttacccaatggttcttgttcaagtccccatgtacaacgaaagagaggtttatcagttgtctattggagcagcatgtgggctttcttggccttcagataggatcatcatacaagtccttgatgactccactgacccaacaatcaaggagttggtgcagcttgaatgccaaagatgggcaagcaaaggggtgaacataaagtatgaggttagggacaataggaatgggtacaaagcaggggctctcaaagaaggcatgaagcgtagctacgtgaaacaatgtgattgtgttgctatctttgacgctgattttcaaccagagcctgatttcctgtggcggaccgttccatttctcgtgcacaatcccgaattagccctcattcaagcacggtggaaatttgtgaatgccgatgaatgtttgatgacccgaatgcaagagatgtcactagattaccattttactgtggaacaagaagtggggtcttccacttacgccttctttggtttcaacgggacagcgggagtatggagaatttcggcgcttaatgaggctggtggatggaaggataggaccacagtggaagatatggacttggccgtgcgagccagtctcaaaggatggaaattcttatacttgtctgacttgaaggttaaaaatgagttgccaagtactttcaaggcctaccgctaccaacagcaccgttggtcttgtggtccagccaatctttttaggaaaatggtcatggagatcataaataacaagaaagtgtcattgtggaagaagatacatgtgatttacagcttcttctttgttcggaaggtcgtagcacacataaacacgtttgtgttttattgcattgtattacctgcaacagttttggtgcctgaggttgtggtcccaaagtggggagctgtctatatcccttccatcatcactattcttaatgcagttggaactccaaggtcactccatttgatggtcttctggattctctttgagaatgtcatgtctctgcatcgaacaaaggcaacgattattggtttacttgaggcaagtcgagtgaacgaatgggttgtcactgaaaaacttggtgatgctctcaagactaaagcaggaggtaaagcacctaaaaagcctcgattcaggattggagacaggattcacttgttggaacttggtgtcgcattctacctcttcttttgtggctgctatgatattatgtttgggaaaaaccacttcttcatcttcctctttatccaatctttggccttcctcatcatggcatttggatatgttggcaccattgttcccaactcctaa

SEQ ID NO: 3393 - DNA, 567 bp, Glycine max var. Williams 82
atgcgttccagcaacggtacatcaagcagcagggcctccaacggtaacacagggcgccaccctgtttaccgtggagtgaggcgtaggagtagtggtaaatgggtttctgaaatccgtgagcccaaaaaacctaacaggatttggttagggacatttgccacccctgaaatggctgctattgcctatgacgtggcagcgcttgctcttaagggtaaggatgctgagctcaacttccctaactcggcttcctccctccctatccctgcatcatctgcagctcacgacattcagatggctgcagcactagctgcaaccgctgtcggagcagcgaatgatgcactggaaggaagccaaggaggaaatgtttcggtttcattggcggaagagttttcagggggaaacttaaatcactttgtggatgaggacttgatctttgacatgccgaatattctggtcaatatggctgaaggaatgctactcagccctcctcgttttgataattttgctgctaccgactatgaatacatggatgaagatcctaacctctgggggttccctaattactag

SEQ ID NO: 3394 - DNA, 564 bp, Glycine max var. Williams 82
atggctcaccaatcctcttcttctgaatctgatgaccgccagattccttctcatcatcagccattggacctaaacagtccccatccttctaaagatatcatcttcaacaacaacatggaactacaacaagaagagagcaaccttaacaagcatgaatatgatgaagatattagagataaagataaggatgttgttactacacaaaacccatctgcagcttcagaaacgacccttctttgttgcaacgaggagaatatggcattacaagaagaagagacttcagatgttgcagcagcaaaagaagaagaagaagaagaagatagtggacgcgagaggctgaataggcatagagttgaagtggctgggagggtatggattcctgatatatggggtcaggaggagctattgaaggattggatagattgcactgcatttgatgctactttagttccaagcagaatctccactgcacgagaggctttggttcaagagtgtacaagagccaattctgctggactaagaatagagaacagggaaaagacagttacgtataattcggattaa

SEQ ID NO: 3395 - DNA, 828 bp, Glycine max var. Williams 82
atggcaacttcaacctctgcactcaataaaaggctggaaggaaaagttgcactgatcacaggaggagctagtggcatcggcaaacgcactgcagaagtgttcgctcagcaaggagccaaagtagtgatcgctgacatccaagacgaactgggacattccgttgctcagtccatagggccatcaacatgttgttatgtccattgcgatgtcaccgatgagaaccaaataaaaaatgccgtccaaaaagccgtagatgcttatgggaagctagacatcatgttcaacaacgccggcattgttgatcccaacaagaaccgaatcattgacaacgataaggcagatttcgaacgtgtcctaagcgtcaatgtcacgggtgttttccttgggatgaagcatgcggcgcaggcgatgatcccagcacgcagtggtagcatcatctctacggccagcataagctcctacgttggtggtgcagcctcgcatgcttactgttgtgctaagcatgctgtggttggtctaactaaaaatgcagcagttgagcttggacagttcggaataagggtgaattgtttgtcaccttacgctcttgctacacctttggccaccaagtttgttggagctaatgatgaggagcttgagactatcatgaactcactggctaatctcaagggtgtcactcttaaagctgaggatgtggctaatgccgcactttattttgctagtgatgattccaggtacgtcagtgggcaaaatttgctcatagatggaggcttcagcattgttaatccttcctttcacatgtttcagtacccggactcggagtcttga

SEQ ID NO: 3396 - DNA, 1150 bp, Glycine max var. Williams 82
gactttggcattggcctacctcaccgttgctatttaatggtagcattaagctaaagcttgtctgtaatttcatatcgtaacaggttgttccttctatccctttcttttggtcttaggtcatatatcaatggcaacttcaacctctgcactcaataaaaggctggaaggaaaagttgcactgatcacaggaggagctagtggcatcggcaaacgcactgcagaagtgttcgctcagcaaggagccaaagtagtgatcgctgacatccaagacgaactgggacattccgttgctcagtccatagggccatcaacatgttgttatgtccattgcgatgtcaccgatgagaaccaaataaaaaatgccgtccaaaaagccgtagatgcttatgggaagctagacatcatgttcaacaacgccggcattgttgatcccaacaagaaccgaatcattgacaacgataaggcagatttcgaacgtgtcctaagcgtcaatgtcacgggtgttttccttgggatgaagcatgcggcgcaggcgatgatcccagcacgcagtggtagcatcatctctacggccagcataagctcctacgttggtggtgcagcctcgcatgcttactgttgtgctaagcatgctgtggttggtctaactaaaaatgcagcagttgagcttggacagttcggaataagggtgaattgtttgtcaccttacgctcttgctacacctttggccaccaagtttgttggagctaatgatgaggagcttgagactatcatgaactcactggctaatctcaagggtgtcactcttaaagctgaggatgtggctaatgccgcactttattttgctagtgatgattccaggtacgtcagtgggcaaaatttgctcatagatggaggcttcagcattgttaatccttcctttcacatgtttcagtacccggactcggagtcttgatttttgtctactatgaagaagcaagagtaattaataagggctcatatagattgagctatagtgcttgtgggattgggctttgattgtaaaacatacgggtgtttaaaaatgttgaactgaaccaaattgtgtgaaatcatcctatttaatttgtttcaattcaagtttactataacattttattgtttcgtgctt

SEQ ID NO: 3397 - DNA, 576 bp, Glycine max var. Williams 82
atgtctggctccagaaagaagcttcttctgaacaccgtgtccgtgaaactaggctgcggcacctgcagaagaccaaacctgtgtcgcatattccacccgaagccaaaacccaagaatcttaacaacacttaccgaaagcacaaacattcttcttcttcttcttcctttttttcaggccaatggggtggtgaggacaagtgtgacagcaccagcaccacccccacccccacccccaccaacaccacattctcaccctacgttgattcctcgcacttttctgactcagattcgtacgtgaaggccgtggggggtttaggcagagctgggaaagaaggtgtggctgtggagaaagactctgatgacccttatcttgatttcagacattccatgctgcaaatgatattggagaatgagatatactccaagcaagatctcagagagcttctcaactgctttcttcagctgaattcaccgcaccaccatggtgtcatagtcagagctttcactgagatctggaatgctgttttctctgtgaggtccagttcacacatcaaccgtaagccacgtgagttctaa

SEQ ID NO: 3398 - DNA, 1413 bp, Glycine max var. Williams 82
atggctcctccttcttcttattacattattctctttctattactatctcttctctctcacacagcattcactttctccaactccatcactctccctctctcccctctcctcaccaaacctcattcctcagactcagatccattccactctgtcaaactcgccgcttcctcttccctaacccgggcccaccacctcaaacaccgcaacaacaactccccctccgtcgccacaaccccagcataccccaaatcctacggtggatactccatagatctcaacctcggaaccccaccccaaacctcccctttcgttctggacacaggtagcagcctcgtatggttcccctgcacctcccactacctctgctcccattgcaacttccccaatatcgaccccaccaaaatccccaccttcattccgaaaaactcctccaccgccaaactcctcggttgcagaaaccccaaatgcggctacctctttggccccgacgttgaatctcgctgcccccaatgcaaaaaaccaggatcccaaaactgttccctcacgtgcccctcctacatcatccaatacggcctaggcgccaccgcaggcttcttactcctcgacaaccttaatttccctggaaaaaccgttcctcaattcctcgtaggttgctccatcctctccattcgacaaccctcaggaatcgccggcttcggtcgcggccaagagtctctcccctcacaaatgaatctcaaaagattctcttactgcttagtttcccaccgcttcgacgataccccgcaaagcagcgacctcgttttgcagattagttccactggcgacaccaaaactaacggcctcagctacacgccgtttcgctcgaacccgtccaacaactccgtgttccgtgagtactactacgtgactcttcgcaagctcattgtcgggggcgtggatgtgaagattccgtacaagtttttggagcctggctctgacggtaacggcggcaccatcgtggactctggatccaccttcacgttcatggaaaggcccgtttataatttggtggcccaagagtttctgaggcagctggggaagaaatattccagggaagagaacgttgaggcccaatctgggttgagtccctgctttaatatctccggcgtcaagaccatcagtttccccgagtttacttttcagttcaaaggaggcgccaaaatgtcgcagccgcttctgaattatttctcgtttgtcggcgatgccgaggtcttatgtttcaccgttgtctccgacggtggtgccggtcagccgaagaccgccggtccggccatcatcttggggaactatcagcagcagaatttctacgttgaatatgatttggagaatgagaggttcggatttggtcctcgtaattgcaaaaggaaagcttag

SEQ ID NO: 3399 - DNA, 2462 bp, Glycine max var. Williams 82
gccatataaaatgtttttactcctcgtatatataatgcaaacatacgaatatgatagcatttgaatacaacagttaaatacttaaattttacatcgattatgacaatttaggactaaaatgaaaaagtgagtgtgattgtgaagaaaataacccaaaacgacaaagtatcgataggtatagaaacggtaggaaacagatgacagtgtgactgtgtgaggctgtgagcagttgagttgagttgagttgagtttgagtccagcgttgccgttgatggcaagttttgttaaattccatccccgtcaaggtcaaatctcactgccacttccatttataaaggaacagggttgaagaacatacaccaccttcattctatcttcaatggctcctccttcttcttattacattattctctttctattactatctcttctctctcacacagcattcactttctccaactccatcactctccctctctcccctctcctcaccaaacctcattcctcagactcagatccattccactctgtcaaactcgccgcttcctcttccctaacccgggcccaccacctcaaacaccgcaacaacaactccccctccgtcgccacaaccccagcataccccaaatcctacggtggatactccatagatctcaacctcggaaccccaccccaaacctcccctttcgttctggacacaggtagcagcctcgtatggttcccctgcacctcccactacctctgctcccattgcaacttccccaatatcgaccccaccaaaatccccaccttcattccgaaaaactcctccaccgccaaactcctcggttgcagaaaccccaaatgcggctacctctttggccccgacgttgaatctcgctgcccccaatgcaaaaaaccaggatcccaaaactgttccctcacgtgcccctcctacatcatccaatacggcctaggcgccaccgcaggcttcttactcctcgacaaccttaatttccctggaaaaaccgttcctcaattcctcgtaggttgctccatcctctccattcgacaaccctcaggaatcgccggcttcggtcgcggccaagagtctctcccctcacaaatgaatctcaaaagattctcttactgcttagtttcccaccgcttcgacgataccccgcaaagcagcgacctcgttttgcagattagttccactggcgacaccaaaactaacggcctcagctacacgccgtttcgctcgaacccgtccaacaactccgtgttccgtgagtactactacgtgactcttcgcaagctcattgtcgggggcgtggatgtgaagattccgtacaagtttttggagcctggctctgacggtaacggcggcaccatcgtggactctggatccaccttcacgttcatggaaaggcccgtttataatttggtggcccaagagtttctgaggcagctggggaagaaatattccagggaagagaacgttgaggcccaatctgggttgagtccctgctttaatatctccggcgtcaagaccatcagtttccccgagtttacttttcagttcaaaggaggcgccaaaatgtcgcagccgcttctgaattatttctcgtttgtcggcgatgccgaggtcttatgtttcaccgttgtctccgacggtggtgccggtcagccgaagaccgccggtccggccatcatcttggggaactatcagcagcagaatttctacgttgaatatgatttggagaatgagaggttcggatttggtcctcgtaattgcaaaaggaaagcttagatttagtatttgaaaattaacacaccagaggttcccaattcgattcacataacgtccacaacattgtttggtggtcatagtttattattactatattatttatttgtcgcactcattgatttttttctttttcttaaatgcgtaattgcatgaacagagtagggatgtttagaatgatttcaaataaattaagatatatgattagttcatcaagtgtatatgaaggaagatggttgatgctaaccgttatttggtttcatgtgtgagttttagctaaaggagcatttttgagaatgggatggattcctttccatgttctttcataaagttgtctttcatcatgttaatgttaggggagggtaagataaagcgtagggctctttattcttgcattatttgtggtttttgtttgtcttctagaacgctgcgaaggagccttgcttgctatttcgtacaaatatgcaaaaagcaataatattatctgtggatgatcaccgacagagattctctacttttttatattaatccgcatgcagtttttttataaacagcagcttaagttattctctactttttttttctctctctacatcagaacaattgtatcaagcctctattcgtcttgaactactaattgaaatattaaattaagcttaatttttcgttttga

SEQ ID NO: 3400 - DNA, 684 bp, Glycine max var. Williams 82
atggccgataagcaaccccacctgaacggtgcttattacggtcccgccattcccccggcggagcaaccacgctaccgccctcaccgcgaaagaagctgctgctgctgcctcttcggaatcttgtggaagattctggttgcactcattgtcctcgttggcctcgcagtactcatattctggctggtggttcaaccccgctacttcaagttctacgtcacggaagccgacctaacacaatttgattactatagcaacaacaacaccctccactacaacatggtcctcaacttcactgcacgcaaccccaacaagaagctcagcatatactacgacaaggttgaggcattagcattctacgaggatgtcaggttcgccaattacagtgtgataacgcccatgaactccttccggcagtacaagaagagcagcagcaccatgagcgctgttttatcggggcagcaagtgttgccgctcgacaacgacctagtctcagagttgaaccaagacaagattggtggggtgtacgagatctatgtgaagctctacttcaggattaggttcaggctcggggatgtcaaaacccgtcgcttcaagcccaaggtcaaatgtgatgcgaaggttcccttgaggaccatgggcaacgtaactctgtttcagaccaccaagtgtgatgtcgattactag

SEQ ID NO: 3401 - DNA, 975 bp, Glycine max var. Williams 82
atgggttccctccctcacgtagtagaggattgcatgggcttcctccaactctatagcgacggttccattttccgttccaacggcatagaattcaaagtttcacccattcaagacaactccataacctataaggattatctctttgacaaaagattcaacctttctcttcgcttctacaagccccaacaacaacacatagcactcagcaataagaaggtccctattgtgattttccttcacggtggaggcttttgcttcggttcgcgcacctggccccatattcacaactgttgcatgcgcctcgcgtcggggctccaagcggcggtggtttcgccggactaccgtctcgcgccggagcaccgtcttcctgctgcggtggacgacgccgtggaggcggtgaggtggctccagaggcagggcctgagcttgagggaggacgcgtggttgagtgggggcgttgactttgaccgcgtcttcgtcgtgggtgactcgtctggcgggaacattgcgcaccacctggcagttcggttggggtccggttcgagagagatggacccggttcgggtacgaggttacgtcttgtttgcgccgttttttggcggggaggttcggaccaagtccgaggaaggtccaccagagcacatgttgagccttgagttactagacagattttggaggctttcgatgcctgttggaaagagccgagaccacccattggcgaatccgttcggacctggaagcccaaatcttgaacaagagaagcttgatcctattttggtgatagtaggtggcaatgaattgctcaaggatagggcaaaaaattatgctacaaggttaaaagaattagacaaggacattaaatacgttgagtttgaggggtgcgagcatgggtttttcacgcatgattcattctcatcagaagttgcagaagaggtcatccaaatccttaaacgattcatgcttgcaaacttctag

SEQ ID NO: 3402 - DNA, 1413 bp, Glycine max var. Williams 82
tataaaaagtcgccctgcctcacagacagaacttcaattcaatgtcatgaaaccctaattggcttcgctgttaattgcaattcgcaatctttgcgagttgcgagactgagaattcagaaatttctcttttgttttgcatttttcatggcaaacgttgtattttgttgcaaatgaattggattatgaaatctagaaaggatggaggggattttgctttgttttaaataaaagaagagtgaatcgaattttgaggagtagctggtgatgaatgaattattggcatgagctgcgacaacgtttctgcgcaccgtgtattgtcacacgggttgttgttgcgatgaataatgtgccaaaatgctaatctgaggctctctctctcttttcattttagagctaaatgagaagacaagggcaatgttaaagttaattgaagaagatgcagattcctttgctaaacgtgcagagatgtattacaagaagcgaccagaacttgtgagcatggttgaggatttctacagggcacaccgctccctagctgagcgctatgatcaagtcaagcctgatactactggaattggacacctcattactggggggtcacctttcgcttcagcaaagtatcagttggagaagttgatgactttttcagataacggatatgatacctattctgagcattgtgatgtgtacgagtctgaggaatctgaagttgatgatcctgagcaggaggaggaggaagaagaggggaccaagtttctgcataaaagcacaaaaaaggagcaagttttgtttgtggttgcgggtgatgttgaagtgatgaagctgagggatgaaattaagagactcaatgaagagaacaaggctcaaagggatcaaatcaagcagaaggataccatttgtgatgaagtaatgatgttgagggaagaaatagaaaggcttagagatgagaatgaggcacaaaaggaacgactcaagcagaaggatgaagagaagattgaggtgataagacagctgagtttagcaatagatgtgctgaagcaggagaatgcaaagatgagaaactacattgctaaggaatccaccaagaaatggaagaacccatttgagatcaacaaacttgtggaagcattttcggtgaagttgttcagtggcactccaaagaatcagcccggtgttgagctctctagatgtggttaacaaagttagcagattgagtaattatacacaacaatatttataaagatgtctatatttatgttaggaacttatgacccaaaaagcctaggcttaaaatcttttattttatatattatatgttccttggttttgaatcctagtgtgagtacttgtcatattcattatattcttttgaatgtcctttctttagcgagttgtattacaaccaattgttac

SEQ ID NO: 3403 - DNA, 1887 bp, Glycine max var. Williams 82
atgggagtggtaactgttggtgaattgaagcccagcatttcaggaaaaaggacatttcgtccaagttcaagcataagacatgccactgaatggccaatatctgacgtctctagtgatcttaccatcgaagtaggagcatcaaccttcgcacttcacaagtttcctttggtttctcggagtgggagaattcggaagctgctgttagatgcaaaagattcaaaagttttacgcataagtctcccaaatgtgccaggtggtcctgaaggatttgaactagcttccaaattttgctatggaatcaatgttgagttcacactctcaaatgtggctttgctacgttgcacggcccattttcttgaaatgaccgaagagttcgcagaaaaaaacttagaggccagagctgaagcatatctaagagacacagtgctccctaacatatcaagcaccgtttatgttcttcactgttgtgaggctcttcgtcccatatcagaagaaataaaccttgtcaataagctaatcaacgcaattgcgaacaacgcgtgcaaagagcagcttacaactggtttactaaaactagatcacactttcccttctaaaaccacaccaaccatggaaccagaaacatcctcagattggtgggggaagtctttcaatgttcttagtcttgagttcttccaacgagttgtgtctgttgtgaagtcaaagggactaaaacaagacatgatcagcaagattttgataaactatgcacacggttctcttcaggggattcgtgttagagacccccaagtggtgaagggaagtcttcatgacttggaattgcaaaagaaacaaagggtggttgttgaaaccatagttagcttactcccaactcactcaaggaaaagcccggttccaatgggattcctctcaagtttgttgaaggctgcaatagcagcatctgcatcaactccttgcaaatctgatttggagaggcgaattagtctacaacttgaccaggcaattcttgaagacatcttaatcccaacaaactcacctcaaaactcccacaacacaatgtatgacacagacttaattctgaggatcttttctatttatcttaacacggacgaggaggatggcgaagatagcgataactacattgatgaaagccaaatggcgtatgattttgacagtcctggatctcctaaacaaagctcaatcataaaggtatccaaattgctggacagttatctcgctgaagtagcactagactcaaacttgttgccgtcaaaattcacagcacttgcagaactgcttccagatcatgcacgtatcgttagtgatggactctatagagctgttgacatcttccttaaggttcatccaaacatgaaggactcagagaggtaccggttatgcaaaaccattgattgtcagaaactgtctcaagaagcaagcagccatgcagcacagaatgaaagactaccggtgcagacggtggttcaagttctttacttggagcaaatgaggcttcgaaatgccatgaatggagggcacaaccaagtcttctttggtcagttccctcaccgttcaggaagcggtgcagggagtggagccatttccccaagagataactatgcatcggttagaagagagaacagagagctgaagcttgaagtagcaagaatgagaatgaggctcactgacttggagaaagaccacgtgtccatgaagcaggagcttgttaagtcacaccctgccaacaagttgttcaaatcatttaccagaaagctgagcaagctaaattctctattcaggataaacagcattaagccaattggtggcaaagctagttcagaaactcgcttcccttttccaaagcgaagacgccactccgtttcatga

SEQ ID NO: 3404 - DNA, 885 bp, Glycine max var. Williams 82
atggcagcaaagccagctgaagaagctcctcaaggagaaaccctcaagtaccagtcgtgggttttgaaagtattgatccactgcgatggctgcaaaaggagagtcaagaaaattcttcagggaattgatggggtttatacaacagaggttgattctctgcagcacaaggttactgtcactggtaacgtggacgctgagactctcatcaagaggctttcaagatcagggagggtagtggagctttggccagaaaaaccacctgagaagaaagataatcagaagtctgggaaatccaataaggggggtggtgatggtaataaagagaaggaagaccaaaagaatagtgaaccagatgctgatggtggtggttcaaatgagggttctaaagacgctcccggtgaagattctgacaaagaaggtcatagtgatgaatgtgaggagggaattggtggtggtggtggtgaaggtggcaaaaagaagaaaaagaaaaagaagaagaagaacaaaggggaaaacggtggttctgcatctgctcctcctaataagggaggaggaggagaagaaattagtaaagttgatgcattagtcccttcttcaaatttcttggctcctaaggatcttattagtcctccaattcagcatgcttacccatatccaccacatgtgtattattcacctcctccagcatatggattaagctataacacagcatatcctgtctctagtagtgcttcatattatgttggtgctcctatcatgcccatgcatgcttacactacttcatactctagactgccaccacctcctccaccatctgatccaatcaagcactatggtgaggatgaggatgagtatgaaggtggtggatattgctccattatgtga

SEQ ID NO: 3405 - DNA, 975 bp, Glycine max var. Williams 82
atgaagttctgcaaaaagtatcaggaatacatgcaaggccaggagaagaaacttccatgtgtaggattcaagaagctcaagaagattctgaagaagtgcaggagaaactcttcatccctgaaaccccttaatgcatcccttgccgccaaaacctgccccgaccattgcccagtgtgcgatgggaccttcttcccttcccttctcaatgaaatgtcagatatagtggggtgctttaatcagcgggcgcagaaattgttggagctacatctcgcttctggggtcagaaagtacttcttctggatcaaaggcaaattacaagggaaccatactgcactgattcaagagggcaaagatcttgttacttatgcactcataaatgccattgcaattcgaaaaatactaaagaaatatgataagattcattattccaagcaagggcaattgttcaagtcacaagtccagagtatgcacaaggagattcttcaaagtccctggctttgtgagcttatggccttccacatcaatttaagggaaactaaggtcaagtcaaggaaggcacatgctttgttcgatggatgttctctcacattcaaggatgggaaaccgtcacttacttgtgagctctttgattctatcaaagttgacattgacttgacttgttctatatgcttggacacagtgtttgatccagtttctctgacttgtggccatatattctgctatatttgtgcatgctcggctgcatcggtatctattgtcaatggacttaagtctgcagatcctaaaatgaaatgtcctctatgtcgtgagggtgcagtttatgaaggtgctgtgcgcttggaagaactaaatattctgttaagccgaagttgtcaggaatactgggagcagaggcttcagacagagagggtggagagggttaagcaaataaaggaacactgggattcacagtgtagggcattcgtgggcgtctaa

SEQ ID NO: 3406 - DNA, 297 bp, Glycine max var. Williams 82
atgactccttctttcactaacgtcaaaatcttctcttctctcgtcctagacggattcttcaacgctctcaccagacgcgggtacgcggtggcatcacaaagcgcaacaaaggaaggagtgggctttatgagcggcaagatggcaccaaagtcaggggaagacaacaaaggggtgtctacgtacaaggtttcgtgggtgccagatcctgtcactggttactacaaacccgagaacatcaacgagattgaccctgcagaattgcgcgcgatgcttctcggcaaaaaaatcgacaactaa

SEQ ID NO: 3407 - DNA, 459 bp, Glycine max var. Williams 82
atgaggtcttcaatcatatttctttgcattctggtgtatctgaacgtggtagctgcggaattgtcagcttacgacgttcttgagaaatacgatctcccagttgggcttcttccaaaaggtgccacagggtatgaattaaacgaaaaaaacgggcacttcacagcgtatttgaatggaacatgctacttcagcatagagtcgtatgagctaaagtacaagtccaccatcaagggagtgatctccaagggcaagttgtcgaagctgaaaggtgttagtgtgaagattgaagtgttgtggctcaaaatcgtggagctaactcgcgacggcgatgacctccaattctcggtgggtgttgcctctgctggcttcagcgtcgacagcttctccgagagcccccagtgtggctgtggattcgcttgcgacaatttcaatcaaaatggtgatgtttcttctctttag

SEQ ID NO: 3408 - DNA, 1848 bp, Glycine max var. Williams 82
atgccagcaaccaaccaccctatttatccacttcagacttcacactcaaccaaatcacagtatcacttaccgtcttcttcttcttcttcttcttcttcttcttcttcttcttcttcttcttcttcttcttctatatatatatatatatataccatgtatagccccattagcagaaaaaaaccaccaatggagtctcacgtagacaccattctctctgcaatttttgttctactcctttcttcgttaacccatttcagcatcaccgcaaatgcaacaagaacaccccaagaaaacagcctccatttccaagtagcaaactccacatgcgagggaacactctactccgacctctgtgtctcaacccttgcctcattcccagatctcacctcaaaaaccctcccacaaatgatacgctctgtcgtgaaccacacaatatacgaggtcacattgtcggcctccaactgcagcggcctccgaaggaacctcccgaaactcgacaaactcgaacagagagccctcgacgactgtctcaatctcttcgacgacaccgtttcggagctcgaaaccaccatcgcggatctctcacagagcacaataggaccgaagcgttaccacgacgcacagactttgttgagtggcgcaatgaccaacttgtacacgtgtcttgatggctttgcgtacagtaaagggcacgtgagggacaggtttgaggaggggctgttggagatttcgcatcacgttagtaactcgctcgccatgctgaagaaattgccagcaggagtgaagaaattggcgtccaagaatgaggttttccctggatatggtaagatcaaagacggctttccaacgtggctatcaaccaaggatagaaaattgcttcaggctgctgtgaatgaaacaaacttcaatcttcttgtggccaaagatggcactggcaacttcaccaccattgccgaagcagtggctgtggctcccaactccagcgcaactagatttgtgatacacataaaagccggggcatacttcgagaatgtggaggtaatcaggaagaagaccaatctgatgttcgtcggagatgggattggaaagactgttgtgaaggccagtaggaatgttgtggatggctggaccactttccaatcagccactgttgctgtggttggagacggattcatagcaaagggtataacctttgaaaattctgctgggccaagcaaacaccaagccgtggccctaaggagtggttctgatttctcagccttctataaatgcagcttcgttgcctaccaagatactctctatgtccactccctgcgccaattctaccgcgattgtgacgtttatggcacagtcgacttcatcttcggcaatgcagcaacagtgctccagaactgcaacttgtacgcacgcaagcccaatgaaaaccaaaggaacttgttcactgcacaaggaagagaagaccctaaccaaaacaccggcatttccatcttgaactgcaaggttgcagcagctgctgatttaatcccggtcaaatctcagttcaagaactacttgggtcgtccttggaagaagtattcgagaactgtttatcttaattcttacatggaggatctgatagaccccaaagggtggttggagtggaatggcacgtttgcattggatacgttgtattatggagagtacaacaataggggtcccggttcaaacacaagtgcaagagttacgtggcctggttatagggttatcaagaacgccactgaggcaaaccagttcacagttcgcaatttcattcaagggaatgaatggttgagttccaccgacattccattcttctctgatttcagttga

SEQ ID NO: 3409 - DNA, 2439 bp, Glycine max var. Williams 82
atgtctacgcaaccaaagcttggtcggattcccagtatcagagaccgagttgaagacactctctctgctcaccgtaacgaactcatttctctcctctccaggtatgtggctcaggggagagggattttgcaaccccataatttgattgatgaacttgacaacatccctggcgatgatcaagcaatagtggatcttaaaaatggtccctttggtgaaatcgtcaagtctgcaaaggaagccatagttttgcctccttttgtggcaatagcagttcgtccaagacctggtgtttgggaatatgtccgtgttaatgtctctgagctcagcgtggagcaattaagtgtttctgaatatctcagcttcaaggaagaacttgtagatggaaagattaatgacaattttgtattggagcttgattttgagccatttaatgccacatttcctcgtccaactcgctcagcatccattggcaatggtgtccaatttctcaatcgccacctttcatctattatgtttcgcaacaaggattccttgcagcccttgcttgatttcctccgagctcacaaatacaagggccatgctctgatgttaaatgatagaatacaaaccatttccaaacttcagtctgcattggccaaggctgaggattatctctctaagcttgcacatgatacactctattcagagtttgaatatgtattgcaaggaatgggttttgagagaggttggggtgatactgctgaacgggtattggaaatgatgcatctgctattggatattcttcaggctcctgatccttctacactagagacttttcttgggagagtaccaatggtattcaatgttgctatattatctcctcatggctactttggacaagccaatgtcttgggtttgcctgacactggtgggcaggttgtttatatactagatcaagtgcgtgcccttgaaaatgagatgctccttcggatcaagaaacagggacttgatttcactccaagaattctaatagttaccaggttaatacctgatgcaaaggggacaacatgcaaccagcggctagaaagagtcagtggtactgaccatactcatattttgcgagttccattcagatcagagtcaggaactctccgtaaatggatttcaaggtttgatgtgtggccttatctagagacttatgcagaggatgttgccagtgaaattgctgctgagttacaagggtatcctgatttcatcattggaaactacagtgatgggaatcttgttgcatctttattggcttataaaatgggagttacacagtgcacaatcgcgcatgcacttgagaagacaaaatatccagattcagatttatattggaagaaatttgaggataaataccacttttcatgccaatttactgctgacctaatagccatgaataatgctgattttatcatcaccagtacataccaggagattgcaggaacgaaaaatactgttggccagtatgagagccacgctggttttactcttcctgggctctatagggttgtccatggcattgatgtttttgatcccaagttcaatattgtctctcctggagctgatatgtcaatatatttcccctactctgaaaagcagaacagacttacagccctgcatggttcaattgaacagctattatttgctcctgagcagactgatgaatacattggtttattgaaagacaagtcaaagcccataattttctccatggcaaggctagacagagtaaaaaacataactggattggtagaaagctttggtaagaacagcaaattgagggaactggtcaaccttgtcatagtagctggttatattgatgtaaagaagtccagtgacagagaagaaattgcagaaattgagaagatgcatgagctcatgaaaaagtataacttagttggtgattttcgttggattgctgcccaaacaaatagggcacgtaatggggagctgtatcgctacatagcagacacacaaggtgctttcgttcagcctgctttctatgaagcttttggacttacagttgtggaggccatgaattgtggactccccacttttgctacttgccatggtggtccggctgagatcattgagcatggtatatcaggattccacattgatccttatcaccctgatcaagcttcacagctattagttgaatttttccaaaagagcaaggaggacccaagccattggaagaaaatatctgatggtggtcttcaaagaatttatgaaaggtacacgtggaagatttattccgaaaggcttatgactttggcgggagtttatagtttctggaaatacgtttccaaattagagaggcgtgaaactcgacgatatcttgagatgttctatatcctcaagttccgtgatttggcaaattctgttccgctagctaaggatgatgcaagttaa

SEQ ID NO: 3410 - DNA, 444 bp, Glycine max var. Williams 82
atggaaggtatctcagtgggtttgaagaagtactggagaagaagcattaggggataccaaagattacacgtctcggatcggcgaaagaaggaaacggttcagcttggaggcagccagagaaggaggagatggcgcataaagttagctcgtaagatcagaattcccaaaatctcttctccaaagaaattggtgctgtgggtcagagacgcctacgtcaggatgatgctgggtatggctaactccatgggtgcctccgccgtcggctacggcggagacgccgcgttcaccgccaagggtggattcgagagggccccaccgcccaaggagtacgaccagaagatgatcatacatatgtacaagtccttgattatggcacagggacagttgctgccgcgagattcaacacccaaacctgccacaacaacaatggttaccacattctga

SEQ ID NO: 3411 - DNA, 1626 bp, Glycine max var. Williams 82
tagtgatatatttatctttatatttctatgaattatcttttgattagcaaaatctatgaggacaagatggtatttcagtccaaggccgacaaagttttcgactcaaacaatactttcagaagtatctatattttcttaagacgagtgcgattaatttgaaattgcaaactgtccttttttataaactataaaatttaaacatatgttatgtaaatgttaattgaggatatagatacgtggcagttaattacagcctaataattattttttttgcaaatatttttattaatactgttcataatcttttctataccagactttttttttcaggtacataaaatttcgatcattgatattatccattttgcattctttttctgtaactcttttttttattattacagtgtagtattatttctcacatttattatttttgtttcctcttttattaatttgtttttctttatagatatctacacttatagtgtctaccgaatatatatatataaagagcatgagcatgtaccaaacttgattgcctcgcctccttacattctgacccagcttggctttcatacttgttttgtgtggcagagcaagagagagcgcaatggaaggtatctcagtgggtttgaagaagtactggagaagaagcattaggggataccaaagattacacgtctcggatcggcgaaagaaggaaacggttcagcttggaggcagccagagaaggaggagatggcgcataaagttagctcgtaagatcagaattcccaaaatctcttctccaaagaaattggtgctgtgggtcagagacgcctacgtcaggatgatgctgggtatggctaactccatgggtgcctccgccgtcggctacggcggagacgccgcgttcaccgccaagggtggattcgagagggccccaccgcccaaggagtacgaccagaagatgatcatacatatgtacaagtccttgattatggcacagggacagttgctgccgcgagattcaacacccaaacctgccacaacaacaatggttaccacattctgagaatcttttttagctttttttatttattattattactataaaaatttcactttgtttttattttactctttaaatatttgtataaaatagtaaaagaaaaaaagaacactgtttttactattttataaagagccacttacttcatggatcaactgcgcatgtgttgatctggtagagatatccatgatttctaaaacaatacaaataatattggaaaaaaatgaaaatgaagttgtatttttattataatttagataacaattaaatgtaaaaataaaaaaaattatgtcaaactaagtttggcttaacttctctccttctcccccacgcttcatattccaatctttccttcttttccattttgttttttttttaattttacttggatttttgcttttaattttttaataaagttgtattgcatcaactacctggattcttcccttcccaattagacgtggattgtaattaatgacgtcgttagatcatgatgttaccatatgtgtagcttggttgctatatgattgcttaaatatgtggatcagagggagtttgtttaaatttgaaataaa

SEQ ID NO: 3412 - DNA, 474 bp, Glycine max var. Williams 82
atggagagaaaagagcgaaagataatggtgggtgtggatgagagcgaggagagcatgtttgcactgtcctggtgtatcaccaaccttattgccgatacccccaacgttaaactagtgctcctctatgtcaagccacctcctcctgttcactccttcaatgttgcatggtattccagtcatgctatcttagctatggaacaacacggcaaggatttggctaattcagtaatggaaagagctgaagccatttgcaaggacttcaaaaccacaaatatgaaaaaggagagagtagttgggtgcggagatgccaaggatgtgatatgcagtgcagttcagaaacttgaggctgataccttggtcttgggaactcatggttatggattttttaagagggcacttattggaagtgtaagtgattattgtgccaagcatgcagagtgtactgttgtagtcgtgaagcaaccatgtccataa

SEQ ID NO: 3413 - DNA, 2583 bp, Glycine max var. Williams 82
atggctcctccaaacaatccagtgaattccaccttgggatttaagtcactggaaaaggtttttgatttatgtgacgggaaattcaccgtgagaggtgtgccattactctctcaggtacccaataacgtcactttcagttccttctcctcaatctgtgaaccccgtgacgccccaccttccatccttcaacgtgtcattgccgtgtcacacaaaggtggcttcttcggattctcccaggtttctccctccgacagattaacaaactccttaggtagtttcagtggcagaaacttccttagcatcttcaggttcaaaacatggtggtctacccagtgggtaggaaattccggttcagaccttcaaatggaaacccagtgggtcctcatagaaatccccgaaataaaatcctatgttgtaatcattcccatcattgaaaaatctttcaggtccgcacttcaccctggctctgatggccatgtcatgatttgtgctgagagtggttcaactcaagtgaaagcatcgagtttcggtgcaattgcttatgtccacgtttctgagaacccttacaacgtgatgaaagaagcctatagtgttctcagggttcacctcgattcgttcaggttgttggaggagaaaacggtgccaaaaattgctgacaagttcggttggtgcacttgggatgcgttctacttaaccgtgaaccctgttggggtttggcatgggcttaaggattttgccgagggtggggtggctccgaggtttgttatcattgatgatggctggcaaagtgtgaattttgatggtgatgaccccaacgtggatgctaagaatcttgttcttggcggggaacaaatgactgcgaggcttcatagatttgaagaatgtgacaagtttggaagttaccaaaaggggctccttttgggtcctaatgctccttcttttaacccaaagacggttaaggagttgattgcgaaggggatagaagttgagcgtttggggaagctgcgtgatgaggctgtttcgtctggggtttctgatttgagtttgaccgagattgagtcgaggattgtgaaggtgaaaaaggaaattgatgatctctttggtggggagggaaaggagaacaaagaattatgtggagggtgttgttgcaaagcaaatgagtgtggtgggattaaggctttcataagggacttgaggactgaattcaaaggtttggatgatgtctatgtgtggcatgccctttgtggctcgtggggtggtgtgaggccaggagccacacacttgaattccaaaataacaccttgcaaactctcccctggccttgatgggaccatgcaagatcttgctgtggttaaaatagtggaaggttccataggacttgttcatcctgatcaagctaatgacttgtacgattccatgcactcttatcttgcccaatctggtgttaccggagtcaaaattgacgtctttcatagtcttgaatatgtgtgcgaggaatatggaggcagagtcgagcttgcaaaggcttattacgatgggttgacaaactctattgtcaagaattttaatggaagtggaatcatcgctagcatgcagcagtgcaacgactttttcttccttggaaccaagcaaattcccatgggaagagttggggatgacttttggttccaagaccccaatggggacccaatgggagtgttctggttacaaggggtgcacatgattcactgtgcctacaacagtttgtggatggggcagatgattcagcccgattgggacatgttccaatcggatcatgtgtgtgccaaatttcatgcgggttcgagggctatttgtggcggtcctgtctatgtaagtgacagtgtgggctctcatgactttgatctcattaagatgcttgtgttccctgatggtaccgtgcccaaatgcatacattttgcacttccaacaagagattgccttttcaagaaccctctctttgaccaaaaaaccgttctcaaaatttggaacttcaacaagtatggaggagttattggtgctttcaactgtcaaggggctggttgggaccctaagatgaagaagatcaagggtttctctgaatgctacaggccaatttcttgtactgtgcatgtaactgaggttgaatgggaccaaaagaaagaagcagttcacatgggtaaggcagaggagtatgtcgtgtatctcaatcaggctgaggaactgcatttcatgaccccaaagtctgaaccactccaatttactattcaaccttccacttttgagatctacaactttgtcccagttgaaaagctaggtggcagcatcaaatttgcaccaattgggctcacaaacatgttcaacagtggagggacaattcaagaattggagtgtgttgagaagggtgcaaaggttaaggttaagggtgatgggagattccttgcttactcaagtgaatctccaaagaagttccaactgaatggttctgatgttgcttttgagtggctccctgatggaaaactcactctcaaccttgcttggattgaagagaatggcggggtttctgatttggcaattttcttctag

SEQ ID NO: 3414 - DNA, 873 bp, Glycine max var. Williams 82
atggagaataataagatgatgggtgtgaagaaagaggactatgctgccaatataggatcttcatccctcccttcttgtaataattatccattctttgatttctctgaagataagggctctttagggtttatggagctattgggtgtgcaagactacaatcatctccttgatttccctctatcgtcacacgtgtcagtgcctcaaacctctgcggttaaggaaccacctgagactaagaaagagtgttccgaggtaaccaacaaccagcaaccgacgactccgaactcttcatccatttcctccgcgtccagtgaggttctctatgatgaacagaataaaactgtagacctagcacctgaacaccaaaagacaaaggaacagttgaaggcaaagaagacaaatcagaagagacagagagaaccgagattcgcgttcatgacgaaaagcgaggtggatcatctggaagatgggtacagatggagaaagtacggtcaaaaagctgtgaaaaacagcccctttcccaggagctactatcgttgcaccagtgtttcatgtaatgtgaagaaacgcgtggagcgatctttcagcgacccaagcattgtggtgacaacctacgaaggccaacacacgcatccaagcccagttatgggtcgctccaacaactttggtacggtaatgtctggatctgctggaaactacatgtcccaatattatcatcagcaacaagtccacgtcaatgcattgtcttctttgggtttcctctcttcttcttcgtcttcaaggaatgccactttttctcaagagactgccttgttaagtgactatgggcttcttcaagatgttgttccttcacatatgttgaaagaagactag

SEQ ID NO: 3415 - DNA, 717 bp, Glycine max var. Williams 82
atggatgttaataaggtgaagaaagcacggtccatagtgctggattgtgaagaagaaatcagaaaaggtccatggagcgttgaagaggacaccattctccaaaatcacgtcgccacccacggcgacggtcgctggaattccctcgcacgctctgcaggcctgaaaagatcggggaaaagttgcaggttaagatggctaaactacttgcgtcccgatgttcgtcgcggaaatataacactccaagaacagataactattctggagctccactctcgctggggcaataggtggtcgaaaattgctcggcatcttccgggtagaacagacaacgaaataaagaattattggaggacccgagtgattaagcaagcaaggaatctcaattgtgacgtggacagtaaacagttccaagatgctttgcgttgcgtgtggatgccccgtttgatagagcggattcagccaccattaccaataccatcggaattaactcacggcccggcccatattgccacctcgcaacttggcccaaacccaaccgctcaggcccaacatgagtttcatggttccttggagttaaacgctcctttagattctgaacatcatgtttggggtgcatgccactgtttcaatgggaatagcacgttacctttaggtggtggggacttgatggaaagtttgtgggatgatttggaaattaaacacaatttccttgcgtga

SEQ ID NO: 3416 - DNA, 719 bp, Glycine max var. Williams 82
cactcaacaatatatgtgatcaaaaaataaaatgaaaaagaatgtggtttttgttaatctgtaacttttgttttatagggtttaatgttgaaactgtggaatacaagaacatcagcttcactgtctgggatgttggtggccaggacaagatccgtcctctgtggagacactacttccaaaatacccaagggcttatctttgtggttgatagcaatgaccgggatcgtgtggttgaagctagggatgagctgcacaggatgttgaatgaggatgagttgagagatgctgtgcttctagtttttgcaaacaagcaagatcttccaaatgctatgaatgctgctgaaataactgataagcttggtcttcattctcttcgtcagcgtcactggtatatccagagcacatgtgccacatctggtgaagggctttatgaagggcttgactggctctcaaacaacattgcaaacaaggcatagtgattatcggtcatgggttgcatcaaagttcatttgagtttagcggttgtgacttccaatgtttgatgtgcttaccctgtttagaatcttattttctctagcatgtattatttgtcttcgataaagaacagattgtctactacctaatatcaaaataatttgcattttttctccgtgtataaccaaaaggcatttgtcttacccatcgatttgtgaagtcaatttatcattgaaatttttaca

SEQ ID NO: 3417 - DNA, 1828 bp, Glycine max var. Williams 82
tttcttctacctcttctctctctgcatctcactaaatacatacatacatggacaacccacaccaccgtcaattgaccttcttcctcagccatagtatagatcacacagatcctccttctgtcaaagaaatggatttcttctcaacttcatcggcacctgatcataaaaataacactagtaccagtgataccaatgatgattatcagaagcgtgatgatcaacatgacactcatgatcgccatggaagcatcaccgccgatggatcaccaacacgcgccactgaccaccatgtaaacactggactgaatttaacttgtgcaagtgctggaatgacaaaatcagacaatagtgaaaatcctgaaactgagctgagttctcttgaaaaccaattggggaaactacaagaagagaatagcaagttaagaagtgtgctggaccagataaccaaaaactatgcccaactacaagctcagttgttcaacgccttgcaaaaacaaaagcttcctaagaatgtggaaacaaaaattgtggacccaggagcaagcacgaaattagacgtggtcaataatgcatcggtttcggatgaaaagactgatcaagatgtatcggtttatcgttcaaacaacgcggaggcttgtcctgatgctgcagaagatgttcttgaccggtcctcttcacagagttggggatcatccaagttagaggaacaacccaaaactgcagaacaacttcctgcagaacagattcctctcagaaaagccagggtttccgtccgtgctagatcagaagctcccatgataagcgatggatgtcagtggaggaaatatggacaaaaaatggccaagggtaacccttgccctcgtgcttactatcgctgcactatggctgtaggatgcccggtccgaaaacaggttcaaagatgtgcagatgacaaagcagtgttgataacaacctacgaaggcaatcacaaccaccctttgccgccggccgccaccgccatggcaaatactacgtcagcagccgcagccatgctgctatcaggttcggcagccccaagcaaggaagcgctaacaaactctgcaggatattactcttcttcttcaattccctatgcttcaatggcaaccctatcagcttcagctccattcccaaccatcactctcgacttgacccaaaaccccaacaacgccatgcagctgcaccgagtaccagcaggccatggcgccacgttccctctgccactgcatgcggcagctgctggtccccacctactaggtcaccccttgttcttccaacagaagcttccaccggcagcattaatgccccttcttcaacgacaaccttcgtcgtcgatggtcgaaacggttagtgcagccattgcttcggatccgaacttcactgcagctttgatggcagcaatctcatcaatcattggagtaccaagaagcagtgatgataataacaatggaaatggtgctattccagggtcaccacagcttcctcagtcatgcactactttctccaccaactagcggaattttgagaaactatatacttaatttctctatgtatatacacaacttaaaagagaagattaggcatgcgcggtgtttactgtttttatttacttatatgtaaaacagattaattaagagtcacctctgattctgaatgcatgactctataaacacaaatcgtttgaacctcaagttcgacttgcaggagtgtgcatgtaagttgatgcttttggtacaatagtctggatataacttatgttatatacgtcacagatttgcaatttaattcccatgtgatttttttaattaag

SEQ ID NO: 3418 - DNA, 1869 bp, Glycine max var. Williams 82
gggaccgacagtgaaggaaggactgttgctgctgctcacacacatacatacgagctagctagacaggatatgtgtccgattccgtaataaaaaatgaaaatgatcaataatccttgtttctgtttctgtataaataaataacaaaacagacgagtgagtgaatagtgtgattaagcttttgaggttgttgcgagaaatgagaatgaagaagctgattttaatactcatagcagcatttaccttcgtttctgtggctagatctgcgtctgatcatttcttcgaaaacgatggcgtttcactggcagttgctgcaacgcccggacctccacctctcatggtccccctcactcttattcagggagctgcttccaaaggagccgtctgtttggatggaacattgcctggttaccactttcatcctggatttggatctggggcaaatagttggctcattcaattggagggaggaggatggtgtaataccatcagaagttgtgtctttagaaaaactactcgtcgtggttcctcaaaatacatggaaaaacaactagcattcacagggatattgagcaataaagctgaagaaaaccctgatttctttaactggaacagagttatagtacgttactgtgatggggcatctttcagtggagatagtcaaaatgaggctgcacagcttcaattccgaggacaaaaaatatggcaagctgcaatgcaggaattattgttcaagggaatgcagaaggccaaccaggcccttttgtccggatgctctgcgggtggtctggcatctataatacattgtgatgagttccggagcttgtttcctacatctaccaaagtgaaatgtttgagtgatgcagggtttttcctagatgcggttgacatatctgggggtcacacactgaggaatctgtttggaggtgtagttaaattacaggaggtgcaaaaaaatctgccaaacagttgtctcaaccaactggacccaacttcgtgcttttttcctcagaatttgatcaaccatgttgaaactccattgtttctactcaatgcagcttatgatgcatggcaggtccaagaaagtttggccccacattcagcagatccccatggctcttggaatgattgtaaatcaaatcatgcacgctgtaactcatctcaaattcagttcctccaagacttcagaaatcaaatgctaaatgatgtgaaaggcttctcagggacatctcaaactgggttattcataaattcttgttttgctcattgccagtctgagagacaagatacatggtttgctgatgactctccactaattaacaacatgccaattgcaattgctgttggagactggttttttgatcggaaaactgtcaaagctatcgactgtgcttacccctgtgacaatacatgccataatctggtcttcaatgatgatgacacacctaccaataccatgaccatgatatattcccgctccacaaggctgacttttagtagtggcctatatatgctaagtattttattgccatttacatgttcctagtgcactatggatagtttcagcccagaaaagcaaatgcactataggcaggttcgttagtccctattcaatcttccatttaagccacttatggttatctgtgtcagctattaattacaggtcaagacctggattcagcaatagatagtttaggacttgaagaaccaatttggttaaggaaaaacaacctgtaactatgtaggtacctcctccgatcttctaaatattttagcgaattgcacagttcactttgtaatctcaagtttgttataatggagtttaagaaatgatttagtgaaatttgaattacatcaaggtgctatatataa

SEQ ID NO: 3419 - DNA, 1266 bp, Glycine max var. Williams 82
atggcaagagtggtggcactccaacagaaccaactatctttctctcccttagcttcctctctttttgacttcagtggaaccagacttcaaactcaacttcagttcaagagaaaactatgccatccaaaagggtctttctacgtctcggcatcgagcaccaagaaaatcctaataatgggaggcaccaggtttattggtgtgtttttatctaggctccttgttaaagagggtcaccaggtgactttattcacaagaggtaaagcgcctgtcactcaacagttgccaggtgaatcagacaatgattatgctgatttttcttccaagatcttgcatttgaaaggagacaggaaggactttgactttgtaaaatccagtctctcggcagagggatttgatgttgtttatgacataaatggtgtgcaaattcctacttgttcacaccttctgtgcttatttttcacctacaatttcataatatatgttactcttcgggttcaaatcaccatttttcataacatatctctcttcataatatatttttcaggacgtgaggcagatgaagttgagcccatactggatgcgctgcctaatctggaacagtttatttactgctcttctgctggtgtctatctcaaatctgatctattacctcatgcagagacagatgcagttgatcctaagagcagacacaagggaaagcttgagacagagagtttgctgcaagcaaggggtgttaattggacttctataaggccagtctatatctatggacccttgaactacaaccctgttgaagagtggttcttccatagattgaaagccggacgcccaattcctatccccagctcaggactacagataacccaacttggtcatgttaaggatttggcgacagcttttatccaagttcttggtaatgagaaggccagcaaggaagtattcaacatctcgggagagaagtatgtcacgtttgacggattagcaagagcatgtgctaaggctggtgggttcccagagccagagatcattcactacaaccctaaagattttgactttgggaaaaagaaatcatttccattccgtgaccagcatttctttgcatcaattgagaaagcaaagagagtgcttgggtgggaacctgaatttgggcttgtagagggtcttgcagactcgtacaacctggactttggtagaggaacataccggaaagaggctgatttctcaacagatgacataattcttggaaagagtcttgttagtgtataa

SEQ ID NO: 3420 - DNA, 993 bp, Glycine max var. Williams 82
atgccacctaacatcaccaccgttgttgccaatgtcaccaccgagcaattacccaaggctcgtggaggaagtgggcgtgccttcgtgacctttcttgctgggaacggtgattacgtaaagggtgtcgtgggtttggccaaaggactgagaaaggccaaaagcatgtaccctttggtggttgctgtgttaccagatgttcctgaagaacatcgtgagattctcaaatcccaaggttgcattgtcagggagattgaacctgtgtaccctcctgagaaccagacccagttcgccatggcctattatgtcatcaattactccaagctacgtatttgggagttcgtggagtacaagaagacgatatacctagacggtgacatccaagtatttggaaacatagaccacttgtttgatctgcctgataattatttctatgcggtgatggattgtttctgcgagaagacttggagccacacccctcagttccagattgggtactgccaacagtgccctgataaggttcaatggccctctcactttggttccaaacctcctctatatttcaatgctggcatgtttgtttatgagcctaatctcgacacctaccgtgatcttctccaaactgtccaactcaccaagcccacttcttttgctgagcaggactttctcaacatgtacttcaaggacaagtacaagccaataccgaacatgtacaaccttgtgctggccatgttgtggcgtcaccctgaaaatgttgaacttgataaagttcaagtggttcattactgtgctgctgggtctaagccttggaggttcactgggaaggaagagaacatggatagggaagatatcaagatgcttgtgaagaagtggtgggacatatatgaagatgagacactggactacaataacaactctgtcaacgtggaacgtttcacatcggcactattggatgctgggggctttcagtttgtgccagcaccttctgctgcctaa

SEQ ID NO: 3421 - DNA, 1360 bp, Glycine max var. Williams 82
tttctcacacactgcaattcaaaacaaccaacctcttcagtgatctttgattagtactaagctaaaccatttcttattccctcaaaatcaaaacctttttctttctagctatttcccttttcaaatcatgccacctaacatcaccaccgttgttgccaatgtcaccaccgagcaattacccaaggctcgtggaggaagtgggcgtgccttcgtgacctttcttgctgggaacggtgattacgtaaagggtgtcgtgggtttggccaaaggactgagaaaggccaaaagcatgtaccctttggtggttgctgtgttaccagatgttcctgaagaacatcgtgagattctcaaatcccaaggttgcattgtcagggagattgaacctgtgtaccctcctgagaaccagacccagttcgccatggcctattatgtcatcaattactccaagctacgtatttgggagttcgtggagtacaagaagacgatatacctagacggtgacatccaagtatttggaaacatagaccacttgtttgatctgcctgataattatttctatgcggtgatggattgtttctgcgagaagacttggagccacacccctcagttccagattgggtactgccaacagtgccctgataaggttcaatggccctctcactttggttccaaacctcctctatatttcaatgctggcatgtttgtttatgagcctaatctcgacacctaccgtgatcttctccaaactgtccaactcaccaagcccacttcttttgctgagcaggactttctcaacatgtacttcaaggacaagtacaagccaataccgaacatgtacaaccttgtgctggccatgttgtggcgtcaccctgaaaatgttgaacttgataaagttcaagtggttcattactgtgctgctgggtctaagccttggaggttcactgggaaggaagagaacatggatagggaagatatcaagatgcttgtgaagaagtggtgggacatatatgaagatgagacactggactacaataacaactctgtcaacgtggaacgtttcacatcggcactattggatgctgggggctttcagtttgtgccagcaccttctgctgcctaatatgcttattatttacagctacaaattaatgttaattaacgacaaagtatatgtattgttatttgctttttttcgtttttgggtcttatatatgaaggaacaacgtctatggttttaatttggatgaccttcttgtatacaaagccacatgtgatctcatacagcttttgattattattaagaaattagaggaccttttattatgagtcctttacttaatttgttttcattgatcaagag

SEQ ID NO: 3422 - DNA, 1213 bp, Glycine max var. Williams 82
acacactgcaattcaaaacaaccaacctcttcagtgatctttgattagtactaagctaaaccatttcttattccctcaaaatcaaaacctttttctttctagctatttcccttttcaaatcatgccacctaacatcaccaccgttgttgccaatgtcaccaccgagcaattacccaaggctcgtggaggaagtgggcgtgccttcgtgacctttcttgctgggaacggtgattacgtaaagggtgtcgtgggtttggccaaaggactgagaaaggccaaaagcatgtaccctttggtggttgctgtgttaccagatgttcctgaagaacatcgtgagattctcaaatcccaaggttgcattgtcagggagattgaacctgtgtaccctcctgagaaccagacccagttcgccatggcctattatgtcatcaattactccaagctacgtatttgggagttcgtggagtacaagaagacgatatacctagacggtgacatccaagtatttggaaacatagaccacttgtttgatctgcctgataattatttctatgcggtgatggattgtttctgcgagaagacttggagccacacccctcagttccagattgggtactgccaacagtgccctgataaggactttctcaacatgtacttcaaggacaagtacaagccaataccgaacatgtacaaccttgtgctggccatgttgtggcgtcaccctgaaaatgttgaacttgataaagttcaagtggttcattactgtgctgctgggtctaagccttggaggttcactgggaaggaagagaacatggatagggaagatatcaagatgcttgtgaagaagtggtgggacatatatgaagatgagacactggactacaataacaactctgtcaacgtggaacgtttcacatcggcactattggatgctgggggctttcagtttgtgccagcaccttctgctgcctaatatgcttattatttacagctacaaattaatgttaattaacgacaaagtatatgtattgttatttgctttttttcgtttttgggtcttatatatgaaggaacaacgtctatggttttaatttggatgaccttcttgtatacaaagccacatgtgatctcatacagcttttgattattattaagaaattagaggaccttttattatgagtcctttacttaatttgttttcattgatcaagag

SEQ ID NO: 3423 - DNA, 1152 bp, Glycine max var. Williams 82
atggaacctccgtctgaaagtctaggccctcctccatcaccattcaccgcagttgcttctgccaccataggtgccctccataggtcaccgttcattgcttttgcgttgaagcaattgttcaagttgcaggcttttgcaccttcctctctctcgggacaagagagcagaataatggaggagctccaaaccccaagctataatggccaaaccgaaaacccagacactctcctcttcgaagacattgacagcacctgctccactccctacgtcagcgccccttccagtcccggccggggacccatctccgccgccggaggagggttcttctacagtgctccggctagcccaatgcacttcaccataaccgccgcttccacttacacacactcagcctcttcttcctcggaaaaaaactctggttgcgattttgagttctcggcccggttcgtttcgagcgggtttactggttccggttcgatgagctcggcggacgagctgttcttgaacggtcagatccggcccatgaagctctcgacccacttggagcggccgcaggtcttagctcccttgctggatctcgaagaagagggcgaagaaaacgaggaagttgaagccagtgtacggggtagagatctgaggctgcgcgacaaatcactccgcagaaggaccagatccctgtcacctcttcggaacacgccgttagagtggacggagaacgaggaaaaaacggaaaagaaggaaaacgtggacccttccgtttcgagcggaagtggaaggagttccaagaggtgggttttcttgagggatttcttaagaagcaaaagcgagggaaggagtaataacaagttctggtccactatttccttttcccccgccgcaaaggacaagaagccccaaaatcagggaaatgggccgcagaagcccaagaaggtcgccggaaagcccactaacggcatcgggaagaagcgagtgccggcggcgtcgccgcacgagttgcattataaagccaacagagcgcaagcggaggagttgagaaggaaaacttttttgccttataggcagggcttgcttgggtgcttgggatttagttccaaaggttatggtgccatgagtggctttgctagagccttaaaccccgtctcttccaggtaa

SEQ ID NO: 3424 - DNA, 1749 bp, Glycine max var. Williams 82
atggtatcaaaaaggcaatctggtcagaggcacgaaggcagtggcaaagttccaattcaggagcaaaaacaaacatcaatcagtggccttagaaatgtgatcaacgcgctatggatgagtgaccactctgcctatttggaaaattttctgcgaagagtggtaagcgaggtggtggaacaaaaattcgaggaccaagctcatctatttccaagaaaaagggttggtgaggctggcatatccggagccaaaccctttaagttgtgttttattaataagctgcccgaaacaatttttactcggtctagtataatagcagaagataaatcaccccttcaaattgtcctatttgatgttagaacccagtctgtagtaaatgatggtcctctctcctcactaaagatagagatctgtgtcctggatggagagtttggatctcaaggcagtgaggattggactgaagaagagttcaattccaatatcttacgcgaaagagaaggtaaagagcctctattgattggagagaggtttgctagtctaaaaaatggagttggttgtatacctaaaattgccatctctgacaactcgagatggctaagaagcagaaggttcagcattggagtcaaagttgtgcaaccaacttccaacggagaaaagattcaggagggtagaagtaaaccttttgtggtcaaagataacagaggagagtcctacaagaaacactaccctccgtacttgaagttgaatgatgatatatggcgtttgaagaaaattgctaaggaaggaaaaatccacaagcagctgtcttcgcgtggaattcacaatgttaaggatcttttgcggttgtacataaccaacgaaccttcattatatgaaatgtttggaaatattccaaagaagtcatggttagtaatcactgaacatgccaaagcctgcgtgatagatgattaccagctttacagctatcattcacaagaactgcaaataggcttgctattcaattccatctacatccttgtgggagtgacatttgattggcaaaattattactcaccagatactctcaccccaagagaaaagcatttggtggaaatagtgaagcagcaagcttataaaaacgtcaacaatttggaattgattaatgacactaaattgaactatttaaatctagctgcatgtctaaaagcaagagaatctgatcctccagatcaaggtctgcaccatattaacatctcaactgtacaaggtatatttaaagatcaatcagtaacattccccggttgtggtcaaccatctatctctccttcatatactgatgaaggaatgcatgaccaccaagtttatgctgatccactgtcaggcataacagaaatgtcaaaaaacagtcatctgttagatgaactttcctctgaaatgtacactgaagaggatagttgtcaccttaatggatctcaatttccattcgtgcgaggcggttattcaacagagaatgaatggtcagagattcaattcatagatgattgcccttcttacacaacatgggaaccagaaactggcattttctttggttctcctgttggagcagaatttagcagctattcgactttcatcaattctgatgaggatacatcaagcagtggcaaaaccaaagcagtgtggtataagattcgtgttgctctcaaatgggtcatatcagtgaaaagggatgcagctgccagaaagaatgctcagctgttttactataactattag

SEQ ID NO: 3425 - DNA, 1014 bp, Glycine max var. Williams 82
atgcatgccttcataaaccgtgtatcatattgttgtgcaagagacagagggagtgagatggaaggcatagaacacagaacagttgaagtgaacggcataaaaatgcatgttgcagagaaaggagagggtccagtggtgttgttcctccatggcttccctgagctctggtactcatggcgccaccagattctctctctcagctccctcggctaccgcgccgtcgctcccgatctccgtggctacggtgacaccgaggcaccaccttcaatcagcagctacaactgctttcacatagtgggtgatctcgttgcgcttattgactctctgggtgtccaacaagttttccttgtggctcatgactggggagccatcataggttggtatctctgcatgtttcgccctgacaaagttaaggcctatgtctgcctcagtgttccttttctccgcagagacccaaacatcagaacggtagatggcatgcgtgctttgtatggagacgactactatgtctgcagatttcagaaaccaggcgaaatggaagctcagatggctgaagttggcactgggtatgttctcaaaaacatccttacaagtcgcaaaactggtcctccattccttccgcatggagagtttggaactggattcaatccagatatgtctgattccttaccctcttggctcacagaagatgatcttgcttattatgtctccaaattcgagaaaactggcttcactggaggcttgaactactacagaaatttcaacttagattgggagctgacagctccatggacaggagtgcaaatcaaggtgcccgtaaaattcattacaggtgagttggactcggtatatacctcgctaaacttgaaggagtatatccacggtggagggttcaagcaagatgtgccaaacttagaacaagtgattgtgcagaaaggagtggctcacttcaataatcaagaagccgccgaggaaatcaatactcacatttacgattttatcaagaagttttaa

SEQ ID NO: 3426 - DNA, 2664 bp, Glycine max var. Williams 82
atggagattcagttagagcagcagcaggagtcatggtcggagacgtcgagcacggggagcaggagcacgcgagtgggcttcagcgggcccatgagcggcccgctggtgacgcccaacaacaagaagagcagcaagaaaagcacgaggttcaaggaccaagaggaggaggacttcgtggagataacgctggacgtgcgcgacgacaccgtgtccgtccagaacatcaggggcggggaccccgagacggcgctgctcgccagccgcctcgagaagcgtccctcctccctgtcggtgcggctccggcaggtgtcgcaggagctcaaacgcatgacctcgtccaagaagttcgatagggtcgacaggaccaagtctggtgctgctcgcgccctcaagggactcaagttcatgaccaaaaacgttggaaccgaaggctggtcccaggtcgagaagcgctttcatgagttggccgttgaagggaaattgcccaaaacgcgcttcagtcagtgcattggcatgaacgagtcgaaggagtttgctggcgaattatttgatgcattatctcgtcgccggggcataacatcagcttccataaccaaggatcagttgcgcgaattttgggaacaaattacagaccagagctttgattcaaggctccagaccttctttgatatggtggacaaagatgccgacggaagaatcacccaagaagaagttcaagagattatcgccttaagcgcttccgctaataagctgtcaaaaatacaagatcgggcagaggaatatgcagcccttatcatcgaggagttggatcccgacaaccttggatacattgagatatacaacttggaaatgcttcttttgcaagccccagcacaatcaaccaacataactacggatagccgtatcatgagtcaaatgctgagccagaagctagtcccaaccaaagattacaaccccatcaagcgtggcttccggtcactggcttactttgtggaggacaattggaaacggatttgggttattctcctctggctttcaatctgtgctgcccttttcacttggaagttcatccaatacaagcaccgtgccgtgttcgacgtcatgggctattgtgtgacttcagccaaaggtgctgctgaaaccctcaagttcaacatggctttgatccttttaccagtttgcagaaacaccatcacttggctcagaagtaagaccaagttaggcatggctgttccctttgatgacaacatcaactttcacaaggtgatagcttttggcattgcaattggggttgggatacatgcaattgcacatttaacgtgtgacttcccaaggttgttgcacgcaacggacgaggaatatgagcccatgaagccattttttggagaagataggcccaacaattattggtggttcgtgaagggaaccgagggttggaccggaatagccattgtggtgcttatggcaatagcctacactttggctcaaccttggttccgacgaaacaggcttaacctccctaaacctctcaaaaggctcaccgggttcaatgccttttggtactcccaccatctttttgtcatcgtctatgggcttttcatcgttcacggttactacttgtacctctccaaggaatggtacaagaaaacgacttggatgtatcttgcaattcctatgatactatacgcatgcgagcgattacttcgtgcttttaggtctggctacaaaagtgtcaagattttgaaggttgcagtgtacccgggaaatgtcttggccttgcacatgtctaaaccacaaggatttaagtactctagtggacagtatatttttgtgaactgcccagatgtctctccttttcaatggcatcctttctctattacatcagccccaggagatgactatgtaagcgttcacattaggactttgggtgattggacatcacaactgaaggctgtttttgctaaggcatgtcaaccagcaagtagtgaccagagtggtcttctacgagctgatatgttacaaggcaacaacataccaaggatgccaaagctggtgattgatggtccttatggagctccagcccaagactacaaaaactacgaagtaatccttcttgtgggactaggaattggtgccacccctttgattagtatactcaaagatgtgctaaacaacatgaaacaacagaaagacatagaagaagcgatggtagaaagtggagttaagaacaacaagaggaaaccttttgccaccaaccgtgcctatttctactgggttactcgtgaacaaggttccttcgaatggttcaagggtgtgatggatgatgttgccgagtatgacaaggatggaataattgaacttcataactattgcacaagtgtgtatgaggaaggagatgctcgttctgctttgatcactatgcttcaatcgctccaccatgccaaaagtggtgtggatatagtttcagggacaagggtcaagacacattttgctagaccaaattggcgcagtgttttcaaacatactgcactcaaacaccctgggaaaagagttggtgttttctattgtggggcgcacacattggttggagaacttaagaggctttctcttgacttttccagaaaaaccaacaccaagtttgattttcataaagagaatttttaa

SEQ ID NO: 3427 - DNA, 1584 bp, Glycine max var. Williams 82
atgggcgctgtgattcactgcattgcatgttgggagccttacaaatcccccttcaccttcttcccttctttctctactcatcgctctcattcttctcctcttccccccaaactcgccatggctccaagcgaacctctctccctcacccccgtccaagactctcccttattcgattaccctcgtctcgatcaacaactcatccacaccatcgcttacgacgccctcgtttggagctctctccacggtctccttgtcggtgacaaatccgttcagagatcaggaagcgttcctggagttggattggtgcatgcgccgcttgccttgttacccacgccatttccggaaaagcagtggagagaagcgaatgagttggcccctatattcaatgaactcgttgatcgggtcagtttggatgcaacgtttcttcaggaatcactttcaagaactaagaaagcggatgagttcacctctagacttttggacattcattccaagatgctacagattaacaaaaaagaggaaatacgattggggttacatcgttcagattatatgcttgatgaaaagactaaatcacttttgcaaatagaactgaacactatttcctcttcttttgccggtcttagtaatcttgtgactgaacttcatagatacatactttctcgccatggaaaattgcttggactagattccaaaaggattcctgccaacaatgctgtcaatcagtatgcagaggccttggctaaagcttggagtgagtataataaccccagggccgtgattatgattgtagttcaggctgaagaacgaaacatgtacgaccagcattttgtttctgatgttctaagagagaagtataatattacaactatacgaaagacgttggcagaagttgatcatgaaggagaaattctaccagatggaacactttttgtggatggacaagcaatttcagtcatttatttccgggctggctatacaccaattgactatccttcagaatcagaatggagtgctaggatactgatggaacaatcttctgctgtcaaatgtccttcaatatcctatcatttggttggcaccaaaaagattcaacaggaacttgcaaagcctggtgttcttgagaggttcattgaaaacaaagaagaaattgccaaactgcgtaaatgctttactgggttgtggagtttggatgactcaaatattgttagaaaagcaattgaaaggcccgagttatttgtgatgaagccccaaagagaaggaggaggaaacaatatttatggtgacgatgtgagaaaagccctcctaaaattgcagaaagaaggttctctagaagatgcagcttatatccttatgcagaggatatttccatctaactctgcagcaattttgatgcgtaatggctgttggcataaggatcgtgccatttcagaactgggggtattcagtacttatttaaggaataaggataaggttatcatgaataaacaaagtgggtatttgatgcgtacaaaaatatcatcatctgatgaaggtggggttgcagctggttttgcagtgttagatagtgtatacctgacttga

SEQ ID NO: 3428 - DNA, 1975 bp, Glycine max var. Williams 82
aaacacacagtgaaagaggccaaaatgggcgctgtgattcactgcattgcatgttgggagccttacaaatcccccttcaccttcttcccttctttctctactcatcgctctcattcttctcctcttccccccaaactcgccatggctccaagcgaacctctctccctcacccccgtccaagactctcccttattcgattaccctcgtctcgatcaacaactcatccacaccatcgcttacgacgccctcgtttggagctctctccacggtctccttgtcggtgacaaatccgttcagagatcaggaagcgttcctggagttggattggtgcatgcgccgcttgccttgttacccacgccatttccggaaaagcagtggagagaagcgaatgagttggcccctatattcaatgaactcgttgatcgggtcagtttggatgcaacgtttcttcaggaatcactttcaagaactaagaaagcggatgagttcacctctagacttttggacattcattccaagatgctacagattaacaaaaaagaggaaatacgattggggttacatcgttcagattatatgcttgatgaaaagactaaatcacttttgcaaatagaactgaacactatttcctcttcttttgccggtcttagtaatcttgtgactgaacttcatagatacatactttctcgccatggaaaattgcttggactagattccaaaaggattcctgccaacaatgctgtcaatcagtatgcagaggccttggctaaagcttggagtgagtataataaccccagggccgtgattatgattgtagttcaggctgaagaacgaaacatgtacgaccagcattttgtttctgatgttctaagagagaagtataatattacaactatacgaaagacgttggcagaagttgatcatgaaggagaaattctaccagatggaacactttttgtggatggacaagcaatttcagtcatttatttccgggctggctatacaccaattgactatccttcagaatcagaatggagtgctaggatactgatggaacaatcttctgctgtcaaatgtccttcaatatcctatcatttggttggcaccaaaaagattcaacaggaacttgcaaagcctggtgttcttgagaggttcattgaaaacaaagaagaaattgccaaactgcgtaaatgctttactgggttgtggagtttggatgactcaaatattgttagaaaagcaattgaaaggcccgagttatttgtgatgaagccccaaagagaaggaggaggaaacaatatttatggtgacgatgtgagaaaagccctcctaaaattgcagaaagaaggttctctagaagatgcagcttatatccttatgcagaggatatttccatctaactctgcagcaattttgatgcgtaatggctgttggcataaggatcgtgccatttcagaactgggggtattcagtacttatttaaggaataaggataaggttatcatgaataaacaaagtgggtatttgatgcgtacaaaaatatcatcatctgatgaaggtggggttgcagctggttttgcagtgttagatagtgtatacctgacttgacagagccaacaaaactgtgggttatcagggtagtccaaaacaaaaacattacgtcggtaatggtttacataatgatatcataatgttttgttttctcatcactactacaaaaattctattttacaaccatgacgggtgtcaagaacagtcttaaaatagaacataattgcaattttgtatcttgcttttacttatctgcctccgcaaaaaatgaaaaaagaggagagactgtaaagttccttttttctttttccatgggaccatgggatgtataataattatagaacctgtggatgcttcgttaactatacccgacgagttgttatattctttctatccaataaaaatttggcaagctgttcaaacc

SEQ ID NO: 3429 - DNA, 1257 bp, Glycine max var. Williams 82
atgtcacctactcttatccttaacacccttactgctgtttttggtggtggttttgcgatgggatattcatcccctgctcaaactggaatcatgcatgatctccatctctctctcgcccagaaaatagaaccaaagaaacacctaggaaactgcattaacggtaaaatagcagattatgcaggtcgtcgagttgcaatgggtttctcagaggttttctgcatcttgggatcacttatcatagcattctcaaaggatgctaggtggctttgcattggaagattgttgataggatgcggcattagcctgatatcgtatgtggttccagtctatatagcagaaatagcacccaagaatcttcgaggagcatttactgaagttcatcagggtatcatgttcatgccacttatgttttatacttcatgggttgttgtgggtttgtcattaacttaccttattggagcatttttgaattggaggattttggctttgattggaactatcccgtgtcttttgcagcttctgactcttccctttatccctgattcacccaggtggctgactaaggttggtcgcttgaaagagagtgatcatgctgatgtttatcaagaggccactgaaatcaaagattatacagaagcccttcagcaacaaacagaagctagcattgttggcttatttcaatcgcagtatttaaagacacttcttggctttcttttctataggaattctatatttatctccgcagggttttcagatagtattggaacgatagcaatggttgctgttaagatcccattgacaactttaggagtgcttttgatggataaatgtggaaggcggccacttttactggtaaaatggttgagggtatatatgggatctttcttgctaggcttggcaggaattccgtgggttataatgtctgagatatttcccattaatgtgaagggctctgctggaagcttagtaaccttggttaactggtcgtgctcttggattgtttcatatgcttttaactttctcatgagttggagttcagaaggaactttcttcatattttctagcatatgtggcctcattgttcttttcgttgcaaaactagtaccagagaccaagagccgtacactagaggaaattcaagcctctttgaattcttcaattccatacccatacacagttatcttcgcttccgcaagtcagaaggaaaacactacatttattattgtattttttttttcaacttgtctatcatcttaa

SEQ ID NO: 3430 - DNA, 1437 bp, Glycine max var. Williams 82
atggacaacaaaaccgatttctcaagtcctcttctccccacaagttacggtcccaatgatgccgttgactctcagggcaaaggcccttcttcttcttccataccaactactcttataatcactaccctcgtcgctgtttttggttcttacgtttttggctctgctattgggtattcatcacctactcaatctgcaatcatgcgtgacctcaatctcggagtggcccagtactcaatttttggttcaatattgacgattggagccatgattggtgccgttgtgagtggtagaatagctgattatgctggtcgtcgagttgccatgggattctcccaggttttctgcatcttgggatggcttgccataacattctcaaaggttgcttggtggctttatgttggaagactgttggtaggatgtgggattggccttctatcttatgtggtaccagtttatgtagcagaaataacacccaagaatcttcgaggggcattcactgcagttcatcagttaatgatttgttgtgggatgtcattaacttatcttattggagcatatgtgaattggcggatcttggctacaataggaattattccgtgtcttgtgcagcttctgagtcttcccttcatccctgattctcctaggtggctggctaaggctggtcgcttgaaagagagtgattctgctttacagcgcctcagggggaagaatgctgatgtttatcaagaggccactgaaatcagagatcatacagaagcctttcaaaagcaaacagaagctagcatcattggcttatttcaaatgcaatatttgaagtcacttaccgtaggagttggcttgatgatactgcaacagtttggagggattaatggcattgttttttatgcaaactctatatttatatcttctgggttttcagaaagtattggaacaatagcaattgttgccgttaagattccaatgacaactataggagtacttttaatggataaatctggaagacgaccacttttgctggtgtctgcagtgggaacatgcgtaggatgcttcctggcagccttgtcattcgttttgcaggacttgcataagtggaaaggagttagtcccattttggcgctagtgggtgtattggtatacgtgggatcttactctataggcatgggagcaattccgtgggttataatgtctgagatatttcccatcaacgtgaagggttctgctggaagccttgtgactttggttagctggttgtgttcctggattatatcatatgcttttaacttcctcatgagttggagttcagcaggaactttcttcatgttctctggcatatgtggcttcactgtgctattcgtagcaaaactagtaccagagaccaagggccgtacactagaagaaattcaagcttctctgaattcatattcttctaagagatga

SEQ ID NO: 3431 - DNA, 1440 bp, Glycine max var. Williams 82
atggagtttcctacgaaccttttgccagacgaagcgagcccagaatggatgaacaaaggagacaatgcatggcagcttatggcagcaactgtggtgggtctccaaagcattccggggctggtgattctctacggaagcctagtgaaaaaaacatgggccattaactctgctttcatggccttctacgccttcgcgggggtacttctatgctgggtggggtggggattccgcatgtcattcggcgagaaaatggtgttcttcttggggaaacccggggtggcggtggacgagaagtttcttctggggaaagcttttctggggctctttcccaatgctacgatggtgttttttcagggggtgtttgcggggatcaccttgatcttgatagctggggcgttgctcgggaggatgaactttcgtgcgtggatgctgtttgtgcctctttggcttactttttcgtacaccgtcactgcctttagcatttggtgccccgatggctggttggcaaagcttggagttattgatttctctggcggatatgttattcacctctccgccggagttgctggttttactgcagcttattgggtgggtccacgatctgaaaaggacagagaaatatttgcatcaaacaacatgattgtggtgcttgcaggcgcaggcctgctttggatgggttggagtgggttcaacggtggaggtccgttcgtggcgagcacggtggcatctctggccgtccttaacacacacgtgtgtgctgctgctagcatcatcgtctgggtcctactcgacactttctactttggtaagcccactgtgtttggcgccgtacagggcatgatcactggtctcgtttgcatcacacctgccgcaggagttgtgcaagggtgggcagcgatcttgatgggtgtgatgtcaggaagcattccctggtacacaatgatgatcctccatgacaagctcccattcctaaagcaaatcgacgaccccatggcggtgttccacacccatgccgtcgccggcgctctcggcggcgtcctcacggggctcttggcggtgcctaaactgtgccgtctcttctacatggtccccgattgggaaaaatacattggactcgcctatggcctccagaacggtgcaactcatgcgggtctaaggcaaatggccatccaagttggggccatagttttcgttattatcttcaactttgttacgaccagcttgatttgcttgctcgtggggtccatagtaccactcaggattgacaccgatgctttgcaaatgggtgacaaggcaatgcatggagaagaggctttcgctttctatggaggagaccctacagcaaagtttgagaacctcaagcacaataaagtttatgatactcaagacttttcgtttgttagagacacaaggtcatttgcccagcttcaaatggtataa

SEQ ID NO: 3432 - DNA, 1440 bp, Glycine max var. Williams 82; identical to SEQ ID NO: 3431

SEQ ID NO: 3433 - DNA, 1131 bp, Glycine max var. Williams 82
atgggaagttctggaacaaccgactatggagcatacacataccaaaaccttgagagggaaccttactggccctctgaaaagctcagaatttccatcactggggctggtggtttcattgcctcacacattgctcgccgcctcaagaccgagggacattacatcattgcttctgattggaagaagaatgagcacatgactgaggacatgttctgccatgaattccatcttgttgaccttagggtcatggataactgcttgacagttaccaagggtgtggaccatgttttcaatcttgctgctgatatgggtgggatgggttttatccagtccaaccactcagtcattatgtacaacaacaccatgattagcttcaacatgattgaggctgccaggatcaatggtgttaagaggtttttttatgcctctagtgcttgtatctatcctgaattcaaacagttggagacaaatgtgagtttgaaggagtctgatgcctggcctgctgagccacaagatgcatatgggctggagaagcttgcaacagaagagttatgcaagcattataacaaggattttggaattgagtgccggattgggagattccataacatatatggtccttatgggacatggaagggtggaagggagaaggctcctgctgctttttgtcgcaagacacttacttccaaagatcgatttgagatgtggggagatggattgcaaacaagatccttcaccttcattgatgagtgtgttgaaggtgtactgagattgactaaatcagacttccgggagccagtgaatattggaagtgatgaaatggtcagtatgaatgagatggcagagattgttcttagctttgaggataagaatataccaatataccatattcctggcccagaaggtgttcggggccgtaattcagacaatacattaatcaaagagaaacttggctgggctccaactatgaagttgaaggatgggctgagaattacatacttttggatcaaagagcagcttgagaaagagaaggcagaaggtgttgatttatcaggctatggatcatccaaagtggttcagactcaagccccagttcaacttggctcgctacgtgctgcagatggcaaagaataa

SEQ ID NO: 3434 - DNA, 636 bp, Glycine max var. Williams 82
atgggaaaagcttgggtaggcctggtggtattgctgtgtttgattgtcacggccatcgccgaacaatgcggtcgtcaagctggcgggcagacatgtcccaacaacctatgctgcagccagtacggttggtgtggaaacaccgaagaatactgttccccttctaagaactgccagagcaactgctggggaggcggcggcggtggcggtggcggcggcggcggtgaaagtgcttctaatgtccgcgccacatatcattactatgagccagagcaacacgggtgggacttgaacgccgtgagtgcttattgctcaacttgggacgctagcaaaccttactcatggcgcagtaaatatggctggaccgctttctgtggtcccgttggtcctcgtggccgtgattcttgtggaaagtgcttgcgggtgacaaatacaggaacaggagcaaacacaattgtgagaatcgtagatcagtgcagcaacggagggttggatttggacgtgggagtgttcaatcggatagacacagatggaagaggatatcaacaggggcatctcattgttaactatcagtttgtggattgtgggaatgagctcgacctcaccaaacctttactctccatcctcgatgctccctaa

SEQ ID NO: 3435 - DNA, 1590 bp, Glycine max var. Williams 82
atgtttgggtgtgagtgtttttggtggaacagtgttcctgaatcctacccttctcagccagagcccttctctctaccagcacctcttccacaatggccacaaggtgatggttttgctagtggaagaataagccttggaagactagaagttttaaaagtaagcaagtttgagagagtttggagctgcccaagttcgcatggtaaatcacagggctttgtattttacaaacctttagagattccagatggttttttctgcctaggtcactactgccagtccaatgaccagccattgagagggcatgttcttgtggctcgtgaaacttgttctgaacctgaacttgaatctccagctcttaaaaaaccaattaactactctttgatatggagtgctgattcaccacatgatggatgtggttatttttggttaccaaatcctccattaggatacaaagcaatgggcatagtagttaccaacaaaccagacgaacctgaagttgaagaagtcagatgtgtacgagccgatttgacggaaacatgcgagacttgtgatctattactatccatgagctcaaaattttcaagaatttcattcaaggtttggaacacaaggccttgtaaaagagggatgtggggtagaggtgtatcagttgggacattcttctgcagcacctattctaactctgaaaaaatagcagatattgcttgcttgaagaatcttgactccaccttacatgccatgccaaacataaaccaagttcatgcactcatcaatgaatatggccccactgtatacttccaccctgatgagatatacttgccatcatcagtgcaatggtttttcaaaaacggagcacttgtgtattcaagagacagtgagaagggtaaagcaatagattaccagggatcaaacttaccaagtggaggaacaaatgatggtgcttattggatagatttgcctactaatgatgatgctagaaataatgtaaagaagggagacatagagagtgcagagctttatgttcatgtaaaaccagctctgggaggaacatttactgacattgctatgtgggttttttgtcccttcaatggacctggaatacttcaagtggggttggtgaacgttgagatgaacaaaataggtgaacatgtgggtgactgggagcacttcacgcttcgcgtgagcaacttcacaggagaactatggaatgggcatggccatgcaagtttccctcatcctgggagctaccttcagggatcatccacacttggaataggagcaaagaatgaagcagctaaaagtaaactgacagtggattccagcaccagatacaaggttgttgcggccgagtatcttggtgagggagcaattgctgaaccatgttggttgcagtacatgagagagtggggtcctacagttgtgtatgactcacgttctgaaatagataagttgatagacctgcttcctgtgtttgttagattttctttggtgaatttgtttgaattgtttcctacggagctttatggtgaggaggggccaattggtccaaagggaaaggccaactgggtaggagatgaaaagtgttactag

SEQ ID NO: 3436 - DNA, 798 bp, Glycine max var. Williams 82
atggctagatacattaatattgtacttttgggaatagtgttggtagtggtgagattgaaaggtgcagaggcacagcgggcgttctttgtgtttggggattctcttgtggataatgggaacaacaactttttggcaactacagctcgagcagatgctcctccttatggcattgattacccaaccggaagacccactggccggttctctaatggctacaacattcctgacttcattagtcaatcacttggggccgaatccacattgccttatttagatcccgagctcgacggggaaagattgcttgttggtgccaactttgcttctgctggtattggaattctcaatgacactggaatccaatttgtaaacataatcagaatatacagacagttggagtactgggaagaataccaacaaagggtgagtggtctcataggacctgagcagactgagcgcttaataaatggagcattggtcctcatcactcttggaggcaacgactttgtcaataactattacttggtcccttactctgcaagatcacgccaatacaattaccagatacgatttgttacatcaaaagtagcatgttgcggtcaaggaccctacaatggtcttggactgtgcactccggcatccaacttgtgccctaaccgtgatatttatgccttttgggatccttttcatccatcagaaagggctaataggttaatcgttcaacagattttgtcaggcacctcagagtatatgtatccaatgaatcttagcaccattatggctttggattccaagaactag

SEQ ID NO: 3437 - DNA, 867 bp, Glycine max var. Williams 82
ccttcctcattcctcctctgcttacatactagttcagcagcaactccactcaattgtatgcattgatccatggctagatacattaatattgtacttttgggaatagtgttggtagtggtgagattgaaaggtgcagaggcacagcgggcgttctttgtgtttggggattctcttgtggataatgggaacaacaactttttggcaactacagctcgagcagatgctcctccttatggcattgattacccaaccggaagacccactggccggttctctaatggctacaacattcctgacttcattagtcaatcacttggggccgaatccacattgccttatttagatcccgagctcgacggggaaagattgcttgttggtgccaactttgcttctgctggtattggaattctcaatgacactggaatccaatttgtaaacataatcagaatatacagacagttggagtactgggaagaataccaacaaagggtgagtggtctcataggacctgagcagactgagcgcttaataaatggagcattggtcctcatcactcttggaggcaacgactttgtcaataactattacttggtcccttactctgcaagatcacgccaatacaattaccagatacgatttgttacatcaaaagtagcatgttgcggtcaaggaccctacaatggtcttggactgtgcactccggcatccaacttgtgccctaaccgtgatatttatgccttttgggatccttttcatccatcagaaagggctaataggttaatcgttcaacagattttgtcaggcacctcagagtatatgtatccaatgaatcttagcaccattatggctttggattccaagaactag

SEQ ID NO: 3438 - DNA, 2184 bp, Glycine max var. Williams 82
atggacaagtctcacatgcccaaagttttcacctcctaccataactggtattcatccacccttatcgactctgctgccactccttccattttgtactcttacgacaatgcacttcacggcttcagcgtttccttatcacaagaacaattggagactctaaaacaaaccccaggtttcatctcagcatacagagacagagaaaccacgctggacaccacccagtcttacaccttcctctctctcaaccactcccatggcctctggcctgcttccaactacgcccaaaacgtcgtcgttggcgtcatcgattccggaatctggcctgagagcgaaagcttcaaagaccatggaatggaaactcaaactcctccgaaatggaagggaaagtgcgagggtggtcaaaactttgactcctccctatgtaactccaaactcataggcgcaacctacttcaacaaaggtcttctcgcagcgcaccaagctgacgctaccaaaattggagccgactcagttagagacaccgtgggacacgggacccacactgcatccacggtggcaggaaactacgtgaacggggcctcgtatttcggttacgctaagggcacagccagaggaattgcgccacgtgctaaaattgccgtgtacaaggttgcgtgggcacaagaagtctacgcctccgacatcctagcaggtttggacaaagccatcgccgacggagtggacgtgatttcaatctcaatggggttgaacatggcgcccttgtatgaggatcctgtagccatagccgcattctcagctatggaaaaaggagttgtggtttcagcttcagcggggaacgcaggcccgttactggggaccttacataacgggattccgtgggttttgacggttggagcgagcaacacagaacgtgttttcggggggacgttaattctggggaacgggaagaggttttcggggtggacactgttcccagcgagtgccacggtcaacggccttcctctggtttaccataagaacgtttcggcgtgtgactcttcacaactcctgtcacgtgtggcgcgagggggcgtggtcatatgcgattctgccgatgttaaccttaacgaacagatggagcacgtgactttgtctggagtgtacggagcggtgtttatatcaagcgatcccaaagtgtttgaacggagaaaaatgacgtgtcccggccttgtcattagccctcgggatggggaaaatgtgatcaaatatgcacgagggactccacgcgcttccgcgactataaagtttcaagaaacctaccttggacccaaacgggctcccacggtggccagttacagttccagaggcccgtcttcggagtgcccgtgggtattgaagcccgacgtcgtggcccctggctcgtccattttggccgcttggattccggatgtgcccgcggcccgaattggcccaaatgtggttttaaatactgaatacaatttgatgtcgggaacgtcgatggcctgccctcatgcttccggggtggtggctctgttgaagaatgcacatcctgaatggagtgcttctgctattaggtctgcgttgactaccacggctaacccactggataacaccggaaagcccattgaggaaagcggagactggcctcaacgggcttctcctctagccatgggggctggccttattgaccctaaccgggcccttgacccgggcttggtttatgatgccagccctcaagactatgttaacctcctctgtgcgatgaatttgacccaggcccaaatcatggccattactagatcaaaggcctactctaattgctccagagcatcctatgacctcaattatccttctttcgtggctttctatgctgacaagagtgtgaaagtggagacaaaattccggaggattgtgacttacgttggagatggtccggctgtttacactgctcgagtgagctcctacaatggcactgcaatctccgtatctcccaataggctggtcttcaagaataaacatgagaaacggaaattcactttgagcttcaagtctcaaatggacaaggactatgatgtggcttttggttcactccaatgggttgaagaaactggaaggcatcttgttaggagtcccgttgtactggtacctaggaacgttgccttcaacttccaaactcggatttaa

SEQ ID NO: 3439 - DNA, 2184 bp, Glycine max var. Williams 82; identical to SEQ ID NO: 3438

SEQ ID NO: 3440 - DNA, 954 bp, Glycine max var. Williams 82
atgcagtggtacttcgtcgcttcgctcctcaccgtcctcaccagttctcagggaatactaacaaccctctcgcaaagtaacggagagtacaagtatgattacgccacggtcccatttctcgccgaggttttcaagcttgcggtgtcaagtttgttactgtggagggaatgcaaaaagtcacctttgccaaagatgacaacggagtggaaaacggtgtctctgttccccattccctcagttatatatctgatccacaacaatgttcagtttgctacactcacttatgtggacacatccacttatcagataatgggcaatttgaagattgtcaccactggaattctatttaggttgttcttagggaggaggctttctaacttgcagtggatggctattgtgctgttggctgttgggacaaccacaagtcaggttaggggatgtggagaggcttcttgtgactcccttttctcagctccaattcagggctacatgttaggagttctatctgcttgtctctcagctttagctgggatttatactgagttcttgatgaagaaaaacaatgacagcttatactggcagaatatacagttgtacacgtttggtacacttttcaatatggcacgactacttgcagatgattttagaggtggatttgaaaatggaccctggtggcaacgtattttcaatggatacactatcactacctggatggtggtattgaatctagggtctactggtcttttggtttcatggttaatgaaacatgctgataatattgtaaaggtctattccacatcaatggcgatgctgctgacgatgatactttcactatttctcttcaacttcaaacctacactgcagcttttcttgggcattattatttgtatgatgtctctacacatgtattttgccccaccaaaatatgctcttagatatgccataaacagttaa

SEQ ID NO: 3441 - DNA, 2118 bp, Glycine max var. Williams 82
atgcaacaagtgtcaaacactggaatcagcatggcttacactgcagttgccatgcctacatctccagcagctacctctgcaactatggacattgcaaaagagcataatggtcttcgccgctcgcaatccagcaaagaactatgcacacgttccattatgcggaggtcttattctgacaaccacctatgttgctccatcaatcgcatacaagccacatcagtgccgccaaaacttaagagcaatcgatcaatgggcatttccccatttcaattttcaggctccatgcttccaaattcactgcgctccttcttgtttgacccagaaacaagcaaggatgtaagtgtggaggagaaggttgtaagtattgaggaaaacatggtggaaagcagcaaagaagagatagcgaatagagccaactgggtagagaggcttatggaaatcaagaaacattggagaaacagactgccgaaagaaagcatggatccagatgcaatatgcaacgaaaatacgtatgatgaatgtgaatgtgatggagatggagatgacaatgtttgtgtggtgggtgaagatgaagatgagcaggaagtgacatatgattgcgactcattctcaaactttctggttcaagtaccatggtctgataccaaactatactctcaacttgctttcctgtgcaacatggcctatgtaataccccaaatcaaggctaaggacttgcgaagatactacagccttcaatttataacatcttctttagagaagaaagttgaagtggccaagttaaaagtgaaacttgatcaagactccactcgtgttcctatagatgactcggatgtctcagagaaaggcaaagacagtataaagaagcctcaaatcaaactagcttatgatattgctgcctcagcagcctcttatgtccaattacgagcgaaggatctcttacaccgtgctgctaagtcacgagacacacaacagactgaaaatgaagattctaatggaagaggagactcaccacgagaagagctagaaagcacttcgcgaggttacaaatcagaggttgcagcttatgttgcagcgtccacaatgacagcagtggttgcagcaggggagaaggaaaaacaagaagcagcaaatgacctccaatcacttcattcctcaccttgtgaatggtttgtttgtgatgatcccggcaattacactcgatgctttgtaattcagggctctgactccctggcatcttggcaagcaaacctcttctttgagcccaccaaattcgaggacacagacgtacttgttcacagaggaatttatgaggctgcaaaaggaatatacaagcaattcatgccagaaataatggagcatttgaagagacatggggatcgtgctaagcttcagttcactgggcactcccttgggggtagtctctctcttttggttcatttgatgctattgactaacaaggttgtgagtccctccactcttcgaccagtagtaacttttggctcaccatttgtattctgtggaggccaacaaataatcaatgagctaggcctggatgagagccaaatccactgtgtgatgatgcatagagatattgttcccagggccttctcctgcaactacccaaaccatgtagctgtagtccttaagcgcttaaacagctcatttcggtcacatccatgtctgctgaaaaataagctgttgtattcaccactgggtaaaatattcatcctccaacccgatgagaagacatctcctccacatcctttactccctcgaggaagtgccttctatgccctggacaatactaaaggtggatattctccaagtgttcttagaaccttcctgaatcaaccacaccctattgatacactaagtgatccaacagcatatggttcagaaggcacaatcctaagagaccacgactccagcaactacctcaaagccatcaacggagtcttgaggaaacattcaaagattaccgttggcagaatgaggaagcaaaggattaatcagttgtggcctctgttgacatcaccatctccacactcttggagccatgaacagaacttggagagatgcagcttgaggacaaaggagatagttacaggggtttaa

SEQ ID NO: 3442 - DNA, 1714 bp, Glycine max var. Williams 82
aatccatctaaccaatattatttgtttaaattgagattatgctccattcccagtcactttagtctctctttttcttgaatgaggcaaatcctgagttcgtcgtgagtcagagctagctaccttcacttcactcactctttcactttgtgtttcagattcagcagcaactctgcccgcatgcgtgcgtgaggtaagatgaaaactacttcaaatcaaggttgttgtacacacatatgtaaaatatcttgaattcgaagtgtgaaggatttgctgagtttcccaaagacatgtggtcagcctgttttcggcagaaatgaagaactcccagagcacacaagaattacagtccccggctcaagcatctcgtgaatcacagagtgaacaaccaaaaaatcacactactgatgctcctgttactgattcggtttcagcatctgcttcaagcaatgatagcaaaaaaatttcacggcaggatatagatcttgtacaaaatttaatagaaaggtgcctacaattatatatgaataaagatgaagtggtcaaaacactcttcgctcgggcaaagatagatcctggatttacaactctggtatggcagaagctggaagaggagaacactgatttctttagggcctactatatcaggctaaaattaaaaaggcaaatacttttgttcaatcatttgcttgagcatcagtatcatatgatgaagtatcccttgcctacaaagattccactggctcccatacagaatggagtccatccaatgcctgtcaacaacctacctatgggataccctgtgctacagaagtcttccattcctgcagctggtcaaccacatcttgactccatgggtagtggtatatcaagttgtcatgtagttaatggagtcctggcatcaagcaactcccatcccattagaatttccgggaatggtatggtgatggaccacagtgctcctgttattccaccaaatagtgcgatgtcatccttgtcagaaatgccagtgagtccgacatcagtagcatccaatggtcatttccccttcactccatcagaaatatcaggaatgggcaccgatacatctatccttgatacggcattcacatctgatgtggcaagctccgtaggacttcaacttgcaccggacaatggcacggggatttccagatccctggatcaaattcagtggaattttagtctatctgacttaacagcagatttgtcaaacttgggagatctaggagctctaggaaactatcctggttcaccatttatgcagtctgattcagatattttgcttgaatcatcggatcaaaaggacatagtggatgacttctttgctaatacagagcccccaggttctccgtcagacgaggagaaatcttaagtgaagttgtagcaagttatgtttcagattaaaatggttaggttgggtaagattaggattaataaatgtgtcgtccagattgctcggcgtacgagccgacaaatgtagctagcctgatgtataaaatcagggcgaagatggaaaacgtcaattgttagctgaagtagtaatcttgagttttatttttcagagaaagtgctatttggaaatgttaggtggtatggtaagaatgtgtaattgatgcatttggatatatattggttggttcacattacactactaatgagaactattcttcatgcagaataattttactttgttgga

SEQ ID NO: 3443 - DNA, 846 bp, Glycine max var. Williams 82
atgggaagagctccttgttgctctaaagtagggttgcatagaggtccatggactcctcgagaagatgcattgctcactaagtatattcaaactcatggagaaggccagtggagatcactaccaaaaagagccgggcttcttagatgcggaaaaagttgccgactgagatggatgaactatctgagaccagatataaagagaggaaacataaccccagaagaagatgatcttatagttagaatgcattcgcttttaggaaatagatggtccctcatcgcggggagattaccaggacgaacagataatgagattaagaactactggaatacccatctcagcaagaagctgagaaatcaaggaaccgatccaaagacacacgacaagttaactgaggcaccagagaagaagaagggtaaaaagaagaataagcaaaagaatgagaataacaaagggtcagagaagactttagtttatctaccaaaacccataagggttaaggctttatcatcatgtatacccagaacggatagcaccttaacccttaattccaattcagcaactgcatcaactagcgaagagaaagttcaaagcccagaagcagaagtaaaagaggtgaacatggtttggggggtaggtgacgatgcagacaatggtgggattgaaatattctttggtgaagaccatgacctagtcaacaatactgcctcttacgaggaatgctattctgatgttcacactgatgatcatggtacgctagaaaaactctacgaagagtacttgcagctcttgaatgttgaggagaagccagatgaattagattcttttgctcaatctttattggtgtaa

SEQ ID NO: 3444 - DNA, 1359 bp, Glycine max var. Williams 82
atgtttcttttcatatttctctcaaccctcgttttaatcgcggttcgagcgaagaagctatggatagcaatcgaagactggttccacgtgtaccagttcttcaaagtcccagaactcaacgaaaccacgcagcataaccacctctacaggaaggtctccctctacttacattccctaccttccatcgaagactctgtcttcgccaacctcatcactggcaagaagcaaaacgacatcgtcctctgcctcggccccaaccaaaccatccaagaccactttctcggagccacactcttctggttcaaccaaaccggaacctttgttctcaagatcagaaaggttgacaagcgccgaatcctccgtccttaccttcagcacattcacgccgtcgccgacgaaatcgaccagcaagggaagcgcgacttgcgcctcttcattaacagcgcccacgacttcggacgctggagatccgttccgtttacgcatccttccacgttcgacaccatcgccatggaaccggatctcaaaaccaaggtcaagtccgatctcgaatctttcctcagagccaagcagtactaccaccgcctcggccgcgtctggaaacggagcttcctcctctacggtccctccggcaccggaaaatcgagcttcgtcgccgccatggccaatttcctctcttacgacgtctacgagatcgacctctgcaaaatccctaacgattcggatctgaaatcgctcctcctccaatcgacgccgaagtcggtggtggtgatcgaggatctggaccggttcctcgcggacaaaacggcgagaataagcgcgtcgggaatactgaacttcatggacgggcttttaacctcgtgttgcgccgaagagagggttatggtgttcacgatgaacacgaaggagcatgttgacccgaacctgcttcgtccgggtcgggtcgacgtgcatattcattttccgctttgtgatttttcggcgtttaaaacgcttgcgagtagttaccttggcgtgaaggagcataagttgtttcctcaggtgcaggagatttttcaaaacggggcgagtttgagtcccgctgaaatcggtgagttgatgatcgcgaaccggaactcgccgagtcgtgctattaaatcggtcatcaccgccttgcaaacggacggtgatgggagggggtgcggcttgatcggacggcagacggatgatgatgaaatggatgaacctgatggggttgtgtgcggtgagggtctccatacggttaaggatttgcggaaactgtacgattttttcaggttcagggttactagaagatcttcgtcgtccaatgcttccttgcccgcaagcccattgcgataa

SEQ ID NO: 3445 - DNA, 834 bp, Glycine max var. Williams 82
atggccgccacactcactcttctaaagcttccaattcttcctaacaagccattactgccacgcccatcaacctcaaaacttgttccatttccttccatctattcaaagttaaatatcccaaaagattctaacccacaaaatttacccttcttagatcaaaacatcgatgctctcaagcctgtctttctttccctctcagcaatctcttttccattgttattagaaaccaaggatgctcttgctgttggaggagagtttgggatattggaaggaagatcatttgctctcatacaccccattgtgatgggttcttttttcttgtataccttgtgggcagggtatttggggtggcaatggcggcgagttaggacaatccagaatgatattaatgaactcaagaaacaagtcaaacctaacccagtcaccccagatggcaaaccagtggaagaagcagcaccatcaccagttgaactccaaatacagcaactcactgaggaaagaaaagagctgataaaaggttcctataaggatagacacttcaatgcaggatccatacttctaggatttggggtgcttgagtcagttggtggaggagtgaacacatggtttaggacaggaaagctttttcccggtccacatttatttgcgggagcagctattactgctttatgggcactggcagcagccctggtaccatcaatgcaaaaaggaaatgaaacagccagaaatcttcacatcgcgctgaatgcagtaaacgttctgctctttgtgtggcagattcccactggaattgacattgtgttcaaggtgtttgagttcacaacatggccttga

SEQ ID NO: 3446 - DNA, 1277 bp, Glycine max var. Williams 82
gtggttcagcacatgaaaaattacaaaacataaatcaatatcctttccctgggggcctcagaatccttaacacgagtgaaagtacaagttgcagggatggcctcaacctcctcctccacactctctatatcctcttcatccacccttgttgatgccaaggctccaagtccaagacaatccccacaatgtgtctcccctccacctgttcactctccttggaagaccactgctttctgtcgcaggattgcaagcaatgttatggcaatggctaccaccagagaggcacccgcagcagaagttgccacgaccgagctctctgttgccgagacgccagagattgtgaagactattcaagaagcttgggacaaagttgaagacaaatatgcagtgagttcacttgccgtagccggtgtggttgcattggttggctcagctggcatgatctcagcaattgataggcttcctttaattcctggggttcttgaggtcgtaggcattggctacagtggggtaagttcattaaattttactgttgccatcagctgcatgagattgttggataaaagtgttttcccttatttaatttgcttgttgcatattattttatattttaactctcgtatgatagtatatatatttacattattaaattatcagagtaaggcagaactgcttccaaggaaaatgaacaatagtagttaattttttaattttaagatggtttccttgcattcctgggttttggaacatccatttattcatcttcaatttgtctttctttgcagtggtttgcttacaagaacctatttttcaagcctgacaggtagagccgaattacgttgaataatttactgaaatttggttcaatgaattaacttcatgatatatgttttaatttccataatttgcttacaactacagggaagcttttctacgaaaggtaaaggaaacatatagcgaaatacttggaagcagctaaaacagtgaggaattgctgcttagattctgttcacacaaaagagatctctgtcttgcagcattttgttaaagatgcaaacctcgcttcattttgtcgcaataagcttcctgaccatactttatcccatgtgatgtaatctagcctgataataaatgtaactcttttaataatcaatctacttcaagaagatttcatttcttcaattatccctttgtggtttcaaagttaagaaaaaacatctaatgcatggatgacttcatgaatttgaaggaaaccttatcattgtatatattaatct

SEQ ID NO: 3447 - DNA, 201 bp, Glycine max var. Williams 82
atgggcactagagtgtgtgcagttgctgagcctgacaggcctctctggtcctccatggctggagagctggaatacttcacagacaccactagcctctttttcataggtgcatggttccagtacatttacactgccacctgtcctattgacaacctctttgctcaccttgcagatccttcctatactaaccatttcaattaa

SEQ ID NO: 3448 - DNA, 751 bp, Glycine max var. Williams 82
tcccacatgccacatggcaactcaccatctgattacccatttacactcctatactttaagataagagatcctgcatacatcaactaatttgcattaatcgatcatcaaacacatacacagagcctgccatggcttccgcttgtgcttcctctgccattgcagctattgccatctctacgccgagaagaatggatgaggcttgggaagagcaaaaggttgttttgttagtgggaggaagagagcagttggaggacgatggatgggcactagagtgtgtgcagttgctgagcctgacaggcctctctggtcctccatggctggagagctggaatacttcacagacaccactagcctctttttcataggtgcatggttccagtacatttacactgccacctgtcctattgacaacctctttgctcaccttgcagatccttcctatactaaccatttcaattaattgccttttctttattaatcacaggctttcacccctaagtgaaattaaaggcttagatcgatccacaactaatggatatgagattgccagctgtttgacccaatttatagagcgaaatcgtcttaggagatgagtgtttatgtctgtaatatgatctatatggtaatccaacgtgccgacatctatttaaattttagatgccatgaatgtaagttcaggtaataatcacatttgttcatatataagatcataacccacgttgaatggtatatttcatcattcacggcaaaa

SEQ ID NO: 3449 - DNA, 1026 bp, Glycine max var. Williams 82
atggaagtgaaaggaaggataagcaactccaccatcaccaccaccacaatccaaagtgaggatgagatggaccttcgaagaggtccttggaccgtcgatgaggatcttgctctcatcaattacattgctaatcatggtgaaggtcgatggaactccctagctcgttcagctggactcaaacgaactggcaagagctgcagattgagatggttgaattatttgcgtcccgatgttcgacgtggcaacatcacacttgaagaacagcttcttattctcgagctccatggtcgctggggaaaccgatggtctaaaattgctcaatatttgcctggaagaaccgataatgagataaagaattattggagaacccgtgtccaaaagcaagccaagcaactcaaatgtgacgtgaatagcaagcaattcaaggatgccatgcgctacctttggatgccaaggctggtggagcgcattcaagccgccgccgcggccgccaccactgccacggccaccgtgggttctccaacggcatcagctagtgctactacaaccatcaccactaacaacaacgccaccacatacaactacgagaacaacaacaacaacaaccttaacaacagttttgaagtgcacagtgggaacatgatgttgagaaatccagcaatcatgaacattaataattttgttggttcacacagttacactccagagaataatagcacgggtgcctcatcggattcatttggtgctcaggtttcgcctgtctcggacttgactcaggattattacaataatgtcacggttgagaataataacaacaacaataaccctaatcctgagtattaccaacaagcacatgatcaattgagtttcttagactgcatcacaagcccttcagggttgttcgatttccagtccatggaaccaaacaccccgtggattcagagtaatgttggggacacgtcaaccaacggtttctggaatgttgaaaacatgttgctctttcaacaactctctgacaacatgtga

SEQ ID NO: 3450 - DNA, 1359 bp, Glycine max var. Williams 82
atgactggaaagctagttgaattcatgtggcctgcattagtggctaataagatactcaacaagcgactcggaagcagcaattttatagcagattatccaagtaataatacagatatacccttattgggtcacgatcagtcatctctgagctccaaatccattcttaatgatcacaaggatacagacaaatacaagatttttgtcagcacatggaacgtgggtgggattgccccagatgaaggactgaatatggaggatttattggagacatccaacaattcctgtgacatctatgtacttgggtttcaagaaattgtgcctctaaaagcatccaatgtattggggtatgaaaacaataagatctctaccaagtggaattccataatcggaaaagctctaaacaagagcacacatcacagtttcagagatgataaaaaggaggaggatgtgaagaacaatatttgttgcaataataaggaagctggaaataataataataatccaggtcagcagtgtgaagccccacaagatttcgaatgtatcattagcaagcaaatggttggtatattgatatcagtatgggctaagagagaacttcgtccattcattcaacattcaagtgtctcacgtgtcggatgtggcatcatgggctgcttagggaacaagggttctgtatctgtgagatttgtgttacatgaaacaagcttttgctttgtgtgttgtcacctagcttctgggggaagagagggggatgagaagcatagaaactctaatgttgctgaaatattttcaaggtcaagctttcctagaggtcctatgcttgatttgccaagaaagattcttgatcatgaacacgtaatattgcttggagatttaaattacagaatttctctaccggaagaaacaacacgtttagttgttgaaaatgaagactgggattccctactagaatatgatcagctaacgatggagctaatgaggggaaacatgttaaaaggatggcatgaaggagcaatcaaatttgctccaacctacaagtattgtccaaattcagacatgtactatggatgttgttaccaaggcaaaaacgcagcgaagaagcgagcaccagcatggtgtgacagaattatatggtttggcaacggcttaaagcaaattcagtatgctagatgtgaatcaaaactatcggatcataggcccgtcaagacattatttatagcacaagtcagggtttcatcagcactaaaatgctttcaaagtttgtttctgtcagagagatttgaacaaattaaaacccactttggacttctctccaatgatgagtttgtatgtaaaaagcaattaagtttccggttgtga

SEQ ID NO: 3451 - DNA, 1804 bp, Glycine max var. Williams 82
aacaaacgtatgcacagaagaattcgaatcttgaagaagacccatgttttctccccctccctctctctcttcacccttgcactcttcatcatgagcatgatatcaatatgatccgttttcctttattgctgtggagttgtcattttgttctgatcatttctttttgccgccaaaagtagtataaaccattactatgactggaaagctagttgaattcatgtggcctgcattagtggctaataagatactcaacaagcgactcggaagcagcaattttatagcagattatccaagtaataatacagatatacccttattgggtcacgatcagtcatctctgagctccaaatccattcttaatgatcacaaggatacagacaaatacaagatttttgtcagcacatggaacgtgggtgggattgccccagatgaaggactgaatatggaggatttattggagacatccaacaattcctgtgacatctatgtacttgggtttcaagaaattgtgcctctaaaagcatccaatgtattggggtatgaaaacaataagatctctaccaagtggaattccataatcggaaaagctctaaacaagagcacacatcacagtttcagagatgataaaaaggaggaggatgtgaagaacaatatttgttgcaataataaggaagctggaaataataataataatccaggtcagcagtgtgaagccccacaagatttcgaatgtatcattagcaagcaaatggttggtatattgatatcagtatgggctaagagagaacttcgtccattcattcaacattcaagtgtctcacgtgtcggatgtggcatcatgggctgcttagggaacaagggttctgtatctgtgagatttgtgttacatgaaacaagcttttgctttgtgtgttgtcacctagcttctgggggaagagagggggatgagaagcatagaaactctaatgttgctgaaatattttcaaggtcaagctttcctagaggtcctatgcttgatttgccaagaaagattcttgatcatgaacacgtaatattgcttggagatttaaattacagaatttctctaccggaagaaacaacacgtttagttgttgaaaatgaagactgggattccctactagaatatgatcagctaacgatggagctaatgaggggaaacatgttaaaaggatggcatgaaggagcaatcaaatttgctccaacctacaagtattgtccaaattcagacatgtactatggatgttgttaccaaggcaaaaacgcagcgaagaagcgagcaccagcatggtgtgacagaattatatggtttggcaacggcttaaagcaaattcagtatgctagatgtgaatcaaaactatcggatcataggcccgtcaagacattatttatagcacaagtcagggtttcatcagcactaaaatgctttcaaagtttgtttctgtcagagagatttgaacaaattaaaacccactttggacttctctccaatgatgagtttgtatgtaaaaagcaattaagtttccggttgtgaatcattaactaattaatactagtgttcttatatacatagtactagtttgacctttggaaactatagtagttagagaagaaagcaaattaagaggtgacagaattagctcttttgctgatgagagatacaccgaagttggttgtttattaatgtgttatctattacactatgttgctagtttttgaattatccaatagaatgtgcaaatatatatgtcattgaacattaatattatacattttcttattcttt

SEQ ID NO: 3452 - DNA, 216 bp, Glycine max var. Williams 82
atggttgaggggtggaagggggagctgacaaagctcagagagaaagttgttatggcccgaaagagcctcttctccaaaggcaaagaggggtcagaagaagaacaagttgtgaagaaggaggctcacaaggttatgatggctgttcagagagacactcatgaaaccatgtcagaggcaacagtgtgcttgcttatggatagatttgtgccatgctga

SEQ ID NO: 3453 - DNA, 228 bp, Glycine max var. Williams 82
atgtttgaaccaagggacatgtggaccaagctgaaggaaaagggtgagacaattttctctaatgctggctggattcaccgtgaacctagccagggaattcaaggaaaggagaagagttcacctgggttggctgtggttgctggccaacaacacgtgcaagttcacacacctaggatgatgtattccgaggcttcagtttccatgcttgtcgaatgcttcagtgcttga

SEQ ID NO: 3454 - DNA, 384 bp, Glycine max var. Williams 82
atggcaatggccagtgcaacaactctagccacaatcactgttgtggcggctagccccagtgttggcagcagaaggagtgggaagaggaatgtgaacttcatcagagggttgaattcttttggagggttgaaggctcagaacaatgtgacattactaggccttcctgtgtgcactgagcagtgctttgcaaaggtggtgagctcattgaaatatccatcatcatcatcacgtaaggggagaggtggaggtgctgccttttcaacatgcaatgctgctggtgagattttccagattgcagccatcatgaatggccttgtgcttgttggggtggcaatagggtttgtccttcttcgagtcgaagcgtttgtggaagagtctgagtga

SEQ ID NO: 3455 - DNA, 531 bp, Glycine max var. Williams 82
atgggtctgaagtttacacatggagtggtgatattaattgttataagtgcttcaatgttttcagtgagcatggccaacaaggattggtcctttggtttcaactacactgattggtggtctagatttgggaatcatcctcaaaacaaaacacagcaacaacccaggcaaattctcgtgggtggctcagagcattggcactacggtttcaactacaccgattgggccttcaagactgccccattttacctcaatgatactctagttttcaaatatgatgctccaaatgccaccagtttcccacacagtgtgtacatgttcaaaagttttgggagcttcttgaagtgtgacattaaaaaggctaagatgctagcaaatcccacacaaggttcgggagagggcttcaagtttgtgttgaagaagtggcagcctcactactttgcctgtggtgagagaaatggcttccattgcaacaacggtaccatgaagttcgctgtgatgccaatgtttcgtcccttctggaagtggccttga

SEQ ID NO: 3456 - DNA, 462 bp, Glycine max var. Williams 82
atgtctcaacccgactcgttggtggctgagattgaggtgaaaacctctgctgatcacttttacgacaccttgaagggtaagaaacagcatcgtattcatgatgttgcccctcatcatatccataaggtggaagttcatgaaggtgagtgggataaatctggcaatatcaaggtgcttacattcgctgatggggacactgttgagaccttaaaggagagagttgattttgatgatgaaaacaagaagataacctacaccatattggagggtgtcatgttgaagtactataagagctacaaggttatcgttcatgttttaccaaaaggtgatgagcacagccttgtgaagtggactttcttgtatgagaaggtggatcacactgcccctgagccaaccaagtacaaagatttggtggttaaactcaccaagaacgtggaggctcatcttgttgaggctcgttaa

SEQ ID NO: 3457 - DNA, 1860 bp, Glycine max var. Williams 82
atggctgcttctacttctccaaacttcacaacatctttgcataagaactcccacaaaacaaagtttccttctttaccagggaagaaaactctgcacaccaaacttagtttctcattttcttttccgttcaataaatcgatacgtgtgaaatccattggcacggcgaagtatgatgaagttgtggtggatgaagagttggacaagattagaaggctgcagaatggttcagatgttagaggagtggcattggagggtgaaaagggcagaacagttgaccttactcctcctgcagttgaggcaatatcagagagttttggagagtggattatcaaaggtttaaagaaggaaaaaggataccctgtagagaatgttagagtgtctctcgggcgtgaccctcgagtcacagggtccaaattgagcgtcgcagtctttgcaggtctggctcgcgccggttgcatggtgtatgatatgggactagccaccaccccggcttgtttcatgagcactttgttgcctccatttgcctatgatgcttcaatgatgatgacagcttctcacttgccatacaccagaaatggtctgaaattttttacaaagagaggtggactgacttcaacagaggtggaggaaatatgtgaaaaagctgctcgtaaatatgcaaataggatggccaaggtgtctactttgcttaatgttcttccaacaaaagttgattttatgagcacctactcaatgcacctacgagaaatcatcaaggagagaatcaatcatcctttgcattatgacactccactccagggatttcagataatagtaaatgctggaaacggctcaggagggttcttcacatgggatgtgttagacaaacttggtgcagatacctttggctctctacatcttaaccctgatggaatgtttccaaatcacattcccaaccctgaggacaaaactgccatggcactcaccagagcagcagtgctacaaaactcagctgatcttggaatagtttttgacaccgatgtcgaccgaagcggcgtggttgatagcaaagggaatccaataaatggtgacaagctgattgctctcatgtctgcaattgtgctgagggaacatccaggatcaaccatagtgactgatgctcgtactagcatggcactcactagattcataactgatagaggtggtcaccattgcctataccgtgtcggatacagaaatgtcattgacaagggagtgcatcttaacaatgacggaattgaaacgcatcttatgatggaaacatctggtcatggtgctctcaaagaaaatcatttccttgatgacggggcttacatggtggtgaagattataattgaaatggttaggatgaagcttgctggatcaaatgaagggattggtagtcttatagaagatcttgaagaaccgtatgaatcagtggaacttaggataaatatcatctctgaacctcgacttgctaaagccaaaggaatcgaggctattgaaatatttagaaattacattgaggaagggagacttaaagggtgggagttagactcatgtggtgattgttgggtgagtgaagggtgccttgtagatacaaatgacaccccagctcccattgatgctcaaatgtacagggcaaaagtatcaaacgatgagcatgcacaacatggttgggttcacatgaggcagagtattcacaacccaaacattgctgtgaacctgcaatcatctgttcggggaggttgcttgtctatggcaagagcttttagagatgagttcctcaaagcaagtggagttcatacattccttgacattactcaagttgataagtttgctgaaaatggctccaaagcctaa

SEQ ID NO: 3458 - DNA, 204 bp, Glycine max var. Williams 82
atggagaacattctgggtctcatcaaacttcgtatcaaaagaggcactaatctcaaagtttgtgatactcgtacctgtgacccatatgtctttgtcaccatggccgaacagaaactgaaaactggtgttgtgaaagatagcattaatccagagtggaatgaagaattgacactttatccaataatgagtggtaatggctggtaa

SEQ ID NO: 3459 - DNA, 1203 bp, Glycine max var. Williams 82
atggcaacatttatccgaagaatagcaatcagctatattctcgtgacattgtttttctcttcagatattggattttttggacgtgttgcatcatttggaatcaactatggccaagtagctaacaatttgccccctccagacaaagtccttgaactcttcagcaacttaaaggtcacaaaaacaagaatttatgacaccaaccctcagattttgacagcttttgctaaatcaaacgttgaggtcattgttacggttgaaaacaacatgctaagccagttaaatgatccacaacaagcccttcaatgggtgagtggccatatcaaaccatacctcccagacacaaagatcacaggaattcaagtagggaatgagttatacacaaatggtgacaaaactctaattcagtatcttgttccagcagtggtgaacatccacaatgctctagttcagctaggcctagactccaacatccacgtttcgacgccgagttccttagaagtgcttcaggaatcataccctccttcagctggtagtttcaagagtgagatctcagggatcatgtcccagtttttgaacttcttggccaccactaaggcacccttttggatcaatgcatacccttactttgcatacaaggatgaccctaataggattccattggactatgttttattcaatcctaatgaaggaatggttgacccttacaccaacctacactatgataacatgctctatgctcaggtggatgcagtctcatttgccattgctaaattgggttttagtgggattgaggttagggtatctgagactggttggccatcccaaggagaccctaatgagattggtgcgtcagtgcagaatgctcaaacttataacaggaatttgctgagaaggcaaatggctaatgaagggacaccttttagtcctagaatgaggttggaagcatacatttttgcattgttcaatgaggacatgaagagtggagcaacctcggaaaggaactatggtctctttcaacctgatgaaactatggcttacaatgtagggttggctgcttttgcagactcatccacttcatccacttcaatttctcttacctcctctgccactaaaataaaggcagcatcaaatggatttcaaagcttgttcttcttctggatgtttgtgtgtttgctgacttcagccctttgtggctttgtttga

SEQ ID NO: 3460 - DNA, 3455 bp, Glycine max var. Williams 82
ttacaacctacaaactaacaagttaaaagaccttaaaagtttcgccatccatgattgatgattaacccaacacaacactttttttgtcttcatttctgtgcctaaaagtcccttcactgtctccactcttatacctagctgtctctctgctctccttgtttgttgttggctccgaattctaagaatgtgaaatttgtcaccctctcattcccacccttcagagatgacttccctcagagaactcctcacagacgaaggcttctaccaaacaacccctaacaacaacaaccctttgaagccaaagctcaaactctcaccaccaacaccagagataatactaaactcactccctctacacctatgcaatgacagaaaaagctttgttgattgctccaacaaaagcatagacaagtccatgacaagaaaagggtcttggccatttcactccaatactcaaagggttgttgttggttcagtttctgaaacttcattggtgtcaccaccaccaagaactgttgtgggaccccccatggatgaagttgccacaagagcagtggttgctatcctaagtggatacattggaagatatgtgaaagatgatagtttcaggaaaatggtaagggacaagtgcaattcttacttggtcagaaggagaagaaacggttcaggatcatcatcggaagaagaaaatgaggttctggtgaacatgaaactaggcatggagaatattgacaagttggtgcaggatcaagggacaaagaaagatatgaagatcaaaagcttgaggaattccattgagcttttgaccatagttgcttcactgaatagtaaaattagaacaacatcaagggaaagtggttcaacttgtggaatacccaattcccatatctctgcttgtgctcagctctacttggcaatagtttacaagcttcagaagaacaacaggatttgtgctaggcatttgctgcaagtattttgtgactctccttttttggccaggacttatttgcttcctgacctttgggagcatgtgttccttcctcaccttctccatcttaaaatttggtatgccgaggagctcgacgcagtttcggcctcaagtgaatgtcaaggtgagaaggacaagaaaatgaagaccttgagcaaggtgtatggtaacaaggtggacacaggaactgctatgtttgctttgtattacaagcagtggcttaaagttggggctaatgagcctcctcttcctattgtctctttgccttcaagaccaagttgcagatcatcaagaaaaatgtcttcagattcttttgttttgcattcctctatcaacacaaacttatacaaggaagtatttggccccaaactagagatgaaacctacccctctagctgaacaaaatggattgttgacaattagatggagctcaaggaatcatgaatacagctgcagttcacttcagaaagaagagacaatatacctaggaagatcatcaaggtcaattgacaagagttatgctgaaataaggctagggtcacagagattggacaattttcaatgcttttcttgcaggagtatgcaagcagaaagcttggtgaacagcagctacacatcctgcaatgcttcatttagaaatgaaacaactgtcctttcaagtgaatttgttggagctcttacaactatatgttcatcagatatattaagtgaatgtgaattctcaattcgtgtgattgccaaagcatggttgaactctcatgctgaccctctaattgaagaagcactgtcacagtctagtgtggttgaggctatccttgaggtattgtttgcctcaagtgaagatgaaattctagaattggctatatcagttttagcagaattagtaggaaggaatgatgcaattagacaaattatgctgaactcggatccacgactagaaatctttgtgagacttctaagaaggactggcctatttcaaaaagctgcagttctgctttatctgttaaagccacaagcaaaacagatgttatcaccagaatgggtgccactagtacttcgagtgttagaatttggagacaaagtgctgaccctcttcacagtacaatgcaatcctcaagtggctgcaatttactttctggaccaacttcttactggtttcgatgaagataggaatttagagaatgctaggcaggttgtttcacttggtggattgacccttcttatgaaaagaattgaagaaggagaaatccatgagagaaacaatgctgcttttatcatttatagttgcattcatgctgaagaaagctgccggagttttctagctgacaatataaagaagagttctttactagaactcatcgttcttggcaatagtaaaaattgcagtggatgtgccttttctgtgctagctgagttactataccttgatagaactaccaagattttaaatttcttgaggggacttaaagatggatggggtggcctaaacacaatgcacattctgttcatctaccttcagagggctccacctgaagaatgccctttggttgcagtggtattattgctgtttgatattatggaagatcctttcaaagagagcttatatagagcagaagcaattgaggcaattgtggctgctttaaattgtcaagtgtgtaatgacaaaatacaagaacaatcagcaagagctttactcttgttagcaggacacttttcttatacaggagaatcattaatggaaagaactcttctacaacaagctggcttccaagaaaattgcttagaagattcctcttatggcaaggaaattgttgtttatgattcagctcacaagaatgaagaggatgatgaagctgaaagttggcgaagaacagcagccaatgtcttgttgaaaagtggaaataagaatttactaagtgtactttcagattctgcagcaaatggagttccaagtttagcaagagctagccttgtaacaatttcatggatgagcagctaccttcacttagttgatgatagaaagcttccaccaatggcattatcaatcctcatgccattgttgctaaaatacttgaattatgacaaggatgttgaggcaagagtcttggcttcatattcattgctatgccttgtaaaaatttcaggatgtgtctctttcctatcatcactagataaagactcactcaaacatctccagaatctctctctagtgacgtggacttccaatgagctaatttcaatcatctccaaaagcagcttgcaataaaaaccaatgaaaagcaaaactccattgtttgaactcttcagtgtgtgttcattatttgtcttttatgtacatgtgattgtaatcagtaatcacccttgagtttgtatagttgattagtttgaaactttgaatggaattgtttctaacaaaatctaccaaaatatatttgtttcattttatgatagcttatgatttcacaacc

SEQ ID NO: 3461 - DNA, 675 bp, Glycine max var. Williams 82
atggagaaaatgagggtgatagtaattactgtattcctatttataggtgcagcaattgcagaagatgttggtattggtctccttagcgaagctgaggcgtatgtgtctcctaagttaaaaaagttcatcacaccttgcacttcgcatgttggtgaaacatgcagtactactagtagtagtggaagtgaagcattaatgcagaaccagggtgggttggctctttgccttttcgattctatggagagatgcttggtagaccatggtgcccaactttatcaaacaagtgttactaaccttcaagttgaaccttctgaagtatttccaaggaagaataatccacaaggtggacgtaagtccaaattagatgaccatcaagttcaacccttatcatttcgattaccaccatttcgattaccaccaatgccaaaactaggaccaacaagtccgattataagaacgattccatcaccacccatagctcctcgagatttgtcactcattgagactatacaattacgaactgccttgagaacctgtactcatgtcactgcacgaacttgtctcactgctccaaatgttgccacatctgatttagaggcttgtctcactccatccatgaatcaatgcatctatcctcgtggagctgaatatggtaccccgcctattagggcgtaa

SEQ ID NO: 3462 - DNA, 2937 bp, Glycine max var. Williams 82
atggctgctctacccttctcaacaacctgcaggcattccaactcacctttacatcacaattcaaaaacaagcttcataggtttcagccaaagaaacaatatttggcagttgtttgtcatcacaaagtcaaattccagacgggcaataagaaagctctgcgtgaagaatgtcaccagcgataagaagcaggaactggaagaaccactcaatgaacaagacactttcaatgaatttgtaccagattctgcatctattgcttcaagcatcaaattccatgccgagttcaccagccctttttctccagagaagtttgagctcaataaggctttctttgcaacggcagagagtgttcgtgattccctcatcataaattggaatgcaacaaatgactactatgaaaggatgaacgttaagcaagcttattatatgtctatggagtatctacagggtagggcattgctaaatgcaattgggaatttacagctctcaggtccttatgctgaggctcttagaaagctgggtcacaatttagaggatgtggctaataaggagccggatgctgcccttgggaatgggggattaggtcggcttgcttcttgctttctggactccttggcaaccttgaattaccctgcatggggatatggacttagatacaagtatggtttattcaaacaacacataacaaaggatggacaagtggaagttgctgaaaactggcttgagatgggaaatccctgggaaattctgaaaaatgatgtctcttatccagttaaattctatggagaagttatttcagggccaaatggaagtaaacagtgggttggtggagaaaatatattggctgttgcttatgatgttccaatacctggatacaaaactagaaccactataaacctgcggttatggtccactaaagtttcaccagaagaatttgatttgcaagcttataattctggagatcatgccaaagcatatgctgttatgaaaaatgcagagaagatctgctacgttctgtaccctggtgatgaatcaatagatggaaagactctgcgactgaagcaacaatacacactatgctctgcttctctccaggacatctttgcacgctttgaaaggagattgggaaagagagtaaattgggacactctcccagataaagtggtggtgcaaatgaatgatactcacccaactctctgcattcctgagataattaggatattggtggatgtcaagggtttaagttgggagaaagcctggaatattactaagagaacggttgcttacacaaatcacacaattctaccggaggcactagagaaatggagtttgactcttcttcaggatttgcttcctcgacacatggaaataatacgaaagatagatgaggagttgataaatgaaatcatttctgagtatgggatagatgatctggacttattccaacaaaggcttaaaaaaatgagaatactagaaaatatcgagttgcctaactcagtgatggagctgcttagcattacagaagagactccagctgttgatcctgtgaaggaaattgatgttgatgatactgatgtaaaggcaactgaaaaagaagatggtgatgatgatgatgactatgaagtagtagaagaggaacaagaagaagataatgaagaaccatctgtcgaagaggatactagcaataaaatagaactgaaattcaaagttgatccaaagctaccaatgatggttcgcatggctaatctatgtgttgttggtgggttttctgtaaatggggtagctgagattcatagcaagattgtaaaggaggaagtttttgatgaattttacaagttgtggcctgagaaattccagaataaaacaaatggggtgactcctagaagatggatccgtttctgcaatcctgatcttagtaaaatcataaccaagtggattggaacagaagactgggtgacagatcttgagaaattggctatacttcgcaagtttgcagataatgaggatctacagctagagtggatagaagcaaaaagaagaaacaagattagggttgcatcatttctcaaagagaaaaccggttatgttgtcaatccaaatgcaatgtttgatgtacaggtgaaacgcattcatgaatacaaacgacagttattgaatatcttgggaattgtttatcgctacaaaaagatgaaagaattgagtgctgaggaaaggaaagatatgtttgttcctcgagtttgtatttttgggggaaaagcatttgcaacatatgttcaagccaagcggatagtaaaattcatcacagatgtgggagctacaatcaacagtgatccagagattggcgatcttttgaaggttgtatttgttcctgattacaatgtcagtgttgctgaaatgctaattcctggcagtgagtcgtcccagcacatcagcacggctgggatggaagccagtggaacaagcaacatgaaatttgcaatgaatggatgcatagttattggaactcttgatggagctaatgttgaaataagagaagaggttggagaagataacttctttctttttggtgcgcgagctcaagaaattgtcgggctacggaaagaaagagttgagggaaagtttgtaccagatccacggtttgaagaagtaaaggcatatgtaagaagtggtgtttttggcccttacaattacgaagaattgatggggtccttggaagggaatgaaggctatggtcgtgctgattatttccttgttggcaaggacttccctagctacctggagtgccaagaagaagttgacaaggcttatcatgatcaaaaaagatggacaaaaatgtcaatcttgaacacagctggttcattcaaattcagcagtgaccggaccattcatgaatatgctagagatatatggagaattgaacccgttgaattggcttga

SEQ ID NO: 3463 - DNA, 843 bp, Glycine max var. Williams 82
atggagggtggcacaacaagctctgaactcccccctggctttaggtttcatccaacggatgaggaactgattgtgtattacctttgtaaccaagccacctcaaagccatgccctgcatctatcatcccagaagtggatctctataagtttgatccatgggaattgccagataaaacagaatttggagaaaatgaatggtatttctttactccaagagacaggaagtacccaaatggggtgaggcctaaccgagcaaccgtgtcagggtattggaaggctactggcacagacaaggcaatctacagtggatctaagcatgtaggggtgaagaaatctttagtcttttacaagggtaggccaccaaagggtgccaagacagattggatcatgcatgagtatcgattggctgaatcaaaaataccatctagcaggaaaattggatccatgaggctggatgactgggtcttgtgcaggatctataagaagaagagcatggtaaaggcattggagcacaaagaggcacagcctaaagtccaaattgctaatcttgcagctgcaaatcaagatgttgaacagaaaatgatgaaccttcctaggacttggtcccttgcttaccttttggatatgaattacttgggtccaattttatctgatggctcttattgcccaaccttagattttcaaattaacaatgccaatattgaatttgacccttttgtgaaatctcaaccggttgaaatgaactacaattatgaagcagattcagggaagtaccaagtgaaacagagtagcaccattgaccaacccatatatgtgaaacaaatgtatgatttgctaggataa

SEQ ID NO: 3464 - DNA, 594 bp, Glycine max var. Williams 82
atgattgtttgcctgcaatggctcaggtacttacaggacgtcatgaaacttctgttccatgattgtttgcctgcaagggctcaggtagattatcgtggctatgaagtaacagtggaaaactttttacgggtacttacaggacgtcatgaaacttctgttccaaggtccaagagtcttcttagtgatgaaggaagtcatattcttctgtatatgacagggcacgggggtgatgagtttttgaagtttcaggactcagaagagcttcaaagtcatgatttagctgatgttgtgaagcaaatgaaagagaagcataggtttaaggagcttctaataatggtggacacctgccaagcctctaccctgttctgccagcttcattcgccaggtgttttggcaattggaagtagtatgaaaggagagaattcatattcacctcatttggactcagatgttggtgtttcagttgttgatcgctttacattttacactcttgctttctttgagaggctgaatatgaatgacaatgcttcattgagcgggcactggtatagcaaacttagaatgtgttgttctacctccgagcagcagtactga

SEQ ID NO: 3465 - DNA, 2167 bp, Glycine max var. Williams 82
acacttctttttcttttaccttttagtttttctgatattccagaaatacccaccctctgtcaccttctccccctccgctgcaaccccactcccgcggccgcaccgcctcaacaacgccaaagagatctctgcaggaatcctcaccttgttggatgtctctttcatattaaagttcctcaggccatctaaagtaatccaatcaaattctacccgctttgctgaggcggcaggcttgactgtctttgatagcacactgttgtcagttatttagaagagaagatatttgtatctttctacctttttgggcttttgatatgtagcctctttcagaggatgattgtttgcctgcaatggctcaggtacttacaggacgtcatgaaacttctgttccatgattgtttgcctgcaagggctcaggtagattatcgtggctatgaagtaacagtggaaaactttttacgggtacttacaggacgtcatgaaacttctgttccaaggtccaagagtcttcttagtgatgaaggaagtcatattcttctgtatatgacagggcacgggggtgatgagtttttgaagtttcaggactcagaagagcttcaaagtcatgatttagctgatgttgtgaagcaaatgaaagagaagcataggtttaaggagcttctaataatggtggacacctgccaagcctctaccctgttctgccagcttcattcgccaggtgttttggcaattggaagtagtatgaaaggagagaattcatattcacctcatttggactcagatgttggtgtttcagttgttgatcgctttacattttacactcttgctttctttgagaggctgaatatgaatgacaatgcttcattgagcgggcactggtatagcaaacttagaatgtgttgttctacctccgagcagcagtactgaagcaatctcacttgaagctactgttaaaacaattccacaattagatcgtatagcaaatgataaaattttccaaataaatgtcttcccgataccaccatatctacaaagaaaataaactccacccgattgacttgcaacaacacgcataatcttatcaaaaataaaagtctgcttatttgcatttagtaatgtatacatcatgaattagtagtatagattgttgggaatgaatattatattaagaaaaactaaaatatgttgtgcatacctgctagtgagtgacaacatttgttgaattcagtgcacaaaatttccttatcataagccatttcattgtagatgagcttatttccatgtggattggcagcatatcctattgggtatgacattgaaggaaaatctcgtagacttttcccgttggcttgcagcagattttcaatttcagtcaaacatagatgcattatttctttgtcagttagttgaatgcctgtgaatagtacagaaattacttcgttagtaagtgacttgtttcatatgaatgatatgcaattatttaggatgtttgaaattaccttgtcttttatgattaaatagaatatcatctgtcatccattgtcatgtttgttcccacacatattttggtctattcatggtattcataaatagcagcttcacaaataactttctaagaaagtgttcagatccccaagtgttagcttctcgtaaaacaccaacaaattcttgatcatttcctagaaaaccttttgcaaaacatgtttctctaaatgtattgtagaccacattttctattgttctaatatctttctaagattgtgaccctttagcggaggatagcattatcctcatgtagaataactctccacttgaagggggtacccatatgatcctgccaattgtatttccttgttttcttggttgctagtatcttttgtgtgcaacataaacgaattcggacacatatttagcataagatcgatcctgtccatgagggtatattttattagaatccatccaagctttaaacattgattcttttattgtactctttgatagtactgaacctatttgttgactatcttttcagtaaataggtaggctgttgattttcaaggtgaaaatagagacattcaactgctggtgcacgttcatgcattgggaatgcaaaaatcttccaatatgcctcacagggcaacacatacctggtgaatgaataataaaa

SEQ ID NO: 3466 - DNA, 963 bp, Glycine max var. Williams 82
atggcacgtactcctgacaagattaagtctattgacgggtcaagagaaacccttaaacttgctgtaaggatcacagatctttggttcgttgggactcccaacaagtctgagcaagctgaaattgttattgtagattctgatggagatgaaatctatgttgtttgtaaggcagaccagctaaagtcttggaaagctgatttgaaggaaaattccacttatgtcatgcataattttaaagtgatgaagaatgatggtcaattcagagtctgtgagcatcaatataaattagtttttattggagttactgttgttgggcaatccaatttagatgaccttccttttaaggaatttagatttgttgaattttccaatatcatttatggcaatttcgaggctggcctgttggttgacattattggcgtcgttgatgaggatttgagtggccaagtgttatcttgcactatttgggaaaattactatttacagttcttagcctacttgaatgagattgaaaatgatggcccgatggttatcattttgacacatgccagaatcaaagaagggcagggatcctatccaccttcagtgagtaatttgttgaaggcctcacaattattgattaatgaacctgtattggaaatccaagaattcagggagaggctttcagatttaggtattgaggatattgtttgtgttaccgtgggcacaattagcagaatagtaatggataatcattcgtggtgttatccaacttgcattcaatgccacaagaaaactgacatagaggcagcaccattcaaatgcggatgtggcaaagagaatgatcaacctgtcctgagggttgccattaacgccaaaaaaagtctatcatctgatgaaattgatgatgagccaagaagctcacaaatttcaccagcccaacttttgtctaacaaattagctagacattctcacattaaatga

SEQ ID NO: 3467 - DNA, 810 bp, Glycine max var. Williams 82
atggtgacaccagaaaagagcctttcaacagctttaaatgccagaaccataggctcaggcaatgagaccatagttttgtgtcacgggtttggaacagaccagtcaatttgggacaaaatcattcctcttttggctgaaaactacactctagttctctttgattggcccttttctggggctgtcacagataagagcctttatgaccatgccaagtacacatccttcgaaccttatgctgatgatttaatcactatcatagatgagatggacctcaaatgtgtcacttttgttggacattccatgtctgctatgatcggttgcattgcctcaactaaaaagcctgagctctttaagagacttattcttgttactgcttcaccaaggtatataaacacagatgactacgaaggtggctttgagagttcagatattgagcaactagtctcaaccatagagtcgcaatacgaaaattggatctcaatctatgctcctattgcagttgatccaaatgatgttgcctctgttgacaaattccacaactgcttgaaaagtatgggtgctgaagttgcaatttccttagccaaaactgtgttttacagtgattacagagacatgcttgaaaaggttcaaataccctgcactatcatccaatcaagcaatgatatggctgttccacttaacatagggcactacttggaggagaaaattaaaggggtgtccactttggagatcatagacatgattggtcatttccctcatctaactgcacaccttaagctagttgaggtgttgaagggtgttttgagatga

SEQ ID NO: 3468 - DNA, 1129 bp, Glycine max var. Williams 82
accaccaagtacctaggtatacataattctagttcagtttttttttactcctttcttagtgaaccatattttcaaacatggtgacaccagaaaagagcctttcaacagctttaaatgccagaaccataggctcaggcaatgagaccatagttttgtgtcacgggtttggaacagaccagtcaatttgggacaaaatcattcctcttttggctgaaaactacactctagttctctttgattggcccttttctggggctgtcacagataagagcctttatgaccatgccaagtacacatccttcgaaccttatgctgatgatttaatcactatcatagatgagatggacctcaaatgtgtcacttttgttggacattccatgtctgctatgatcggttgcattgcctcaactaaaaagcctgagctctttaagagacttattcttgttactgcttcaccaaggtatataaacacagatgactacgaaggtggctttgagagttcagatattgagcaactagtctcaaccatagagtcgcaatacgaaaattggatctcaatctatgctcctattgcagttgatccaaatgatgttgcctctgttgacaaattccacaactgcttgaaaagtatgggtgctgaagttgcaatttccttagccaaaactgtgttttacagtgattacagagacatgcttgaaaaggttcaaataccctgcactatcatccaatcaagcaatgatatggctgttccacttaacatagggcactacttggaggagaaaattaaaggggtgtccactttggagatcatagacatgattggtcatttccctcatctaactgcacaccttaagctagttgaggtgttgaagggtgttttgagatgagttaatttggcatgtaagtcatctttaattgtcaattctatctccttgtgtcaagtgttacattgtgaaatttgtgtaatagtaaaagaagcagatagatgctgaagaaatagaatatggtattaattacgatttgtgtggaagtgtgtattctattgtaaactgactggcaaagtggattgttgaagccataatattgttggtattatcctttttgcgtgaactaaaattttaagtatcac

SEQ ID NO: 3469 - DNA, 5058 bp, Glycine max var. Williams 82
atggatgaggggcttgctcagattgttaaacactacgcatcaaataaggttgcatttaagataaagttgtttccaggatcttcaccaaaagatgtggctttagaacaggccacaaaactcaatgcaacttgggtgatacttgacaggcaaatgaagaaagataaggagtttttcctggagaagctttcttgtggtatatctatattaaggcataacaatcggattgttcgactacgacctatagatctcccagacgaaataccatgtaacggccatgaaacatatgatgaaagcttaccaagtgttccatataaagatcttttcaacgttgatgttttccccaagagcacacttgaagttgatgagttgaaccagatacaaagcaggccctatgaggaagaggggtgctcaaatattactaccaatactaatgaaaaaacatgtcagacaatggatggaacagaaataaatagtaaccaaatgattgacaaaatagaaagagatgagcaaggccaagatcaagaacagttgcaaagcatgccccatgagacagaggaggacacaacaattgtgattaaaaatgatcaaacaactgctcgagaaataggtgatcaaccgaaccaagatgaagaaaagacaaacaacttcctcaatggtgagaggtgggacttgaggaatccagaaaagaatgaagaaatgattaatcaaccaatagatgatctgctgagccggaatcaagcacagatgctgagcatatccaatggggttatattggatggagaggaagagaaaattattttggaaaactcaatgtccactttctgctctgtctgcaaaactagacgaccaaatattgggtggaaaaaggaatttagttatgaagaactccaagcagccacagatgcattttcattgaagaattgtctctctgaaagtggatctctattcactttccaaggccagatggagggagggatgaaactagtggttaagcagcatgatgtaagaaacactcaagtaagggaaaaagttaattcaggaatgcaaaccatcctcaaagctagacataagaatgtgatcatgctatttggttcatctacagcagaatgtttcctgttcactgtatatgagtatgcatgcaatggttcacttgacaagtatctatcaaaagaaggctccagaccattgacttggatagaaaggaaaagagttgcaataggcattgccagaggtcttaagtacctacatgaaaataacattgttcattgcaatataaaaccaagcaatattcttctaacacatgacttcaaaccaatgattggagattttggctatgggaaagaactagatttgaagtcctacaaaaataaaaacaaagggaattgcgaatatgcagcaccagaataccaggaaaagcggaaattttcaactaagacagatgtatactcatttggtgtggttattttagagttgatcacagggcgaaggactacagatttaatgttggaagataaatgccttgttgaatgggcaaagcctcttcttaaaagaaagaagtactcagagttggtggatcccataatcagaaactcatacgaagaggaacaccttcgttggctggtccaagtaacaacacaatgtctaaaaaagaatcctaaggaaagattatcaatgaatatggttgtttctgcattacaaggcatagcagaaagtgaaacctgccacatgacagaagacattactccagctatatcagattcaacaattgtgccagacataaatggttcacaaggtccaacaacaacaaaagctgatgagcaaagtcaggaagaggagaaaatcaagagcagattccatgcggaggaaaagaagttaagactaataattgaaaataatcacttttactccgataaacttggccagattgaagaacagatgcagagaaggccccaaggggaggagaagagctcaggaaagttgataatcaatgaccgcatgatggatcagacagtagttaatcagctgagtgagtttgaagaacagatgccaagcaccttccatagggaaggcatcacaactcagaaaattagtgtcaaccacatgataagtcccacaaaaggtgatcagttgagccaggatcaagaagaggagataaactttattgaaatgaaaataggcttaataccagaacctattagtggaatgatagatcaaacaaaagcagatcagctggtccaggataaaacacaaacacagcggagatgccatgacgatttactggatgagcgtcaaggtgaaatcattttggagaattcaaagtcctctgcatgctgtatatgcaaaagtaggcgtccgaacaatgcatggacaaaagactttaattatgaagaactcctagaagctacagaaggattttcaattgagaactcgttatcagaaagagaagatggacctacttttgaaggcttgctagagagacaggtaaaaatagttgttaagaaatatcaagttactacatcccaccaagagaagatattaaaatcagaagtacagttgttcatcagtgctagacataaaaatgtggtcatgttgttgggtttatgcacaaataaaagccaactgatgattgtgtatgagcaagtatgcaacggttcacttgaacagtacctaacaaggggaagtttccagtcattgacttggaagcaaaggctgaaagtggcaatgggtactgccagaggtttaaagtacctacatgggaataacataattcatggaaatataaaaccaagtaacattcttctaacacatgacttcgaaccacggattggagattttgactttggaaaagtgaaacatggaccaaagaaatccagcaaagataaaagtgtacggaattctggatatgcagcacctgagtatgttgagaatggaaaagtatcaaataagacagatgtgtactcctttggagtggttcttttagagctgatcagtggccggagggctacagacaaattaccaggtggaaaaagccttgttgactgggcaaggcctctactgggaggaaagaagtaccctaagttggtggatctgaaaatcagtaactcctatgaagaagaaaaacttctatggttggttcaagtaacagaacaatgtctcagaaagaatcctaaggaaagaataacaatgaatatggttgtatcttcattacaaggcatagaagaatcagctgagtattctgtaattgaagactctcctccagaaaactcatgcttaccacatgatgagcctgccatgattagtacacaaggtcaaatgaaagctgatccagtgaagcaggagcaagaatggattggcagaaaccaatatgaggaggaaagaagcctaagattaacagtcataaccaatgacataataggtcagcgaaatgcagatcaactgatacagggtggagaagatgtgcagagcagcccccatgaagagatgtccagagtaacagttatcagcaatgacgtgattgatgagaaaaattctaaccaaaaaatccaggaaaaactgcagattaagggaagctgtgatgagggtttgaagaatgcgaatgaagcgaaagtcattttggagaattcgaagtcttctgtatgctcaatctgtagaagtaggcgtccatacagtggattgcaaaagaaatatacttatgaagaacttgaagctgctacagaaggattttcaataaagtattctctatgtgaaggtgaatatggacctgctttcagaggccagctagagaataaccaagaaatagttattaagcaacacacattcacaagcttacaagaacagaaggtctttatctcagaattccaattgctcataaatgccagacatgaaaatgtgatcatgctgttgggttcgtgtatacgattaagtcaattgctaattgtatacgagaaggcatgcaacggttcacttgaccagtacttatcaaggcaaagtgctacatcattgacttggggagaaagggtgaaagttgcaataggtgttgccagaggtctaaagtatctacatgagaataatatagtacatggaggaataaaacctagtaacattcttctaaatcatgagttcaaaccaatggtaggagattttgtgtttggaaaagaaagatgtgaattgaagaatgtctgcaagcaaaaaagtatacggaattgtggatacactgcaccagagtgtcaggagagtgaagaattatcaactgaggcagatgtgtactcttttggtgtagttcttgtagagttgattgccggccgtatgatagcagataaaatattaggacagaaatgtcttgttgaatgtgtaaggtcacttcttggacgaagagagtatcgacagttggtggatcccaaagtcagaagctcctatgatgaacaagaacttgtttcattgttccacataacagaaaattgtctgaaaaagaatccaaaggaaagattcacaatgaatatggttgtctctgcactgccatgtgtagcaaatagcaatggcctctatgtaaaggaagacttttcaccagaaaactcaaatgtttcagatgcaaaaaactcaaaaggtgaagaggaatcactgaaagaaaacaatttaggaacagagaatactgaagaggtaaggatgaatcacagagaaggtgagaaagaggaatcattggaggaagaagatttagacacagagaatagtgaaaaggtaaggaggaatcacaaagaaggtgagaaggaggaaacactagaagaagaagaagatttaggcacagagaatagagaagaaagagtggaacaaataacttgtagtagaggcaataatgaaccagaagttagtcaagagtgtgatacctacacaaagtgtggtgaaattagtaagaaaacagaagaaaaagaaggttctagcaccaagctatgtcaaaaatgggaagggtgcttatcttatggtggagctagaaaattttatcaccaaggggctcaagaatacacagcatgtaaagaatttttcggctggtgtgattccatttga

SEQ ID NO: 3470 - DNA, 1828 bp, Glycine max var. Williams 82
aatggttgttgctgggtacagggcgcaaccccctttatgtggcagatatgataattgagttgagttggggagtttctctttttacctaccccgaattttgtttttgaaatgagaataggatgccagtgaaaacccaggaaatttttgctgctgtagtctttgctgttttgattcatttccagttcatcattgggagatattagtatttgggagttacggtgtttgctcaaagatgattactaacccttcattgcatgcttcaacattgccaagtgctttatcttcatctctgattactctacatggaagttctgtaaagtgtatgccctgccttccatttagagccctaagaaaaatcaactggataagagctacatctgctgcagatggagggcctattgagtcatcgccagctttgggatcaaaaaatcctcttgcggttgttttggacattcctcgtaccatttggaagaaaacaatgcgtccattaagtgattttgggtttggtggtaggagcatatgggaaggtggggtaggattgtttttagtttcaagtgcggttctatttgcgcttagtttggcctggttgaagggtttccaaatgcgatccaaattcaggaagtacacagcaacatttgagtttgatcaggcttgcggtatttgcactggaactcctgtgaggatcagaggggtgactgtaggtgatgtcattcgtgtgaatccttccttaagaagtattgaagctattgttgagattgaagacgataaaacaatcataccgcgaaattcattggttgaagtaaaccagtcaggtcttcttatggaaactataatcgacattactcctcgtgatcctattccaacaccttcggctggacctcttgaccaagaatgttctaaagaagcactcattgtgtgtgatagagaaaagattaagggtatagaaggagtgagtttggataaattggttgggatatttacccgtcttgggcaagatgtagagaaaattggcattgttaatagctattcgttggctgaacgagctgcttcaattatcaaagaagcgaaaccacttcttataaagatgaaagccatggctgaagatgttcaacctttgttgactgaagtccgtgatagtggcctgttgaaggaagttgagaatttaacccgaagccttacacaagcaactgaggatttgagaagggtacactcatccataatgacccctgagaacactgaactgctccaaaagtccatatatactcttatttttaccctgaagaacattgagaatgttagctcggatattttgggtttcactggcgatgaagctacaagaaagagtttgaaattacttatcaagtccctcagcaggttattgtgaggtcaacagtccaattttagtaggatataatgcaattaggttatttccaatgtgtttcaccaaccacaacattgaaggagtaaatattaccgtgactgtttttttgttgtctctaaggagtggcaatactgatggtttttacattctactgtgatagaaatttgtttacaacgaggtgcagagatgttattgattggggcagatgattgctatgtgcacaaacttattttgctgaaattgttattcatttgtgtagaatggaggtgattcttaatgattgtcagtcacacttcagctaaaatgaccctgacttttgttaattgccattgcaaaacaaacaactaatggaaattgtcatcttcgaaactcgaaggccatatcacatggtatgatggttgtaaattcattcttgggatacaaacttttttgccacaaacataagag

SEQ ID NO: 3471 - DNA, 1452 bp, Glycine max var. Williams 82
atgaagaagaagctttctctttatgcttttttgctcaatttgagtctcttggttcttcttccttacagcaaagccactcaggctgataagcttcaagatttgattctgtctaagagctcgcagaagccacctgtgaccctttcttgggcagaggaagatgcgttgaaaactcattcttctgcatatgttgcatcccaagaggggcaaaaggaagctgacaagattgtcgcattgcctggccaaccctatggggtgaattttgaccaatattcaggctatgtcactgttgatccagaggccggaagagcacttttctattattttgtggagtcttcatataacccttcgactaaacctttagtattgtggctaaatggaggacctggttgttcctcactggggtatggtgcctttgaggaattgggacctttcagaataaactctgatggcaaaacactatatcgcaacaaatatgcttggaatgtagaatcccctgctggagtgggcttttcctactcaaatactatttctgactatgagcattcaggagataagtcaactgcaaaagatgcctatgttttcctgatcaattggctagagaggtttccagagtacaaaacccgcgatttttacataactggagagagctatgctggccattatgtgcctcagcttgcatacactattttggtgaacaataaattcagtcaacaaaatattaacctcaaaggcattgctatagggaatgcttggattgatgatgttacaagtttgaaggggatatatgattacatatggactcatgctttgagctcagatcaaactcatgagttgattgagaagtactgcgatttcacttctgaaaacgtttctgcgatatgtgccaatgcaacaagaacagcctttgaggagaatggaaacatagacccttataacatctatgctccactgtgtcaggactcttctcttaaaaatggatcaactggttctgtatatgattttgacccgtgttctgattactacggggaagcctatctaaataggccagaggtccaattagctcttcatgcaaaacccacaaactggacccactgcagtgatataataaactggaacgacagtccagctagcatcctacccgtcatcaagtatctcatcgacagtgacattggattgtggatatacagtggtgatactgattcagttgttccagtcacatcttcaagatattcaatcaacaccctcaagctccctatccaggttccttggcgtccatggtattctggaaatgaggttggaggatatgtggttaaatacaacggtgtgacatttgttacagtaagaggagcgggacatctggttccaagctggcaaccatcgcggactctgactttgatattttcattcctccatggaagcttgcctcctacttcaccatggaagggtttctag

SEQ ID NO: 3472 - DNA, 1452 bp, Glycine max var. Williams 82; identical to SEQ ID NO: 3471

SEQ ID NO: 3473 - DNA, 1065 bp, Glycine max var. Williams 82
atgaaaagatttcatagtgatagtaaattctttactttttcgatcttgattttccttgttgtactcccgactctagtcgttgctgagtgcacgtgcgatcgagaagatgaggagcgtgacaaatcaaaagctttaaggtacaaaatagcggctttggtatcaatactagttgctggcgcgatcggcgtgtgcattccacttcttggcaaagttatatccgctttgagccctgagaaggataccttcttcatcattaaggcctttgcggcaggagtgatattatcaaccggttttattcatgtcctaccggacgctttcgagaacctcacgtcgccttgtttaaaggagcatccatggggtgagtttcctttcactggctttgtggctatgtgcactgccatgggtactcttatggttgacacttatgccacggcttattttaaaaaacatcatcattcacaagatgaggccacagatgtagaaaaggaatcagggcatgaaggacatgtgcatcttcacacacatgcaacacatggtcatgcacatgggcatgttccaactgatgatgatcaatcatcggaacttcttcgtcatagggtcatatcacaggtgttggaggtaggaattattgttcattctatcatcattggaatttctttgggagcttcagagagtcctaaaacaataagaccactgatggctgcattgatttttcatcaattttttgaaggcatgggacttggaagttgtataactcaggcaaatttcaagaagttatctattacattaatggggttagtctttgctttaacaactccaatgggaattggaattggcatagggatcactaaagtttacgatgaaaacagtccaactgcccttattgtggaaggaatcttcaatgcagcatcagctgggatattgatttacatggcacttgtagatcttcttgctgcagattttatgaatccaagaatgcaaaaaagtggcagcctccgattaggagccaatctctctcttctacttggagctggttgtatgtctcttctggctaaatgggcttaa

SEQ ID NO: 3474 - DNA, 1480 bp, Glycine max var. Williams 82
gaggacggttcaagtatttaaatcattttttgtcacttgttctctacatttccatattaatctacactctttgtcctgcactttagtttagacactctttgcctctcactttaattttttcctgccctgccctacactcttttgcctctttcactgatcaccatgaaaagatttcatagtgatagtaaattctttactttttcgatcttgattttccttgttgtactcccgactctagtcgttgctgagtgcacgtgcgatcgagaagatgaggagcgtgacaaatcaaaagctttaaggtacaaaatagcggctttggtatcaatactagttgctggcgcgatcggcgtgtgcattccacttcttggcaaagttatatccgctttgagccctgagaaggataccttcttcatcattaaggcctttgcggcaggagtgatattatcaaccggttttattcatgtcctaccggacgctttcgagaacctcacgtcgccttgtttaaaggagcatccatggggtgagtttcctttcactggctttgtggctatgtgcactgccatgggtactcttatggttgacacttatgccacggcttattttaaaaaacatcatcattcacaagatgaggccacagatgtagaaaaggaatcagggcatgaaggacatgtgcatcttcacacacatgcaacacatggtcatgcacatgggcatgttccaactgatgatgatcaatcatcggaacttcttcgtcatagggtcatatcacaggtgttggaggtaggaattattgttcattctatcatcattggaatttctttgggagcttcagagagtcctaaaacaataagaccactgatggctgcattgatttttcatcaattttttgaaggcatgggacttggaagttgtataactcaggcaaatttcaagaagttatctattacattaatggggttagtctttgctttaacaactccaatgggaattggaattggcatagggatcactaaagtttacgatgaaaacagtccaactgcccttattgtggaaggaatcttcaatgcagcatcagctgggatattgatttacatggcacttgtagatcttcttgctgcagattttatgaatccaagaatgcaaaaaagtggcagcctccgattaggagccaatctctctcttctacttggagctggttgtatgtctcttctggctaaatgggcttaagatagaatgagagtttttagtggaggagagtacggtgaacttttttggcccaacccaaaaaacttttgtttttaatacatgcattggctttttaatagataatcaaacacagcctaagctgttcatatattttttacttttctccacttccaaatttttctgctttcagtttggtgttgtttcctactgtgtaattaatgtacatcataactgttttgatgatggtgttacataatggaagattattttccat

SEQ ID NO: 3475 - DNA, 1482 bp, Glycine max var. Williams 82
atgtttgttttgagttttcagagaatgcggcacttcaacagaacacactcgagtctggctgtgtttggtatcactgcctttgtagtgttttttggtcttgatccattagagggtgtaaaattggtttcaagattttttgtctcaacgccaacatgcgcattgattcatcaaagggttcaaaaagggcatccagaattatacaaagaatcctgttttgttaataaaattggagaatgtagggctcaaaagccaatggcctgtagaggagaatcgaactttgttaataaaatgcttatagaaaaacaaatcgaagatgatagaaaattggagaaggttgaagcaagtcttgcaaaagcaagagctttgataaaagaagccttgttattgagaaccaatgccaccgtgcttcaagatgacacaagtgattatattccagaaggagacatatacagaaatgcagttgctttccataggagttaccaattaatggagaaggtgtttaagatcttcgtatatgaagagggagagccccctctatttcattatggtccatgcaagaacatatattctatggaaggaatctttatcaactcattggaaatcaattctcaatttcggactcagaatccagatgaagcccatgtctattttctgccctttagtgttgtgatgatccttgagcacctcttccacccagttattcgtgacaaggccgtattggagagaactatcggtgattatgtgcacatcatatcccacaaatataaatattggaatagaagttatggagctgaccatttcatgctttcttgtcatgattggggaccaagagctacatggtatgttaaagaattgtattttatagcaatccgggtactatgcaatgcaaacatctctgagcatttcaatcccaagaaggatgcatcatttcctgaaatcaacttggtaaatggggagacaagaggtcttatcggtgggtaccctccatgtaaccgaacaattttggccttctttgcagggcaaatgcatggtagaattaggccagtgcttttccagcattgggagggcaaagacaaggatgtgctagtttatgagaaactcccagacggagttccataccatgagacaatgaagaagagcaagtattgcatttgtccaagtgggtttgaagtggcaagtccaagaattgttgaggcaatctatgcacaatgtgtgcctgtgataatatcacaacaatatgtgcttccttttagtgatgttctgaattgggactctttctcggttcagattttagtgagtgatgtacccaagcttaaggaaattttgttgggtatatcggaggacaaatacatgagattgcaagagggagttaagcaagtgcaaagacattttgtggtgaataatcccccaaagaggtatgatgtattccatatgattattcattccatatggctaaggaggttgaatgtgcgtgtgaaataa

SEQ ID NO: 3476 - DNA, 1668 bp, Glycine max var. Williams 82
tttcgatcttcaatttattaccgtgtacagaattggagaattcacaacattcgtgcctcaaaaactccgtcaaagctagaatgaattggatgagagatgtgccaatgaatcgatgtttgttttgagttttcagagaatgcggcacttcaacagaacacactcgagtctggctgtgtttggtatcactgcctttgtagtgttttttggtcttgatccattagagggtgtaaaattggtttcaagattttttgtctcaacgccaacatgcgcattgattcatcaaagggttcaaaaagggcatccagaattatacaaagaatcctgttttgttaataaaattggagaatgtagggctcaaaagccaatggcctgtagaggagaatcgaactttgttaataaaatgcttatagaaaaacaaatcgaagatgatagaaaattggagaaggttgaagcaagtcttgcaaaagcaagagctttgataaaagaagccttgttattgagaaccaatgccaccgtgcttcaagatgacacaagtgattatattccagaaggagacatatacagaaatgcagttgctttccataggagttaccaattaatggagaaggtgtttaagatcttcgtatatgaagagggagagccccctctatttcattatggtccatgcaagaacatatattctatggaaggaatctttatcaactcattggaaatcaattctcaatttcggactcagaatccagatgaagcccatgtctattttctgccctttagtgttgtgatgatccttgagcacctcttccacccagttattcgtgacaaggccgtattggagagaactatcggtgattatgtgcacatcatatcccacaaatataaatattggaatagaagttatggagctgaccatttcatgctttcttgtcatgattggggaccaagagctacatggtatgttaaagaattgtattttatagcaatccgggtactatgcaatgcaaacatctctgagcatttcaatcccaagaaggatgcatcatttcctgaaatcaacttggtaaatggggagacaagaggtcttatcggtgggtaccctccatgtaaccgaacaattttggccttctttgcagggcaaatgcatggtagaattaggccagtgcttttccagcattgggagggcaaagacaaggatgtgctagtttatgagaaactcccagacggagttccataccatgagacaatgaagaagagcaagtattgcatttgtccaagtgggtttgaagtggcaagtccaagaattgttgaggcaatctatgcacaatgtgtgcctgtgataatatcacaacaatatgtgcttccttttagtgatgttctgaattgggactctttctcggttcagattttagtgagtgatgtacccaagcttaaggaaattttgttgggtatatcggaggacaaatacatgagattgcaagagggagttaagcaagtgcaaagacattttgtggtgaataatcccccaaagaggtatgatgtattccatatgattattcattccatatggctaaggaggttgaatgtgcgtgtgaaataagtcatcaactctattatgttctctctctattcatacttttgctaatggttttaaagtttaattgtttgaccttc

SEQ ID NO: 3477 - DNA, 2803 bp, Glycine max var. Williams 82
aaaagggacacatcatcggttcagttagggggtggcgtagtgagtctgagtctgaacactggaacgagaattagcattagacagacaagacaagaatggattctgatcgcggtgaaactgttgttgttggaacagaacacaacataacataacataacaaggaatatcgttcgttggaaaatgggagggtactctacgaaccccgcggactacaagcttctagaagaaattggttatggcgccacagccacggtgtacagagcgatgtatctccccttcaaccaactcgtggccatcaagtccctggatctcgatcgttgcaacatcaatctcgacgacctgcgtagggaggcccaaaccatgagcctcatcgaccaccccaacgtggtgagggcccactgctcctttgccgtggagcggagcctctgggtggtcatgccctttatggaccagggctcctgcctccacctcatcaagattgctctctcccacggcttccaagaggacgctatcggatccatcctcaaggagactctcaaggccctccactaccttcaccgccacggccacattcaccgcgacgtcaaggccggcaacattctactcgacacctccggcgctgtcaaactctccgacttcggcgtcgccacttgcttgtacgacgccgtcgacaggcagcgttgcagaaatacttttgttgggaccccttgctggatggctcctgaggtgctgcaaccagctggaagtggctataattccaaggctgatatttggtcttttgggattacggcacttgagttggctcatggccatgcaccattttcaaaatatcctccaatgaaggttcttctaatgacaatgcagaatgcccctcctggacttgatgatcgagataaaaagttctctaagtcttttaaggaaatggttgctatgtgcctggtgaaagatcaaacaaaaaggccatcagcagagaagttactgaaacattccttcttcaaacatgctaagcctcccgagctctctgtaaagaaattgtttgctgacttacctcctctttggaactgtgtaaaatccctcaagctcaaagatgcagcacaactagcagtgaagaaaatgccttctgcagatgaagaggcaatatctcagagtcaatatcaacgaggagttagtgcgtggaactttgatattgatgatttgaaagctcaagcttcattggtgatggatgataatgataatgcagagatgagggaagatgaaaacaaatttttcactaattacaaggctagtgcaattgattcccagtctggtactgtcaaaatgaatacagagaaatcaccacagaataaaatcacatcactggtaggtgcttttgacataaaacagactgagcaaaatgaatacttgaacaaaaaggagaagaatcttgaaagtgatctccaggaacctggattgcccagaaatattatttggaagagaaatgggtcaattatggaggcaacaacatccactatagagaaagatataggtatgagccatcaaacccaaagtgggttaccaggcacagttctcagtcattctgcatcagaaaggagacgaacattagaaaggcttgagaatggaaatcagttattgggcgagaaaaataaccgtgaagcgcgacaacctccaagttttagtggtccattgatgcttccgacgcgagcttcagcaaatagtttatcagctccaataaagtcttctggaggattcagagattccttggatgacaagtctaaggctactcttgtgcaaattaaagggcgattctctgtaacatcagaaaatttagatcttgtgaaggatattcctgtaagttcagtttcacgccaatcttcacagggatcagtatcaccactgcggaaatctgccagtgttagtgattggatgttggattccaaacaaatggccactgaagattctgccaccgacagtatctctgcatcacttcttacgactcaccttcaaaatcttttacagcaaacatctattcaacaggatcttataatgaatctgttaaatagtgtgcaatctgctgaagcaattgaagaatggaaagctgccaccattacctcgcagttcagaaatcaatggaagtgttgatacagcagcttcagagagggaacgtcttctgctgctcaaaattttagagcttcagactcggataatcactttgactgatgagctgactgctgagaagttaaaatacatgcagttgcaacaacagctaactctctacagtcaggaacaaaatatggacaagagagaggaaattgcatgaaagctgattaattatgatctgatcattccttaatgaagtacatgcacatccacttgagtgatgaacctctgccgaaggagaacgggatttggatattgaaaaaaaaagagttgtatatcatccgcgatccaacttgccttgccattaataagtttctatgaatacctatagtttagcaaggccaatatacagagttgcagacataatatctcagttaatctcattgtttatttcatacaaaattccgatgtaaccaagcttccctgctgtatcttctgcaacctgataagtttgcagatccacacgggttgttgtaaatgtagaatatcactacatatttaactgttaatttcatagcagctaaagcttgtatataattaattaatgtgttgtaccgattgaaaaggccaaatatttgagctattcaaaattagttcgtcatggatgagaactggaaagtaactaccaaggaataaggatatagga

SEQ ID NO: 3478 - DNA, 1347 bp, Glycine max var. Williams 82
atggcggtttcttcttcttctgcaacaaaatgggtcgtcttcttgcttctggcgctgcttattcgagaagaagctatggctacaccacagatctctgacctcaggaatcttgaagttgaaagacacaggttgccgagcttgacgaactcgtcaatggcggagagggcaaaagaggctgagaaattaaatgaacaagctgcagtggctaacccagaggaagtggtttcaatggttgagatgagcatccaaaacagcacagagaggaggaagttgggatttttctcttgtggaactggcaaccccattgatgattgctggcgttgcgaccccaactggcaacgcaatcggaagcgtcttgcagattgtggcattggttttggccgaaacgccatcggtggccgtgatggaaaattctatgtggtgactgaccccagggatgatgaccctgtgaacccgaaacccggcactcttcgccatgctgtgatccaggataagccattgtggattgtgttcaagagggacatggttattcagctgaaacaagagctgatcatgaacagcttcaagacaattgatggtagaggagtcaatgtgcacattgctaatggagcatgcatcacaattcagtttgttaccaatgtcatcatccatggcttgcacattcatgattgcaaacctactggaaatgctatggtgagaagctccccaacccactttggttggaggacaatggctgatggagatgccatctccatatttggctcaagccacatttgggttgaccacaactccttgtcacactgtgctgatggccttgtggatgctgtcctgggctcaacagccataactatttccaacaaccacttcacccaccacaatgaggtgattctgctgggccatagtgactcttacacaagagacaagcagatgcaagtgaccattgcatacaaccattttggagagggacttatccagagaatgccacgttgtagacatggatatttccacgtggtgaacaatgactacactcactgggagatgtatgctattggtggaagtgctaaccccaccatcaacagccagggcaacagatacaatgctcctactaaccgttttgccaaggaggtgacaaagagagtggaaacagcagaaagtcagtggaagggttggaattggaggtcagagggagatttgttgctgaatggtgcctatttcacaccatctggtgctggagcctcagcaagctatgcaagagcctctagcttaggagcaaaatcttcttccatggttggttccatgacttccaatgctggtgcactaggttgcaaaagaggcagtcagtgctag

SEQ ID NO: 3479 - DNA, 876 bp, Glycine max var. Williams 82
atgaaccttgtttattatgacgaaagtattcttttggcattggcatcagcagtaggacaccctatcaaagttgataacaatatgaaagattttcggagagaccattttgcatgtgtttgcattgatgttgatcttaccaagccagttgttggtagggtcgcccgcgagtacttcaacctcgcctgcctcgagagggactaccaagaccgcctcttcatctacgttgacgacgccctcaacaccaccgtccccaacggcttctccggggtcgtcgtcgaccttttttcgaagggctctttaatccccaagctccaagatcttgccacttggcggatgctggggggagatgtgactgtggagtttatgctaaggtacacaagttccggtaaatcctccacttacgtgggcatgatggtcgagtcctttggctccataggatcccttgcaattaagatttgcgtcatcataaccaatttaggggttcttatcatctatttcattattcttggagacgtgctctgtggaaatgagtcgaacgatatcgcacacttgggtattctacaagattggtttggcatcaactggttgacctctcgtgcttttgctcttctttttgttgcactcttcataatggttccacttgttatgttacgtcgtgttgcattggtgtttgttgtaatatgctcatcaatggcgattagtgcattgttgtctggaaaaagtcagacaccgagaatagtgcctgatttctctcaagtcactgtcatttaccttttcaccactatcccagtgtttgtcatgggttccgattccatgccaatgagtttttactctctggtaatcgattaccagattgttgtaatcgattaccagtag

SEQ ID NO: 3480 - DNA, 3300 bp, Glycine max var. Williams 82
atgtctatggcggaagaagaaccttccataacatcgccaccggcaagaacgttacacaagttcctctcccgcagcggcaagaccgtcatcgccgcgcaacctctggcggtggttcgcgccaccaccagcaccggcggcgcgcgcgttctcgccgcgccgccgaactcgaacgacgatccaacaccaccgcaggaagaagaaggagaaggcgaaaccggcttcgatgcttctcatcatcatgaacggatattgttgcagagagagctaacggtttcgttcgacgagtttctcgaggtcaccaacacgaaggtcgccaccgaagaggaggctctgaaatcagtgatggcgccgttggaagaagaaactgaagaaggagaggaagccgaatcgtcacaggctcaatcagcgcaaccggttcaaccggtgccgaggggaccgcaactgtttcgaccggtgcagaagaagaaagcggttaccggtgatgacgtggaggtggtggaggtgcggaagcctgtggaaaagaagaacattccgaatatttcgaatctcgaggacggtgagtttccggaggagtctgggtggttccttctcgggaggaaggttgaggtcgcagtttcgacggccaggggagtgaacaggttggtggataatgaaatcgttcatttcaattttcctattccgagttactcgagtaagtctcagtggatcgttcgagcgtcaaccaagcgttctggagaggttgggaggatgccaatggaatgggcaaaggctgtgattccggttatgcaatctggaagggttaaggttcgaggccggtgcattgctgtgccagataaactacaaatgatgcaagagattatgtttttagtgagcttttatgttcaccactctgtatttgctgagcgtgttgatacttcttggaggctggaggcttgtggtaaaattgatgatactgtttatccacttcttgccctattaaaaatgctagagatcaagccaagtcaaaaggctgtattcactcctgaggatatagattcccggaagcggttgctctatccaaaggctgatccagatgaagctgcagcattgcctttgatcaagcgaagaaagggcggtgagccccttcctgagcaaaataatgatgaacaagctctttcagagtcagctttgaataaacttgttggagcggcagaaatctatgacctcaaggagaaggaagccccagagacacttgtgtgtaatttaaagccttaccagaagcaggctttacactggatgactgaaatagagaaagggatggatattgagagtgtagaaagaaatctgcatccctgctggtcagcctacactatatgcaagggcagaaggacaatttatttgaatatttttactggagaggcctctaaaaaatttccaaaagcaacgcagatggcaagaggaggaattctagcggatgcaatgggacttggaaagactgttatgacaattgctttgatactcagtaacccaggcaggggtaactcagaaaacaatgatgtggagaatggagatgataattttatcacaaataaaagaaagaatgctaataccttacataaatttgagggtggcactcttattgtttgtcccatggctttgttaagtcaatggaaggatgagcttgaaacacattcaaaggaaggtagtatatccatatttgttcattatggtggagcaagaaccactgatccctggatgatctcaggccatgatgttgtcttgacaacgtatggtgtcctacaagctgcatacaaaaatgatggagagaatagcatctacaacaaggtcaagtggtacagggtggtgctagatgaagctcataatataaaagcccatcggaatcagactgcccagtctgcttttgttctgtcctcacacagccgctggtgtttaactggaaccccacttcagaatagcttggaagacctatacagtctcttgcgtttcatgcgtgttgaaccttggtgtaacttggcatggtggcagaagttgattcaaaggccttatgagaatggtgatccaagatccctgaagttggtcaaggccattttgaggatgctgatgttaagaagaacaaaggaaacgaaggataagaaaggaaggccgatacttttcctgcctccaattgattttcagttgattgagtgtgaacaatcagaatctgaacgggacttttatgaagccctgtttgagagatctaaagttcaatttgatcagtatgtcgcacaaggaaaggttcttcaccattatgcaaatatccttgacctactaatgcagttgaggcggtgttgtaaccatccatttttagttatgtgcggaagcgatacccagaaacgtgcagatttaagcagactcgcaagaaaattctttcagactaatactgaattccccgatgaaagcaatcaaaatgatccacggcagcaagcagagttgaacaaacttgcaagtagattacttctaaaatctgcttcttctttgcactcggttcaacctcatgcatacattgccgaggttttggagaatattcaaaagggtgacatcatagaatgctctatatgtatggaatctccagaagatcctgtgtttacaccatgtgcgcataagttttgtagagaatgtctatttagttgctggggcacctcagtgggtggcaaatgtccaatctgtcgtcaattgctccagaaagacgatctgattacttattcatctgaaagcccattcaaggtcgatattaagaacaatgtgacagagtcttcaaaggtttcgaagctatttgaattcctgcaacgtattctgaacacatcaagtgaaaagagtatcgtcttcagtcagtggacatcattttttgatctgttggagaatccattgaggaggagaggaattggttttttgagatatgatgggaagttgactcagaagcagagggagaaagttctggatgaattcaatgagacaagagagaaaagggttttgttaatgtcactaaaagctggtggtgtgggtttgaacttaactgcagcctcaaatgttttcattatggatccatggtggaaccctgcagttgaggagcaagcaataatgagaattcatcgcataggacaaaaccgaagagttgtagtgagaagattcatcgttaaggacacagtggaagatcgattgcaacaagttcaagctaggaaacaaaggatgatatctggtaccctcaccgacgatgaggttcggactgctaggattcaagacctcaaaatgcttttcacatga

SEQ ID NO: 3481 - DNA, 1275 bp, Glycine max var. Williams 82
atgagaacggggaacctcttctggcttggcattgttgcagcacttgttttcagcttctgggttgatgccttttcagccaatcaatattacccccaccaccacttcaatgaaaccgagttctcttcgttggagtctcaagaacaggcacattcatccctccttgggaggactcctctcatggttggactcacccttattcaaagtgctgctgccaaaggagcagtttgcttggatggaacattgcctggttatcatttgcatcggggatatggatcaggagcaaacagctgggtcgttaatttagagggaggtgggtggtgtaatgacgttagatcatgtgtttatcgcaagaaaacacggcgtgggtcatcaacattcatggaaaaacagataccttttacaggaatattaagcaacagtgctgaagataatccagattttttcaactggaacagagtgaaaattcgttattgtgatggtgcctcttttgctggggatggtgaagataaggtggcgcaactgcaatttagaggacagcgtatttggttggctgcaatggaagatttgaagtcaaagggaatgcgatttgccaagcaggctcttctttctggatgctcggctggtggtctggctactattatacactgtgatgaattcagaggttttttcccagagactaccaaagtgaagtgtcttagtgatgcaggattatttcttgatgcgattgatgtctccaggggacataccatcaagaatttattcagtggtgttgtaaggctacagggagtgcaaaagaatctgccgcacttttgtactaatcaccttgatcccacttcgtgcttcttccctcagaatttgattgccggtattagaaccccactattcattcttaatacagcctatgactcatggcaggtccaaacaagcttagctccttcatcagcagatccccatggcttttggcatgattgtagattaaatcatgctaaatgtacttcttcacaaatccaatatttgcaaggattcaggaatcaaatgctgaatgctattaaaggcttctcaagatcacctcaaaatggattgttcataaattcatgttttgctcactgccaatctgagaggcaggatacatggtttgctgacaattctcctgtcattgggaacaaggcaattgctcttgctgttggagactggtatttcgaccgagcagttgttaaggccattgattgtccttacccttgtgataatacatgtcaccatcttgtcttcagatga

SEQ ID NO: 3482 - DNA, 2123 bp, Glycine max var. Williams 82
ctgtaattaaaagctgaaaaagcccggcaaacactgtttgttcactgtctataaatatgtccctcttctctccttagtattattatgaaccttaccacatttctctttctctattttgtagtatttggcacatagtgcatagtttgtgccattaattaaccaaggaaaaacgccaccttttggctccttctgttgttccaactgtgcatttgtgtgctgtttctttcacaaacacgcagcagcagagccagaatgagaacggggaacctcttctggcttggcattgttgcagcacttgttttcagcttctgggttgatgccttttcagccaatcaatattacccccaccaccacttcaatgaaaccgagttctcttcgttggagtctcaagaacaggcacattcatccctccttgggaggactcctctcatggttggactcacccttattcaaagtgctgctgccaaaggagcagtttgcttggatggaacattgcctggttatcatttgcatcggggatatggatcaggagcaaacagctgggtcgttaatttagagggaggtgggtggtgtaatgacgttagatcatgtgtttatcgcaagaaaacacggcgtgggtcatcaacattcatggaaaaacagataccttttacaggaatattaagcaacagtgctgaagataatccagattttttcaactggaacagagtgaaaattcgttattgtgatggtgcctcttttgctggggatggtgaagataaggtggcgcaactgcaatttagaggacagcgtatttggttggctgcaatggaagatttgaagtcaaagggaatgcgatttgccaagcaggctcttctttctggatgctcggctggtggtctggctactattatacactgtgatgaattcagaggttttttcccagagactaccaaagtgaagtgtcttagtgatgcaggattatttcttgatgcgattgatgtctccaggggacataccatcaagaatttattcagtggtgttgtaaggctacagggagtgcaaaagaatctgccgcacttttgtactaatcaccttgatcccacttcgtgcttcttccctcagaatttgattgccggtattagaaccccactattcattcttaatacagcctatgactcatggcaggtccaaacaagcttagctccttcatcagcagatccccatggcttttggcatgattgtagattaaatcatgctaaatgtacttcttcacaaatccaatatttgcaaggattcaggaatcaaatgctgaatgctattaaaggcttctcaagatcacctcaaaatggattgttcataaattcatgttttgctcactgccaatctgagaggcaggatacatggtttgctgacaattctcctgtcattgggaacaaggcaattgctcttgctgttggagactggtatttcgaccgagcagttgttaaggccattgattgtccttacccttgtgataatacatgtcaccatcttgtcttcagatgagagaaatctcatcaatctccaccatttcgctcatctcattcatttggatctattattacttgcaattaggaaatatgctattcaattaggaggaatgatagtaatatattttttgacacatttttcttaacacattttattatttggtgaaattcatgcaagacttactaaattatgtcattccatctttggtgggactagtatgaaattcaccaaatgatagtgttaagaagaacacgttaaaaagtgtgagtattatctcgtttagtttatgatcagacaataaatggttggttgaagtgcaaaattaatcagccttttccattatttagtaaattggtgggagtagttttcatgtatagattacttagttgggaaagctgaggcaaatgccttcggtttttttacaaagattgggagaggtaaaggactattagaatatatacactgtaatggagtaagcattgacagtagttgaatgagataatctcaatctcatatttccctttcaatttgggaatgaaaaatatgtcattattgaattatcaatgtttattatatacactgatgacttaaataatgtttcattattgatt

SEQ ID NO: 3483 - DNA, 174 bp, Glycine max var. Williams 82
atggccggtgacggtgcagctacatgcatagacatcctccttgccatcattctccctcctcttggagtctttctcaaatatggctgccaggtggagttctggatttgtttggtgctgaccctttttggttatatacctggaattatctatgctgtctatgctatcaccaagtga

SEQ ID NO: 3484 - DNA, 1986 bp, Glycine max var. Williams 82
atgggtgtcatctctcggaagatcttcccagcatgtgggaacatgtgtgtttgctgtccagctttgaggtcaagatcacgccagccagtcaaacgatacagaaaactgcttgctgatatattccctaagtcccctgatgagtctccaagtgaaaggaagattaccaaattatgtgaatatgctgcaaaaaaccctttccggattccaaagatagcaaaatatcttgaagaaaggtgctacaaagaactcagatatgagcacatcaaactggtcaatattatagcagaatccttcaacaagttgctttccatttgtaaggtgcagatagcgtattttgctgttgatgtgcttaatgtaattttggagctcttgagctattctaaggatgagaccattcagacacttggttgccagtgcttatcaaagttcatctactgtcagatggatgctacttatactcataacattgaaaagttggtgccgaaagtgtgcatgctatcacgggaacatggtgaagcatgtgaaaagcgctgcttgagggcatcaagcttgcaatgcctttcagcaatggtttggtttatggccgaattttcacatatttttgtagattttgatgagattgttcgtgccactttagataactatgagtggagtagacaaaatgaagaagctgatgtcagggcagaggcacatcataattgggtggatgaggttatccggtgtgaaggtcggggtggttcagttattggtaatgacaatcgctctagttgcttgatcatccagccacgaccagaaataaagggtccttcccttttaactagagaagaaattgaaaaaccacaaatatgggctcagatatgtattcaaagaatggttgaattagccaaggaaagcacaactatgcgtcgtgtgctggatccaatgtttgtctactttgattctagacaacattgggctcctcagaaagggttagcaatgataattttatcaaggatggcctacttcatggagaactctgggaatcagcgcttaattctagcttctgtgatacatcatctggaccacaaaaatgtcatgaatgatcctcaacttaagacctgtgttattcaggttgccacatctttggctatgcaaattagatctgagagtggcttggcagagattggttttgttggtgtcctttgcagacatcttaggaaaagccttcaagcctctagtgaatttggtggagagcaagaattgaacttaaatatctcacttcaaaattccattgacgattgcttactagaaattgccaatggggtaattgatgcccagccactttttgacttgatggcgataaacctagaaaatattctacccggtgttgttggtagagcaaccattggatctctgatcatccttgctcgtgcagtcactttagcattaagtcacttacattcacagcagggatttcctgaagctcttcttgttcaactcctaaaagtaatgttgcattcagatgtggaggctcgcgtcggagcacaccttatattttccattcttctttttccaagttccttccatacgaatgagatttcctctctgcggtccagatatctaggtcaacacaacaaaaggcattctcatgctccatctgtgtctgcatctgcttcaattacagctttacttgaaaagctccgcagaaacagaaacaccaaggtagaaaatcatgggaatattgttcatgatcaagaaagggatattgtggcagaagactggaagcagggctgtggcttaaagaattctcctaacttttacaaactcacttctatcattgataaggctacaggatcaccaagtttgactgacacagaaccatatgttatgaaactaactgaagatcaaatggcccagctgctttctgccttttggattcaagccaatcttcctgataatttaccttcaattgattatgcaggattttccctcaaattcagcaggtga

SEQ ID NO: 3485 - DNA, 1105 bp, Glycine max var. Williams 82
ggagggcagaatagagtgtgggcaggagtatgtaagaagaagtgtggtgtggcaaaacgtaacgcgattgcaatgatatgataggcgcagagcagagagagagaaaacgcaaaggcattatttgggcattaaatctgccatggcagcagcacccgctagagctcgtgccgattacgattacctcatcaagcttcttcttatcggcgacagcggtgtggggaagagttgtctacttttgaggttttctgatggctcattcacaaccagttttatcaccaccattggtatcgattttaagataagaaccattgaactagacagcaaacggattaagttacaaatctgggatactgctggtcaggagcggttccgaactattaccacagcttattaccgtggagccatgggtatcttgctggtttatgatgttactgatgaagcatctttcaataatattaggaattggatccgcaatattgaacaacatgcttctgacaatgtaaacaagatacttgttggcaacaaggctgatatggatgaaagtaaaagggctgtacctacctccaaagggcaagcacttgctgatgagtatggtatcaagttctttgaaactagtgcaaaaaccaacatgaacgtggaagaggtcttcttttcaatagcaagagatattaagcaaaggcttgcagacacagattcaagagctgagcctcagactatcaagattaaccaacctgaccaggcaaccagtggtggtcaacctgcgcaaaagtcggcttgctgtggttcatgaaaagaatcagtatctgtagaaagaggtgcacaggtttctgcaatagcactcatctgggtgctaatgttattctgatgacattataagtgggagcatgtatttgtccctctgtatctcccaactgcagatgtcttattttaaagttaatattttaaattctttgctcactgacttggtggaatttgttgtgactagtaatttgcttcaatttcctattttcatttgtagtgtgactcttaaaaggtatcttgattagatgcggatagattatcacaacagcttgatcatttgcagaatatcggtccgaatgttttt

SEQ ID NO: 3486 - DNA, 1332 bp, Glycine max var. Williams 82
atggagggattaggaggactgggccacctttttgtgacaatgtttgtgtcggggtttggtggtgtcatagttcttccggcaatcaccgacgttaccatggcagcactttgccctggtcaagatcagtgttcccttgccatttacctctctggcttccaacaagctatggctggagtggggtcagtggtgatgacaccattaataggaaacttgtccgaccgatatggcagaaaagcgttgctcacacttcctctcactgtgtctgtcattcctcaagtgatattggcctatagcagggatacccaattcttctacgcgtactatgtggtgaaaactctggctgccatggcaggcgaagggtccttccactgcctggctcttgcatacgtggcagacaaggttccagatgggaaacgaacatcagcatttggaatacttgctggtgttggatcagcatcattcgttggtggaacattagctgctcgtttcctatccacggctttaacatttcaggttgcttcagtcttgtcaatggttgcattggtgtacatgagaattttccttaaggatagtgtgcctggtggtgccttgagacagccattattgaaagaggtcgaggaaccttgtgatgaggatgattcatcaccaagggcaacaggaacatttaagaaacttccatcgctgggggatttgatttgtttgctcaggtgtagtcccacattctcccaagcagccatggtttcgttcttcaatagtcttgcagatggtggcttgatggctgtattgctgtattatttgaaggcacgttttcaattcaacaagaaccagtttgctgatttgttgatgattactgggattggagccactcttgcacaactatttttcatgcccattttagtgcctgtgataggagaggagaagctgctctccacagggctcttaattagctgcataaatgtctttgtctacagcatagcatggacagcatgggttccttatgctctagcaggttgctctgtgtttgcagtttttgtgcgcccaagtttatgcagcattgcatcaaaacaagttggacctactgaacagggaatggttcaaggatgtctttcagcaattagttccttcgccaacatcattgctccattaattttcagtccactgacagccttgttcctgtcagaagaagcaccgttttattttcctggcttcagtctaatgtgccttgggctagcactgatggtagcattttttcagagtctaataattcgtgctgttcctcctattgcgggtggcaaaattagcagtaaccgctgcacggataccttggtctga

SEQ ID NO: 3487 - DNA, 1401 bp, Glycine max var. Williams 82
atgccaagtgaaatggagtccaataatgctgaatatgtgacactgggaggagaaggttcaactccaaagttagagaagatgagcaaggtttcaattatgcctctgatgttcttgatcttttatgaggtctcgggaggaccttttggtgtggaagacactgtgagagcagctggtccattgttggctctccttggtttcttgcttttcccattcatttggagtgttccagaggcactcctaactgcagaaatgggtactatgttccctgagaatggtggctatgtggtttgggtttcatctgcactgggtcctaactggggtttccaactaggttggatgaaatggctcagtggagtcattgacaatgctttatatccagttctatttttggattaccttaagtcagctattccagctttaggaggtggttttccaaggataatagcagtgatagttttagttttagctctcacttacatgaactatagggggctaaccatagtggggtgggctgcaatattgttgggaatcttttcattacttcctttcatggttatgggagttatagcaatacctagaataaaaccaactaggtggatcatggttgatttgaagaaagtgaactggggtttatacttgaacactctcttctggaatttgaactactgggactcaattagtacccttgctggagaagtggataatcctggtaaaaccctcccaaaagctcttttatatgctgttatgttggttgttttggggtactttttgcctcttctgataggaactggagctatgccggttaaccgtgagctatggtatgatggttacttctcagaagttgctagagtgattggaggggtttggttaaggagttgggttcaagcagcatctgctttgtcaaatatggggatgtttatggctgagatgagcagtgactccttccaacttttggggatggcagaaagaggcatggttcctgagttctttgcgaaaaggtcacgttatgggacccctcttgttggcattttgttctctgcatctggggtggtcttgctttcatggttgagctttcaagagatagttgctgctgagaacttcttgtactgttttgggatgcttatggagttcgtggcatttgtcaagttaaggaggaaactcccatatgccgagaggccttataaagtgcctgttgggaaaacgggagctatattgatgtgtgtgcttccaacactgctgatatttgtggtcttagctcttgcttctttcaaggtcttcattgtaagcttctcagctgtgatcatagggcttgtattaaggccttgtttgaaatatatggagcagagaagatggcttagattctctgttaatcctgatcttccagatattcgtgctacttag

SEQ ID NO: 3488 - DNA, 1161 bp, Glycine max var. Williams 82
atggccaagccagtgtccattgaggtatggaacccaagtggcaaatacagagttgttagcaccaaaccaatgcctggaactcgttggatcaatcttctcgttcaaaatgatgttcgccttgaaatatgtaccgagaagaaaacgattctgtcagttgaagacatcattgctttgattggtgataagtgtgatggagttattggacagctgactgaagactggggagaacagttgttctctactttgagcaaagccggaggcaaagctttcagtaacatggctgttggttataacaacgtggatgttgatgctgcaaacaagtatggtgttgctgttggaaatactcctggagtgctcactgagacaacagctgagttggcagcttcattgtctttggcagctgctagaaggatagttgaggcagatgagttcatgagggcaggattatatgatggatggctacctcatctatttgttggaaacttgctcaagggacaaactgttggtgtaattggagctggtcgaattggatccgcttatgcaagaatgatggttgaagggttcaagatgaacctaatttactatgatctctaccagtccacacgactagaaaagtttatcacagcctatgctacattcttgaaagcaagtggtgaaacccccgtgacttggaaaagggcagcaaccatggatgaggtcctccaggaggcagatataattagtcttcatcctgtcttggataaaaccacttatcatctagtcaacaaggaaagactagctaagatgaagaaggaagcaattcttataaactgcagtagaggacctgttattgatgaagctgcacttgtggagcatttaaaacagaacccgatgtttcgagtaggccttgacgtgtttgaggaagagccctacatgaaacccgggcttgcagagttgaagaatgccattgtggtaccccacattgcatctgcctccaagtggactcgtgagggaatggctacactagcagctctaaacgtgctggggaagatcaaagggtacccagtttggtttgatgccaatagggttgaaccattcctcaatgagaatgctcaaccaccagctgcatccccaagcattgttaatgcaaaagccctgggtttgccaacttcaaagctataa

SEQ ID NO: 3489 - DNA, 912 bp, Glycine max var. Williams 82
atgggtagttgtggaagagaaggatcagtgagacaatatgtaagatcgaaggttcctcgtttaaggtggactcctgagctgcaccgttgctttgttcatgctattgatagccttggaggccaccataaggctactccgaagcttgttcttcagttgatggatgttaaagggctcacgatttcacacgtcaagagccatcttcagatgtacagaagcatgaggggtgacttgggcagacaaggtaggacatcctcccaacataggaaccaatcttttgaggagcatgatgatggatgtgttgatgaagggaatgatgttggtgttgagtactcttgttcgaaaccaatgggaagagaatctgattccttcttcggccacagtaatctccctccaaaaagagcaagaatcgagacgaggagttccatctcagagagcctgcagtgcagccaaagattatgtgatgcagttcaaaatccgtactgtttttatgattatctgcaacagaagaagcccatggctgatgagcacaaggagttctcaacatggcagcaggcacaaccccattcccttctgtttccagaatttcccaaccacacttcattcaattctcctaaccaacaatctgatttccttcaggttactaaattaaatgaaggaaagagcacttcacagcctagtaatgtacttgtgaacactactactgagacagctattgcagaagttgaagatgaattgtcattatcgctcacattgccaaatccttcacctcagagttcaggcagtgagataagtgaggcaatctcatcatgccctgggtttggcaacaactacaaggactgctctagttcatccactcacactctcaaagaaagaattaatttggacctatctttagccctatgtggcaattga

SEQ ID NO: 3490 - DNA, 1509 bp, Glycine max var. Williams 82
atgctccacatcacctgcattcttttaatgtgccttctaagttccttctcacccccaatcaacgctcttctcaacctcactttaccccaccaacaccctcaccccgaatccgtcgtccacgatctccaacggaaggtgaatgcctcactatggagaagggaaatgctgtcaaaggaggaccaacaagaaggcatgtcgtcgtcgtcgtgtctgaccggaaaccccatcgacgactgctggcggtgcgatccgaactgggcggcggaccggcagaagctggcggagtgcggcctagggttcggcaaatacgcgatgggcggcaaaggcgggcagatctacatcgtgacggactcctccgaccgcgacccggccaaccccgttcccggcaccctccgccacgccgtcatccaggacgagcctctctggatcgtcttcgccgccgacatgaccataaacctaaaacacgagctcatcttcaacagctacaaaaccctggacggccgcggcgccaacgtccacgtcaccggccacggctgcatcacgctccagtacgtctcgaacatcatcatccacaacatccacgtccaccactgcactccctccgggaacaccaacatacgggccagtccaacgcacgtagggtggaggggcaaatcggacggtgacgggatttcgatcttcggctcacggaagatctggatcgaccattgctcgctgtcgtactgcacggacggtttgatcgatgctattatggggtccactgggattactatttcgaatagccactttgcgcaccacgatgaggtgatgcttctgggacacgacgataagtatttgccagataggggcatgcaggttacaatcgcgtttaatcacttcggtgagggtctggtgcagcgtatgccacgatgcaggctcggttacatccacgtcgttaataatgacttcacgcagtggaagatgtatgctatcggcggtagcgctaaccccaccatcaacagccagggtaaccgttacaccgctcccgcagaccctgatgccaaagaggtgacgaagcgcgtggacacagacgatagagagtggagtggttggaattggaggacggaaggggacataatggtaaatggagcgttctttgtaccctcaggggcggggcagagtgcacagtacgcagaggccaccagtgtgcaagccaaatccgctgttcaaattgaccagctcactatgtactccggtgtcttcggtgatcccagggataatggagatttatatcccggtttcaacggcggtgggaccgtgaccggagccaccagcaaaggcaacacagaggggtccagcagtgacgatggggacttctttgggatgatattcagaggcagcagcagcagccaagcagcgccaccatcaccttcttcgtccattgtatttgtttcaacctttttgtctcttttaataatttttattttggacactaccaccaaccatgccattctattatcattactatga

SEQ ID NO: 3491 - DNA, 1776 bp, Glycine max var. Williams 82
atggccgctgccatcggaagcatggtggacacgaatgggctcatggtccaagtcatcaccggaaggtggttcgtggtgttcgcctcctttctaatcatggccgccgccggcgccacctacatgttcagcctctactccggagacatcaaatccgccctggcctacgaccaaaccaccttaaacctccttagtttcttcaaagacttgggtggcaatgtcggcgtcctctcgggcctcatcaacgagatcactcccccgtgggtggtcctcgccatgggttccgtcctcaacttctttggctacttcatgatatggctggcggtgacaaaaaaaatacccaagccgcacgtgtggcacatgtgcctctacatctgcataggctcgaattctcagtccttcgccaacaccggttcccttgtgacttgcgtgaagaacttcccagaaagccgtggggttgtgctgggcatcctcaaaggctacgttggtctcagtggagccatcattacacaactctactttgctttttactacgacgattcaaggtccttgattttgctcatagggtggctcccagctgctatttccttccttttccttcgaaccattcgctacatgaaacccgttcgacagcccaatgagctaagtgttttctacaagtttttgtatatctcacttggccttgctgggtttcttttggtcatgatcatagttcagaagcaagtgcatttctcacaaagtgagtatggtgtcagtgctggggttgtgctcttcttactatttcttcctcttgctgttgtgtttgttgaacaatataagatcagagagagtcaaaagctagcattcattgacccctccccggtcaagatagtagctgaaggagagtctgcaaatggtaatacctctaacacgccaatttcaacagagattgaagaaactagatggtggcaaaaagtgttaagtccaccgcctcgaggtgaggactatactatacttcaagccctattcagcttagatatgatactgctattcttcgctggcacatgtggtgttgggggaactttaaccgcaattgataaccttggtcagattggtacatcgctagggtaccccaaggctagcataagcacgtttgtgtcgttagtgagcatttggaattatctgggacgggttttttctgggtttgtttctgaacactttctacaaaagtacaagttccctcgaccactgatgctcacgctaaccctcctcttatcctgtgccggtcaccttctgatagccttcgatgtgcccaacggactctacgtggcatcggtgatcatagggttctgcttcggcgcgcaatggcccttggtgttcgccataatctcggagctgttcgggctcaagtactattcaacgttgtacaactttggaggtgcagcgagcccgattgggctttatgtgcttaacgtgagggtaactgggcacttgtatgacaaagaagctctgaagcaattggcagtggcggggataccaagaaatgatgccaaagaattgacttgtattgggtccagttgttttaagttgtccttcattattatcactgcagcaaccttttttggggccttaatttcactgattttggtggctaggacaattaagttttacaaaggggatatatacaagaggtaccgggagcaagccgaggaagccaccactgctgccactgagatggcggtggtccaaaaccgcggccagaaattagaacaagaagctaacaaagttattggcacgtaa

SEQ ID NO: 3492 - DNA, 1806 bp, Glycine max var. Williams 82
atgcacctttgttgtacccgcagaacttgcttgatatccacaaacatggcaatcaggggtgttgatggatggcgagacatgaagagtctggctgtccaagtcatcacagggcggtggttcgtggtttttgcctcctttctaatcatggcagccgctggagccacctacatgttcggtctctattccagcgatatcaaaaccacccttggctacgaccaaaccactctgaatctccttagtttcttcaaggacttgggcaccaacgttggggtcatctcgggcctaatcaacgagctggctccaccctgggtggtcctagccattggtgccgtccttaacttctttggctacttcatgatatggctatccgtcacccaaagaatagccaaacccaaagtgtggcagatgtgtctctacatctgcataggcgctaactctcagacttttgccaacactggttcccttgtcacttgcatcaagaacttcccagaaagaaatggggttgtgttagggatcctcaaaggttacctcggtcttagcggtgcaatcatcacgcaactctactctgctatttactatgatgacaccagggcattgattttgctcatagcttggctccctgctgctatttccttcgcttccctacgaaccgttcgctacatgaagcccgttaggcagcataatgagctcaatgttttctacaggtttctctatatctctcttggccttgctgggtttcttttgttcatgatcactatacagaaaagggtcaacttcactcagagtgagttcggtgtcagcgctgctattgtgctctttctgctcctcctcccactttctgttgtttctatagaagaatataaggtctggcagagtaaaaggcttgctttggttgaccccaccccggtgaaaatagtaaccgatgagggtgaaaaggtcatgaaaccgattgaggcaacaaatggttgcaaaaattcagtttcttccaagtggtgggaaaatgtgtttagtccaccagaaagaggtgaggactatacaatacttcaggcgctattcagcctcgacatgttgatactattcatatgtagcatctgtggtattgggggcacgttgaccgcaatagataacctgggtcagataggaaagtcgcttagatacccaaagaaaagcataagcactttcgtgtccctagtaagcatttggaattatctgggaagggttttcgctggatttgtttctgaacattatctacaaaagtacaagttccctcgtcctctcatgcttacactaaccatgctcttgtcatgtgttggtcaccttctgatagcatttgacgtgccaaatggtctttatgcggcttcggtaattattgggttttgttttggcgcacagtggcctttactttttgccattatatccgagctttttggacataaatattatgcaactttgtataactttggaagtgcagcaagtccactagggctatatgtgcttaatgtggtgatgactgggcatttgtatgacaaagaagccaagaagcaacttgcagcattggggcttgagagaaaggaagggcaggaattgaattgcattgggatccattgcttcaagttgtcctttattattatcacagctgcaactttctttggtgtcattgtttcactcatcttggtggctaggacaagaaccttttacaaaggtgacatatacaagagataccgggatgcagccacggtaacagaccaagctgaaatggcgagggtggagaaagatgacaaacatgtgatgccaactcagaagtaa

SEQ ID NO: 3493 - DNA, 924 bp, Glycine max var. Williams 82
atgtccacaattgcaaagagagatttgagttgtaatgaagaagagagtgagctgagaagaggtccttggactcttgaagaagacagcttacttatacactatattgctcgtcatggtgaaggtcgttggaatatgttagccaaaagtgcaggattgaagaggactggaaaaagttgcagactcagatggctgaattatttgaaaccagacattaagagagggaacctcactccacaggagcaactcttgatcctcgaactccattccaagtggggtaacaggtggtcaaaaattgctcagcatctgccaggaagaacagacaatgagatcaagaactattggagaacaagggtacagaaacaggcacgccagcttaacattgagtctggtagcaagagattcattgatgctgtcaagtgtttttggatgccaagattgctccaaaagatggaacagagcaattctccaagccctcagtcttccatgacaaccatgatgaatttagggaattctggagaagcttctatgagttcaatgtcaagcagcttcaatattaatccttctatgtcttcttcatcatctcctccacaaaggaaatttattatggatgatgctaatcattttagtactatgtccaaccccatcaatccatccccagattccttccaattttcacagccacttgaaatttctgaacaccccaaaagtcctcccaatgtgtttgagaacaatgtttgcagctatccaatccaggacaattgctatcttgataccaataactatggcatggaaggcataaacatggatcccctttcagcaatggatacttatgacttctcacagtttgattttcagactgcagggaatggatggatgctagacagcatgggggattccactttatggaacatggatgctatgtga

SEQ ID NO: 3494 - DNA, 1266 bp, Glycine max var. Williams 82
atgaagggccaaaataatcaatactccttaaactctgtttccaagtttttcaatgctcaatttcactttattcagtttcttagctatatccttattttgggctttggtataagcattggagttatcttcagtttctaccttaaagactgcaactttagtctacaattcactcagttgtcactctcctcctttccgcgaacaccacccttgccaccaacaactgcaaaaccagaaatatctaatcaaactcaaactcaaactcaatcacagattcaaactcaaacgcaaatgcaaactcaaacacaaattgaaactcaaactcaaattgaaaacagtcacgtaggattgaaggagttccttaagcctcctcctgttgtgcatgatatggatgatgaggaattgctatggagagcttcagtgactgcaaagatccctgattacccgtttgatcgtgttccaaaggttgccttcttgttcttgacaaggggtcctgtgtttttggctcctttgtgggagcaattcttcaaagggcacgaaggattctactcgatttacgtgcactccaatccatcatacaatggatcacgcccggagagtccagtgtttaaaggtcggagaattcccagtaaggaagtggaatggggtaatgttaacatgattgaagcagagcgtcgcttgctggccaatgcacttcttgatatctcaaaccaacgttttgtactcttgtctgaatcctgtataccactcttcaacttctcaaccatctacacttacttgatgaactccacccaaaactatgtcatggcttttgatgatcctagttctgttggtcgaggccgctacagcatccagatgttgcctaaaatctccgtcaatcagtggagaaaagggtcccaatggtttgaaatggatagagagcttgcacaagaagtggtgtctgacaaaaaatacttcccagtttttcaagagtattgcaaaggttcatgttatgcagatgaacattacctgccaacatatgtgagcatcaagttttgggaagggaattccaataggagcttgacttgggttgattggtcaaagggtggtccacacccaactaagtttttgagatcggagatcactgttaagttcttggagagtttgagggatcagaaatgcgagtataatggggacagcatcaatgtttgttttctgtttgctaggaagttcgcccctagtactgtgtcaaagctcaccaagattgcacccatggttatgcatttctaa

SEQ ID NO: 3495 - DNA, 1881 bp, Glycine max var. Williams 82
atgagttcagtttatgaattagtattattgcttttattttgtggccttatgccacttgtcttcgctgctgggaaccaagcagagtgtccaccttcgtttccatgtggatatcttgacaatatcagtttcccattcactcaaactgaacgcccggactgtggcttattgcccattcgcaattgtgatgatccacttaagcacaaaatgatccaattacagaaaaatggagaatggtttcagcttgtacgcgttgctcagcttttcagtagtcctactactcctctcacaacttttcaatttagagacacaaatctctatcaccttctgcagaatgaaaattgtgaagctttcggaaacaattatactcttccttttcctcatagttctggctttgctgcttctctttatatccaatactacacaactctgttcaggtgcaaccgcagcctccatgtcagccctcccacaaacatgcataattatacagagtgccccgattacgatctctactacaatgacaaccccaaagctgaagatgcgtctttgagagcatgtacaaaggtcctgcttccaattaaagacacgcctgacgctaacaacccattcacattcgcaactgcagatatcttcactaaagtagaattaactggtgaatgtgcagattgccactatcgcagaggagggcagtgtcaacttgacagcagagagatatttttttgtgccactgccaatagtacctttacgataataggccttgtagtagtggtggcattagtagctgtagttctgctgatggtcttggcttgcagctttagaaaaaagatcttttgcatggagaatccaacccatcggataattgaagggtttttgaaggaacatggaccccttcctacaactaggtacagttattcagaggttaagaaaatgaccaattcttttagaaacaaattaggccaagggggatttggtagtgtatacaaagggaagttacatgatggtcaagttgttgcggtgaagattttaaataaatcagagggcaacggagaagaattcttcaatgaagttgcaagtattagtaagacttcacatgttaacattgttagacttttgggattttgtttagatagttctaaacaggctctaatatacgagtttatgcctaatggatctcttgacaagtttatatatgaagagaaaaatccaccaggggttgctcgccaattggattgcaaactattgtatgatattgcaattggcattgctcgtggattagagtacttacacagaggttgcaacactagaatcttgcattttgacataaaacctcacaacatactactagatgaggatttcagcccaaaaatttcagattttggacttgcaaaactatgtccgagaaaagaaagtgtcgtatcaatattgggtgcaaggggaaccgcaggttatattgctccagaagttttttccaggaattttggtgcagtatctcataagtcagatgtctacagttatgggataatggtcctagaaatggtcggaatgagatataattctaaggctgaagtaaactgctcgagtgaaatatattttcctcattggatttacactcatcttgaatcagatcaggaacttggtttacaaaatataagaaatgaaagtgatgacaaaatggtgagaaagatgacaatagtgggcttatggtgtatacaaacttaccctccaactcgaccagccataagtagagtggtggaaatgctagaaagtgaagttgagttattgcaaattccacctaaacctactttttcttcttctgcaacccctccagcccatttttcaagtgagacaaatgataatgtaattaatgagaatactagtgtgtag

SEQ ID NO: 3496 - DNA, 1761 bp, Glycine max var. Williams 82
agcatcacttttcctttcactaacacacttcaccaagactgtggcatattggtgatacatggctgtgatgacaaggaaccaggggccaaaaaaaccataaaatgtaacaatacatggtttgatgttgtcgggctcgaccagtttacgattaccataaaagacgataaactgcacgacttgttgctacaaagaagttgcgacaccttcagctacagctctacgttcacagtcagctcccctttgcttaaggcttctcgtttaaagcattacctagagatactcagatgcaaccacaccctcggtcatccgccaaaaaaatctgtttctaacaacacactttgcaaaaatgaaacactctattcaatggtggaccccaacccctccggctccgggtacagtcatcacaatggatgttcgatgcttctgattccaacctgcttgcagctactggatcgccatggccatctatattccagtgaccctttcgagttcataactgataatatcgccgtcgaaatagaattatctccggattgttctacttgtatctatgctcatggaggccaatgtcggcttgacaacacccaaaagttttattgttacaaaggaaataaatcgactcttcttatagcagcaattgcatctgccggtggagcactaggagctatgatatttttgatttggtgcattagaagacgcttttacaagaagaaaaatcccacccaccaaataattgagatgtttctgaacacccacggtcaccttgcagccaaaagatacagttattcagagataaagaaggccaccaactccttcagatacaaattgggtcacggaggatatggtagtgtatataaggggaagttacaagatggaagccttgtggcagtaaaagttttaagcgactccataggtaacggtgaggaatttatcaatgaagttgctagcataagtgtcacttcccatgttaacattgttagtttactgggattctgtctggaaggttctaaaagagctctgatatataagtacatgcctaatgggtcacttgagaagttcatatatgaagacaaggatccactcaagctcaatcttcaattgagttgcaaaaccatctacaatattgcaatcggcgttgctcgaggattggagtatttgcacaggggttgcaatactaaaatcttgcattttgacatcaaacctcacaatatattgctagatgaggatttctgtccaaagatttccgattttggactagctaaaatatgtccaaagaaagagagtattgtgtccttattgggaaccagaggaacagcgggatacattgctcctgaggtattctcaagaaacttcggagaagtgtcacataaatctgatgtgtacagctatggaatgatggttttggaaatggttggggaaagggtgaataacaatgttgaagttgaatgttcaagtgaaatatattttccacactgggtttacaagcgtcttgaactgaatcaggagcctagattgcgaagcataaaaaatgaaagtgataaagaaatggtacgaaagttggttatagtgagcttatggtgcattcaaacagacccgtcaaataggccagcaatgagtagagtggtagatatgatggaaggaagcatggagtccttgcaaataccaccaaaaccttatctctcttcacctcccagatctcccccaagaccctcggatcacaacacttacacatctcacactacgtatccttctgagaactga

SEQ ID NO: 3497 - DNA, 624 bp, Glycine max var. Williams 82
atgtctccccccatctttaaagtactcacactgatcatatctgtttttgccatcttgcaaatatcaacagctggtgacccagatattctcactgacttcatagtcccacccaacaccatacctaatggcaacttcttcaccttcactggcttccgtgccattttttcacccaacaacattgtctcagctttcaaagtgttgaaggcaaccaaggtagaatttccagccctcgatggacaaagtgtctcatatgcaatccttgagttcccaggtggcagcatcaacccaccacacacacaccctcgttctgcagagttactcttcgccgttgagggttcccttcaagtggggtttgtggacacaaccaacaagctcttcactcaaacactacaaaccggagacctctttgtgtttccaaagggtctcgtgcacttccaacacaatgcagatcctcagaagccagcactcgctatatctgcctttggaagtgccagtgctgggactgtgtcaattcctagcactctctttaacaccaccattgatgacaatgtcttggctctggccttcaagactgatgttgccaccattcgaactctgaagaaaggctttgctcctaaagcatga

SEQ ID NO: 3498 - DNA, 204 bp, Glycine max var. Williams 82
atgagatcaattttaagtttatgtttgtcttcaacctggtctaatggtttgcttagtgcaataccatcaatggtcacatgttcgagactagacagtcccttcacaaccaaaaccaacaacccgcaacaacagatcaagtttaagtttatgataatgctttcttttcagtgtggtcaatttgtaagtattagttgctccaaatga

SEQ ID NO: 3499 - DNA, 813 bp, Glycine max var. Williams 82
atgaagtttgacaagatcctcaagaggctgatcgagcagacactgccccattggcgtgacaaattcttgtgctacaaaatcttgaagaaacagttgaacgttatgtgtcccgaagatggccaagctctgccccagttgaatgccaaagaattggaccacttccttaacctcttgcagctagagattgctaagttcaacaatttctttgttgacaaggaagaagaatatgtcatcaaattgaaggagtttcaagacagagttgtcgaagccgttgattcaaatgtagacttgatgtcattagggagggaaatagtagattttcatggggagatggttttgttagagaactacagtgctctcaactacacaggtttagtgaagataataaagaaacacgataagaaaactggtgctctacttcgctcaccttttatccaatctgtggtgaaccagcccttctacgaaattgatgttcttaacaagcttgtaaaggagtgtgaggtgatactaagcattcttttcaccaatggtccgagctcatcgataagccaggattttatgcaaaatggttttggctccatgagtggtaatgaaaataaagagactgtaatgcaggttcctgaagaactttctgaaataaaaaatatgaagaacatgtatatccaactaactctatcagcacttcataccttggaacaaatcaggggtagaagctcaactgtaagcatgttcccatctctccaaacaactaggctttgcaattacaagagaattgaaagaagaagaaaaattgcactagagaaagcaacctag

SEQ ID NO: 3500 - DNA, 1252 bp, Glycine max var. Williams 82
ttcccttcaatcctctgcaccccacctactcgatcactaagaaacaaaaaacattattctcttagtgaataacagattattagcattaacatgaagtttgacaagatcctcaagaggctgatcgagcagacactgccccattggcgtgacaaattcttgtgctacaaaatcttgaagaaacagttgaacgttatgtgtcccgaagatggccaagctctgccccagttgaatgccaaagaattggaccacttccttaacctcttgcagctagagattgctaagttcaacaatttctttgttgacaaggaagaagaatatgtcatcaaattgaaggagtttcaagacagagttgtcgaagccgttgattcaaatgtagacttgatgtcattagggagggaaatagtagattttcatggggagatggttttgttagagaactacagtgctctcaactacacaggtttagtgaagataataaagaaacacgataagaaaactggtgctctacttcgctcaccttttatccaatctgtggtgaaccagcccttctacgaaattgatgttcttaacaagcttgtaaaggagtgtgaggtgatactaagcattcttttcaccaatggtccgagctcatcgataagccaggattttatgcaaaatggttttggctccatgagtggtaatgaaaataaagagactgtaatgcaggttcctgaagaactttctgaaataaaaaatatgaagaacatgtatatccaactaactctatcagcacttcataccttggaacaaatcaggggtagaagctcaactgtaagcatgttcccatctctccaaacaactaggctttgcaattacaagagaattgaaagaagaagaaaaattgcactagagaaagcaacctagtatctaatagtgagaataacatggatctacttgtgtttgtacatggctgatattatagagactaatgcagccatccaattagttactcggaatatattacacatgatgggtgttgactctcagtctcatgtttccttgttgcccttttctgtgttgaggtcctacttaataaatttgtgtgatagttcaggactacctattaatttctccgtaggtgggtgcggcttgaattttggcccttatctgttttgcaatgtacaaaataatttcttcaggctttgaggtgttatgaactggtcaactattttggtagtcgctatgaatgtgttaacaatctatcccactttag

SEQ ID NO: 3501 - DNA, 678 bp, Glycine max var. Williams 82
atggcaatgcgttccctttgcttcttagtgtttctagctgcagcaatgcaaggaacacttgcagttgattacactgtcaccaacaacgccctctcaacctctggtggcgtgcgtttccgtgatgcaataggggacgattatgcaaaacaaacgctcgactcagccacccaattcatatggggggtgctccagcaaaacgctcctgctgatagaaaagatgtgcaaaaagtaaacctgttcgtggatgacatggatggcgttgcatataccagcaacgatgagattcatttgagtgcaagatatgtcaatgactatagtggggacctgaaaacagagatcacaggggtgttgtaccatgaaatggtccacgtttggcaatggaatgggaatggccaaactcctagtggattaattgaaggtattgcagactatgttaggctgaaggcaaattatgcacctagtcactgggtgaaagcagggcaaggagagaaatgggaccagggttatgatgttactgctcattttcttgactattgtgattctctcaaaagtgggtttgtggcacaattgaaccagcagatgagggatggttacagtgatcaactctttgttcagctactggggaagacagttgatcagctttggcaagactacaaggctaagtatggcactagttaa

SEQ ID NO: 3502 - DNA, 678 bp, Glycine max var. Williams 82
atgatcaatcatgctctttgtttcttagtattcctatctgcactccatgcaacacatggagttgaatacactgtcactaacaacgcactctcaactcctggcggcgtggctttccgtgacaaaataggggctgaatacgccaagcgaacacttgactcggccacccaattcatatggaggatctttcagcaaaacaacccttctgacagaaaaaatgtgcagaaggtaagcttattcgttgatgacatggatggtgttgcatatactagcaacaatcaaatccatctcagtgcaagatacgttggaaacaataaaggggacgtgaaaacagagataacaggtgtgctgtaccatgaaatggtgcacgtttggcagtggagtgggaatggtcgtgctcctggtggattaattgaaggtattgcggactatgttaggctgaaggcaaactatgcacctagtcactgggtgaaagcagggcaaggacagaaatgggaccagggttatgatgttactgcacgctttttggactattgtgatagtctcaaaagtgggtttgtggcacaacttaacaagttgatgagaactggttatagtgatcaatacttcgttcagttactgggaaaaccggttgatcagctctggcgagactacaaggccaagtatggcaatattgcctaa

SEQ ID NO: 3503 - DNA, 1587 bp, Glycine max var. Williams 82
atggatgtttggtcatggatatgtgagctccccaactcggtggagtggacagagtccgactcgccacccatgaagttcgaactcgcgagtgagaagaaggagaactcaactcgttccattcacctgaaagccgagcgaacctccggctcagactcggaagctgcggtgaccttcaccgtatgcttgcaaggctttcacccacacaacgcccacaagcctctctgggtctccgaaaagtgccacctgtcatcagaaaagcccttcctccctctcctcctgcaacttctccaagaaatcatatcccactcccccacggcgcacgatagcacctgcccccgttcccagctccagaaactgaatcccgagcccatcgcatggatcatggactcgcacacacccgaatccctctccaccttcttcaacctcgtcttcaccatgcgcctcttctggctctgcgcctgccacgcgccccccgaagccggctccctctacttccactacctcctcgcccccagcctccaaacggcgtcgtccaaactcgcctcctccgtcctccgaaccttcttcatcaccgtgggcgtcgacaccgaactctgcttcatgcgcaccctcggttacatcattacaaagcttcacatgatcaaagaactcagcgttggattgggcttaaaaacgatttttccttctcccagattctcttacgccaacgagactcacggtctttggattctcaaaggttacgcgccagtcatgaccatgaaactggcgcgaagcaataacgttaaaaaaagtcaattctctggcatcgatgccaaggagtcaattctccgttactctctggcgcaccaccaactcgaggcacacgtgcagctagaatacaccgttgggtttttcgatgctttcattcaggttcgtgcacgtgtcgataacatacgcctccacgtggcgaggttgggatttacccaaaacgacgacgtggatgatttcgttgaggagaagcactttccgtcccgggttcgggtttgggtgggcccggagatcggagcgacttattgcgctgggctgagcttgggccggtcgacggagaacaaagagagcgaagtggaaactaagagggttgtggagggcaatttggagaagtcgcagggttcgaatgtgaaagcgttagccaagtcgtcgaggaggacgcggagtaggagttggagaatggatcaagacgcggaagggaacgcggcgatattcgacgtcgttttgcatgataacactacgggccaggaaatgggctcgtggaggcccataagtgaaacgggtggtgacccgggtcatgggctgagagggcgatatgcgagggcaaatagagcgtttaataaaagcgggtcggtggttattgcaggggatgaatatggagaggaagtggggtggaggctttgcaaagagatggaagggagtgtgatgaagtggagaatagggggagagttttgggttagctatttgcccaaccaagcaaagggttcttcttttgaaactaggtacatggagtggtgtgatgaagttgatttgcctcttattcatggtaaaacaacctaa

SEQ ID NO: 3504 - DNA, 1587 bp, Glycine max var. Williams 82; identical to SEQ ID NO: 3503

SEQ ID NO: 3505 - DNA, 2397 bp, Glycine max var. Williams 82
atggatgttgcgtgcaactctgggtcagataatcgctcccccgttgcctctgcttctcctcttcaatctcctaccgcctccgtcaattccaagatcggaaagaataaattgaccaaggattctacatcaagtgctcttaacaagttcaaatcacaaattagaaagcctcctcgtcgtaaaacctctcctattaactggttcccacgtaaaaaaggggatacctatatgaataggaaaattaagatgcttcaggaagtagatggtatgaatttgacgcttgatcagactcttggcagttctaacccacattactcaagagtgctgagagagaaaatggcagctagagaagcggcacataaggcaatcgaggctagaagagcagcattagtggaagcctcttggtgtcgtattttacgtgctgccaggattcccggtgatgatgcagaggcccaactcttaaaggcagaaaaaagtgcagtagaagcttttgagacagcccaggctatgggtgttattatgtttgacttgccaaattgccctaagaagcattgtcaaatagagacatcctctgttaatggagaaggatcatctacccatactgttactgcatcttttgaaactgcctttgaggtggacagagaagtagctgctgcagtcaaaactgcatttattagacttgcaaactgccattcatttagtaaaggtgaattcaaagaactgctaagaaaaattagtgaaaatcctgatacagatgaaagtaatctggacttgtctgagttctcttcagggtatgaatccgagtctgggtcagagcttgattcagtctctcagaagagtgacttaaactgccaagacttagattccaaaatatcatttcttggggtaagtcagaggaaaaacaggaggagtcagtctcttgaaaacagaataaaacttgtggatatgatgattgagaggttaaaatgtttgcaagaagatgaactctcttctcttgccactatagttgcaacttatggtttgaacgctgccttggctgaagtacagaattccaaaccgcacaatccaggctctgctattgagtattcatcctcttcagcaactaattttccatctagaagaatgtcatcattgggattgggaaaatcagccttggatgtgatgagaaagaagcaggatgagccagaactgccaagcctcgataagtttttagttaagcacatgacaaaacttgaaagagaggtttgggaagctaaaaaagcccgaaagaatgagacagaatcagtcagggatagctctcgtaaatctgttgatgaaactccaccggagatggtacctgatttgggaagtattctagtgaagaattattcaaaattagagaaagacatcaaggaggcaaaaattaagtcaggaaaggaaacaccagcagttccaagaggcatgccaaacagtcaaaaggatcacatagaagtaccaagcttagataaggtcttagtgaaacatgtctcaagactagaaaaggaagttcaagaagcaaaaaacagaacaatcaaggagaacagaagcttgaagaaaaaagctgatctagatacaacaggtggactggactcaactttctattctgatgaagaagcattagacaggaaagaaaacataaattcaaatacagagatcaattcgggggaaagcaaagatgatgggctggagaaaatactaataaagccagtgcacagattagaaagagagaagctgcatgcccagtcactgggaagccatgttgaaaactataaacaaagaatgaatcatggagcaaccaatgttgcggattgtgagagcttggataaagttttagtaaagcacgtctctaggctggagaaggagaaaatgaggatcaattcgggggaagaatggggcccagttaagagaagtcccagaaacatccattcggaaacaaatgaaggtggcctggaccaagtgttggttaaacataaatccagacttgagcgagaaaagatggttgctgctcagcagccagagaactcagttagtctttcaacaactcgtcgtgaagcaagggagaaagagttgcaaaaaacttggggaggactgagcttaggaaacattcatttggaaacaaatgaagctggtctggatcaagtgttggttaaacataaatccagacttgagcaagaaaagatggttgttgctcagcagccagataactcagttagtttttcaatgactcgccgtgaagcaagggagagagagttgcaagaagcttggggaggacagggcttaggaaactccattaaaccttgtctctctaagcttgaacgagaaaaggctgcctggattaaagctgaagaggaggaaaggaagcaagcaaagaaagcaatttga

SEQ ID NO: 3506 - DNA, 783 bp, Glycine max var. Williams 82
atggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaaacatccacaacaacaacacccaattaccgtcttcttcactgtcagacaaagaagcgtcgccgccggtgaaactaacacacaggtgcaccgtttgcaacaaggcctttggttcttatcaagcactcggtggacacaaggccagccaccgcaaggcctcgtcggaatccaaccccaccgcctccgtctctgccctagccaacgacagcgtttctgcttccaccgtcggcggcggaaggatgcacgagtgttccatctgtcacaagagtttccctaccggtcaggccctgggtggccacaagcgctgccactacgacggcgggaacaaccacagtaacagcaacgccaacggaaacaacagcagcggcgccactacctccgacggcggcgctgcctcctcctcccacacgctccgtgggtttgacctgaaccttccggcgccgctgacggagttctggtcgccgatggggtttgatttcgggaagaagaaggtaggcggtgaacaagaggtggaaagcccgttgccggtaaccgccaagaggccgcgtttgtttacaggggaagatgatgaaaccgcgtag

SEQ ID NO: 3507 - DNA, 327 bp, Glycine max var. Williams 82
atggaaggtttgattccatatctgattcatgcaatcaagaagcaaaagcctcaccaccacaactacaggagctactctcattctgaaagctcaaaccgcagctaccacgtgctattggcgtctgaatccttcacaggatcttctcacagaagaacaaggtctgattttcagccccccacaagtgagttcttagagcagagatatggtgttgatggattcttggtcagccccagaggccaatttactgctgctgctcctcctcccactgtcaatgttaatgctgcccaacactctaacaatatcaccaacatgcgcaatcgcaagtga

SEQ ID NO: 3508 - DNA, 2046 bp, Glycine max var. Williams 82
atggtctctccaaaagtactttctttcttttttctactttttactctgatatctcaagctactgccaagccagaatacccatacgctgtttgcatcacagaaggtggagattatgcccctaatagcacctaccagaccaacctcaataccgttctttcaaggatcatttccaccacacaaaatgattatggcttctacaattcctcctatggccaagaacccgacagagtctacgcaaatgggctttgcagaggagatgttaccccacatgcttgccttacttgcctcaacaattctcatttacttctcctaaagcagtgtccacatcagaagcgtgcaataggaggatatgctgaatgcatgctgcactattcatatcgctcggtactaggttactatgattctgatttccgggtctacttgcagagtaaaactaatgtaaaagattgggatcagtacagttacgtgctgatgaagttgctgtcaagactaaaagtgaaagctgcaacaactgattcctatctgaatcgtaaatatgcttcaggaaatgcaacaattccgggttctcaaactatatatgccgttgttcagtgcgcacctgacttgacagtggcacaatgcaacgactgcttagatggtgccatttcagaaataccaaaatgttgtaatcacatgtcaggtggtgtggttattaaattcaggtgtaacttcagatacgagagctctaggttttatgagccaacggctgatacactaacactacaattgtcaccacaaggatctccatctccttcacctacaccagcatctacaactgcaaattacccagagagtacttatcatggaaaaggcaacaaatcacaagctgcaatcgctaaatatgttgtgcctattgttgtctttgttgggtttctgatctttgtttgcatctatttaagagtgagaaagccaacaaaactgtttgagagtgaagctaaggttgatgatgaaattgagcaagtagggtcatcactttttgactttgacaccatcagagtcggtacaaacaacttctcccctgccaacaagctaggacaaggtggatttggacctgtttacaaggggatgctcttcaatgaacaagaagtagcaatcaaaaggttatctagcaattctggccaaggagaaattgaattcaagaatgaagtgctattaatgtccaggcttcagcatcgaaatttagttagactccttggtttctgttttgaaagagaagaacgactccttgtctatgagtttcttcctaataaaagccttgactacttcttatttgaccccatcaagcgtgcacatttggactggaaaacacgctacaaaataattgaaggcattgcacgtggccttctttatcttcatgaggattctcagaggaggattattcaccgtgatctcaaattgagtaatattcttttagatgccgatatgaatcctaagatttcagattttggctttgcaaggctgtttaatgtggatcaaactctgtttaatgcaagtaaaattgcaggaacctacggatacatggcacctgagtatgcaaggcatggaaaactctcaatgaagttagatgtctttagttttggtgtaataatactagagattgtaagtggccaaaagaatggtggatttcgtaatggagacaatgtggagcatctattaagctttgcttggacaaacttgaggaaaggaacaacagctaatattatagatcccaccttaaataatgctttcagagatgaaatagttagatgcatttacattgggctactttgtgttcaagaaaaggttgctgatagaccaacaatggcttcagtggtgcttatgcttgagagccactcttttgctttaccagttccattgcaaccagcttattttatgaacaacagttgtttatcagacatccagtttttggggtgcagttctgcggaaacaggatcaaatgaacagagaagtaactctgctgatgtatcagcaaatgaggcttcaattagtagtctatatcctcggtag

SEQ ID NO: 3509 - DNA, 2078 bp, Glycine max var. Williams 82
aacacacattattacaacatctagaccatggtctctccaaaagtactttctttcttttttctactttttactctgatatctcaagctactgccaagccagaatacccatacgctgtttgcatcacagaaggtggagattatgcccctaatagcacctaccagaccaacctcaataccgttctttcaaggatcatttccaccacacaaaatgattatggcttctacaattcctcctatggccaagaacccgacagagtctacgcaaatgggctttgcagaggagatgttaccccacatgcttgccttacttgcctcaacaattctcatttacttctcctaaagcagtgtccacatcagaagcgtgcaataggaggatatgctgaatgcatgctgcactattcatatcgctcggtactaggttactatgattctgatttccgggtctacttgcagagtaaaactaatgtaaaagattgggatcagtacagttacgtgctgatgaagttgctgtcaagactaaaagtgaaagctgcaacaactgattcctatctgaatcgtaaatatgcttcaggaaatgcaacaattccgggttctcaaactatatatgccgttgttcagtgcgcacctgacttgacagtggcacaatgcaacgactgcttagatggtgccatttcagaaataccaaaatgttgtaatcacatgtcaggtggtgtggttattaaattcaggtgtaacttcagatacgagagctctaggttttatgagccaacggctgatacactaacactacaattgtcaccacaaggatctccatctccttcacctacaccagcatctacaactgcaaattacccagagagtacttatcatggaaaaggcaacaaatcacaagctgcaatcgctaaatatgttgtgcctattgttgtctttgttgggtttctgatctttgtttgcatctatttaagagtgagaaagccaacaaaactgtttgagagtgaagctaaggttgatgatgaaattgagcaagtagggtcatcactttttgactttgacaccatcagagtcggtacaaacaacttctcccctgccaacaagctaggacaaggtggatttggacctgtttacaaggggatgctcttcaatgaacaagaagtagcaatcaaaaggttatctagcaattctggccaaggagaaattgaattcaagaatgaagtgctattaatgtccaggcttcagcatcgaaatttagttagactccttggtttctgttttgaaagagaagaacgactccttgtctatgagtttcttcctaataaaagccttgactacttcttatttgaccccatcaagcgtgcacatttggactggaaaacacgctacaaaataattgaaggcattgcacgtggccttctttatcttcatgaggattctcagaggaggattattcaccgtgatctcaaattgacggatacatggcacctgagtatgcaaggcatggaaaactctcaatgaagttagatgtctttagttttggtgtaataatactagagattgtaagtggccaaaagaatggtggatttcgtaatggagacaatgtggagcatctattaagctttgcttggacaaacttgaggaaaggaacaacagctaatattatagatcccaccttaaataatgctttcagagatgaaatagttagatgcatttacattgggctactttgtgttcaagaaaaggttgctgatagaccaacaatggcttcagtggtgcttatgcttgagagccactcttttgctttaccagttccattgcaaccagcttattttatgaacaacagttgtttatcagacatccagtttttggggtgcagttctgcggaaacaggatcaaatgaacagagaagtaactctgctgatgtatcagcaaatgaggcttcaattagtagtctatatcctcggtagatatgaatcatgctaagatgacattctttttacatgttatgtatgagtaagagaatatattcaccattcactataagaaaaaataataatcaaatacgatattttttttaataaaaa

SEQ ID NO: 3510 - DNA, 2001 bp, Glycine max var. Williams 82
atgggttcttttcattttttccttctgctcctaactttcttttccctctttgttcacacctctccctcccctatcatccaagcagctatcgatcaaggtaccaaagcctactataactgcacaaggaacagcacttttgctgcctatagctcttaccgttctaacgtcaaaacacttctagattttctctcctccaatagcaccaacaatgccagattctacaacactacagtttctagcaaagacactgtttacggtagcttcctatgtagaatagacaccactccaaaacactgccaagaatgcgtgacacaagctgccaaactcatatcatcgctttgcaaaaatgctacagaggctatagtatggtaccaagtatgctatgtgcgctactccgatcgtcgtttcttctccaccgtggaggagagtcctaaactctcctttatgaatgataaagattatgtgggtaacgttgggctcttcaacaacattgtgtgggatatgatgaacgatttgagaagtgaagcagcaagtgctgctaataaatcggctgataagtctgtgaacatcattgataatgaaaaggtatatggctacgcttggtgcctcccatatctgtccaaagagaactgcagctggtgtcttagcgatgccatagcagaaattccaactggttgctgcagaggaaaatctgggggaacaataatatatcccagttgtggtgttagatacgaatcatatcaattccataaggcacaaatcaggggtggttcggtgacgccgccgccacttcccagtagtccttccccttttgcttcaccagggaaaagaaaacaaaagacactaacaataattgtgattgtagttccaattgttgtttcactggtgcttctatctttgggctgctgctgctttttacatagaaaagcaacaaagaatcaacatgatattctcaaagaaaactttgggaatgacagtaccactctggaaaccttgcgatttgaattagccaaaattgaagctgctacaaacagatttgctaaggaaaacatgataggcaaaggcggatttggagaggtttataggggtattcttttggatgggcaagaaatagcagtgaagaggcttactggaagctcccggcaaggagcagtggagtttaaaaacgaggttcaggttatagcaaagcttcaacacagaaatttagtaaggttactaggattttgcttagaagatgatgaaaagatacttatttatgagtatgtgccaaacaagagccttgactattttttattggatgccaagaagagaagactactatcttggtctgaacgtcaaaagatcattataggaattgctcgaggaattctatatctacatgaggattcttgcctcaaaataatacatcgtgatttaaaacctagtaatgttttgctagacagtaatatgattcccaaaatatcagattttggcatggctagaattgttgctgcagatcaaattgaagaaagtacgggcagaattgtagggacatatggttatatgtcccccgagtatgcaatgcatggacaattttctgtgaagtccgatgtgtttagttttggagtcatggttctagagattattaatggaaagaggaaaggttgttcttctgaatcagatggtattgatgacatccggagacatgcttggacgaaatggacagagcaaacaccattggaactattggatcctaacataggaggaccatattccggagaagaagtcatcaaatgcatacacattggtctgttatgcgttcaagaagatccaaatgatagacctacaatggcaacagttgtgttttacctcaacagcccttcaatcaacttgcctccccctcgtgaaccaggatattttaagcgcgatagaatacaagacaacaagacgacccacaaagaattggataatatcagtgattccatcaacggaatttctttaactaatttctttcctcgttaa

SEQ ID NO: 3511 - DNA, 1056 bp, Glycine max var. Williams 82
atggcagccatggcaaccacaaccctctcttcaaaccccaaactctcattcttcaacggaaagcccgtcacatattcttcccgcgtcgcgcccaccaccaaattatcctcatccaaacaaggcacaatttccatgtccctaaccccacccccctacgacctccagtccttcaaattccagcccatcaaagaatccatcgtgtcacgggaaatgacgcgccgctacatgaccgacatgataacctacgccgacaccgacgtcgtaatcgtcggagccggttcggccgggctctcctgcgcgtacgagctcagcaagaaccccgccgtgagcgtggccatagtcgagcagtcagtgagccccggcggcggcgcgtggctcggcgggcagctcttctccgcgatggtggtccgcaagccggcgcacctcttcctcgacgagctcggcgtggcgtacgacgagcaagaggactacgttgtcataaagcacgcggctttgttcacgtccaccatcatgagcaggctcctcgcgaggcccaacgtgaagctcttcaacgcggtggcggcggaggacttgatcgtgaaggaagggagggttgccggggttgtgaccaattgggctctggtttcgatgaaccatgacacgcagtcatgcatggaccccaacgtgatggaggcgaaggttgtggtgagctcttgtgggcacgatggaccctttggcgccactggggttaagaggttgaagagtattgggatgattgatagcgttcctggaatgaaggctttggatatgaatgctgctgaggacgctattgtcaggctcactagggagattgtgcctggcatgattgtcactggcatggaggttgcagaaattgatggctccccgagaatgggtccgacgtttggggcgatgatgatatcagggcagaaggcggctcatttggcgttgaaggctttgggtaggaacaatgcaattgatggaacgtgtggagttggaagggaagaaccccagcttattttggcttctgcggacactgaggaaattgttgatgcttaa

SEQ ID NO: 3512 - DNA, 417 bp, Glycine max var. Williams 82
atgagtccaaccttacggtcttcaactactggtttctccagggaaaggcctgttgttgcagctaatgcaacactgtcagggcaagatgccaggaagggatggtgtattagagattttcatcgtgcaccactgggtcaggtacctagattccaaaatctaatcaatgatagtctaggctcttctcaacctcatgatgcctggaagattattcatcacgcgtctaactcaccacaacatatctttagtaatagggggccagcaaggagtctcatgatccctcctattgacaacattcgaaatactgatataaacccatatcaggttccacctgcatcttttgaaataaggccttctacaaatttgaatgtcactcgacctcctaccttaaatccaataactccattgcaaaaacgttag

SEQ ID NO: 3513 - DNA, 600 bp, Glycine max var. Williams 82
atggtgctgcccaagttctctctgtgcttctggcttctcctttcttcacttgtgattctcttaataaattgtccagttaaatgtgacgatgatgaggaagacaatctctatcaaggtatcaacaagtatcgagcatcgttaaacttgaaagctctaacaaggaatgataatgcaaattgccttgccgaaaaactagctaaccaattcaagaaacaaccctgcacaaataccacaggtgctaacactgtacctggcacagaacctcagttttccaactatccagaccttttatccaagtgtgacttggctatttccaacacaagggatggaaatgtaatgcctgcctgtgttcctggcctggttccaagtcttgtccttgctaatttcaccaaatctctctactctgatagtctcaacgacacaaagtatacaggaattggtattggttcagaagataactggattgttgtggtcttgaccactaacactccttcaggaacctttgctccctatagttctaatggtgtcaatttgatttctaaatctggattgatttactgctcagtgctcttcttagttggttacattttgctgttatga

SEQ ID NO: 3514 - DNA, 882 bp, Glycine max var. Williams 82
atggccatctccagcaacgcttctccttttgattccatcatcttcgatttggacgacaccttgtacccgtcaagcaccggtattgacaagtgcgtcaagaaaaacatccaactctttctcatccagaaatgcggattctcagaatccgaagccttcaccctccgagttgatctcttcaaaacctacggaagcacccttgccggtttaagagtcagtaataataacacatcaatcaatgtcttattacaagctctaacacaccaatatccccatctcaactctgtttccttcttcgttactttgcaggcactaggccatgatatcaccgcagaggagtaccatggtttcgtgcacggaaggctaccttacgactccatcaaccctgatcatcacttacggaaccttctctgcaccatcaaacagagaaaaattgtttttactaattcggacaggattcacgcgatgaggtcgttggatagacttgggatcaaggactgtttcgagcaaatcatatgtttcgagactataaacccgaaccttccatattccacccgacccgatgaattcctcatcctccttaaaccgtctctcgacgccttcaagatcgcccttgacgctgccaacgtggatcctcgtcgtacgttatttctggatgacagcgttcgcaatattgccgcgggaaaagaaatgggtctccacactgttctggttgggaagacagagaaaagcaaaggagcagactatgcagtggagtgtgtgaatgacttggcacaagtgatcccagagatatgggcaaacgaaatggacggtgaggatcaaacgatgacacgtaccaagagtgaattggaggccgtactcgcgtgtgctgtggttggagcttga

SEQ ID NO: 3515 - DNA, 1203 bp, Glycine max var. Williams 82
cctctctataaattcccctccaatcccttcattcgaagctcgcttcctctttctaacttgccataccatcttacttttactttgttttcacaacatagccatggccatctccagcaacgcttctccttttgattccatcatcttcgatttggacgacaccttgtacccgtcaagcaccggtattgacaagtgcgtcaagaaaaacatccaactctttctcatccagaaatgcggattctcagaatccgaagccttcaccctccgagttgatctcttcaaaacctacggaagcacccttgccggtttaagagcactaggccatgatatcaccgcagaggagtaccatggtttcgtgcacggaaggctaccttacgactccatcaaccctgatcatcacttacggaaccttctctgcaccatcaaacagagaaaaattgtttttactaattcggacaggattcacgcgatgaggtcgttggatagacttgggatcaaggactgtttcgagcaaatcatatgtttcgagactataaacccgaaccttccatattccacccgacccgatgaattcctcatcctccttaaaccgtctctcgacgccttcaagatcgcccttgacgctgccaacgtggatcctcgtcgtacgttatttctggatgacagcgttcgcaatattgccgcgggaaaagaaatgggtctccacactgttctggttgggaagacagagaaaagcaaaggagcagactatgcagtggagtgtgtgaatgacttggcacaagtgatcccagagatatgggcaaacgaaatggacggtgaggatcaaacgatgacacgtaccaagagtgaattggaggccgtactcgcgtgtgctgtggttggagcttgaaaagtgtttggatgtggaggaggataaggcctgacgttgtacaatgtacattcccaaaccaacccaactatctaagcaattaaaataatagcagcaagtactatcagaacaccaacaaccaagacaataacaataagtaacatgggcccctaagcaattatttgcgacatcatgttaatcatgtcaatattgtaagatatttagtagtattatttgtacgtattatcaatcgtcttacaaataaaatcaaattgtctctcagagatatcaattgcttaacaattaataaagttgagttactgtcattattttgatta

SEQ ID NO: 3516 - DNA, 2028 bp, Glycine max var. Williams 82
atgaagctagaaattttcacatgtctcataactctattgttcttttccacttcagcatccaccaacaccacctttcaccacccactagaccctttaaccccatccgagttcaagttggtccgaaccatagtccaaaaaaaataccaagcctcaccccccacactaacctttcaatacattggcttggacgagccagacaaagccatagtcttatcatggcaatattcagaccccaaaaccaaagccacaacactcccacctcgtcgtgcttttgtcgttgcccgtttcaaaaaacaatcccttgagatcaccgttgacttgtccaaacgttccattgtctccaccaatgtctacattggccatggcttccccatgctcacgttcgatgagcaagactttgtggccgagcttccttttaagtataaacccttcattgaatcagtgaacaaacgaggccttaatatatctgaagttgtgtgttctactgcctcggttgggtggtatggggagataaagagcaaaaggacactgaagcttcagtgctttcacacacaagggtctactaatttgtttgctatgccgttggagggtattacggtggttgctgatcttgatgagagaaagttagttgcatattttgacagcaagattgttcctgtgcccaaggctgagggaactgagtacgtagcttcaaagcaaaagcctccatttggaccaacgttcattggagcagcttttgtgcagccaaacggaccaggattcaagatcaatggccactctatcagctgggcaaactgggagttccacctgggatatgatattcgagccggtccagtgatatcgctagcatcaatttatgacattcaacagcaaaggtatcgccgagtgttatacagaggatatatatcagagttctttgttccatacatggacccaacatcaagttggtacttcaagacctttcttgacagtggtgaattcgggtttggccaatccatggtgtcacttgagcctttcgctgattgcccatccaatgctgcatttttggatgcatattttgcaggagaagatggtgtgccagttaaaatagctaatgcattttgtgtttttgagaagtatgctggggatatcatgtggcgtcacacagaatcagaaatccatgatgaagagataagggaggttaggcctgatgtgagcctagtggtgagaactgtctcaactgtgggcaactatgactatatcgtagattgggagtttaagccaagtggttccataaaaatgggggttggtctgacaggaattttgggaatcaaagcaacagcatacacccacgtggatcagataaaggaggatgcctttggcacattgctaacagacaacaccattggtgtgcaccatgatcactatctcacatatcacctcgacctcgacattgatggagaagccaactcattcgtcaagaccaatttggagaccgtgagagtaacagatcacagttcaccaaggaaaagttactggaccgtggtgcgtgaaactgctaagactgaggctgatgctcgaatcaaacttggtttgaagccatccgagctagcagtggtaaatcccaacaaggaaacaaagcctggaaacaaaatggggtaccgtttgttcccattcacagtggcaaacccacttttggcccctgatgattatccacaactgagaggttccttcactaattataatgtgtttgttacaccatataacaagtctgagaaatgggcaggggggttgtacgctgatcagagcagaggagaagacactttagctgtttggagtctcaggaataggagcattgaaaataaggacatagttctgtggcacacggtggggattcatcatgtgccttgtcaggaagattatcctattatgccaacactgagcggtggatttgagctaaagcctaccaatttctttgagagtaatccggttcttaaagccaaggcaccaaagcctgtgcatttgcccaagtgcaattctaaaccttag

SEQ ID NO: 3517 - DNA, 2028 bp, Glycine max var. Williams 82
atggatgcaaccacgaaggttacactgttctcaatcctcatgctcttttggagccatgcagaatgcaaccatcttcttcacccactagaccctctaaccccttctgagctcaaccttgttcgaaccattgtccaaaacttttatccaacctctcaaaacctcaccttccactacgtaggcttggacgaacccaacaagcccgaaatcctcaaatggctatcctcaaacaactcaaaaatcaaacccaaaccacgaccacctcgccgagcctttgccgtagtccggttccaaaaacagtcccacgagatcacagtggacctgtccacgcattccatcgtctcaaccaaagactgcgaaggaaatggcaaccctatgctcacctttggcgaacaagccgtggcgtcgcagctaccattcagctacgaaccgtttaaagagtctttgaagaaaaggggtctcaacacgtcacaggttgtttgtgcttgtttcactattggttggttcggagaaggcaagaccaaaaggaacgtcaaggttaagtgttattacgcaaatgacactgccaatttgtatgccaggccattggaaggtgtggctgcggtggttgatttggacgacatgaaaattgttggctacaatgatagatatgtggttccggttccaaaggcagagggcactgaatacagagcttctaagctgaaaccaccgtttggtccaaagcataagggaatagctgtcacgcaagacggtggacctggtttcaccaaagacggccattcggtaagttgggccaattggaactttcacgtaggatttgacattagggctggcccaataatttctcttgcttcaatatatgatcttcaaaagcaaagacatcgtcgggtactgtataaaggattcataccagagctatttgtaccataccaagacccaactgaggaatggtattacacaacatactttgattctggtgaatatggttttggacagtctatgtcttcactgcagcctctcaacgattgccctcccaatgctgcattcatagatgcatactatgctggatcagatggtaccccggtaaaaatagctaatgccttttgtatatttgaaaagtatgctggtgatatcatgtggcgtcacacagagatttcaattccaaatgaagtgataactgaggccagatctgatgtaagcctagtagtgagaatagtttcaactgtgggaaactacgactatgtcatagattgggaatttaagccaaatggctgcatcaaaatcggggttgggcttactgggatattagggctaaaggcagggacatacaccaacacagaccaaataaaagaggatatttacggcacactaatagcagataataccattggtatataccatgaccacttcttcacctattatcttgaccttgacattgatggtgaagccaactcctttgtgaagtccaatttggagacagtgagagtgaaagatgacaccacacccaggaaaagttattggacggttgtaagtgaaacggctaaaactgaagctgatgcaaaaatcaacctagggtccaagccttcagagctactagtggtaaatcctaataaaaagactaaacaaggaaataaaattgggtaccgtttgcttccaggtccagtggcacacccacttttgcttaatgatgactatccacaaatcagagctgccttcaccaattacaatgtatgggtcacaccatacaacaaatctgagaaatgggtaggagggtcatacgtcgatcgtagcagaggcgatgataccattgctatttggagtctcagggatagggaaattgagaacaaagacatagtattgtggtacacaatgggatttcatcatgttccttcccaagaagactatccaattatgccaacgttgagtggtgggtttgagctgaggccaaccaatttcttcgagagaaacccggttcttaaaacaaaatcacccaagcctgtgcatttccctaactgcacttctcaacattag

SEQ ID NO: 3518 - DNA, 189 bp, Glycine max var. Williams 82
atggggtggctgcaatccctcctctctccactgaagaagttctggctccgcctgaattcaactcaaaagaagagaagagggatttacattctgtatgaagatgtcaagtcttgcccctatgaagacgtacacgtcctctggtcaatactagtggaatcacattcaccttctttgccatccaaaaaatga

SEQ ID NO: 3519 - DNA, 1029 bp, Glycine max var. Williams 82
atggggttagaagggaaggaaacgccgtcgtttatgagggattttctcgataagtgtggtggctgcgccgttattgacggtggttttgccactgaacttgaaaggcatggggcggacctcaatgacgaactctggagtgccaaatgccttattagctccccacatcttgtccgaagggttcacctagattacctcgatgcaggagcaaacataatattaacagcatcttatcaggccactattcaaggttttgaggccaaagggttctctagagaagaaggtgaaactatgcttagaagaagtgtggagattgcacgtgaggcacgagaaatttattatgataggtgcaccaaagattcttctgactttatgagagatgaaagatataggaaacgtcccattttaattgcagcttctgtgggaagctatggagcgtatttggctgatggctctgaatatgttggggactatggtgatgcagttactgtccagacactgaaagattttcacagggaaagagtaaagattcttgttgaggctggtgctgacttaatagcctttgaaacaattccaaataagctggaggcacaggcttatgctgaacttctcgaggaagaaggcatagaaactcctgcgtggttttcttttagttgtaaggatgaaagcaatgtggttagtggtgactctatctttgaatgcgcttcaatagctgattcatgcagacaagttgttgcggttggagttaattgtactgctcctagatttattcatggattgatttcatttatcaagaagcaggcaacaagtaaaccagtacttgtatatcccaacagtggggagacttatatcgctgagagcaaccaatgggtgaaatcaagtggggcagcagagcatgattttgtctcctacataggcaagtggcgtgatgctggggcttccctttttggtggctgctgcaggactactcctaatactataagaggcatagcagaggcaacatatgggaaacttaaagacaaatgtatataa

SEQ ID NO: 3520 - DNA, 438 bp, Glycine max var. Williams 82
atgaagcttcaggacgcagggatatatacttgcaatggcttgatgatgcacacgaagaagaatttgactggaatcaaaggtctatctgaggttaaggtcgataagatctgcgaggctgcagagaagattgtgaatttcggttatattaccggaagtgacgcactgctcaaagtacgttgtttattgttcatatctgatccaggaggtggcgtgttcgtaactgatccaaagaaaccagcaggagggcatgtgctagtccatgcagccacggtaaggttgatgttcaggaaagggaaaggggaacagcgcatttgcagagtgtttgacgcccccaacctgccagaggctgaagcaatatccttttacctgattaactcaatgttagtgagttacgtgttccagataacagcaggggggattgcagacgctaaggactaa

SEQ ID NO: 3521 - DNA, 1401 bp, Glycine max var. Williams 82
atggcgtccatggccactttcttcacccaaacctccttcccctcccactctctctccaaaaccttcgatacccatttcgccccatccccgaaagtcaacgtatttgcgaacttcccggcgaggaggcacgtgggggttcgagtttcgaacgcgctgatcgaaccagacggagggaagctggtggagcttgtggtgagggataattcagaaagagacttgaagaagggtgaggctctttcgttgccgaggatcaagctttcaaggattgacctggagtgggtccatgtcctcagcgaaggatgggccacacccctcagaggcttcatgagagaagccgagttcctccaaacgcttcatttcaactctctccgactcgatgatgggtcggtcgtgaacatgtcagtgcccatcgtgctggctattgatgatgcccagaagcataagatcggggataacaaaagggttgctcttttcgattccaagggagaccctgttgcaattctcaatgatgttgagatttataagcatcctaaagaagaaagaatagcccgaacttggggaaccactgcccctggcctaccctatgttgaacaaactataaccaatgctggaaattggttgattgggggtgacctagaggtcattgaaccaatccagtacaatgatggacttgatcattttcggctgtctccagcagaactccgtgcagagttcacaaggcgcaatgcagatgctgtgtttgccttccagctccggaatcctgttcacaatggccacgctttgctaatgactgacacccgtaggcggcttcttgagatgggttataagaatcctgtcctcttgcttcatccactgggaggctacaccaaagctgatgatgtcccacttgattggcgaatgaaacaacatgagaaggtacttgaggatggtgttcttgatccagagaccactgtggtatccatattcccttctcccatgcactatgctggacccacggaggtgcagtggcatgcaaaggctaggatcaatgcaggggctaacttctacatcgttggtcgtgaccccgcaggcatgagccatccagttgagaaaagagatctgtatgatgctgaccatgggaagaaagtattgagcatggcaccgggactagagcgtctaaacattcttcctttcagggttgctgcatatgacaagactcagggtaaaatggcattctttgacccttcaaggcctcaggacttcctgttcatatcaggcacaaagatgcgcacactggcaaggaacaaagaaagccctcctgatggatttatgtgccctggtggttggaaggtactggttgaatactatgatagcttagtactctcaagcaatggcaaagtgccggaagctgttccagcttaa

SEQ ID NO: 3522 - DNA, 2346 bp, Glycine max var. Williams 82
atgtttacgagtccaatcactccaatggaaaagatggctctcattctagcgagctatctcgtcttgagtacactcttttctgcaaatgctgagtttgtcaagaagacttacatcattcaaatggataagtcagcaaagcctgacaccttcaccaatcaccttaattggtattcatcaaaagtgaaatcaattttgtcaaattcagtagaagctgagatggaccaggaagagagaatcatttatacttaccaaactgcttttcatggactggctgccatgttgagccaagaagaagctgagaagctagaggcagaagaaggtgttgtggccatattccctgatacaaagtaccaactacacaccacaagaagtccaactttccttggacttgaaccaacacaaagcaccaacaacatgtggtcattaaagctagccaaccatgatgtcatagtgggagtgctagacactggggtttggcctgagagtgagagcttcaatgacacaggcatgagaccagtaccttctcactggaaaggcgcctgtgagactggtagaggcttcagaaaacatcactgcaacaagaagattgtgggggcaagaatgttctaccatggatatgaagcagcaacgggtaaaattgatgagcaagcagaatacaaatcaccaagagaccaagatggtcatggcactcacactgcagctacagttgctggctctccagtgcatggtgctaattttctaggctatgcttatggcacagcaagaggaatggcaccaggagcaagaattgcagcatacaaagtatgttggactggtggatgcttcagctcagatattctgtcagctgttgatagagctgtggctgatggagttgatgttctatccatctctttgggtggtggagtctcctcttactaccgtgatagtttatctgtagctgcatttggagcaatggagaaaggtgtttttgtttcatgttctgctggaaatgcaggacctgaccctgtgagcctcacaaatgtgtcaccttggatcaccacagttggagccagcacaatggatagagattttcctgcagatgttaggcttggaaatggaagaaagataaccggaacctcactctacaaaggaagaagcatgctctcagttaagaaacaataccctttagtatacatgggaaatactaattcaagcatccctgatccaaaatctttgtgcttggaaggtactttggatcgtagaatggtttcaggcaagattgttatttgtgacagaggcattagtccaagagtgcagaagggtcaagtggtgaaaaatgcaggaggggcgggaatgattctcacaaacactgcagccaatggagaggagctggttgctgattgtcacctccttccagcagttgcaattggagaaaaggaaggaaaagagctcaaacgttatgtgttaacaagtaaaaaagccactgcaactctaggttttcaggctacaaggttgggggttagaccatctcctgtagtggcagcattttcatcaagagggccaaattttctcacccttgaaattctgaagcctgatgtggtggctcctggggtgaacattcttgctgcttggagtgaggccattggtccatcaagtttgccaacagatcacagaagggtgaagttcaacatactctcaggaacttcaatgtcatgccctcatgtgagtggcattgctgctttgctcaaggctaggcatccagattggagtcccgctgccataaaatctgctttgatgaccacagcttatgttcatgacaataccatcaagcctctcagagatgcctcaaatgctgaagcctcaactccttatgatcatggtgccggacacatcaaccctagaagagctcttgacccaggtttggtctatgatattcagccacaggactactttgaattcctgtgcacacagaagcttactacatctgagcttggagtttttgccaagtattcaaacagaacttgcaagcactctctttcaagtccaggggacttgaactatccagccatatctgtagtttttccactgaaaaattccacttcagttttgactgttcacagaactgccaccaatgttggtcttccagtttccaagtaccatgttgtggtttcaccttttaaaggtgcttctgttaaagttgagccagacaccttgagttttacaagaaaataccagaaactatcttacaaaattaccttaacaacacaatctcgccaaacagaacctgaatttggaggtctggtgtggaaggatggtgtgcacaaggtaagaagtccaattgttataacgtatctgccaccaatatga

SEQ ID NO: 3523 - DNA, 363 bp, Glycine max var. Williams 82
atgtatatatatatatatagagtcgaggcttgtttattcaactccatttgtgataacatgaacatgggttcctctgctgcagattcagcgtcgtggtactgtgccatggtgttgttggccacgatactgttggggtcaataagggaaagcaccgtagcagaagaaggtgagcctataaaagggaacaacctccttcaacgaccgtgtgatgaaatatacgttgtgggagaaggggagaccctgcacacaatcagtgacaagtgcaatgacccgtttatcgtggagcggaacccgcatatccatgaccccgatgatgttttccctggccttgtcatcaaaatcacccccatccaccaatactaa

SEQ ID NO: 3524 - DNA, 906 bp, Glycine max var. Williams 82
atggcctccttaagctgccagtttcattccaccagcttgttgaattctaagaatgtcaacagaaggaggaaacgtttcattttttgctcagcacagcctacacaaaacaatattaaggttgtgattaatggagcaaccaaggaaataggaagggcagcagtagtggcagtgactaaggccagaggaatggaggttgcaggagcggtggatacttgtcatgttggggaagatattggaaagatatgtggcatggaagagccccttgaaatacccataataaatgaccttactatgattttgggctctatatctcagtccaaggcagcaggagttgtagttgatttcactgacccttcctctgtatatgacaacgtaaaacaggcaacagcatttggcatgaaaagcgtagtttacgtgcctcaaatcaaattagacacggtagctgcattatctgcattctgcgacaaggccagcatgggcgtcttggttgcaccaaccctttccataggatcaatattattgcaacaagctgcgatttcagcttcttttcattacagcaacgtcgaaatcgtggaatctagggctaatgcaaatgatcttccatcagcagatgcaaaccaaattgccaacaatctctccaacctgggccaaatctataacagagaagacccttcaacagatgtcttggcaaggggtcaagtcctaggagatggaattcgtgtacacagcatggtccttccaggcattccttctagtacaacagttcacttctctggtccaggagaggtatactctatcaagcatgatatcacagatgtgaagtgtctcatgcctggcttgctattagccattagaaaagtagtgcgcctcaagaatttggtatatggcttggagaagtttatatga

SEQ ID NO: 3525 - DNA, 2592 bp, Glycine max var. Williams 82
atggcaaatgctgattcctcccttatttgttatttttgggtgattcttgctctgggtctgtgttgttttagtggctgcatttcgggccagattggtttgggctcgaggttattggctagagaggcccaaacatgggtttctgaaaatggcacatttgctttggggttcactccagcagagactgataatcgattatttgtgattggaatttggtttgcacggcttccaggagatcgaactttagtttggtcacccaatagagacaatccggtatcccaagaagcagcattggagcttgacaccactggcaaccttgttctcatggatggacacatgacaatgtggacctcaaacacctcaggtgctgatgttcaaacagcaatcatggcagaaactggcaacttcatcctccacaactccaacaaccactctgtgtggcagagtttttctcaaccttctgacactctcctcccaaaccagcttctaacagtgtcttctgaactaacatcatcaaagtcttcctctcagggtggttactattctctcaaaatgcttcagcagcctacttccctgagccttgctctcacttacaatctccctgagacttaccaagcctctgatgaatcatacaccaactattcctattggcaaggccctgatatctccaatgtgaccggggaagttatagcggttttagaccaagccgggagctttggaattgtgtatggagactcatctgatggagctgtttatgtgtacaagaatgatggtgatgatgcaggcttgtcttctgcagttcaccaatctgcaccgttgactgttctcaggagactaacactggaaaagaacggaaatctgcggttgtatcgatgggatgaggtgaatggttcgaggcagtgggtgccacagtgggctgcagtttcaaatccatgtgacattgctggagtttgtggcaatggagtttgtaatttggatagaagtaagacaaaagccacttgcacttgcttgccaggaacttctaaagttggcagggatggccagtgctatgagaattcatctcttgttggaaattgcaatggcaagcatgaaaacctgacatcacagtttaggatttcagcggtgcagcaaaccaactactatttttctgaattttcagtaataactaactatagtgatatttctaatgtgtcaaaatgtggggatgcttgcttgtcagattgtgattgtgtggcttctgtttatgggctaaatgaggagaggccattttgttgggtgttgaggagcttaagttttggtggttttgaggatactagctcaactttgtttgtgaaggtcagagcaaatgggtcatggacttcggaaggccaagcaggagggtctaatagctcctctgatggaatgggaagtgcaaaggagaaggctgtgattattcctactgttctgagcatggtagttctcattgttttgctgagtttattactgtatttcagtgttcacagaaaaagaactttgaaaagggagatggaaagttccttgatcttatcaggtgctccaatgagtttcacataccgcaatttgcaaattaggacatgcaacttctcacaactgctaggaacaggtggatttgggagtgtatataaaggaagcctgggagatggtactctagtggcagtgaagaaacttgacagggttttgcctcatggagagaaggaatttatcactgaagtaaacactattggatcaatgcatcatatgaatttggttcgcctatgtggctattgttcagagggatcacataggcttctcgtttatgagttcatgaaaaatggatccttggataaatggatcttcccttcatatcaaggtcgagatagattgttagattggacaactcgtttcaatatagccatagctactgcacaagggattgcatactttcatgagcagtgtagggatcggataatacattgtgacatcaaaccggaaaatatattggtagacgaaaacttttgtcccaaagtatctgattttgggctggccaaattgatgggaagggagcactctcatgtggtaacaatggtcagaggcactagaggttatttggcaccagaatgggttagtaatcgccctataactgtaaaagctgatgtttacagctatggaatgcttcttttagagatcattggtggcaggagaaatcttgacatgtcctttggtgctgaggactttttctatcctggttgggcttacaaggagatgacaaatgggtcaataattaaggtggcagatagaagattaaatggggcagttgatgaagaagagctaacgagagctctgaaagttgcattttggtgcatccaagatgaggtttccatgcgaccaacaatgggagaagtggtaagactgctggaagattcgatcgacattaatatgccaccaatgccccaaacagttgtagaattaattgaagaaggcttagaccatgtatacaaagctatgaaaagagagtataatcagtccagctcattcactcttaccagccatcttacatctcaagccacatgtagcaattccacaatgtcaccaagatag

SEQ ID NO: 3526 - DNA, 900 bp, Glycine max var. Williams 82
atggcagccctcaaacaagtttcatccctcttgctattccctttgtttctcattttttccctattcaaatcctctcatgctggtgggattgcagtctattggggtcaaaacggcaatgaaggctccttggaagaagcttgcaacactgacaactaccaatatgtgaacataggtttcttgaacgtttttggcaacaaccaaatcccacaactaaaccttgcaggccattgtaatccaagcaccaacgagtgcaccggattaagcaatgacatcaatgtatgccaaagcaaaggaatcaaagtgtttctctcccttggaggcgccgttggaagctactctctcaactcggcttctgaagccacagaccttgcagcgtacctatgggataacttccttggaggacaatcaaattcacgtccatttggtgatgctgtgttggatggcatagactttgacatcgaagatggttcaggccaatactatggtgaccttgcaagagaacttgatgcttatagccaacaaagaaaagtgtacttggctgctgcaccacaatgtccataccctgatgctcacttggattcggctattgcaactggcctttttgattatgtgtgggttcagttctacaacaatcctcaatgccattatacttcagggaacattgataacctagttagtgcatggaaccagtggacctcaagtgaagctaaacaagtgtttttggggctacctgcatctgaggcagctgctccaagtggtggttatattcctcctgatgtgctaatttctgatgttcttcctgctatcagcggctctcccaagtacggtggagtcatgatttgggacagattcaatgacggccaaagcggatacagtgatgctattaaggccagtgtttaa

SEQ ID NO: 3527 - DNA, 660 bp, Glycine max var. Williams 82
atggcatcagatcactcgtccgtcaaccaacccaaatttgtctatccaaacaatgaacttgagcaacaagaagccctagaggtcgaaaccaaggactttgactactcaaagagatctcaatggctacgtgctgctgttttaggtgccaatgacgggttggtctcaacagcatcactaatgatgggtgtgggagcagtgaagcaagacatcaaagtcatgatcctaacaggttttgcagggctagttgctggggcatgcagcatggccattggggagtttgtgtcggtttactcgcagctggacatagaagttgctcaaatgaaaagagagaaagaaagggacaacatagatcaagaggaagatggttatgagaaagagaaattgccaaaccctatacatgctgcagcagcatcagctcttgcattttcagttggtgcattggtgcctctccttgcagcctcttttataagggactataaggtgaggcttggtgtgattttgggagcagtgagtttagctcttgtggtgtttggttggttgggggcagtgttgggtaaggctccaacatttaggtcttgtgtgagagtcttgcttggggggtggctagccatggctattacttttgggctaaccaagttgattgggtcaagtggtctttag

SEQ ID NO: 3528 - DNA, 1020 bp, Glycine max var. Williams 82
atggatcacagtgcggatgctcaacgcacggacctgatgaccatcacccgtttcgtgctgaacgaacagtcgaagcacccagagtctcgtggcgatttctcaatcctgctcagtcacattgttctcggctgcaagttcgtctgctctgctgttaacaaggcgggtcttgctaagcttattggacttgcaggagagacaaatgttcagggtgaagagcaaaagaaattggatgtcctatccaatgatgtcttcatcaaggcattgatcagcagtggacgaacatgcatcttggtgtctgaagaagatgaggaagcaacatttgtggaaccttctaagcgtggaaaatactgtgttgtttttgacccgctggatggttcctctaacattgattgtggtgtttcaattggcacaatctttgggatttatttgataaaagaagaccatgaaccaaccgtagaagatgttttgcaacctgggaagaacatgttggcagctggttattgcatgtatggaagctcttgcacgcttgtgttaagcactggaagtggtgttaatggtttcacccttgatccatctcttggggagttcattctaactcaccctgacatcaagatcccaaagaaaggcaagatctattcagtgaatgaaggaaatgctaaaaactgggatggccctactaccatgtatgtggaaaactgcaagtatccaaaagatggttcatcaccaaagtccctaagatatattggaagcatggttgctgatgttcaccgcacattgctttatggaggtatctttctgtacccggctgataaaaagagtccaaatgggaaacttcgtgtactctatgaagtcttcccaatgtcattcttgatggaacaagcaggaggacaggctttcaccggcaaccaaagggcacttgatttggttccaaagaagttgcacgagcgatctcccatattccttggtagctatgaagatgtagaggaaatcaaggctctttactctgctgatgaaaaatag

SEQ ID NO: 3529 - DNA, 789 bp, Glycine max var. Williams 82
atgaataagtgctttacttgtcacagttttgttcttggagccacaaaactatactcggatactctaaaaattgctcgccgtcatgtctactcaaataaaaacaaaaaattgaaacctttggcaaggttccattgttttcaggaaaaattaaggatcatggaggttgagttggggctaaagatcacaagaaccagatatgatagcacttccgtttctgattttcagtttgccaaagacagatcaggacctgtcttcttgtctaaagaaaccgatgcaaagctcatcctcactgcacatcttaaaggatataagaaggaggatattggcatcaatatcaataaagatggtagtgagatttcggtgagtggggagaaggaggtgcaggaaatgcaaatgataccgttcaagaaagagctgaaaaccatagggtttgagaagaagtttggtattcctgatggggtggttttggattggatcaaagctaagtataacgaaggggatgaagttttgacaattgtgatgccaaaaacagaagtggggaaaggaaatagagaaattgaggaggtgaatgaagaagtagcagagccaagtgtactagaaaatgttgttgatagtgtgacaccagagccagaggaaagtgtgccagataagagtgaagaggaaacacctccagtgaagaagccagaaaaaccatggacaccttgtcctcctttggtttttggaggatcaactttgcttgtaactctaatatttcttgtaataaactatattagagccagaaagagttaa

SEQ ID NO: 3530 - DNA, 840 bp, Glycine max var. Williams 82
atgatgtcacgttttatgcatgcgccttctcccgttctgtcttcttcgcatcctcatttgggagttggccacaagagagagcgtgaagatgacactggcgctggtgcgagtggaggtgttgctattgcagcagcttcttcacaaacgcaaacacaagagattgaaagtgctggcggcgacaggaggaggagatacaggggagtgaggcagaggccgtgggggaaatgggcggcagagattcgcgatcctcacaaagcggcgagagtgtggcttgggacattcgacactgccgaggctgcggccagagcctacgatgaagccgcattgaggttcagaggtaacagagcaaaacttaatttccccgaaaacgttgtaccggttccacctcctcctccggttcccgatttaccggcaagtgcggtagccggttccgattccatttccggttccggttcagtggtggcaggtttttcgccgacgctgatgcagggagcgccgtttcagggctcctctgcttttctgagagattattgggggtattctcagctgctgaggagtacaggggacttccatggactcgaccagtggttctttgattctcaaatggcagcgtttcaatcttcttcatcgtcgttgttgccatcgccgccgccgccgtcgttttcgccttcctctgcttcgtatcctctgttttcttccagccagcaaatggggattttccggccgccgggagagcagggtcatggcggagaagacggtggtagtgggtcagagttttcggagcttccaccttcgacgtggtcagataccagtggctatcctcctccaccacctggttga

SEQ ID NO: 3531 - DNA, 2131 bp, Glycine max var. Williams 82
gcttaagccttgtctgatatttaagcaaatcattagtgagttgtgacttaatcctgaatttagttttcaaccagaccgtccttcgtcagttaactatgggctaatcacaattcaggaagcccaaaactattaaagaaaccgacaacacaaaggatttgcagaaagtgcagctacttagttccattttcatcctctctccattaactttcagtcaaaacaaaacaaaacctctttaggtgtgaaattccacgtgccaaaatcatctccgaggcaccaacatcggcagccacatatttctttatttattggtacaatattgtttttttcttcttcttcttcttcatttttcattaacatatatttctttttcgaagaatcaaaggtagaatctacaatattaaaaaaaaaactgtataagaaattaaaggtagtggtagtggagtgtgtgtgtgtgtgttaattatgtgtatgcatggtggaagctagagtaatagaggcgcaacatggtcactgtttctgtgggggctatagccagcttctcatcataaggaatcagtatataaaacacctgctttctaacggtggcgcaccagaggggtttaggttcaggttcggggaagttcttcgcggcggagcaaggcggcgatgaggaagcggaagagagtactgaggtaggttctgttccgagccatgtggtgtcagcctctgcagcttcggcccaaaccaatcagtgggtgccgcggggaagtggttttcccatgatgtcacgttttatgcatgcgccttctcccgttctgtcttcttcgcatcctcatttgggagttggccacaagagagagcgtgaagatgacactggcgctggtgcgagtggaggtgttgctattgcagcagcttcttcacaaacgcaaacacaagagattgaaagtgctggcggcgacaggaggaggagatacaggggagtgaggcagaggccgtgggggaaatgggcggcagagattcgcgatcctcacaaagcggcgagagtgtggcttgggacattcgacactgccgaggctgcggccagagcctacgatgaagccgcattgaggttcagaggtaacagagcaaaacttaatttccccgaaaacgttgtaccggttccacctcctcctccggttcccgatttaccggcaagtgcggtagccggttccgattccatttccggttccggttcagtggtggcaggtttttcgccgacgctgatgcagggagcgccgtttcagggctcctctgcttttctgagagattattgggggtattctcagctgctgaggagtacaggggacttccatggactcgaccagtggttctttgattctcaaatggcagcgtttcaatcttcttcatcgtcgttgttgccatcgccgccgccgccgtcgttttcgccttcctctgcttcgtatcctctgttttcttccagccagcaaatggggattttccggccgccgggagagcagggtcatggcggagaagacggtggtagtgggtcagagttttcggagcttccaccttcgacgtggtcagataccagtggctatcctcctccaccacctggttgacatggaatacacatttttttctttattctattttttctctttctttggttaaagaaagaacaaggctttcttctgtttatttattttaatttatctgtttttgcttttttagattatttggagtccagttcactgaatttttatgtggttttgggttaaactgttactatttgctgctgttatttgaataaatactatttgaagagtagggagtagggaatgggaggttggaggatgcatgataaaggctttaagcctttgaggtagatacgaatggagtttaagtggtacgacaaagcagtacttaggttggaagctgagtttattccagattatcaactcaatggatttgatgttaacattttgtcaacaatccacgcaaaggtgaagaaaccaatatcttttataaaacctgttcccaataaaccaacttttttattatggaatgaggattgagggatgtatttagaagatataatactaatttagtgtgatatgcataattttggtttttaagctggtgttaattgttt

SEQ ID NO: 3532 - DNA, 1083 bp, Glycine max var. Williams 82
atggcggaaaccctgatccaaatcggcgtggttgggtgcgccgacatagcccggaaggtctcccgcgccatcacgctcgcccccaacgccgccctctgcgccgtggcgagccgctctcacgacaaggcagccgcattcgccgccgccaacggcttccctctctcagccaaagtgtacggctcctacgagtcccttctggaggaccccgacgtggacgccgtctacatgccactccccaccagcctccatcttcactgggccgtgctcgcggcccagaacaagaaacacttgcttctggaaaagcccgtcgcgctcgacgtggcccagttcgaccgcattctcgaggcctgtgaatccagtggggtgcagttcatggataacaccatgtgggtccataacccaaggactgctgccatggcccacttcctcaacgatgctcaacgttttggtaacctcaaatcggttcgcacctgctttacatttgcagccgatcctgattatctaaacaccaacattcgcgtgaagtcggatcttgatgctcttggttctctgggtgatgcaggatggtattgtattagggcaatcctgttggctgccaactacgaattgcctaaaacagtagttgcttcatatgaacctgtacttaacaaagatggggtgatattggactgtggggcatctctatactgggaagatgggaaagtagcaaccttccattgctccttcttggcaaacttgacaatggacataacagctattggcacaagaggaactcttcacgtgcatgattttgttatcccttatcatgagaaggaggcatcgtttttggctggtacagaaaccggctttaatgatcttgtcacagggtgggataaacagccaagtaagcatacagtaaccactgatctccctcaggaggctcttttgattagagaatttgcccggttggtcgcagaaatcaaattcaaaaactctaagcctgacaagaagtggccaacaattactaggaaaacacagctggtattggatgctgtgaaggcttctatccagaggggttttgagcctgttcagattcaggagtaa

SEQ ID NO: 3533 - DNA, 294 bp, Glycine max var. Williams 82
atggccatcactagaagcacagtggtcttggctattctctgcttcatccttatacgagctgagttggggatctatggtgaagatttgcacatggatgctgccaagaacatagactgcggtgggaagtgcaattacaggtgcagcaagactagcagacacaaaatgtgcataagggcatgcaatagttgctgcaagacgtgcagctgcgtgccaccaggcacttctgggaaccgagatatgtgcccttgctatgctagcctcaccacacatggaggaaagctcaagtgcccatga

SEQ ID NO: 3534 - DNA, 1083 bp, Glycine max var. Williams 82
atgggggaatccaatgtcatgaccaagactgaggatggtgcttgtctgtctgcaatgctgcttagtactaatctagtgtaccctgcagtactgaatgctgctattgagctcaacttgtttgagatcattgctaaggcaacaccagctggttcttttatgtcatcccatgaaattgcttctaagctcccaacacaacaccctgacctgcctaataggcttgaccgcatgctgcgtttgcttgctagttattctgttcttactacttccactcgcaccacacaccatggtgccactgaaacagtttatggactctcacaagttggacaatactttgtccctgacggaactaggggctacttggcttcattcacagcatttgtctgttatccaccactcttacaagtttggctgaacttcaaggaagccatggttgatgcagacattgacttgttcaagaaaattcatggggtaacaatgtaccagtacatggaaaacgatccaaaaatgaaccaaatctttaacaagtcaatggccaacttgtgtgcaacagagatgagtagaatacttgaaatatacactggatttgagggaatatcaacattggttgacgtaggaggtggcaatggacaaaatctaaaaatgataatctccaaataccctttaattaaaggaattaactttgatcttccccaagtgattgaaaatgcaccaccccttccagggattgagcatgttggaggcgatatgtttgcaagagttccacagggtgacgccataatactgaaggctgtatgccacaattggtcagacgaaaaatgcatagaatttctgaggaattgtcacaaagcattgtctccaaatgggaaggtgattgtggtggagttcatattgccagaagaacccgaaccaactgaagaatcccagcttgtttccactcttgacaacctcatgtttatcactgttggtggaagggaaagaactcagaaacaatatgagactttgtgtaagctctctggattttcaaattttcaagttgcttgtcgtgccttctctagtctgggagtgatggaattttacaaatag

SEQ ID NO: 3535 - DNA, 1887 bp, Glycine max var. Williams 82
atgacgcgcctcagaaaactcggcgccgtcgccacggccacggccagcgcgtacggcagcgtcctcttcctgcactcgtctctcgtctccgccggcgacaacggaggcggctcccccctcgaggccctccggaagaaggtgcacgaccccggcgccgtcgtgccggccagggaggcgcagcagtcagcgctcaaggccgccggcaagtcgaatccgctcgacgttctcgtcatcggcggcggcgccaccggttccggcaccgccctcgacgccgtcacgcgaggactccgcgtcgggctcgtggagagggaggatttcgcctccggaacttcgtcgcgatccacgaagctccttcatggaggcgttcgatacctggagaaagctgtatttaaccttgactatggacaattcaagttagtgcttcatgcacttgaagagcggaaacaggttattgaaaatgcaccacacctatgtcatgcattgccatgcatgacaccgtgttttagctggtttgaagtagtgtactactggatgggcttgaaaatgtatgatttggtcgccggaagacaactgttgcacttatcaagatattattcgacaaaagagtctgttgagctctttcccactctggcaagggtggtaaatgatagaagcctaaggggaacagttgtttattatgatgggcagatgaatgatgcacggcttaatgttggattggcttgtactgctgctctagctggtgcagcagtgctgaaccatgcagaagttgtgtccttactgaaggacgatgacggaaaacggataattggtgcacgaattcgggacaatttaactggcaaagagtttgatacatatgcaaaggtaattgtgaatgcgggtgggccattttgtgactctataaggaaaatggccaacaaaaatgcacaggaaatgatttctcccagcagtggggtgcatattatactccctgattattattctcctgaaggaatgggcctaattgtccctaaaactaaggatggacgtgttgttttcatgctgccatggctgggaagaacagttgctgggactacagattctagcactagcattacttatcttccagaaccacatgaagatgaaatacaatttatattggatgccatctctgattaccttaatgttaaagtacgccgtgttgatgttctttctgcttggagtggcattcggccattagcattggacccaacagccaaaaatactgagagtatctcaagggatcatgttgtttgggaggattaccctggtttggtcaccatcactggtggcaagtggactacctatcgaagcatggcagaagatgctgttaatgcagctataaagtctggaaagctgacccccaccagtatatgtgtgaccaacaatctccggcttgttggtggtgaagggtgggagccttcttcttttacagttcttgctcaacagtataagcgcatgaaaagtacatataggggtaaagttgttcccggggtaatggattctgctgttgcaaagcacttgtctcaggcatatggaacattagccgagcgtgtggctaccattgctcagaatgaaaatttgggtaaacgacttgcccacggttacccttatctggaggcagaagtggcgtactgtgctcgtaatgaatattgtgaatctgctattgatttcattgctaggagaactcgtcttgctttccttgaaactaacgcagcacgaaaggcattgcctcgtgtgattgaaatattggcaaatgagcacaagtgggacaattcaaagcagaaggaagagttggagaaggctacagagtttttgaagacttttaaatcctccaaaaatgctcagttccatgatgggaaacacagttag

SEQ ID NO: 3536 - DNA, 507 bp, Glycine max var. Williams 82
atgccactttctaacattccttcttcacatatgattgccagaagcagaagccttatcatcatccatctccatcccccttataagtaccactctcttccaccacctccaaagaagccctacaagtacccatccccaccaccacctaagaaaccatacaagtacacatcaccaccatcaccaccaccagtgcagaatctatcactcaccaccacccccaaaaaagaaaacatacaagctaagtacccatctccaccaccaccagtgcacaagcaccctcccccacacccaatctatcactcaccaccactacctaaaaagaaaccctacaagtacccatctacaccaccaccacataagaaaccatacaaatacgcatctcctccacctccagtgcacaaaaagtacccttccccttcccctcaccagtctaccacaagtctcctcctcctccaccacttgcaccactgctataattataaatcatctcctccaccttaccactactag

SEQ ID NO: 3537 - DNA, 183 bp, Glycine max var. Williams 82
atggcatcactcaaagctgagaaacctgttgaaaaatcttgttgctctcaaccatctgcaggacaggtgaagaaagagtcttctgccaaacctagttcaggcacttccaaagccccggtctcgaaaccaaccccaaagaaaattccaagccagactaggaagaaggcaagcagcaataaataa

SEQ ID NO: 3538 - DNA, 981 bp, Glycine max var. Williams 82
atggctttcccaattctcttccttctcttcatttcccttcccttctcctccgcaaagctcaacgtcgattactacaaaaacacatgcccagacttcgaaaaaatcgttagggaaaacgtcttcaccaaacaaagcgctagcgtggccacagcaccgggtctccttcgcctcttcttccacgattgcatcaccgatggctgcgacgcttccctcctcataacttccaatgcatacaaccctcatgcagaacgtgatgcggacctcaacctttctctctccggtgatgccttcgacatcatagttaaaatcaaaaacgcattagaacttgcatgccctggtgttgtgtcgtgttccgacatcgtggcacaggccacaagagaccttgttaagatggtcggtggtcctttttaccccgtgaggctggggagaaaggatagcactgaatcagatgctgcgagagtgagtgcaagccttccaacaccaagcatgaccatggaccagatcattgagaagtttacctcaaagggtttcactgttaaggagatggtggctttgactggggcacacaccattgggttcacacactgcaaggagttcatccacaggatctacaacttcagcaagacctctgatgctgaccctatgatgcaccctaagctggtccaagggttgaggtccgtgtgccagaactacaccaaggactcctcaatggctgcattcaatgatgttaggtcaccagggaagtttgacaatgcctactaccagaatgtcatcaagggtttggggttgttgacctctgattccattcttgctgttgaccctaggacaaagcctcttgtggagctctatgcaaatgaccagcaagctttcttcaaggactttgctgatgccatggagaaactttctgtgtttagagtcaaaactggcgacaaaggagaggtgaggaacaggtgtgaccaattcaacagtattcctgcctaa

SEQ ID NO: 3539 - DNA, 1929 bp, Glycine max var. Williams 82
atgtctcaaatcttggcaccgttccagttactggaactgaacgtgatttccgcccaggacctggctcctctgggtcgcaacatgcgtacctacgctgtctcctgggttcacccggaccggaagctctccacacgcgtcgactctgagggccacaccaacccaacttggaatgacaagttcgtcttccgcgtcgacgaagagtttctctactccgacacctccgccatcatgatcgagatctacgcgcttcattggttcaaggacatccacgtcggcaccgtccgcgtcctcgtcggaaacctcgcccctcctccctccaaacccttccacaacaaccgcactccgctcggcatgcgcttcatcgccctccaggttcgccgcccctccggcaggccacaggggattctaaacattggcttcaccgtcctcgacagctccatgcgcagcatgccgctctacactcacaacgcctcggccgtcggctaccgccacctcatgggtgagaaggacgcttacgacagccacaaccacctcagcccccgcatccgccccactgccgtcgcaactcccatgcctgagcttcgccggaccaagagcgacaccagctccatgctcggcgccgctgaagccgtggcgcgccaccaccgagccatggctgtacgagccgactccaccatttcgggatccgaggttagcgttaaaaagaagaaggggaagaagaagaaaacgaaagccaagaagagtagctcggttgtgagtagcgtcaacgaaacgaactcggtcctcagcgacaccgttttgccgtggaaggttaaaagcggaaaggcaagtcccgatgatattgtccacgtccacaacaacgtcgttgaggaggttcataatgataatgacgatgataacgagaacgcacattcaaccgttaactccgtttctgaaattgccaccagcgaaaccgacgctgatgaaggacaacaacatgttcatgttaatcacgttcaatacgaagttcgagcctcccccaaaccgcagtttcgaaactctccggcaccacaatttaagaactctccggcaccacaatttaagaactctccggcaccgcaatttaaaaattctccggcaccgcactttaagaattctccggcaccacaatataagaattctcctgcaccacggtatatgaactctccgaagccgcagtttaagaattctccggcgccgcaatttaagaattcgcctgcaccgcagtttaagaactctcctacgccacagtacaagagttctccggtgctgcagtatatgaactcgccgaagccgcagtttaagaattctccgatgccgcagtatatgccaactccaaagccgcagtttcggaactcgccggcagtgtcgaagttcaacccggcggtggggttcaacgggtcgcagagggggacgccaatgcatccattcgggaaagtgaacggtgcagggtttgagtacatgacaccgcggaggtcaaacttggccaacatggggcatgtggtgataacggagtcggagctggggccgtcgccatcggaggtggcggcggcgatcgcgaggaagccggtgatcgacgagggggagaattcaacggtgggaggatggagcttggacgcggagagcgtggaggggctgcagtcgaagctggagaggtggcggacggacttgccgccggtggtcgatcgcggcgaggtctcgagctacccaacgacgagcaccaccaagacgagccggcactcgcggaggcacaccgacggcgggagtactgggagtggcttgttctcatgctttagtaacatatgtggtgttgagtgctacgttggttgcggcggtgaccctaaaggaaagaagaaccgcatccgcagtcgccgcactccctcagcggatgacagttccagtcttctctaa

SEQ ID NO: 3540 - DNA, 201 bp, Glycine max var. Williams 82
atgcacaacatacccaaagcaaagcatgggagtgaatcaggagtttatgacacagaaggacgttatgtgccagcaaatattgagaacgtgttcagtaagtatgctcgtacagttcctgacaagctcacacatggggaggtctgggacatgacagagggaaaccgaaatgcgtttgacatatttggctggcgaattttctga

SEQ ID NO: 3541 - DNA, 213 bp, Glycine max var. Williams 82
atggcgtccgagtgcaaaggtaagagctcatggcctgagttggttggagtggaaggaacggtggcggtggctacaattgagagggagaatcctttggtggatgctaacactgtgcttaaaggatccatcgtcaccgctgattttcgatgtgatagggttcgggtttgggtcaccaaacatggaattgtttatcaggctccaagaattggataa

SEQ ID NO: 3542 - DNA, 210 bp, Glycine max var. Williams 82
atgtcccagtgcaaaggtaagaggtcatggcctgagctggttggagtgaaaggaacggtggcagaggctacaattgagagagagaattctttggtgaatgctatcgttgtgcctcaaggatcaggcgtcaccgctgatttccgctgtgatagggtttgggtttgggtcaatgaaaatggatttgttttccaggttccaacaattggataa

SEQ ID NO: 3543 - DNA, 711 bp, Glycine max var. Williams 82
tttaattattttttagtttgaagattttttttcttaaaacttaaagatgtgacatttttttaatgttataactaacacaattcaatccaattggatgacaaaataaaaaaaaaatcaaatctaattcaacctaatctaattaaattaaattaaattaaattaaagaatagataaaattcaccaaactcgggagtgcctgcacacctaagactaagtaaaaaatgcagcgttgagcaacaggagattgccaccaaaacacagtataaataccccccacatatccaggcatccatatcagcagaagaaaaaaatgtcccagtgcaaaggtaagaggtcatggcctgagctggttggagtgaaaggaacggtggcagaggctacaattgagagagagaattctttggtgaatgctatcgttgtgcctcaaggatcaggcgtcaccgctgatttccgctgtgatagggtttgggtttgggtcaatgaaaatggatttgttttccaggttccaacaattggataacactcatgcacttcatgcatgtgtcttattttgattttaaataaggacctattcttccaattatgttgttatatatattttaagaaacttctttttcccatttttaattatcttgtgtttctcccaatattcttcacctcccgcaaatacgtatataaaccatgtttcatattctgtgtgtaaagaattaa

SEQ ID NO: 3544 - DNA, 1317 bp, Glycine max var. Williams 82
atggctgcctcagttaaactcttatttttgtcctttctctcgttgttcatctctttctccatagctcaaacctctttcagaccaaaggcacttgttcttcctgtaaccaaagatgtttctgcctcagttcctcagtatgtcacacaaatcaaacaaagaaccccacttgtggcagtgaaactaactgttgatcttggtggtggctacttgtgggtgaattgtgaaaagggctatgtctcatccacctctagaccagcccgttgtggctctgctcagtgctcgcttttcgggttatatggttgcagtactgaggacaaaatttgtggccgttctccaagcaacactgtgactggtgtctccacatatggtgacattcatgcagatgttgttgctgtcaattccactgatggaaacaatcctactaaggtggtttctgtgcctaaattcctcttcatatgtggatcaaatgttgtccaaaaaggccttgctagtggtgtcacaggtatggctggtcttggcagaactaaagtttctcttccttctcaatttgcctcagctttcagctttcatagaaaatttgccatttgcttgagttcttctactatgacaaatggtgtaatgttctttggtgatggcccttacaattttggttatttgaactcggatctctccaaggttctaactttcacccctctcatttcaaaccctgttagcactgctccaagttatttccaaggggagccctcagtggaatactttattggggtgaaatctattaaagtctcagacaaaaatgtagcattgaacacaaccctgttgtctatcgatagaaatggcattggagggactaagattagtactgttaatccatatactgtcatggagaccacaatttacaaagctgtgtctgaggtctttgtaaaagaggtgggagcccctacagttgcacctgtggctccatttgggacttgctttgcaaccaaagacattgggtctacaagaatgggtccagctgttcctggcatagatctagtgttgcagaatgatgtggtgtggaccatcattggtgccaattcaatggtgtatgttaatgatgtaatttgcttgggttttgtggatgctggatcaagcccaagcgtggcccaagttggatttgtggcgggtggttctcatccaaggacttcaatcacaattggagcacatcaattggagaacaacttgctacaatttgatttggcaacctcaaggcttggcttccgctctatctttttcgatcacagcaactgtgccaactttaactttacctcttctgcttag

SEQ ID NO: 3545 - DNA, 1689 bp, Glycine max var. Williams 82
attattcacatcattaacacgtttcctttttatctctatctttcttcacatcttaaccttgttcttaccagatggctgcctcagttaaactcttatttttgtcctttctctcgttgttcatctctttctccatagctcaaacctctttcagaccaaaggcacttgttcttcctgtaaccaaagatgtttctgcctcagttcctcagtatgtcacacaaatcaaacaaagaaccccacttgtggcagtgaaactaactgttgatcttggtggtggctacttgtgggtgaattgtgaaaagggctatgtctcatccacctctagaccagcccgttgtggctctgctcagtgctcgcttttcgggttatatggttgcagtactgaggacaaaatttgtggccgttctccaagcaacactgtgactggtgtctccacatatggtgacattcatgcagatgttgttgctgtcaattccactgatggaaacaatcctactaaggtggtttctgtgcctaaattcctcttcatatgtggatcaaatgttgtccaaaaaggccttgctagtggtgtcacaggtatggctggtcttggcagaactaaagtttctcttccttctcaatttgcctcagctttcagctttcatagaaaatttgccatttgcttgagttcttctactatgacaaatggtgtaatgttctttggtgatggcccttacaattttggttatttgaactcggatctctccaaggttctaactttcacccctctcatttcaaaccctgttagcactgctccaagttatttccaaggggagccctcagtggaatactttattggggtgaaatctattaaagtctcagacaaaaatgtagcattgaacacaaccctgttgtctatcgatagaaatggcattggagggactaagattagtactgttaatccatatactgtcatggagaccacaatttacaaagctgtgtctgaggtctttgtaaaagaggtgggagcccctacagttgcacctgtggctccatttgggacttgctttgcaaccaaagacattgggtctacaagaatgggtccagctgttcctggcatagatctagtgttgcagaatgatgtggtgtggaccatcattggtgccaattcaatggtgtatgttaatgatgtaatttgcttgggttttgtggatgctggatcaagcccaagcgtggcccaagttggatttgtggcgggtggttctcatccaaggacttcaatcacaattggagcacatcaattggagaacaacttgctacaatttgatttggcaacctcaaggcttggcttccgctctatctttttcgatcacagcaactgtgccaactttaactttacctcttctgcttagaatttgatattattctactatattcaaaacttgtatcttaattaagaccaatgtgtgtagacgaggagatgaataagtgaggttatatttatgcataacctccatagtcttgttcccttttgtctacaaaataaagagcacatggaggacgtattcatcttacatcttgaattactccattatccgacatggttaccattgttataaaatgtgatgtgtgatagacgatgctcgtataaataagaggcttctctcccagtagataggtacacgtacggctcatcgtttatccttattcctt

SEQ ID NO: 3546 - DNA, 2034 bp, Glycine max var. Williams 82
atggtgctttcagtactactacttttgttttctcttgtgtttttgctctcaaacccaacatgggtgtgtgggaatggagagttaagagcactgatggatatgaaggccagtttggacccagagagtctttatctaccctcttggagtatcaatggtgatccatgtgacggatctttcgaaggaatagcatgcaatgagaagggtcaggtggcaaatgtttctctgcagggaaagggtctcttagggaagctttcaccagccattgctggcctcaagcacttaactggactctacttgcattataactctttgtatggagagataccaagagagattggaaacttgactgagcttgttgatttgtatttgaatgtgaataatctgtccggggaaatccctcgtgagatcgccagcatggagaacttgcaagttttgcagctttgttataatcagttgacaggaagcattcctacacagcttggtgctttggaaaagctgagagttgttgctttgcagtcaaacaatttaaccggtgccatccctgctagtctaggtgatttgggtatgctggtgaggctagatttgagttctaataatctctttggttccattcccactagcctagctgatgctctttcactgaaggttttggatgttcacaacaataccctttctgggaatgtacctcctgctcttaagagactagatgatggatttctgtatgaatacaatttggggttatgtggagttgggttttcatcactgaaagcttgcaatgcttcggatcgtgtcaatcctagcagacctgaaccttatggagcagccacaagagatatcccagaaactgctaatgtgaagttaccttgcaggggaactcaatgccttaattcatcaaaatccagtcaatccacatcagttactgctggcatatttgtggttataattgcactgtgtgcaattggtgtttggacattcgcaatatatcgtcgaaggaaacaaaagcttggagattcttttcatatcagtgacagtcatctaaacactgatgaagccattggagcatataggaaaaatggatctcctttggtcagccttgagtactctactggatgggaccctttggctgatagtaggaatttcaatgggtataaccaagatatattccagagtttgaggttcaacttggaggaagtggagtcagctactcagtatttctctgagttgaatcttttgggtaagagtagctttagtgcaacatatagaggagttttaagagatggatccgttgttgctgtgaagagcatcagcaaaacaagttgcaagtcagatgaagctgagtttatgaagggattgcacatgttgacctcactgaggaatgataatgtagtgaggttgagaggattttgttgttcaagaggacgaggtgaatgctttctgatttatgattttgttcctaatggaaacctttcacgcttcctggatgttaaggtaggaggtggagaagtccttgaatggtcaactagagtttctattgtgaaagggattgctaaaggtatggcatatttacatgcatacaaagcaaacaagcccgttttggttcaccaaaacatctcagctgacaaagtactcattgatcagcggtacaatccattactagcagattctggcatgtacaagcttcttactaatgatattgtcttctccgcgctcaagggtagtgcagcaaagggttacttggcgcctgaatatgccaccactggccggtttgccgagacaagcgatgtttatgcttttggggtgctgcttttccaaatcctttcagggaagcacgagatcacaagctcaataaggcttgctgcagagtcttccaagtaccaagaatttatggacccaaatctccatggaagatactttgaatatgaagcagctaaactggcaaagatagctttgctttgctcccatgaatctccttttgagaggccatccatggatgccattgttcaagaactggggaattgtagtagctgtctctga

SEQ ID NO: 3547 - DNA, 1653 bp, Glycine max var. Williams 82
atgttctacttcctcaaaagattgtgccttctatgcttcctcttgttatcctttgctgtttcactgttttcatgtgcttcactcagaggcttggcttcttgcttggataatcacaatatcaaaaactttaccacgttcccttacaaagaacatgatcattcctctgcctatagttacttcaaaattctcaatttttccatccaaaaccttcggtttgcagaacccgtgattcctaagccaatagccattgtactgccagagagtttggagcagctgcagaaaagtgtagcatgctgtagagaaggctccatggaaataagagtaagatgtggtggacacagctatgaagggacttcatatgttgctgatgatggcactccttttgtcatcattgatatgatgaatttgaaccatgtttgggtggacatggagacagaaacagcatgggttgaaggtggtgcaacattgggagagacttactatgcaatctctcaggaaagcaatgaacatggattctcaggtgggtcatgtccaactgttggagttggagggcacattggtggtggtggatttggtttgttgtctagaaagtatggtcttgcggcagataacgtggtggatgcccttcttgtcgatgctaacggaaaattgttcgaccgcgaaaccatgggagaagatgtgttttgggccattagaggaggaggaggtggtctttgggggatcatttatgcctggaaaatccaggtgttgaaagtgcctcaagttgtaactagtttcactgtatcaagaactggcacaaaaagtcatgttgccaatctagtgcacaaatggcaatatgtggcaccaaacttggaagatgacttctacttgtcatgcttggttggtgctggtctgccccaagctaaaaccacagggttatcaacaacatttaatggcttctatctcggtcctagggccagtgccacatccatcctaaaccaggcttttcctgagttgagtattgcagaagaagaatgcatagaaatgagttggattcagtcaattgttttcttctctggcctaagcgatggagcctcggtctctgacttgaagaacaggtatctgcaagaaaaagaatatttcaaggccaaatcagattatgtaaagaaaaatgttcctcttgtgggcatagaaactgcactagacatcctagaaaaggagcctaagggatatgttgttctggacccttatggtggcatgatgcataatataagcagtgagtccattgcttttccccacagaagaggaaacctgtttacaattcagtacctgatctattggaaagaagctgacaatgacaaaagcagcgattatgttgattggataagagggttctatgctgctatgactccctttgtttcatggggtccaagggctgcatatattaattacatggactttgaccttggagtgatggaggggattggtaatggtgctaatatgaaagatgctgtggaacatgcaagggtttggggtgaaaagtacttcttgagtaactatgacagattggtgagggccaaaactctgattgatcctaacaatgttttcaccaatgatcagggcattcctcccatatctttgaccagtccctatgccaaagcgcagagcaaataa

SEQ ID NO: 3548 - DNA, 984 bp, Glycine max var. Williams 82
atgttgtacaaatcatctgtgaggcctttaaaggtggtcatggctaatttgcttacagtgtttttgctaattgaggtgtttgcatatggctacagttacggacaatatggcttaaacacgaattactacttgatgagctcttgtccttttgttgaacctgttgttaagaacattgtcaacagagctttgcaggatgatcccaccctagcagctggtctgattagaatgcactttcacgactgcttcattgagggatgcgatggctctgttctgattgactccactaaggataatacagcagaaaaggattctccagggaatttgagcctgagaggctttgaagtcatagatgccatcaaagaagagcttgaaagacaatgccctggggtggtttcatgcgctgatattcttgccatggctgctagagatgcagttttctttgctggaggcccagtgtatgacatacctaaaggaagaaaggatggaagaagatccaaaattgaggatactatcaatttgccattccctactttcaatgcctctgagctcattaagtcgtttggtcaacgtggtttttctgcacaagagatggttgccctctctggggctcatacactaggagtggcaaggtgtgcttctttcaagaaccgattgaaacaagtggatccaactttggatgcacaatttgccaagacactagcgagaacatgcagttccggcgacaacgcaccgcagccattcgatgccacgagcaacgattttgacaacgtttacttcaacgctttgttgaggagaaatggggttcttacatcagaccaaacactctacaatagccccagaaccaggaactttgtgaatgcttatgcattcaaccaagccatgttcttctttgatttccaacaagctatggtcaagatgggcctgcttgatgtcaaagacaattccaacggtgaagtaagagaaaattgccgcaaaataaactga

SEQ ID NO: 3549 - DNA, 801 bp, Glycine max var. Williams 82
atgaagtttgaagatttggcagaaggatgcatggcaaaaatactgtcctacaccactcgtgcggatgtatgcaggctttctctggtttccaaagcctttcattccgcggctgaagccaacactgtgtgggattgctttctcccctctgatttgtcctctatcatctccccttcttcttccgttcctccctttcgctctattaaggatctctatctctatctctccgatcgtcccaccatcatcgatcaaggtataaagagttttcaattggagaagcggactgggaacaagtgttacatgctttccgctagagatctgagcattatatggggtgacactactcattattgggagtggacaaccctaccagagtccagcaggttcgaagaagttgctaggcttcgagctgtgtgttggtttgacattactgggaggatgaacacccgcgttttgtcgccaaatactaattatgcagcttttcttgtgttcaagatgatcgatgccggtggatttcactacgatcctgcggtgttatcagtaggtattttgggaggcaatagcagtaccaaaaatgtttgtttggatcccaacttagtagataatcgacttgatgatagattccatggactccaacgtccaactgtgaggagcgatgggtggctggagattgagatgggtgagttcttcaatccaggcctagaagaagatgagttgcagattaaagtctcggagacaacaagtaattggtggaagcgcggtttcattcttgaaggaatagaagttaggcctaaacatgtttga

SEQ ID NO: 3550 - DNA, 1329 bp, Glycine max var. Williams 82
atgggtattattatcgggagaaagagaaggtgctcctgttcaactcctcgtgaggaccatcatcttctccttctcactttctttgttgccatacttctacaaagggctgtggttgaatcttctacgctaaattacacgaggcataggcataccagtacccttagacttgaaaggattagtaagcacttgaacaagatcaataagcctccggtgctcaccatagagagtccagatggagatcttatagattgtgttcacaaaagaaaacaactggctttagatcacccccttttaaagaatcacaagatccagaaaatgccaacggagatgccaaaagggatgaaagtgatgagagttgaggatgatatggaaaaggtgagagtgagagagaaggcatggcaaatgtggcacctaaatgggacacggtgtcctaagggaacggttccaatacggcgtagcacagtgcatgacgtgatgagagcaaagtctttgtatgactttgggaagaaacgctcacgagttgattccctctctcgccgcaacgatgcacccgatattctcagcggcaatggccatgagcatgcgatcgcatatacgggatcatcgcaagagatgtacggggcaaaggccacaattaacgtatgggatccatcaattcaagtaatcaacgagtttagtctatcgcaactttggatcctttcaggatccttcgatggcaccgatcttaatagcatcgaagctggatggcaggtcagtccggagctctatggtgacagcagaccaagattgttcacttattggacgagtgactcgtaccgggcaaccggatgttacaaccttctttgtgctggctttattcaaaccaatagcagaatagccattggagctgccatttctcctgtctcttcttatgatggcaaccaatatgacatcacaatcctcatttggaaggatccaaaagtggggaattggtggatgagttttggtgacaacacattggtagggtattggcccgcagagctattcacacacttagcagaccacgccacgatggtggagtggggaggagaggttgtgaactcacgaaccaacggccaacacacctttacccaaatgggctctgggcacttcgcagaagatggtttcggaaaagcaagctacttccggaaccttcagactgtagacacggataacaatctgagttctgtgcagggcatctcaaccttagccgaaaatacaaactgttacgacattaagagctactacagcaacgaatggggcacctacttctactacggtgggcctgggaacaatccacagtgcccatga

SEQ ID NO: 3551 - DNA, 609 bp, Glycine max var. Williams 82
atgggttcctccaagttattgggtactatggccatgcttttcgttgtgctgctacccatggctgccaaaggggataatattactgatttccttgataaggtttgtgaagaagtggaatgtgggaagggaagctgcgtagtaaacacaagttacccattaaacttcgtttgtgaatgcgattctggctggaagcgaacccaagatgacgatgataaatatgccgctagctttcttccatgtgtcattcccgaatgtagcttgaactatggttgtcagccagcaccaccgccagttccagagaagagttttccacataacttctcagcttttgatacttgctactgggcgtactgtggggaaggtacatgcaccaagaacaggacacatacacacagatgcgaatgtcaacccaattactataatcttctcaacatctcagtttttccttgttacagtgaatgtactcttggatctgattgttcgagactcggaataaaagttgcaaattcatccactgatagtggcagtcaagatagctcagcctcaatcttcacaggaaagttccattggatcgttatgttgttgatgtccacgggtatggttatgtag

SEQ ID NO: 3552 - DNA, 5683 bp, Glycine max var. Williams 82
tctcccgggcacaagatctacgtccccgtgtggtgaaacttgacatcaatcgatcacggtgacaggagtcttcactccttcgacgcaattccgagatggctttcatggcagtcttggaatccgaccttcgcgctctctccgccgaagctcgccgtcgctatcccactgttaaagacggcgcagagcacgccatcctcaagcttcgtacattgtcgagtcctagtgaaattgcacataatgatgacatattacgaatctttttaatggcgtgtgaggtccggacagtcaagcttagcgttattggactttcatgtctgcagaaactgatatctcatgatgctgtttctccatccgctctaagggagattttatctacactgaaagatcatgctgaaatggcggatgagggtgttcagctcaagacccttcaaacaatatcaataatatttcaatcacgtttacaccctgaaaacgaggataccatgtctcaagctcttggcatctgtctcaggcttcttgaaaacactcgatcttctgatagtgtgcggaatactgcagcagctaccttcaggcaagcagtggccttgatttttgatcgtgtagtttttgctgagtctcttcctgctggcaaatttgtttttggaggtcagctttctcggacaaattcagttactggtgatgttaaccgtggcatcaatttgtctgactcattaggtcatgagtccatttctggaaggccccctgtgatgagggagactttaactgaaactggaaaacttggacttcgcttgcttgaagacctgacatcccttgccgcaggtggatctgcaatttggttatgtgtgaatattcttcagaggacatttgcacttgatattcttgagttcattttgtccaattatgtggctgtcttcagaacattgttaccctatgaacaggctttacgacggcaaatttgttcacttcttatgacttcacttcgtaccaatgctgagcttgaaggagaaactggtgaacctagctttcgtcgtttggtcttgcgttcagttgctcatattataagactttacagttcttcccttataactgaatgtgaggtttttctcagtatgctactcaaggttacttttcttgatttgccattatggcatcgcattcttgttcttgagattttgagggggttttgtgttgaggcacgcacattgcggattctttttcaaaattttgatatgcaccccaagaatacaaatgttgtggagggaatggtcaaagctcttgctagagttgtttcaaatgtacaggctcaagaatcaagtgaggagagcctggcagctgttgctggaatgtttagtagcaaagccaaaggtattgaatggagtctagataatgatgcatccaatgctgcagttttggttgccagtgaagcacatgctataacattggcagttgaaggcctgttaggggttgtcttcactgttgcaactttaacagatgaagccatagatgttggagagcttgagtcccctagatgtgataatgacccacctgtgaaatggagtggtaaaactgcagttctctgcatctcaatggttgactcactgtggttgacaatacttgatgcattatcccttattctatcaaggtcacaaggagaggccattgtgttggaaatattaaagggataccaggcatttactcaggcttgtgggattctccgagccgtagaacctttaaattcctttcttgcatccctttgtaaatttactatcaattttcctgttgaaacagaaaaaaggagtgctttgccatctcctgtatcaaaacggtcagaactatcagttgaccagagggatagcattgtgcttactcccaagaatgttcaggcattgagaacccttttcaacatcgctcatcgattgcataatgttctaggcccatcctgggttctggtgttggaaactctggcagctttagatcgagcaattcattctccacatgccactacccaggaggtctccacccctgtcccgaagttcacaagggagttatctacccaatccagtgacttcaatatactctcttctttgaactctcagctctttgagagctctgctctgatgcatatatctgctgtaaagtctctcctctctgcattatgtcaactttcacatcaatgcatgacttcaagcagtttgggaccaacaactagtcaaaaaattggaagcatcagcttttcagtggaaagaatgatatccatccttgtgaataatgctcacagagttgagccattttgggatcaagttattagtcactttcttgagctagctgataattctaatacacatttgaaaaacatggcacttgatgcgctggatcagtgtatatctgctgtcttaggttctgatcggttccaagactacaaactatccaagtctcttgaatcatcacaggaaatggaagtcaatcttgataagttgaggtctcttgaatgttctgtcatatctccactaaaggttctttatttttctactcaaagtgtagatgttcgtgttggatctttgaaaattcttttgcatgtcttagagagatatggagagaaacttcattacagctggcctaatatacttgaaatgttgaggtatgtagcagatgtttcagagaaggatcttgttactcttggcttccagaacctaagagtgataatgaacgatggactgtctgctttacctacagactgccttcaagtatgtgttgatgtgactggagcatacagtgctcagaagactgagttgaacataagcttgacagcagttggacttctgtggactatgactgatttcattgcaaagggccttctcaatggaccttttgaagaaaaggaagcaggtgttggttccacagtgaagcagatagacagcaaaaagatggaggatcaaacacgtatttctaataatgtgagagaccaggcttctgtagatggtgttgattttgagaagcttctattctctgtattctcattacttcaaaaccttggggcagatgagagaccagaggtgaggaattctgctgtcaggacactgttccaaactttaggaacgcatgggcaaaagctttcaaagagcatgtgggaagattgtctttggaattatgtatttcctacattggatcgtgcttctcatatggctgctacgtcatcaaaagatgaatggcaagggaaagaacttggaacccgaggaggaaaagcagttcacatgctcatacatcatagtcgtaacacggctcagaagcagtgggatgaaactcttgtgcttgttttgggtggaattgcacgtatattacggttgttctttccttttttcacaagcttaagtaacttctggtctggctgggaatcattgcttcaatttgttgagaatagcattttaaatggaagtaaagaggtagcacttgcagcaataaattgtttgcagacaactgttaactctcattcgtcgaagggacatatgccaatgccttaccttatttcagtaattgatgtttacgagcttgttctgagaaagccttctagttaccgtggcaatgctgctgataaagtgatgcaggagattttgcatggtcttggagagctttatgtgcaggctcaaggattattcaatgatgttgcatacacgcagttgatagcaatcatagatttggctgtgaagcaagccatgttaactaatgataactttgaaatggaatttgggaatgtcccacctgtgctacggactatactggaaatcttaccactgttacgtccaacagagcacatatcttctatgtggcctgttcttcttcgagagtttctgcagtatcttcctagacaagattcatatttacagaatgaggatgattctcaggtgaactatgatgcacctaatggtgctactccaatatcacccaacaaaatagcagtatctccaggttctggatcaactgcagccataacagccattcctagttacatatttgcagaaaagctagttcccgtgctagtagatcttttcttgcgggcacctactgtcgaaaagtatattatataccctgaaattattcaaagccttggaaggtgtatgacaacaagaagagacaatccagatagtgcactttggaggttagctgttgaagctttcaaccatgttcttattgactatgttaccaaattaatcaatggaggtccagattcgaccattagcaaacctgtcagaacacgaatatggaaagaaattgcagatgtttatgaaatattcctagttggatattgtggacgagctcttccttcaaattccctctcagcagtggtgctagaggctgatgagtcccttgagatgtcaatattaaatattcttggtgacacaatccttaagctgccagttgacactcctttggatattctgcagcgactggtctccacattggaccgttgtgcatcacgcacatgctcattacctgttgagactgtagagcttatgcctcctcactgcagcagattttccttgacttgtttacagaagttattttctttgtgcagttattctaatgaagtcaattggaatatgacaagatctgaagtcagcaaaatctcaattacagtgctcatgaccagatgtgaatacatcttgagcaggtttctgacagatgaaaatggcttaggtgactgtccattaccaaaagcaagacttgatgaaattatttatgttctccaagaactggcacatcttgtaattcatccagatgcagcacccattctccctttacacccattgttgagaactggcctagcagaggaaaaggagaagcatgacaaccgtccccatctgtttgtgctattaccatccctttgtgaacttgtcacatcaagagaattaagaatacgggagctggtgcaagtactgcttcgattagtcaccaaggaattgtctctggaaaagctcagcttggcaagtgaaaagaactacactagaaccacctataggagattttcacagtcttctcttctctgttgcctgtcataaattatggtcaaccatactttctcagctccatcaggtacgtgctcatgattggcctaccttaagttacgacagatcagagtttcccatagtccattattaaaccgtttgagatttctccaacccaatacaatggagcagctgacagaattgtgtggttttcacaaccagatattctaaaggcgggaacagcaaagaagaggaagaaatctgttaaaatggtccaagtaagaggatcaatatgccccatgcattgccaattttgttgtaccaagtcactgaaatattatgagtctgacgttgagcccgatttttttaactcgggcccaggccttatttttttgtttgttagtgctaacctttcttggtcctttaaatgttcagtgtatgtataatatcttattgattgtagactgagaaaaaaaacgggcattatatttcggaattcctgaattagatttgaacatgtcccctggggaagaaatagtttaaattccatccccgttcctaaaagctgtttttgagaaaaaatattgtaggatgcctcttaatgctggtgtctttaacgcctcatttgtttgaaaaactacacttggtatcaaaacaatgacgtttgaattatgatggtttaa

SEQ ID NO: 3553 - DNA, 1494 bp, Glycine max var. Williams 82
atggccaatcacaaactagattgttgtttgtgtgaccagaagaaaagccaagctaataaaccgaagaagcttacaattgcagaagctttagatcttcaatctgatttgctgcaccccgataccaatgccaatacgaggcccaaaagagctaccaagagacaagcctctctattttcttgttcatcttctgcccatgacttgaggcatttggaattggagaaagagaaagaaaatatagcatcaccaagaggagtcttggaagcctgcatgaaagactttgactctcacgaccaatcacatgaatcgaaagccacttgttcaaccacgagggcacgctctcactggtccaaattcttcaaaatttggaggaaaaaatcttttaagcgcctaggctccctccctcctcttattagtgtgccaaagataccgaagtggaaaagcaaaagcagcagagaaaaccaagttctaagtaagctatacaacttcaggtcttcttgggtcactttcagcctctctgaactcagaaatgcaaccaacaattttagtgatgaaaatataattggaagaggtggctttgctgaggtttacaaagggtgtctccaagatggacaattaatagctgtgaagaaattgagtaaagggaccacagatgaaaaaaccgcaggctttctatgtgagctaggtgtaattgctcatgttgaccatcctaatactgcaaagctagttggatgttgtgtagaaggggaaatgcaacttgtctttgaactctctacactcggaagtttaggatctcttcttcatggttcagataaaaagaaattagattggagtaaaaggtataaaattgctctgggaatagctgatggtctcctctatctgcatgagtgttgtcacaggcgaatcattcatagagatatcaaggcagagaatattctgctcacggagaattttgagccacagatatgtgattttggacttgcaaagtggttaccagaacaatggactcaccatagtgtatcaaaatttgaaggcacatttggctattttgctcctgaatatttcatgcatggaatagtagatgagaaaactgatgttttttcatttggggtcctacttttggagatcataactgggcgtccagcggtggatcatatgcagcagagtgttgtgatatgggcaaaaccattgcttgacgctaatcatatcaaggaccttgttgatccttctcttggcgacgattataaacgagaacagatgggttgtgttgttttaactgcatcaatgtgcattgagcactctcctatcttacgcccccgcatgagtcaggttgtaacactgctaagaggtgaagaccatgttctgaaagctacaaaatcaagccgaaggaggcctctacaaagagcatactcagaagagctactagacgcgcaagaatacaactcaacaaaacatctaagagatctcaagcgatttgagcagattgcattgggttaa

SEQ ID NO: 3554 - DNA, 882 bp, Glycine max var. Williams 82
atgggaactatttttcctcctcactctctctctccactcctcaacatcaaaccttcaccctcaagaattctcttggctccctctccgcaacccaagtcaaattctctcttttgctcgaaacccattgtttctagtctcagaaagaaccaaactttatctcctaaaccttcatcaggcacaagctggttggctcatgctcaacaaggcctagcagctttggctatctccttggcactcaactttagcccagttttgttcaatggcaatgcactggcatctgagtttgatgtacttaacgagggtccacccaaagattcttatgtgtttgatgatgcaggagtgcttagtagggtaaccaggtccgatttgaagcagttgttgtctgatttggaatcaaggaagaacttccggatcaattttataactgttcgaaagctcacgagcaaagctgatgcatttgagtatgctgaccaagtcttggagcgttggtacccttctgtagaagaagggaacaagaagggtattgtggtgcttgtcacgagtcagaaagaaggagcagtcactggtggcccggcttttgttgaagctgtgggggaaaagatccttgatgctaccgtctcagagaaccttcctgtattggctacggatgagaagtacaatgaagctatttttagcactgctaaacggctagctgctgccattgatgggcttccagatcctggtgggccaacagttaaagacaacaaacgtgagtctaatttcaaaaccaaggaagagacagaagagaagcgtggacaattcactcttgtagttggaggtttgttggtcattgcattcgttgttcctatggcacagtactatgcctatgtatccaaaaaataa

SEQ ID NO: 3555 - DNA, 1326 bp, Glycine max var. Williams 82
atggaggttaatactacaaccactgtacctgcaggtccaccaactaggaaccattcttacacaccacaccacttacattcagaaagacatagccatagccatggccatttcccctccaaaaccattctcataatcatcgcattggtcaccttagttacggtcctatttatcatttttgttgttttattcttgatccgtcgccagaaatccttcagcaagaatggaacttgcgaagaagacagcagagagcttcatgacacaagcagcaggctcattacttcaacaacgttgaattctagcccagatgtgaaaagtgggtgtctcaatgggggaaatttgagcaggaccccagcacctaaatttagaggagtacaagtgttcacctatagggaattagaaattgccacggatggattcagcgaagcaaatgtgattggtagtaatggaattggagggcatggtttgatgtacagaggtgttctaagtgatggcactatggcagcaattaagttgcttcacactgagggtaagcaaggggagcgtgccttcagaatagcggtcgatctcctgagtcgcttgcactctcctcattcggtggagttacttggctattgtgctgaccaacaccacaggttattgatttttgaatacatgcccaatggaaccctccactaccatcttcacaccctcaacgatcaaactcggccgttggattggtgggcccggatgaggatagcccttgattgtgccagggcactggaattcttgcatgaacatgcagtctctcctgtgatccacagagacttcaagagtaacaacgttctactggatcaaaacttgcgtgccaaggtgtctgattttggattgcctaagatgggatcagacaagaggaacggtcaggtttccacccgtatgttggggaccactggatatttggcaccagagtacgccatgggtaagcttactacaaagtcagatgtttacagctatggtgtggttcttcttgaactgctcacgggacgtgtgccagttgatatcaagcgggccccaggagaacacgtccttgtctcttgggctctcccaaggttgacaaacagagaaaaggtgattgaaatggttgacccagctctacgtggacagtactcaaagaaggatttaattcagatagctgccattgcagcaatgtgcatacagccagaagctgattacaggccgctcatgacagatgttgtacaatcactgataccacttgttaggaaccaatcctctcttagttcatctagctccctacgatttcagaaacaaacgccaagtccaagtcattag

SEQ ID NO: 3556 - DNA, 231 bp, Glycine max var. Williams 82
atgtcaatttcaagaactcaaatggggtgtctcttggtgctcatactagtattattaagcagttcttgtttaaaccatggagcattaggtgctagatatgggaaaaaagtggagcatacacacaagtttagagtatggtggaaaagctttagccatgaaacagctcgaggctcttataagacagttaatagagaagtaccttcctctcctgaccccttacacaacaggtag

SEQ ID NO: 3557 - DNA, 2670 bp, Glycine max var. Williams 82
atggagattcacgaaaaccaacacgagtcatggtcggagacggagagcacgggaagccgaagcaagcaagtgggcttcagcgggccactaagcgggcctcttagcgggcctttgagcgggcctttggtgtcttccaacaaaaggaacagcagcaagaacaaaagcgcgaggttcaaggacgacgaggagatggtggagatcacgctggacgtccgcgacgacgccgtttcggttcagaacatccgcggcggcgactccgagacggcgttcctcgccagccgcctcgagatgcggccgtcgtcgttctccgaccgcctcagacaggtgtcgcgggaactgaagcgcatgacatctaacaaagctttcgatagggttgaccgcagcaaatccggtgctgcgcgcgcccttcgtggcctcaagttcatgaccaaagcaggcactgaaggttggtcacaggttgagaagcgcttcgatgagttggccattgatgcaaagctccccaagactcgctttagtcagtgcatagggatgaccgagtcgaaggagtttgccggagagttattcgatgcattggctcgtcgtcgggggataacatcagcttccataacgaaggatcagctgcgtgaattttgggagcaaattacagatcagagctttgactcgaggcttcagaccttttttgacatggtggacaaagatgctgatggacgaattaatgaagaagaagtaaaagagatcatcaccttaagcgcttcagccaataagctgtcaaaattaaaagatcgtgcagaggaatatgctgcccttatcatggaggagctggatccggacaaccttggatacattgagttatacaacttggaaatgcttcttctgcaagccccagcacaatcaaccaacataaccaccgatagcaggatactgagccaaatgctgagccagaaactagtccctacaaaggagtacaaccccatcaaacggggctttcgggcactagcatacttcgtgcaggacaattggaaacgcctatgggtcatagccctgtggctttccatttgcgctggtcttttcacttggaagttcatccaatacaagcaccgtgcagtgttccatgtcatgggctactgtgtcacagtggccaagggtggcgctgaaacaaccaagttcaacatggccttgatcttgttgcctgtttgtaggaacaccatcacttggctcaggagcaggaccaaactaggagcaatcattccctttgatgacaacatcaactttcacaaggtggtggcctttggcattgcaattggggttggattgcatgcgatttcacatctgacgtgtgacttccctagattgttacatgccacagacgtagaatacaaacccatgaaacaattttttggggatgagaggcccaacaattattggtggtttgtgaaagggactgagggatggaccggggtggtgatggtggtgcttatggctatagccttcattttggctcaaccatggttccgaaggaacaggctaaaactccccaaaccccttaagaagctcactggtttcaatgccttttggtactcccaccacctttttgtcatcgtctacgtgcttttcatcattcacggatacttcctatacctcagcaagaaatggtacaagaaaacgacgtggatgtatctcgccgttcccatgatactatacggatgcgaaaggctacttcgtgcttttaggtctggctacaaatctgtgaggattctcaaggttgctgtgtacccaggaaatgtgctagcattgcatgtgtctaaaccacatggatttaagtactctagtggccagtatatatacgttaactgttcagatgtatccccatttgaatggcatcccttttctattacatcagctccaggagatgactacttaagtgttcacattcgaactttgggtgactggacatcacagttaaagggtgttttcgccaaggcatgtcaaccagcaagtgacggtcaaagtggtcttctacgagctgatatgctacaaggcaacaacaaaccaaggatgcccaggctactaatcgatggaccttatggagctccagcacaagactacaaaaattatgaagtaatccttctggtggggctaggaattggtgccacccctttgattagcatactcaaagacgtgctaaacaacatcaagcaacataaagacgtagaagaaggagcggtggaaaaggacaacaagagaaaaccttttgccaccaagcgagcttatttctactgggttacgcgtgaggaaggttcctttgaatggtttaaaggggtgatgaatgaggtggaagagaatgacaaggaaggagtcattgagcttcacaactattgcacaagtgtgtatgaagaaggagatgctaggtcagctttgatcactatgctccagtctcttcaccatgccaaaaatggtgtggatatagtttcaggaacaagggtcaagacccattttgcaagacccaactggcgcaatgtctttaaacatgcagccatcaaacaccctgaccaaagagttggtgttttttactgtggggcgcatggattggttggggaactgaaaaggctttctctagacttttctaggaaaaccagcaccaagtttgattttcacaaagaaaatttttag

SEQ ID NO: 3558 - DNA, 2223 bp, Glycine max var. Williams 82
atggcatccacatcctctctgcatctatctcaggcccttctggcacgtgctgtgtaccttcatggctcttcttctgaccgtgtctcactctccttcccatcattctctggcctcaagtcacattctccatgcaaagcagcagccacgtcctcacgtagaaggggtgcttgcgcttccaccagcgttgttcgagccgctgcggttgagacactggaccagaccactgaggtttctctggtggagaaatccgtcaacaccattcggtttttggccattgatgctgttgagaaggccaactctggtcaccctggtctccccatggggtgtgctccaatgggtcacattctctacgatgaggtcatgaggtacaatcccaagaatcccacttggttcaaccgtgaccgtttcattctctctgctggacatggctgcatgctccaatatgctctccttcaccttgcaggctatgacagtgttctggaagaagacctgaaggaattccgacaatgggggagcaggactcctggacatcctgagaactttgagacagttggaattgaagtgactacaggtcctcttggtcagggcattgccaatgctgttgggttagcactagctgagaaacacttggctgcacgatttaacaagcctgacaatgagattgttgaccattacacatatgttatattgggtgatggttgtcaaatggagggaatttcaaatgaagcatgctcacttgccggtcactggggtctagggaagcttattgctttatatgatgacaaccacatttccattgatggggacactgagattgcattcactgagaatgttgatcaacgttttgaggcacttgggtggcatgtaatttgggtgaagaatggaaatactggatatgatgaaattcgtgcagccattaaggaagcaaaggctgtcaaagacaaacccactatgatcaaggtaaccactaccattggatttggttctccaaacaaggctaactcctacagtgttcatggaagtgcattaggtactaaagaagtggatgctacaaggaagaatcttggatggccatacgagcctttccatgtgccagaagatgttaaaaagcattggagtcgccatacccctgagggtgctaaacttgaagctgagtggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaaatcatacggagatttccaaaagaatactcccgaagagcgcaatgttagatttggtgttagagaacatggaatgggagcaatctgtaatggtattgctcttcatagccccggattcattccatactgtgcaactttctttgtcttcactgactacatgagagctgccataaggatttctgcactgtgtgaagctggagttatttatgtgatgactcatgattcgattggacttggagaggatggaccaactcatcagccaatagagcacttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacattatttcagacaactcgtcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaagagagtgttctccctgcttcggtaacagttagagttagcattgaggcaggatcaacatttggttggcaaaagattgttggaagccaaggaaaggccataggcattgatcgatttggagcaagtgctccagcaggaaaaatatacaaggagtttggtatcaccaaggaagctgttattgctgctgccaaagaactttcgtag

SEQ ID NO: 3559 - DNA, 1494 bp, Glycine max var. Williams 82
atgacgatgaccactatacaatcgacgccaggaagctcagggtatttggatttgtttcctgaccgcaaaatgtcattttttaagaacccttatattctcggactaactgcagttgctggcattggtggcatgctttttggctacgacacaggtgtgatatcaggagcccttctatatattaaagatgattttgaaggggttagacaaagtaatttacttcaggaaacaatagtgagcatggcaattgcaggtgcaatagttggagcagcaggaggaggatggatgaatgatgcttatggaagaaagaaggcgactctgattgcagatgtgatatttattatgggagcaattgggatggcagctgcaccagacccttatcttctgattctgggacgttttctcgttggtatgggtgtcggggttgcctctgttacctctcctgtctacattgcagaagcatctccatccgaaatcaggggatcattagtcagcactaatgttctcatgatcactgctggccagttcctttcctacatcgttaaccttgcttttactcgtgtccccggcacctggcgatggatgctcggtgtctctgccgtccccgccattgttcagtttcttctcatgcttttcctccccgaatccccaaggtggctcttcatcaagaataggaaaaatgaagctgttcatgtgctctctaacatctatgactttgctcgcttagaggatgaagttgattttctaaccactcagtctgaccaagagcgccaacgaagaaactctatcaaattcggggatgtttttaaatctaaagaaatcaaacttgcattacttgttggagctggcctgcaggctttccagcagttcacaggaataaacacagtgatgtactacagccctaccattgtccaaatggctggcttcaactctaatgagttggctcttctgctgtccctcgtagttgctggcatgaatgctgttggaaccattcttggcatttacctaattgaccatgctggccgcaaaatgttagccctttctagcttaggaggagtatttgcatctttggtcgtcttgtctgtctcatttttgaaccaatcatcatcaaatgaattatatggatggcttgcagtgttgggtttagtcctatacattgcttttttctctcctggaatggggcctgtgccatggactgtgaactcagagatatatcctgaggaatatagaggaatttgtgggggcatgtcagctactgtgtgttgggtttcaaatctgatcgtgtctcagagctttctttccattgctgaagctatagggataggttccactttcttgattcttgctgctatttcagtgcttgcctttctatttgtgcttttatatgttccagagaccaaaggattgaccttcgatgaagtagaactcatatggaaggagagagcttggggcaacaacactgactcacgaaaccttcttgcagaaaatcaaccttag

SEQ ID NO: 3560 - DNA, 2409 bp, Glycine max var. Williams 82
aattttgctcctatattaaaatgatagtaaaataaaaaatagccccaaatattttgaaaaattgtgagcatcatcccttcacatcgctaggcaaatctgcaaggaagacattgatcgcgtttcattggcttctatgctcggaattcagcttttgcgtctgaattaggctgcgtgttgttcccgattgtttgtttttcaatcgttagcagcagagcgtgcttgaacaagttaattggttggttttgtgattttgacgcttggggaccgcaatggaatttgatctctgcgatagcagtggaacagatgatggtcttcctccttcccatcaatgtctaaatagatttcaatgaccagatcatgccactggaactggaaacggaagatctgcaattgtaggccttggtccatatcctcggatgcagaacgacatggaaacacaaatccataacattgagcaagaagcatacacctctgtcctgcgggcttttaaagctcaatctgatgcaatcacttgggaaaaagaaagtttaattacagagcttaggaaggagctaagagtatcagatgaagaacacagagaacttctatcaagagtcaatgctgatgacatcatccacaacataagggagtggagaaagggaaatgggctccaatctggagcagtaaatactgctcaacaagttcatgatcacaataccagccctaccattttggcatctcgtaagaaacaaaagaaatcacaatctgtggcttcattatccttgggtgcaccatctcctgcggttcatccatctatgcaaccatcatcatccgcattgaagcatggacctccatcaggaactaagaccaaaaagcaaaaatcattcccttctacaggacttacaagccaaagccaggtcactaatcaggggggttcttcaggtgcctttgcaacaaaaggacctgctgaagcagcttcttatgatccctggattggaaggaaagtttggacaaggtggcctgaagacaaccacttctatgaagctgttataacggattataatgctgctgagggactacatgctttggtttatgatatgaattcagcaaatgaaacatgggagtgggttaatcttaaagagatatctccagaagatattctttgggagggtgaagatcctggaatatcccataaaggatgccagcccggtccaggtagaggattgaagaagtctatgcctcacggtggtgcagttactggtgctggaagaggtaggggaatgatgaaggtgcagcctaagaaagatttcactttgtcacaaaaagggggcaggaagaaggctacaaatgatattgagatactccatacagatacccttatcaaggaggttgaaaaggtttttactgcaagccatcctgatcccatggaaattgagaaagcaaagaaaatgctaaaagaacatgaacaggctcttgtcaatgcaattgccaggctcggagatgtgtctgagggtgaaagtgatggagaacctccgttttcgcaagggctgtcaatggatcaggaaaaacgctggaagaaacaacagtataattcgggtggtgttggagtaccagatggttcaaatggtgataaattacaaagagaaactagtgctccatctgagtatccgcatgaagttggcaacaacgcatgactaatgtaatatgctattattattgtataattgtagtttctttttgtatctattaagttgtgcagcgggtagcttcaatctagagagacaaccgatatgttacttgtaaattataaattactaaaaacatggttcttatgcttgtaattccccttctctctcattatccaatcagcagaaatgcttactatgtgggtaactgatttctttcattttagaaggtggcataggcgtagggggcacaaataaacattgcaatcgcagattcaacaagattttgtacacaaactaatcccaattcccaatagtagagtcaaatcacactcagcacaatcagttatttgtcttcatagtgatgcaataaacttgatgatgagatccaccatctcagcatcataaccaggcccttccatctggaagtggcctaccccatcgattaaatgtgtttctacacgtcctgctgcagaattaagcttgttcctcagctgctttacactggtgaatccatcttgtgttcccataatgaagagttttggttttggtgactgtaggatggctttgtggtgtcgtccaaaaaggattgaggcagtcattccaaatggataacctatgcttacataaccaatgacttgttcaatctgatcaacggcagaccctgctataggtgcacctgtaataaaagaaataactcaaatatatgacaactctttcaggcttgaacattgatgcaacacat

SEQ ID NO: 3561 - DNA, 1098 bp, Glycine max var. Williams 82
atgggatcgtgcctctcggtgtcgggggcatcggcctccgtagatgcttttgatgaatcatcttccaattccagttccagaactgcctctgattataacatggaaatgcggctccacagagttcctggcagattattcttgaactgttcgtcccaggttgcttccttgttctgtaagcaaggtcgcaaagggatcaaccaggatgccatgcttctctgggataatttctcttcaaacaaggacaccgttttctgtggtgtttttgatggccatggacctcatggccatatggttgcaaagaagctcagggattccttccctctcaagcttattgctcaatggaatttgcttcatcctaacaacaacagcagcagcaacaacaacagcgatacaccttgtgcggttgccccgggtaacattggtacgctcagagactcctttgtgaaggcttgcaaggtgatggacagagagctgaaagtgcagcatcagatagattgctcgtgtagcgggagcacgggtttgacgttgctgaagcagggtcaggaccttgttattgcgaatgtgggtgactccagagcagtattggccacccaagatcgtagcaatggttctcttgttgctgtccagttgagcactgaccacaagccacatctcccaagggaagcagagaggataaggatttgtaaaggaagggtcttttccattaagaacgaatcagggattcctcgagtatggctccccaacattgattcccctggccttgccatgtcacgtgcttttggagatttttgtctcaaggactttggagtcatctctgttcctgatttctcatatcaccgcctcactcaaagggatcagtttgttgtcttagccacagatggggtatgggatgttttatccaacgaagaagctgtggccattatctcttctgctcctcgctcttcagcggctcgaatgttggttgaggcggctattcatgcatggaaaaccaagcttccccttacaaaggttgatgattgctctgtcgtttgcctcttctttcattcagactcagactcagactcacttagactcgaacctcaacaaaaccaccaatag

SEQ ID NO: 3562 - DNA, 957 bp, Glycine max var. Williams 82
atggtacttttgacagagaaacttgcaaaacgttacttcaacttcaagctggagaatcgccaccatgccattacacatcctcaaccagaggagttatcatcttcacttcttgcgtttaaatcctatgtgtccaaatcaattgaccaattagcattggatttgaaacctggatcagagaccttgtccttgacatggtttggaaggtgttttgacctcttgcccttaatcaacaaggcttttgcaaagcttgttgcggatattgactacccaatgagtaaatgggagattttttccattgaagggtactacttgagctacaccttgagtttgctagagcttctgaattccatttcttcttgtttttctcatcttggccaagctagcctttctctggttcatggtttgaccctagtggagaattcaccttctttggctacaaagccatatctgaaagcaattcaacttcaacaagggtgtttcagcaccaactttggtcaagatcatgatgacgaaaaaagggtttttttctctggcaaggagtggatggttcatgaggctgtaaaggaaatgaggagtattggattctgggtatgtggggttatgttgtcttgtttatatggtgatggtaagccatacatggagctgagaaaaattgctggagggtttgatggtggttctctagttgccacgcttgattccaaaatcggtgaacagttgatgaagcaaaggccaatcttcagtgagatcaaagaggtaaacaatgctgtttctaaccttcttgttgcttctgatgaagtgagacatgatgcagccaaggaattgcagacaaagctgagtgtgttggagaagctatctgatgatataaggaaggaggtggataatctgtttgccaatgtaatgactcagagatccgaattaattgatggctttcggctacagaaacagccacaaaaataa

SEQ ID NO: 3563 - DNA, 540 bp, Glycine max var. Williams 82
atgagtcatggccaaaccaagaagccacaagcagacggtgaacccaccgaatgcggcgacgttttcggtgtctccaccgccgcggagcctcacgctgcgccggtggtgtccgccggtatcggttcggctgccatagatggcgaccccataaccatcggagaagctctggaagcggcggcaatatcgatcggggataaaccagtggaccaaaatgacgccgatgcgattggcgtcgcggagattagggccaccggagagaataaggtgaggtccggtggggtgggtgaaaccgcacaagaagcagctactttcaacagtcacgtcatgcgagtccaagacatgacgaaactttccgatatcttaacggatgcggcggagaagctccccgtggacaaggcggtgacaaaagaagatgctgaggctgtgtatactgcagaggtgcagtttccatggcagagagatgcggcggaagtggttgctgaacctggcggagtggcggcatccatggccaccgcagctaacctaaatgaactaagttga

SEQ ID NO: 3564 - DNA, 1042 bp, Glycine max var. Williams 82
aacaagcttatacttcatagcaagcgagagtccagggcagttatatatccaccgtttttatacacgcaccactaaaagccacgtgtactagtacaccacagcaagtaactcaagtatctcctaaggtggacgtagaactaaaggccaccttcaacttttgtctctgcaaaaccaacacgtgttcagcatgcaccatccaaaacattccaaatactcttgggcatgtagaagtcaaattaattaacacttctacgcttacaccaaacctttttttccaaaacaaaaaccaatgagtcatggccaaaccaagaagccacaagcagacggtgaacccaccgaatgcggcgacgttttcggtgtctccaccgccgcggagcctcacgctgcgccggtggtgtccgccggtatcggttcggctgccatagatggcgaccccataaccatcggagaagctctggaagcggcggcaatatcgatcggggataaaccagtggaccaaaatgacgccgatgcgattggcgtcgcggagattagggccaccggagagaataaggtgaggtccggtggggtgggtgaaaccgcacaagaagcagctactttcaacagtcacgtcatgcgagtccaagacatgacgaaactttccgatatcttaacggatgcggcggagaagctccccgtggacaaggcggtgacaaaagaagatgctgaggctgtgtatactgcagaggtgcagtttccatggcagagagatgcggcggaagtggttgctgaacctggcggagtggcggcatccatggccaccgcagctaacctaaatgaactaagttgaagtttgaagtgcagtgcttcctcttttttaaatgtgttattgagtaaaattaaagtagctttataactgctgaatatgcaaatggtatcttgttaactactagttctttgttttttactagtctggtactatgtcattgtaaatttttttagtattgaaaaaatgctttataaaagtggtgaaaccttgcagctgatggtccaaaaggaagtg

SEQ ID NO: 3565 - DNA, 1233 bp, Glycine max var. Williams 82
atgcataggatcaacaccgcaaggtccattttttctgctgttttcagaagcaaatctcggcctcactctgctgctttctccacctccttgctcttcgacgaaactcagacacagtttaaggaaagtgttgctcaatttgcaacggaaaatattgcccctcatgcttcgaaaatagaccaaacaaattatttcccaaaggaggtgaacttatggaaaagcatgggggaatttaatctccttgggattactgcaccagaggaatatggagggcttggcctaggttacttgtatcactgtatagcaatggaagagattagccgtgcttcaggatctgtaggtctttcttatggtgctcattcaaacttgtgtatcaatcagctggtgaggaatggaagccctgctcagaaagagaaatatttaccaaagcttatttctggggatcatgtgggagctttggcaatgagcgagcccaattctggttctgatgttgtcagcatgaaatgcaaggctgatcgtgtagatgggggctatgtacttaatgggaacaagatgtggtgtactaatgggccagttgctcaaacattagttgtctatgctaaaacagacataactgctgggtcaaaaggcattactgcattcatcattgagaagggaatgcctggattcaatactgcccagaaattggataaacttgggatgcgaggaagtgatacgtgtgagcttgtctttgagaattgctttgttccagacgaaaatattcttgggaaagaagggaaaggagtctatgtcatgatgtctgggctggatctggagagacttgttttggcagctggtcctcttggtattatgcaggcatgtcttgatgtcgtccttccttatgttcgacaacgagagcagtttggtcgtcctattggggagtttcagtttatacaggggaaaattgctgacatgtatacttcattacagtcttctaggtcttatgtgtattcagtagctcgggattgtgacaacggaaaagttgacccaaaggattgtgctggagctatactttgtgcagctgaaagagcaacccaggttgctttgcaggcaatacaatgtttaggtgggaatggttatgtgaatgagtatcctactggtcgtctcttgagagatgccaaactctacgagattggtgcaggaactagtgagatcagaagaatgattattggacgtgaactcttcaaggagcaataa

SEQ ID NO: 3566 - DNA, 1431 bp, Glycine max var. Williams 82
atgggaaacaaaactacccttttgcttttgctctttgttctttgccatggagtggccacaacaacaatggccttccatgatgatgagggtggtgataaaaagtcaccaaaaagtttgtttttgatgagcaactccacgagggttttcaagactgatgcaggggaaatgcgtgtgctgaaaagccatggtggtaggatattttataggcacatgcacattggcttcatctctatggaaccaaagtccttgtttgttcctcagtacctcgactccaatctcatcatattcatccgtagaggggaagcaaagctgggattcatatatgatgatgaactagcggaaaggagattgaagacaggggacttgtacatgattccatctggttcagcattctatttggtgaacataggagaaggtcagagacttcacgttatctgcagcattgacccctctacaagcttgggattagagaccttccagtccttctatattgggggaggagccaattcgcactcggtgctttctggattcgaacctgccatccttgaaactgcatttaatgaatcaagaacggtggtagaggaaatcttctccaaggaactagatgggccaattatgttcgtggatgattctcatgcacctagcttatggactaaattccttcaactgaagaaggatgacaaagagcaacagctgaagaaaatgatgcaagaccaagaggaggatgaggaggagaagcaaacaagtaggtcatggaggaagctcttggaaaccgtatttgggaaggtgaatgagaagatagagaacaaagacactgctggttcccctgcctcttacaacctctacgatgacaaaaaagccgatttcaaaaacgcttatggttggagcaaggcactgcatggaggcgagtatcctccactcagcgaaccggatattggagttttacttgtcaaactctcagcgggatccatgttggcacctcatgtgaatccaatatcagatgagtataccatagtgctgagtggttatggtgaactgcatatagggtatccaaacggaagcaaagcaatgaaaactaaaatcaaacaaggggacgtgtttgttgtgccaagatacttccccttctgtcaagtagcatcaagggatggacccttagagttctttggcttctccacttctgcaaggaagaacaagccacagtttctggctggtgctgcgtcccttctaaggaccttgatggggccggagctttcggcggcgttcggagtgagcgaggacacgttgcggcgcgctgttgatgctcagcatgaggctgtgatactgccatcagcatgggctgcaccaccggaaaatgcagggaagctgaagatggaagaagagccaaatgctattagaagctttgccaatgatgtggttatggatgttttttaa

SEQ ID NO: 3567 - DNA, 1829 bp, Glycine max var. Williams 82
aaatttccaaaatttaaagggaagaagataagaagacgctgatgttagagaatttcaagcagactttgaatgtgtcactgtgtttgtgtctttgatccgaagtttctcactgaacctcaacatgtctacacattacatcgccagcaaacccctcaagctctacatgcacgacacgtgtctctacattctcttcacactcccttcataaataaaccaccctttcttccatcctcatccctcaaacacagtcatgggaaacaaaactacccttttgcttttgctctttgttctttgccatggagtggccacaacaacaatggccttccatgatgatgagggtggtgataaaaagtcaccaaaaagtttgtttttgatgagcaactccacgagggttttcaagactgatgcaggggaaatgcgtgtgctgaaaagccatggtggtaggatattttataggcacatgcacattggcttcatctctatggaaccaaagtccttgtttgttcctcagtacctcgactccaatctcatcatattcatccgtagaggggaagcaaagctgggattcatatatgatgatgaactagcggaaaggagattgaagacaggggacttgtacatgattccatctggttcagcattctatttggtgaacataggagaaggtcagagacttcacgttatctgcagcattgacccctctacaagcttgggattagagaccttccagtccttctatattgggggaggagccaattcgcactcggtgctttctggattcgaacctgccatccttgaaactgcatttaatgaatcaagaacggtggtagaggaaatcttctccaaggaactagatgggccaattatgttcgtggatgattctcatgcacctagcttatggactaaattccttcaactgaagaaggatgacaaagagcaacagctgaagaaaatgatgcaagaccaagaggaggatgaggaggagaagcaaacaagtaggtcatggaggaagctcttggaaaccgtatttgggaaggtgaatgagaagatagagaacaaagacactgctggttcccctgcctcttacaacctctacgatgacaaaaaagccgatttcaaaaacgcttatggttggagcaaggcactgcatggaggcgagtatcctccactcagcgaaccggatattggagttttacttgtcaaactctcagcgggatccatgttggcacctcatgtgaatccaatatcagatgagtataccatagtgctgagtggttatggtgaactgcatatagggtatccaaacggaagcaaagcaatgaaaactaaaatcaaacaaggggacgtgtttgttgtgccaagatacttccccttctgtcaagtagcatcaagggatggacccttagagttctttggcttctccacttctgcaaggaagaacaagccacagtttctggctggtgctgcgtcccttctaaggaccttgatggggccggagctttcggcggcgttcggagtgagcgaggacacgttgcggcgcgctgttgatgctcagcatgaggctgtgatactgccatcagcatgggctgcaccaccggaaaatgcagggaagctgaagatggaagaagagccaaatgctattagaagctttgccaatgatgtggttatggatgttttttaatttgaacacttgatttggaataggggttatttggtagtgctagtgcctagtggaattctgtgttgagttttttgttctttatatttagttgagatgtgtgttgtgttcttgagttgtgaataaaaatctactttctttgtgcattgaa

SEQ ID NO: 3568 - DNA, 615 bp, Glycine max var. Williams 82
atggagagcagcgacacatacacccccacttcctctgccccactttctcactccccctctaattcctcttcttcctcaccaccaccacctcccactgttgtgatgagtccttgtgctgcatgcaagattttgaggagaaaatgtgcagagaaatgtgtgttggcaccttatttccctccaactgaacctgccaagtttactattgcacaccgtgtatttggtgctagcaacatcatcaagttccttcaggagcttccagagtctcagagggctgatgcagtgaccagcatggtgtatgaggctagtgcaagaataagagaccctgtatatggttgtgcaggggcaatttgccagctccaaaagcaggtcaatgaacttcaagcacaattggccaaggcacaaggtgagcttgtgaacatgcagcttcagcaagccaatcttgtggctctaatttgcatggaaatggcacagagtccacaggaatcaccacaacaatcagtggataatttcatttcaactcctccccagagtggtggtgcatatcaaagtggcatgaacttctttgaggacaacactagcctaaactcactatgggaacaacccctttggacatga

SEQ ID NO: 3569 - DNA, 1854 bp, Glycine max var. Williams 82
atgctaggaagactttcttgtaacttaagtgggtcctctgaagtgcctcagaaggtgtctccacgtgccgtgcgcaaactcaagcctactactctggacatcgactctgcatcttctttaagtcaggctactaaatcatcaaaggaaagaagccccaaagtcactgaccgcagatcacccagaagcccagttgttgagaggaagcgccccagcaaaatatctgagttggaatctcaaatttctcaactccaaaatgacttgaagaaggtaaaggaccagcttattttgtctgaatcatgcaagaagcaagctcagcaagaagctgaggagtccaaggagcaactactagccctatctgcaaaacttgaagagtcacaaaaacaagttctggatctttgttctactggagaagctcgcgttcttgagctccagaatatcgtagaagaacgtgatatggcatgccaatctgagcttgagtcttccaaaaagcagctctcagttgagtctgctgccctggcctctgcaacgaacgaaattcagatgctcaaggcgcaacttgaattggtagctaattgtgagagtgtgcaatctcaacacgcagaatcagcagacattgagcttcttaacctgaagcagaacttgtccgaaacgctttctcttgtggatgccttgaaaaaccaactaagggattgcaaagaatctgaagctcaggcccaagcattggtcaatgaaactatgatgcaacttgaggctgcaaaaggaactgttgagttcctaagggctgatgttgcgaaagctgttgatggctacaactccattgctaaagagttagaccaatctgaagcacgggtgaactcactagaggcacttgttagcaatcttgagacagaccccatcaataataaatgcatcctttcagaaaatgttgcagatgatcataaatttgagtaccaacctgaaatattgaaacagggtgaggatcctagtcagctggaagcagaagttgtttctttgaagtccgaggttgaacgattgagatctgctatagagactgctgagattaaataccaagaagaacagaatcggagcacggtgcagatcaggaatgcctacgagttagtagaccagataaaatctgaatcatgtcagagggaatgtgagctagaggctgagttgaaaaagaaaaaagctgatattgaagagttgaaggctaacctaatggacaaggaaactgagttgcaaggcattgtggaggagaatgacaacctgaacctaaagcttcaagagagcatgtcatccaaaaacgagcacgaactaaaaagggaaattaaaagactagaagaatgtgtggcggaactgaaggcagatatgatggacaaggagacaatgctgcaaagcatatctgaagagaacgaaacgctgaaatcggaaatgaacaactgcagcaaagcaagggaggaagttgctgctgaagtagagcaagtgagggcagcggaacgcgaggctctcatgaaactcgggattgtgatggaggaggcagataagagcaacaagaaggctgcaagagtggctgagcagctggaggcaacacaagccgcgaactcagaaatggaagcagaactgagaagactgaaggtgcagtctgatcagtggaggaaggctgcagaggcagctgctgttatgatttcaacagggaacaacaatgggaggctcacagagagaactgtgtctttggataacaacaactacaagggctcaccctatgctgaagacatggatgatgacttccagaggaagaaaaatggcaacatgctgaagaagatcggggtcttgtggaagaagcctcaaaaatag

SEQ ID NO: 3570 - DNA, 573 bp, Glycine max var. Williams 82
atggaaggtaggagagtggagaggaagaaaacattgtttgagagggtgagaaagaatagcacagtggatgaggaagtggaaaatgaaggggaggaggaggatgaaagtggtgttaatattactgaagaagagaagaagataggggttagtagtggtggtgggagaagagggtcaagtgggggtggtggaggggtttctccaccttcatgtcaagcagagaggtgtggtgctgatttaactgatgcaaagaggtaccatcgccgccacaaggtgtgtgagtttcattccaaggcacctgttgtggtggttgcaggactgaggcagaggttttgtcagcaatgtagcaggttccatgatctggcggagtttgacgaatccaagagaagctgccgcagacggttggctggacacaacgaacggcgcaggaaaaccaacccggaagctgccaatgagggcaacagcaaaggccaacaccctaaggaaacaacacattgcaggcttgcagatgagagggggagaattcagatgaacctaacagggagttctgaatacaagtctttcaacatcagatga

SEQ ID NO: 3571 - DNA, 849 bp, Glycine max var. Williams 82
atgacgggcaaagaaatttttcataagatgaaggaaaaagttttgggatcatctgatcccgattcaggtaaaggaaagagcaagatgaagaagcacataactcatggctttcacttggtaaagggaagatcaggtcatgccatggaagactatcttgttgctcaatttaagcaagttgacaacaaagagttgggtttatttgcaatatttgatggccactctggtcacagtgtacctgattacttgaagtctcatttgtttgataatatcttgaaagagcctaacttctggacagaacctgctgaggctgttaagagagcatatagtataactgattctactattttagacaaatcaggtgaattgggtagagggggttcaactgcggttacagcaatattgatcaactgttacaagctactagtggccaatattggggattcccgggctgtcttatgtaagaatggcgtagccaaacaactatcggtggatcatgaaccaagcatagaaagtgaagatataaaaaacagaggtggttttgtgtcaaacttcccaggggatgtgccacgtgtcgatggtcagttggcagtgtcaagggcatttggtgacaaaagcctgaagatacatttgagctcagaaccatatgtaactgtggagatgatagaagatgatgcagagtttcttatactagccagtgatgggttatggaaggtaatgtcaaatcaagaagcagttagtgctatcagagatgttaaggatgctagatctgcagcaaaggtgcttactgaagaagcaaagaacaggaaaagctcagatgatatctcttgcgttgttgtgaaatttcagtga

SEQ ID NO: 3572 - DNA, 1716 bp, Glycine max var. Williams 82
atgaaacgtttcgtgtttgctttggccagggcttttgctctttttctagcatgttccttggcttctggtgctgttgtggaacacattttcaatgtggaaaacattactgtgcaacgtttgtgtcgtcaacaagtgatcactgccgtcaatggaaccctgccaggaccaacaattaacgctcgagagggtgacactgtagtcgttcacgtattcaacaagtcaccctataatcttactattcattggcacggaatttttcaatttttaacaccgtggtcagacggtcctgaatttgcaactcaatgcccaatagcttctggtagtagttacacatacagatttaacctaactggacaagaagggactctttggtggcatgcacactcatcttttctacgtgctacggtctatggtgctcttctaattcggccacgactaggacactcgtacccgtttcctaaagtttatcaagaaatccctatactagttggagaatggtggaatgctaatgttgtagaggttgagcaaaatgcaacagaaactcaacagccgccaattgaatcagatgcatatacaattaatggtttacccagcgatctctataactgctctcaggatggaacataccaggtcaaagtaaagcaaggaaaaacctacttgttgcgcataatcaactctgcactcaataatcaacacttttttgaagtagccaaccatacattaaccgtagttgccattgatgctacctataccaatcactacgacaccaaggttgtagtgcttgctcctggccaaaccgttgatgtcctcctaagaacaaaccaaagtgtgggttcttactacatggccttcactccataccattccgctccacttgtacaaatcaacgccaacatgactcgaggagtgataatttatgagggtgccacgtcagcaaagcccatcatgccagatctcccggcccaaactgacactccaacggcccacaagttttacaccaacatcacagggttggccggtgggccccactgggtcccagtgccacgtcaagtggatgaacacatgtttataacttttgggcttagctttgacatatgtcgcagtgatacaggagtttgtcctgggccagtacccttattttctgcaaacatgaacaacgagtcctttgtgttgccacatggcaaaggggtatcaatgcttgaagcgtttttccggaacgatgttactggggtgtacactagagattttccggatcagcctgcggttgtgtttgactttaccaacccaaacataacgtcgtcgccagatacacctcgtgaattcctaatcgcacctaaatcaacgaaggtgaagacgttgaagttcaattcaacagttcagattgtgcttcagaacacggccatcattgccgctgagaatcaccctattcaccttcatggcttcaattttcatgttttggctcaagggtttgggaattacaacgccactagagatgaacccaagttcaattttgtgaatcctcaaatacgtaacacaattgctgtgccggtcggaggatggtccgtcattagattccaagcaaataatccaggtgtttggcttatgcattgccatttggaaactcatttgccgtggggactatccacggctttcgaggttgaaaacgggccttcaatcagagtgcctccgccaccggctgatcttcctaagtgctaa

SEQ ID NO: 3573 - DNA, 465 bp, Glycine max var. Williams 82
atgagtcaaccagtaagaaagataaccttctcatgggaaaagaagcccggtgtctccaaagtaacaagtactcatcatggtgaaaatctgatcccaaaggaggaagagtttttggccaagttgccaccaccaccttgcacaccagaagaatcagctactactcatcacaaaaaccaccctcttcttgattttcaaattccacttcctccttgtgcttttcagcctcctttttatagaacttcctccaggaggtgcctttgggttcaggacaaagaccctttcctagcagctttcaaagagtgcaccaagaatcatcagaaaagtagtgctacggtgaacaaaaagttgatcaaagatggaattgagtcaagggtgagaaagagcatgtcctttttctcatgtactcgatcatgcaccgttcatgacactaatttggtcaggatctctcatctagacaaagattga

SEQ ID NO: 3574 - DNA, 441 bp, Glycine max var. Williams 82
atgttcttccacgaagaagccgaagcggttcagtcctcatactttccggttctcgaaaccatgttcactccaagcgaaatagaggagctgttttccctcgttaacgaaccggccagcccggggtcggggtctggatccggttcgcagggttcgaaccgggcggtccggtcctcgcacgagagaaagcttaggcgaatgcagtcgaaccgggagtcggccaggcggtcccgctggagaaagaagcggcatttggagaacctcatgaaccaactgaaccggttgagaatggaaaaccagaaatatagaaaccggttattcttaaccatgcaccagaatcttctactctccctggagaatgaacgtcttagatccgaatccatgacccttatggctagactctcggatctctatcaaattttaggcaccatgatttcacagtag

SEQ ID NO: 3575 - DNA, 240 bp, Glycine max var. Williams 82
atgtctaaagtggtcacactcttcactttggctcttctattaagcttcaatttaatccatgcctctcgtcctaatccttcacttaacgttgtctcttcttcgcatgaggatgttgcagctacaaaggaagagatagatgaagagagttgtgaagaaggcacagaagaatgtttgataagaaggacgctagctgcacatgtcgattatatctacactcaaaagcataaacccaaaccttaa

SEQ ID NO: 3576 - DNA, 558 bp, Glycine max var. Williams 82
atggattatcatcatatatctgctgcttcacaatacagtagtgctagtgaatcaggctggacccattatttggaccaatcctctctttctgaaaattactaccagaggagaggtggtgttgtggagtgtgaaggaaaaggagcaagaatggaggagtactctgaggaagatttgtccatggtctctgatgcttcttctggacctccacattatgataatgaatgctattgtcagaattggtatccttgcctttcttctaaagccaaagaatcccaaaagaagaacaagaaggtcaaagaatatggcagaagtcaacagccttcacctcttgatgacaccgcaagctctccttttttcaactcttccaaggagagtcacaagaagcaagatagtttctcagggaatggagcagtggagagtgcattggatttttctcaatgtgtatctgcaacaagaataaagagaaagacaaaattccagaagcactttggtttcttagagtctcttggtggaaaactagcctcagaggaacaaggtggttttgatgaagggaaatga

SEQ ID NO: 3577 - DNA, 894 bp, Glycine max var. Williams 82
atgcattcattctttttattcctcaacctctctactaagcttacttcttcccgatccaccttcccacgcgccatgtacacacaccgcaacgcctcgctctcacgcgccgccgccgactccctcggccatttcctctctccaccggacgcatccacggcgtcgccaatgcagtactccgccgccgctcaccaccaactcgggctgggcgagtttgacaactcggttcacgaactcaattactcggagatgagttcgagtaacacgtacaacagctgcagcagcgggtgcacgagctacatggggtcgccgagttcgctggcgagtaattacgagagtcggcgagtagtgcagaggagcgttagcagccactcgctgcagaagaatggtagggcccaccaccaacccttttctgagttctctcctcttttcgttgagttcattgactcggaaaacggtcccgtacggagagcttgcagtaccggtgaccttcagagattcaatggaatgcaacattttcagcattctgatagctcattgtcaagtgaaagtagtttgatcattgaagaaatgagcagaaccagtccttatagcccagaggagaagaaggtgaggattgagagatataggaacaagagaaaccagaggaacttcggcaagaaaattaagtatgcttgcagaaagactttggcagatagcaggccacgtatcagagggcgatttgcaaggaatgatgaaactgctaagaaccctccagctcagtggagtcacatgggaaatggagaggaagaggatgaagaggaagagaattgggctgatttctttgattccttagttcctgcaaatattgctcaggagcctcaaggcagtagttcctcctttggtgtgttctattaa

SEQ ID NO: 3578 - DNA, 723 bp, Glycine max var. Williams 82
atggctacctgtggtttatcaacagtgattttttcatttgtggttctaatgttattgtcagctagcagtcacacaatggttgctggagcacgcaatcttctcgaatcaacgctgccaaaaccagaagtgccacaacttcccaaacccgagttgccacctttgccgaaagtccctgaattaccaaaggcagagttgcctaagatccctacattcccaaaacctgagcttccaaaggtccctgaattgcctaagcttgagaagcctaaagttcccgagttgcctaaagtatcagaaatacctaaagttcctaaattgcctaaagcaccagagatgtttaaagtctctgaattgccaaaactagagttgcctaaagtagctgagatatctaagattcttgaattgtctaagcctgagttgcctaagattcctaaattgcctaagattcatgaattgtctaaggtccctgaattgtctaatcctgagttgtctaaggtttctgaattgcctaaggtccctgaattgcctaaagtacctgaattgtctaaacccgagttgcctaaagtacctgagttgcctaaggttcgtgaattgcctaagcccgagttttctaaagtccccgaattacctaaggttcatgaattgcctaagcccgaaatacctaaaatacttgagtttcccaaggttcctcaatttcctaaagcattttcaaccagcaatccttga

SEQ ID NO: 3579 - DNA, 2253 bp, Glycine max var. Williams 82
atggatattgctgctcttttaacttctgctggaattaatattgctgtgtgtgtggttctcttttcattttattctgtattaagaaaacaacccagtaatgttaatgtgtactttgggaggagactagcctctcagcattcaagacgcattgatctctgcttggaaagatttgttccctcccctagctggatattgaaagcatgggaaacatctgaggatgagatattggctattggtggcttggatgctgtggtttttgtgaggatacttgttttcagtattcgagtgttttccattgctgctgtcatatgcactattctggtgcttcctgtaaattaccatggaatggacagaatgtataagaatatacctttggagtcgctggaagtatttaccattgagaatgtcaaagaaggatcaaagtggctttgggctcattgtcttgcactatacatcataacattatcggcttgtgctcttctttactttgaatataagagtattactaatttgaggctactacatattattggatcacctccaaatccaagccattttacaattcttgtccgatcaattccctggtcttcagaagaatcttactgtgaaactgtgaaaaaattcttctcatattaccatgcatcaacatatttgtcgcaccaaatggtttataagtccggtaaagttcaaaaactgaaggatgatgctgaacatatgtgtaaggtaattagagatgcttcaatggaaaggacttgtaagcctagttttatgcaatgttgctgttctggagcaccaacaatttcttttaagaagatttctactgaaatgggtagtacgcatgggagaacttgcaacactgacttgcatttagatacaggaaaaaaggaatgttcctctgcttttgtgttctttaaaagtcggtatgctgctcttacggctgcacaggtactgcagacatcaaatcctatgttatgggtgacagatgtagctcctgaaccacatgatgtttattggtccaatatttgcataccatataggcaactttggatccgaaggatagctacacttgcggcctcggttgccttcatgcttgtgttccttatccctgttacatttgtacaaggcttgactcaactagaaaaacttcagaaaatgttcccttttctgacagggatacttaaagagaaatttgtgaatcaggtggtgactggttacctgccaagtgtgatattggttttatttttgtgcgcagttccacccgtgatgatattattttctgctgtggagggttctatttcccgcagtgcaaggaagaagagtgcatgttttaaagtcttgtacttcacaatctggaacgtgttttttgttaatgtatttactggttctgttatcagtcagctctcagtcttttctagcgtaacagatctgcctgcccaacttgccaaggcagtgccagcacaggctactttcttcacaacttacattttatcatctggctgggcaagtttggcagttgaagttatgcaaattttccctctactacgcaatcttttccagagattcatactcaggcttaaagaagatgcactggatggcagcctatcttttccgtaccatacagaagttccaagaatcttactgtttggattcctcgggttcacttgtgctattctggcacccctaatgttgcccttcttgttggtctactttttcattgcttaccttgtttatcgaaaccagattatcaacgtatacattacaaaatacgatagtgggggacagttctggcccattgttcacaacacaacggttttttcgttgctattttctcaacttatcgcactaggggtgtttggactcaaacgctcatcagttgcatctggattcaccattcctctgctgattggtacgcttctatttcaccagtattgtaggcaacggtttctcccagtatttaggagcaattcagcacagattcttattgacttggatcggagagatgggcacagtggaaggatggaagaaatttatgaacatttgcgttcagcctacaaccagtccagtttaatgccacataccacaagccaacccgaatgtgtcagtcttcacgaggacaaggatagtggtccatcttcatcagaagatatggagacaggcaatgaaaatgaaattagtcaaaaagatagaccacggcccattcaacgcacattgagtatgagttcagataaatccgtacttggtgtaaagcaatga

SEQ ID NO: 3580 - DNA, 420 bp, Glycine max var. Williams 82
atgtggttgaatctatccatcatattctgtttgaatgcccgaaaaatttatgcatttggtggcaatggtattgtctatttggtatctgtacagtttttccatcctctgtggaaactcacttctggaagcattgccttggatatgggtccaaaaatacaagagaaatctggaagatttatctggtgtgtcatagtttggagtatatggtgtcataggaatgattgcgtgtttaatgactttagctttgttggagataaattgctagaggaaaccaagtactctttctctcattggcaatcaaatactgctgcatgtattgtggatggtcatcttcaactacttgtctcgtgtttaatattggctgcgacagaggtgtggagttttcagctttatggtagaaggggatttgtttcaagttaa

SEQ ID NO: 3581 - DNA, 999 bp, Glycine max var. Williams 82
atggctttccctccccacgtagtagaggactgcatgggcctcctcaaactcctgagtgacggcaccgttttgcgctccaatatcaacttccaagaacaacctcaacctacccaacacgacaacctcgtacaattcaaagactttgtcttcctcaaaaaattcaacctccacctccgtttctacaaacccaaatttgaggacaatgatgatgacgacaacgaaaacaacaacaagaagttgttgcccgtggtgatgtttctccacggcggcggcttctgctttggctcgcgcgcgtggccacacatgcattcgtgctgtgtgcgtcttgccacgagcctccgtgccgccgtggtggccccggactaccgtctcgccccagaacaccgccttcctgccgcggtggacgacggggtggaggccgtgcggtggctccagcggcagaagggtcaccacggcggggacgagtgggtgacccggggtgttgactttgaccgtgttttcatccttggtgactcctctggcgggaacattgctcaccacttggcggttcagctcggacccggttcgagggagatggacccggttcgcgtacgaggttacgttctgctgggcccctttttcggtggggtggttcggactaggtcggaggtgggtccaccggaacaaatgctgacccttgagttgctcgacagattttggaggctgtcaatacctattggagagacaagagatcacccattggcgaacccttttggacctaacagtccaaaccttggacatgtgaagcttgaccctatcttagtaatagttggtggcaatgaattgctgaaggacagagcagcggactatgcaacaaggttaagagaacaagggaagaacattgaatacgttgagtttgaggggaaggaacatggctttctcactcatgattcgcactcagaggctgcagaagagctcgtgcaaatcattaaacgattcatgcttgaaaattctaattag

SEQ ID NO: 3582 - DNA, 1110 bp, Glycine max var. Williams 82
atgggggattccaatgtcaccaagaatcacctgtttgcaacttctcctcaacaaactgaggatgatgcttgcctatctgcaatgctgctttgcactaatctagtgtaccctgcagtactgaatgctgctattgagttaaacttgtttgagatcatagctaaggcaacaccagctggtacttttatatcatcccatgaaattgcttctaagctcccaacacaacaccctgacttgcctaataggcttgaccgcatgctgcgtttgcttgctagttattctgttcttactacttccactcgcaccacacaacatgcagcctctgagacagtttatggactctcacaagttggacaatactttgttccaaatggaagtagtggctatttggcttcattcacagcatttgtctgttatccaccactcttacaagtttggttgaacttcaaggaagcagtggttgatgcagacattgacttgttcaagaaacttcatggagtaacaaagtaccagtacatggaaaaggatccaaaaatgaaccaaatttttaacaagtcaatggccgacgtgtgtgcaacagagatgaccagaatacttgaaatatacactgggtttgagggaatatcaacattggttgacgtaggaggtggaaatggacaaaatctaaaaatgatattgtccaaataccctttaattaaaggaattaattttgatttgccccaggtgattgaaaatgcaccaccccttccagggattgagcatgttggaggagatatgtttgtaagagttccacagggggatgccataatactaaaggctgtatgccacaattggttagatgaaaagtgcttagaatttttaagcaattgtcacaaagcattgtctccaaatgggaaggtgattgtggtggagttcatattgccagaagaaccagaaccaactgaagcatctcgacttgtttccactcttgacaacctcatgtttatcactgttggtggaagggaaagaactcagaaacaatatgagaatttgtgcaagctctctggattttcaaaatttcaagttgcttgtcgtgccttctctagtctgggagtgatggaattttacaaatag

SEQ ID NO: 3583 - DNA, 1296 bp, Glycine max var. Williams 82
atggatatctcattgccattcacagtcctcttgattatctcaatcctctgcaaccttaaaggactcgaacattcttcactggtagagggagagggaatggatttcagcgagctgagaaaagcagtggaggaggttgaactggtggatggtcactcccataacatagttgccctaaactccacctccatctccggttttgttcaggcctttactgtgggagcctttgttgatgctgatgccattgcttttgcacaaacctctctatccttcaagagaagtttgagagatgttgctgagctatacggaaccgaggtatctttgcaaggtgtagaggaataccgtaaagcgtctggaatagaatccatcagctcaacatgcctcaaagctgcaaaattctccgccatactcattgatgatggcatagaaatggacaaaaagcatgacatgcaatggcacaaaaattttacaccttttgttggcagaatcttaagaactgaacgtgtggccgagcaaatccttgaacaaggtttgcctaatggatcttcatggacaatcgattcatttactgaagcatatgtctcaaaggttaaatcagttgctaaagagatccatgctttgaaaagcatagctgcatactacggtggcttagaaatcaatttaaatgtgactaaaacggatgctgaggagagtctgaaagaggtgttaacaaatactacgaaacctatttttctactaaaatacaaaaattacaaaaatcttgttgactacctcttcttgcaaagtttggaaattgctctatcttatgacttgccaatgcagatacacacaggctttggggatagacttttggatttgaggaagaccaatcctcttcatctccgttcagttcttgaggacaagagatattcaaagtgtcggtttgttttgttacatgcatctcatccatactcaaaggaagcatcatatctagcttctgtttactcccaggtttaccttgattttgggttggcaattccaaagcttagtgtacatgggatgacttctgcagtcaaagatttgctaaatctggctccattagataaggtgatgttcagcactgatgcctatacatttcctgaaaccttctacctaggtgcaaagaattctcgcgaagttgttttctctgttctgcatgatgcatgcattgatggtgagctctcaattcctgaggctgtggaagctgcaaaagacatccttgcaagaaatgcgatccgcttctataagattagttcacccaacaatgctggccctccttag

SEQ ID NO: 3584 - DNA, 489 bp, Glycine max var. Williams 82; identical to SEQ ID NO: 1962

SEQ ID NO: 3585 - DNA, 1149 bp, Glycine max var. Williams 82; identical to SEQ ID NO: 1972

SEQ ID NO: 3586 - DNA, 303 bp, Glycine max var. Williams 82
atgcatatgaatatgatgaagaaggtgtgtggtgggtttgcattaatagtgctggtggcactagtattgcttgtgattccccccaaggcagaggctgtgacttgtagcccagtggaattgagtccttgtttgggggcaatcacttcctcatctccaccatcaactacttgttgccagaaggttagggaacaaaggccatgcctctgtggttacctccaaaatccaagtctgaggcagtatgtcaattctcctggttccagaagggtcgctagctcttgtggggttcccttcccaacttgttaa

SEQ ID NO: 3587 - DNA, 165 bp, Glycine max var. Williams 82; identical to SEQ ID NO: 2066

SEQ ID NO: 3588 - DNA, 324 bp, Glycine max var. Williams 82
atgaagattcaatgtgtgatgctgtgcattatgcttcttagtctttttctaattgaagcagacgtgtcagcaccagcaccagcaccagcaccagcaccagctccagtggcagagtgttgcaacgtaatggagttggttccatgtgctgctgccttcaccacctcaaccccgccctcaccagagtgctgtcaaagactcagagagcaaccaagatcatgcatttgccagtacatgaaagacccaacacttgagaagttcatcaacacttccaatgccaagatggttagtgacagttgtggctccccaatgccaaccaattgctga

SEQ ID NO: 3589 - DNA, 291 bp, Glycine max var. Williams 82
atggccctcactagaagcacagtggtattggctcttctctgcttcatccttatacaagagttggggatctatggtggagattcgcacagggttgcttccaataagatagattgtgttggaaagtgcaattacaggtgcagcaaggctgggaggaacgtaatgtgcctaagggcatgcaatgcttgctgccagaggtgcaactgcgtgccaccaggcacttctggtaaccgagatttgtgtccttgctatgctagactcaccacacatggaggacatctcaagtgcccatga

SEQ ID NO: 3590 - DNA, 675 bp, Glycine max var. Williams 82
atggcttgctggtctgcagaaaatgccacaaaggcctacctcagcactttgaaaatgggtcaaaagtgcaaagagccagatgtagcagagtttatatcagcactagctgcaggaaacaatgcacaacttatggttgtggcatgtggtggtgcagctgactccaccacactagcattggttgctgctgctaaccaaactggtggcaaagtcatttgtattgtccctagccatgaagagctaagagcttccaaaatttccatgggaagaatggcttctcatcaagttcaattcatggttggagaagctcaagaagtgcttttagagcactatgatcaggcagcagattttgtgctcattgactgcaaccttgagaaccatgaagagatccttagagcagttcaagagggtaggaagcaaaatgggacagtggttgtagggtacaatgcatttagctgcagaaagtcttgtttggcatgtggttcaaaaactcagcttctgcctataggaggaggtttacttgtgacaagatttggagtgagtgaaacaagtccaaaatatggaaacagaattatgggaaaagtcaaaagccgttgggttgtaaaggtagataaatgcacaggcgaggaacatgtgttcagggtcagatttcctcaaaggaaagtggtccaagcttaa

SEQ ID NO: 3591 - DNA, 1791 bp, Glycine max var. Williams 82
atgaacaaatcctcagatgcaactgcgtctcctacgtgcagaggcagatacaaaaaacccaatttccgaagctccaagtcccaacccccaagccccgtccagttcagctccaagacgccggagaagccgccgcagcgaatccgcaaccgtggcgtcgcgctctccgtcgctgacatcagaaaggccgcctgcaagcgcttgcaggatcagaagcaatgcactgaaatgacgtcggcgccatcgtcatcgtcgctgaacaagagtgtcaggaggcaaatctcactgtggccttcttctcccagcaaaccaaagactactgatgatgaatccaacaagcttcccgagaaatatgaaattttggatgagttcttcgatcgcttggatactttggtttcattgcaccgtctgaaacggtggactccaacctttacttcaatcagttcaaggattgaatctttaactgacaggaggtttactcacagtcatctagcccagttgaaatttatcttgcctaatgctattgttcttaagaagcatcttgtgcttgatgaacggacgagttgtatgaagccggatattcacatttctttagaccctgatgcggtagaggccgatgatgccaagttgcccccacaacgtgggagagtgtcgctgaagaaggtgtttcgggcacggctaagagatttttgtgaatctcatcctgagggtgatgaaattccagaagggacattgcctgagccattcaatcgcccaaagaaagacagtgttttggacatgttggaaactcgcctcccaacaaaattgccaccctgcatgcgttatagtgacattgtcaataatgcagagtctgctaacttggatgagaaattgtctgtacttgtcaatacatcagttgaattgcctaatgagcatctggcagcaccttctcacatgtctccatcctttagagcagatgatgtacagaaaaatcctctgttagatttattacagcccctggcttttccagtttcagagtcaagccggaatgaaaatacaccctttgtggatactgaatctcatctgaaaacgtccccagctaagttggcttcagaagcatctagtagtgaaagttgtctaacaatttgtgctcctctggaatcatcatgtgctcaccctgctactccaagcaaaaccactgagtacaccgaaaacaaagatgggtctctcaagagcattgatgccatgtcaactccagctaaacttgtttctactccaattaggttgatgagtgccacacctgccttgcggtcacccaaaaggcattatatgagcccagatgaccactctatcagttctttgaacaagttagctcggcgtccacctcgctcaaggtcattgaaatttgacactccagtgaagaacaaggatgatatttttgacaccctccaagaaagtactatccaatcgattagagaaaaggaaaggctggccatggagaaaagagacccagctatcacagaagcaaagaaacgaaagaaaaatatagctagcctccctaagctctttgacatgatacgtgggttacttagacagcggaattgtatcactaaagcagagcttgtaagcaagataatctcaagccgatgtgatattgctgacagaagtgaagttgaagagcagctaaatttgttgcaagaactagcaccagaatggatttctgagaagcaggtctctagtggggatttgctattattcataaataaaatgttgagccctgaaaccgttcgagcatcccttgaagaagcaacatag

SEQ ID NO: 3592 - DNA, 435 bp, Glycine max var. Williams 82; identical to SEQ ID NO: 2027

SEQ ID NO: 3593 - DNA, 891 bp, Glycine max var. Williams 82
atggctttgataactctgttttctattttattctttatgctaatggcctcttcaagcaatgcctactggccaccttcacctgattacaggccaagttccaaattcaggcctgtgaacttctatagagggtttaataatctttggggccctcagcaccaaagcatagaccaaaatgcattaacaatatggcttgatagctcctcaggaagtggcttcaagtcaaatcgaccatttcgatccggttactttggtgcttccattaagctccatcctggctatactgcaggagttataacagctttctatctttctaacaatgaggcacatccgggcttccatgatgaagtggacattgagtttcttgggacaacatttggaaagccttatactttacagaccaatgtttatataagagggagtggggatggcacaattattggcagagaaatgaagttccacctttggtttgatcctacccaaaactttcatcactatgctatactttggagtcctaaggaaataatattccttgtggatgatattcccataaggaggtaccctaggaagagtgctgaaacatttccactaaggccaatatggctttatggttcaatatgggatgcctcatcatgggcaacagaagatggtaagtacaaggctgattacagataccaaccttttgttgcaaagtacaccaacttcagggctggtggttgctcagcctatgcctctcgtcggtgccgcccggtctcggcctcgccatatcgctccggtggcttgaccagacgccaatattgggccatgagatgggtgcaaaaataccacatggtctataactattgccaagaccccaaaagagatcacagactaacacctgagtgttgggggtaa

SEQ ID NO: 3594 - DNA, 675 bp, Glycine max var. Williams 82
atggagaaaatgagagtgatactaatgactctattcctatacataggtacgttagttgcagaagatgctgatattgacaaagctattaataatgcaagagatgctgatattggtaaggccattaatccaacagaagacgctgatattggtcttcttagcgaacctgaggcctatgagtctcccgtattcaaaaaatacgtgacacagtgcactccgcatgttgctacaacatgcagtattacaagtaggacggacttaaagattgaaagtgaagcaatattgggtctttgtctttttgattctatggagagatgcttggtacagcatgaaataggcaacgttaattatcgattattcaggccaccaagcccaccaccaggacgaggaccaccaattgaaccaatagatccaattcccccatggattccatcaccacccatagttcctaggaccaaactagataaccatcaacatctccaatattatcagacacttctcactgagactacaaaattccgaaccgtcttgagaagatgtactcatgttagtgcacagagttgtctcactgctcctaatgttgcttcatccacacttttagcggcttgtctcattccatccatgaatcaatgcgtgtatcccgctagagctcaatctgcaagctcacctcagatatga

SEQ ID NO: 3595 - DNA, 828 bp, Glycine max var. Williams 82
atgggtatggcagtgcaagccaggttaggggcatgcaacccaattcgaataccacaatgttccggtgatcgtgacgatggagggcggcctccggcggaggaatttgcaccattagccaccaaatttcagaggcggcttcttgtgggggttgggtcagcttcactagtggctgtgggtgcaaactttggtggcatcaccagttttcttctcggtttgtcgccacaaagtgggcgtaatctcaagctggacgtgctttatcccattggaggttacagccgctgcgttgacacaaaggaaggattcgaattcatatacccagcaaattgggtgggagatcagacgctgctgtatcgagctgctaagaaaagagagatggaacgatcattggatcctcctccgctgaatgaacggcggcgttctaacatcaatgaaccggttgttgcatttggtcctcccggttccactggagaactcaatgttagtgtcattgtttcatctgttgctccagaattctcgattgaagcatttggggggccagatgaggtgggtgaagcagtggttcgaagcataacaggatcagggcaacgccctgacgttaaggggacattaataaaatcaagtttgagagaggattccgttacaaatgtcaaatactacgaactggagttcagagttgagagtccctcgtttaggcgacacaacgtttccgtttgctgcgctcgtgatggcaggctttttacattaaatgctcaggcacctgaatcagagtggccaggattgaagtcagaattctataggattgctaattcatttagcctcacaatttaa

SEQ ID NO: 3596 - DNA, 579 bp, Glycine max var. Williams 82
atgctatcttatattttcaaggatatgggtgaaacacgttttctcaaaaattgtaccttcttgatggcgattcttactctgctttctagctttctcttgaaccatgtcatggctagtgtttacactgttggtgaccaagaagaatggagtagccaaacaaattatgcttcatgggcagagagatacaattttagccaaggggatgttcttgttttcaagtacgtgaaagggcaacataatgtttatgaagtgacagaagacacattccgatcgtgtgatgcaagtagtggagtgttggccaagtatgagagtggagaagatcaagtggcactcagtgaggtgaagagacattggttcatttgcaacatagcagggcactgccttggaggcatgaggtttggaattgaagtaaaagatggcaacagtgttactaattccacggatgttgcatttaacccaccaattgaaccaactccctcgcataattcttgtacctgttattatgtgtctgaaagatggagagtgattgagaattttattcctttaggattattattattgttgaactattacttttga

SEQ ID NO: 3597 - DNA, 111 bp, Glycine max var. Williams 82; identical to SEQ ID NO: 2035

SEQ ID NO: 3598 - DNA, 972 bp, Glycine max var. Williams 82
atggagtcacagtgtgcaatcaagaaagatgccactgaattgataggtaataccccaatggtatacctgaacaacatagtggaggggtgtatggcccgcattgctgctaagttagagtccatgcaaccttgcttcagtatcaaagataggacagcatttagcatgatcaaagatgctgaggataaaggcctcattacaccgggaaagagtgttcttgttgaggctacaagtgggaacacgggcattggaatggcattcgtagcaacattgaaggggtataaagtcatagtggctatgccagcttctgtgagtcttgagagaaaaattgtacttcgagcctttggagctgaagtctatctcactgaccctgccaaaggaaccgatgcagttcttaggaaggccgaggagatagtgaataacacgcccggaagttacatgctccgccagatagataatcctgctaatccaaaaattcattacgagaccactggtcctgagatttggagagactccggagggaaagttgatgctttggttgcaggggtaggaaccgggggtaccataacgggtgctggcagattcctcaaggagagaaaccccaatgtcaagctgtacggcatagaaccagttgaaagtgcagtcctcagtggaggaccgccaggtgatcacctaatccaagggattggtaatggtctcattccaagtgtactggattttaatctcctagatgaagttattcagatatcaagtgaagaagctatagaaactgctaagcttcttgctttaaaagaaggtttgttgatgggaatttcatcaggagccgcagctgcagctgccataaaattggggaagagaccagaaaatgccggaaaactcatcgttgtggtatttcctagttacggggagcgttatttatcttcaccattgtttgaatccattcggcatgaagctgaacagatgacatttgattaa

SEQ ID NO: 3599 - DNA, 327 bp, Glycine max var. Williams 82
atggaagtgatccagcaacgtcaggctcaatcattctgtgtagggacgagacagatccaactacatgaagtgcaacggagaaccatacatgacaaccgaatgaggatacaaaggaacagggacagggcatctactaattataagccatctccaaggagtgaacgaaaacccaataatgaatcgcgatggaatcacgacgagaccaagagaaagcgcagagtggccaaataccagctttacgaaacccaaggcaaggccaagtcttctcttaaggaaggatttcgcagtattaaggtcacgtacatgaagatcgtcgccaatttttag

SEQ ID NO: 3600 - DNA, 1065 bp, Glycine max var. Williams 82
atggcacagaaaaaagcttctcatgtgcttgtatgcaaagagttaaagccacacctgctaatggtcttagtccaggtgggctatacctttttgtatttcatcactgaagcctccttcaatcatggtatgagcccttatgtgtatgtaacctatcgccatattgtggctgcggttgtgatgttcccttttgcatactttttggagagaaatgcaagaccgaagctgacatttgctcttttcatggaaatttttgtgctttctctgttaggggttagtgtgactcttaatatgtactttgcaagcctaaaatacacaaatccgacctttgttgcttccatgatcaacaccatagcttcccttaccttcatcattgcagtggcactcaggtttgaggttcttgatcttcgaaatcctcggggtatagcaaaagttattgggaccattatctccttagctggtgttttgatcatgacactgtacaaaggacccgttatgagaaatttatggcatccactaatccatattccagggaaaagtgctgctataaatgaagactggttaaagggttcaattcttacagtttcaagttgtgttacatggtctttatggtacattatgcaggcatccactttgaaaagataccctgcccaactctcactcaccacgtggatgagctttgttggagcagcacaatctgctgctttcacagttatagtagaacacaactcttcagcatggactatagggctaaacgttgacttgtggtccacaatatatggtggagttgttgttgctggtttgataatctacattcaactatggtgcactgagaaaaaagggccagtttttgtcacagtgtttaatcctctttctacgatattagtggcaattctagcctactttgtctttggagagaaactttatttgggcagcatcataggtgcaataattgtcataattggtctgtactttctgttgtggggcaaagaaggtgaccaagaggtttatatgaagaccaaagataaatcccagtgcagtactgtagacccagaatgcagaatatag

SEQ ID NO: 3601 - DNA, 1053 bp, Glycine max var. Williams 82
atgcaggattcattttcctcagagtctccaatgcaggatataccactacttttacctcaagaagctgatggactagatacttcaaatggagatcataaaaatttaagtggaaattctccattattgtcccaaaagctggagcatgaaactttagtttcagacacccagatgaaagggtttcaagttgaagttgttccttacttgggggcacaacctgttgtcgttgctctagataattgtcgctgtaaattctttataaaaggggaaaaagtttacaatggtgtgaagaataattattttgtggatgatatgccatgtcagaaaccatatgcttatacagaaagggtaatcagaagtgtcagccagtggtctgctggaacaagtcagcctgaagaaagcattcacactgcatattgttctcttattgaagaagcaaagcattttatctacattgagatctctcccaaaatgccctatttggctccctcaacaacatgtcatttctcccctcccactccaacctccaatccctcaacctctccaccaacctccttgaatgcgatctcttacaacaaccaacgacatcgaagacgtcggagaacgagaaagaagacagagggagagtgcaagttgtcattggtcttctccgtgtcgatccagacgccgacagtggcagtgcgggttggtgttggtattgatcgtgaccgtggtaagttcaaccacctccgtgtcaccgacttctcttacaacaaccaacgacatcgaaaacgtcggagaacgagaaagaagatagagggagagtgcaggttgtcattggtcttctccgtgtcgatccagacgccgacagtggtagtgcgagttggtgttggtattgacggcgaccgtgcttttattggatcatctaatataaatggtcacaattttcttggattaagagactctaagatgggagtgattatagaagacaaagaatatgttgaatcattgatgaatgggaaaccatggaaggctgggaaattttcctatagactccgctgctcattatggcaatga

SEQ ID NO: 3602 - DNA, 438 bp, Glycine max var. Williams 82; identical to SEQ ID NO: 2026

SEQ ID NO: 3603 - DNA, 3363 bp, Glycine max var. Williams 82
atggataaccatcaacatgaaaagcatattgatccagcacaagcaaggatgaacagaaaatgtatcaggcaacacaaagttgatgatcagcctcaccacattgtgcatgcacatgtcaggtactctgatcttggtgaccaactcatgcaatgtagccactgtaatgcaaatatgtggtatgatgaaagaatctcaaaacgtgtaagtactacaaacccaacattcaacttatgttgtggaggtggcaaagttgaacttccattgttacaaaatccacctaaatatctccaccaacttttgtatgatcatgatacatctgatagtaaaaattaccaacaaaacataaggacatataacattatgtttacctttacttctactagtattaagttcgacaaatcaattaatcattcaagaggacctcctacaataagaattcaaggtcaaccatgtcatagaataggaagcatgttaccaatgcctgggaaagaacctcaatttgcacaattgtatatctttgacacagaaaatgaagtgcagaataggattaatgcagtaagtccacataatcaaattcaagcacacattgtttcacaacttagtgagaagctagatgaatacaacgcaattttgatgcaaattcaaagagatattattattgaaacccagcatggacaattacaaaggatccatgaattacattctagttatctagctctacaataccctctcctatttccttacagggaagatggatatagacctgatatcctacatagtagtacaccaggtagcaagaaaaggaagagaaatcgtcttacaatgagggaccatgtgggcttcccaaatctgtttattactttaatctacaatccaaattggcctgaaatccatagattgttgaatcccttgaatctgaaagcaacagatagaccagacataatctccagagtcttcaaactaaagtatgaacaaatgttgatggacctaacaaagaatcagatggtagggaaagggatgcctcatgtccatttgttacttgttttacatcccggtaacaaatatccatcttcaaatgaaatttatcaaattatatcaccagagataccttcacagcaagatgatccagaactgcattcattatgcagtcgtttctatcctaaaatgttccagccatatattgttttagatgcagatggttatctagtctatcgtaggagaaacaatggtcacacaattcataaaaatggtgttataattgataacaggtatattgtaccttacaatccaagattgcttagaaaataccaagctcatatcaatgttgaatggtgtaaccaaagcacttctatcaaatatttatttaagtacatcaacaaaggatatgatagagtaactgttgttttgattcatgatgataatgatccaattcacaatggtagtactcataatgatgagatcaaagaatatctagattgcagatacatatgtccctgcgaatctacttggagaatctttgggtttccaatacatggcaaaaaacctgttgttgaaagattacagttccatcttccaggccaacataatgttgtctatgaagaccatgatgatattgatgatgtgctgtctaaaacaaatatctcagattcaaagtttatttcatggatgaacatcaaccaaaattttgttgaaggaagaagtcttacttatgtagaatttgtttctaagtttgtatatagtaagaagaaaagatgttggcagcttaggaagaaaggctacaccattggtaggttactatgggatttaagagcaattggtaatgttcaataccctacatatagagaagcatgttttgctatgggtcttttgcaagatgataaagaattcattgaggcaatcaaagaagcaaaagactggggctcagcacattataaggaagctatttcattacagcttgatgataggactcttcaaaatctggtcttgcttgaaattgaacaactattgcaaacaaatcaaagatcgcttacagactatccttcaatgccatatccagaagatgcgaattgcccaacctatctccttatattagctgaactcaattacaacaatgcagaactcatatcagagtttgaacatctattttctcatatgacagacgaacaagcatcaatttataaccagattgttgaagttgttaataaagatgaaggtggtatgtttttcctctatggatatagaggtataggaaaaacatacatttggaaaacactcgcaagttcactaaaagctgacaataaaattgtaattatggttgcttctagcggcataacttctctactattgcatggaggtagaactgcacattcaaaattagttctagtttttgaagactcaacttgcaatatccatcaaggaactcaattagttgaactattaaatcagaaaagtctaatcatttgggatgaagcacccatggctcacaaattctattttgaggcacttgatcacagccttagagatatcatcaaacacaactcaacggataataaaatctttggaggtaaagtcatggtctttggtggagattttcggcagatcctgccagtcattccaagaggcagccactctgatattgctaatgcaaaaattaattcctcttatctatgggatcattgtcaggtcttgaggctgacaaaaaacatgcgtttacaaaacaacatgcaagcaacagatcaagaagaaattgcgtcttttgcacaatggattatagatattggtgatggtattattggacatgacaatgatggctatgctactattgaaattccacaggaactattaatcatagaatataatgatcccattcatagtatagtcagttctacattcccagatttatgtcatcatcacaatgatcctgaatacttccaatctaaagcaatattagcttctataaatgaaacaatacaacaagttaatgattatatacttacattgataccaggtgaacaaatggaatatccgagctctgattcagttgacaaatctgaaaccattgaaagttgtcattttcgttcactcataactgaatttcttaattcgttgataacatctggcttacctaatcattgtctcacactcaaaattggaacacctataatgttgttaaggaacttagaccaaactcaagggttgtgtaacaatactaggttaattgtgacaaggctagcacaacatgttattgcagctgacataatttctgtgacaaatgtcggaggtcatgtttatatcccaggaatgtctatgtcgccttctcagtcaccatggactttagcattaggaaatgtactatttccttag

SEQ ID NO: 3604 - DNA, 1077 bp, Glycine max var. Williams 82; identical to SEQ ID NO: 1959

SEQ ID NO: 3605 - DNA, 1800 bp, Glycine max var. Williams 82
atgcaacttgggaaatgggttgtggatcttgttctcatattttcacttctcagtcctcagttctccggaagtgtggcagagacaacatcctcttcaacaccaatctgttcagaagaagacagagcttctcttctcagattcaaagcaagcatttcacaggacacaacagaaacactgtccacgtggactagcagagactgctgcgatggtgggtgggaaggggttcagtgcaatccatccacagggcgtgtaaacgtgttgcagattcaaaggccagggagagatgatgatgatgaaacttacatgaagggtactctttctccttctctgggcaacttgcatttcttggaggtaatggtcataagtggtatgaagcatatcacaggacctattcctaatagtttctcaaacttaactcacctcacccagctaattctggaagacaattcccttggagggtgcattcctccaagtttaggtcgtttgtctttgcttcagagcctttcattgagtgggaaccatctgaaaggacagatcccaccaacacttggggctctgagaaaccttgcccaacttaatttagcaaagaattctctcacaggtcctatccctcttagtttcaaaacccttattaatttgcaatactttgatctcagctacaatttgttatcatctaccatcccggattttcttggggaattcaaaaatttgacttatttagacctatcctctaaccttctaaccggaaaaattccagtttccttgttcggccttgtcaatcttttagacttgtcattgagctataacaagctcacagggaacattccagatcaggttggaaatctgaaatccctgactagtcttcaactcagtggcaatctgctcacagggaatattccactgtccatatcaagattacagaacctttggtaccttaatgtatcaaggaattgtctttcagatcccttaccagtgatcccttccaagggtatccctgcccttttgagcatagacatgtcttataataatctcagccttggaattgtacctgattggatcagaagcaagcaactcaaagatgtccatctagctgggtgcaaattgaagggagatcttccacacttcacaagacctgactctttgagctccattgacctatcagataactatctggttgaaggtatttcaaatttcttcacaaatatgtccagcttgcaaaaggtcaagctctcaaacaaccagttgaggtttgacatttctgaaatcaaattgccaacagaactgtcttccatagatttgcatgctaatctgctggtgggttcactatcaacaatcataaataacaggactagcagctctttggaggttatagacgtgtcaaacaattttatttcaggtcacattcctgaatttgtggaaggctcaagcttgaaggtgctaaacttggggagcaacaacatatcaggtccaatcccagtttctatctcaaacttgatagatcttgagagactggacatttcaagaaatcacatactgggtaccatcccttcaagtctaggtcagttgctgaaactactatggcttgatgtatctataaacggattaacagggcaaataccgagtagcctgtcacagataactggtctaaagcatgcaaacttcagggcaaacaggctgtgtggtgaaataccacaaactagaccattcaacatctttcgaccggttgcttacgcccacaacttgtgcttatgtggcaaacctttagaaccatgcaagaaacaagggagtatgggtcagtga

SEQ ID NO: 3606 - DNA, 681 bp, Glycine max var. Williams 82
atgggtggcagtgttagcaagagtaggaggatgagttctgagaaatatgtgatgaatttgaaggagaaagtgaggctcttgcaagaggagataaaggagatgatgtatgagagggagaaggagacaaggagatatgagagggacataatggtgttcactttcaaggaggcagattcgaagcaagaggggaagaggctgagagaggaagtgaagcaattgaggagtttggtggaagagaaagatgagaagataagagagattgaggttggaatgatggagaagaacagtgagaaagagtgggaattgatgggaactaagctcttggttgagcagatgaaggaggagagagcaaggagagatgaagctgtggagaagtggaagcaactttatcttgcaattaagactgagctagatgaactcattcaaagaacatatgatggggatggtctgtattggaaagcagaggaaaatggcatccaaatggaaaatctgaagaaggagttgcaagaaaaggaagaaaccatcaaggccttaaaaactcaattgctttcaatggagaaagaaaagtacaaaaaggagagggagtttgacttgttaaggcaaagcctgaggatcatgaatggcaagaagaattcaattcaaacgaaagagaagctcttgaaaagcaaattgggaaaatga

SEQ ID NO: 3607 - DNA, 288 bp, Glycine max var. Williams 82
atggctcgctctttctccaacctcaaggttctctctgctcttgtcgccgacggattctccaacactctcaccaggcgtgggtacgcagtagcgacacaaagcgcaacaagaggaggagcagcctccatcagcggcaagtcaggggaagacaaggtactaggaggaggtgctgaaaaggtttcgtgggtcccagaccctgtcactggttactacaaaccggagaacatcaaagagattgatgttgctgagctgagagccacggttttgggcaaaaaattcaaccactag

SEQ ID NO: 3608 - DNA, 435 bp, Glycine max var. Williams 82; identical to SEQ ID NO: 2028

SEQ ID NO: 3609 - DNA, 951 bp, Glycine max var. Williams 82
atgagagcaccaaccatcctaaggagcctccccatgcggcagcttcaaccaagagcgccggcggcagtggcccctttgccggagaaaaccctgttcgaccgggaactcaccgccgagctggacaccctccggtcacaaggtgaattagggttggctcagttgcttgatgctgccatcaccacacagaaagttgcctcagattctcttgccaacgtttgttacaaagactatgctgaccgtggtgctgttgataagtacctagaagacaacgttgagatgcttgatgaatgcaactattttatggacaaaatagatcacatcaataagtacgtggactcattgagagtggtcgttcatttggtcgataagggtggttctgcaaagcctataactcgtgctttggagcttttggaatcatgtcaaggcatggaaaagagatgcaaagcaatggagaaacaccgtggctgttgcttgaagaagatgttgcggcaaaagctgtgtcatgaaactgaactcagtgaggttatgtgtggctctatggccatggccttgctgtgttgtaggtttcttgagcttggtctatcgtttgatccaaaacatggattgcccctgatgaagttttctcagcctatgagttcttcatggttgagattgtttcaggagttgataaatcaagctgagaagaaaagggtgcagagaaggaaaagttggtcttctttgttgatgcagacagtggctgcagctagagaattgaaggagcagatgaagagtaaaagggaaaaggagatgaagtatgctgttgagagacttaagatatgctgcagggaactggggcatggggttgagattgttgaggaaagagtgaaaattctgtataaaagtttgattgacgttagaatgattttgttgggaattctttcccagcccactacagtgtttagatctgattaa

SEQ ID NO: 3610 - DNA, 753 bp, Glycine max var. Williams 82
atgaagtttgagaagatcctgaagaggctgattgagcagacgctgcctgattggcgcgacaaattcttgtgctacaaaatcttgaagaaacaattgaacgttatgtgtcccgaagatggccaagctccaccccaattggatgccaacgaactcaaccacttccttactctcttgcagctcgagattgacaagttcaacaatttctttatagacaaggaagaagaatatgtcatcaaatggagggagttgcaagacagagttgtagaagctgtgaattcaaatgtagacctgatgtcattggggacggaaacagtagattttcatggggagatggttttgttagagaactacagtgctctcaactacacaggtttagtgaagataataaaaaaacacgataagaaaactggtgctctacttcgctcaccttttatccaagctgtggtgaagcagcccttctatgaaattgatgcgcttaacaagcttgtaaaggagtgtgaggtgatactaagcattcttttcaacaatggcccgagctcatcaataagccaggattttatgcaaaatggttttggctccatgagtgataaagaaaataaagagactgtaatgcaggttcccgaagaactatctgaaataaaaaatatgaagaacatgtatatcgaactaactctaacagcactgcataccttggagcaaatcaggggtagaagctcaactctaagcatgttcccatcttctccacacaactag

SEQ ID NO: 3611 - DNA, 660 bp, Glycine max var. Williams 82
atggcaagcacaagaaatctgaagcacctcaacctgaacctgaacctgaacatgtgttgttcaaattcagctactcatgaatgcgaatctcctccattgagccccataactagttcctcaaatcacaataacactactcaatgtccttctccttcttcaattatgataaagaacttcaactctatctatgaccctaccttaacctctcatgaccactctttcagctctaccttcttcgagcccgaacccgctgacttcgccaccgccttcgcctcccaacgcttcttcttctcctccccgggcctctccaattccctagttgaatacaacaacaccaacaaaagtactactcgacacccagcattgttgagagaacatggtgagaagatgaaggaggaggaggaggaggaggagaagaagaagaaggtgttgttcaaggggagcgtggcggtggcgacgtactcgccggatccttacgtggatttccggcggtcgatgcaggagatggtggaggcgcggccggagctgatggacgtgaagtccaattggaatgttcttcacgagcttcttctatgctatcttgcgctgaatccaaagagcacacacaagttcattcttggagccttcgctgatcttctcgttagcctcatgtcattctag

SEQ ID NO: 3612 - DNA, 1701 bp, Glycine max var. Williams 82
atgagtttgaaggagaatgtagctaagacaggcaacactgaggacaatgctagtcaaatgtggaccttatgcaaacatgctttctatgatttaactcatgtttctccggtggtgtttctgttcctgctgaaagaatgttattattatggcacatgtaaggcatcaacaaaattccgagcccttcaacatcaagtacatcttgttcttagtaatgatccaaaacccgaaccagcaacttttattgttcagtgcatgtatgtctctccattatttgaagatcatagtcaaggatttactcatctgataatatctgctcttcgccgattcctgaaaagatcaacaaccactacagaagactcattggaggtgaaagacctagttgcccatctacttgtagatattatttggggccagatcgatcatgatgaaaagattgtcctgaagctactcgagatttttgatgtaaaactaacaaatgttgagaaagcaatgtgtcaaattaaggaaaaacatgatttaagttgtggtacagcaaaagaatttgttgaacagtatattgttgagttggtaaaatcccagttgtacatgacagctgtcactttaatagagcaattctctgtctaccagtatggccagtcttttctccttgatatgatacagagtaatcaattcaaagccgcagagaagtgggcaacatttatggggaaacaaatgctatccacacttgtagaggagttcattgagaggaacatgctaaagaatgcccatgagattataaagaaaaataatctaaagcaggattttcctgatgtatacaaaaggtgtaaagaaagctcactaaaaaacttggcagaaaaaggatgctgggaggttgctgaggcaagaataaacaatgatagacagcttatggaatatctggtttatttggcaatggaagctggatacatggagaaagttgatgaactgtgtgatcggtactccctatccaggtttttggacatcaatgtacctgaaacaagtaatctgcaagggcattatttaaatcttgatgaattattggttgaaagcatcatttgggttgatgaagttgaaggtttgcttgatgcaacaaggcatattgagggttttaaagttataggtcttgactgtgaatggaaacccaattatataaaaggcagcaaaccaaacaaggtttctatcatgcagattgcttctgaagattcggcttttatctttgatctgataaagttacacaaagaagtgcctgacattttagataactgtctatctcgcattttgctgtcacctagaattctaaaacttggctataatttccaatgcgatgcaaagcaacttgcttattcgtatgaagagttgagatgtttcaagaactatgaaatgttgctggacatccagaatgtttttaaagaacctcggggtggtttggctgggcttacagagaaaatactgggagctagtttaaacaagacaagacgaaacagcaattgggagcaaagacctttaactccacatcaattagaatacgctgctctggatgctgttgtacttgttcacatattccgccatcttccttgtcaaggacataataaagataaatctgagtggaagtcttgcatcgtgtccctcaccgaaaacgccaagaaattcaagaaatgtgtaccaaagattgtagacacttga

SEQ ID NO: 3613 - DNA, 318 bp, Glycine max var. Williams 82; identical to SEQ ID NO: 1952

SEQ ID NO: 3614 - DNA, 288 bp, Glycine max var. Williams 82
atgcataagatgttctgcattcaaaatactatcattttactactttttgagtctcccacaaggtgtaattatactctttggataatccatgctcgggcatgcaatgagattcgatttgtgaagagacaatattgcaggtttgggtggtataacgaggatcctcaggtaagcaaaaataccaaggggaagaaagaaagcatggcccaatgccataacaatgaatacttgaagtcaatgtattggaataagcatggattaccctttcgatacatagcatcatggcgctga

SEQ ID NO: 3615 - DNA, 2295 bp, Glycine max var. Williams 82
atggtgaaattctcgaaggagctcgaagctcaattaataccagaatggaaggaggcctttgttaactacaggcagctcaagaaacacataaagaggatcaaactcacaagagtctccaagcaatcacaagccccagaagagtcctttggtcgctccgttttcgattcgtttcgcttcataagaaacaagttccgctactcagacaacaataatttacaagacataattcaggtgaggagaaaaacaacggaggagagtgaagaggtgtatgaaacggagctggcgcagttgttttcagcagaggatgaagtgcaggtgttttttgcaaagctggatggagagcttaacaaggtgaaccaattctacaagaaacaggagactgagtttgttgagagaggagaaatgctgaagaagcagcttaacatcttgctagacctcaagcaaattcttagtgaccgacgcaagaaaaatccgtcgctaaagccttctaatactggagtttttcctcgttctcctggccaagattccaattactccgaatcaaatgatgataattcagaagtttcactaatggatgaagtaatctcaacgttggaaagaaatggtctaagttttgtgaattcggcaatgagggtaaagacaaaaaagaagggaaagcctcatatggcaataagaattgatattccagccaccactcctacggctgttacttccatgttgtgggaggatttagtgaacagtccaatgaaaccagggtatggtggagagttcattaacaagagaaaaattcaatgtgctgagaagatgattagaagtgcatttgtagagctctataaaggtcttggccttctcaaaacttacagctcattgaatatggtagccttcacaaagatactcaaaaaatttgacaaggtgtcttgtcaaaaggcttctgcaaattatttgaaagaagtgaagagatcccatttcattagttccgacaaggttgttagactaatggacgaagtggaatctatattcacaaagcactttgccaacaatgatagaaaaagagcaatgaagtttttaagaccccaacagccaaaagcttctcatatggtcaccttccttgtcgggttgtgtacaggttgttctgtatccttgttttgtgtatacgtaatcttggcgcatatgtgtggtatattctctcctagtacagagccagcttatatggacatagtctaccctgtttccagtgtgtttgcattactaagcctacacttgtttatgtatggatgcaacctgtacatgtggaagagtacaagaatcaaccataatttcatatttgaattctcaccaagcacagcattgaaacacagagatgcatttctgatgtgcactaccctcatgacaactgtgtttggggcaatggtgatacacctgctactaagggctggaggtttttctcctggccaagttgatgccattcctggaatcatttttctgttctttgtaggtcttctcatttgcccatttgacattttttatcgccctactcgtttctgcttcatccgggttgttcgtaacattgcttgctctccgttttataaggttctgctggtagacttttttatggctgaccaactaactagtcagattccattgctaaggcatttggaaacaacaggttgtcacatttttgctagagttttcaagtcacaccaccctgaggcctgccattctggaaggctatacatagaaataccttatcttatctcatttttgccatattggtggcgtgcaatgcagtgtgcaagaagatggtttgatgactctgatgttaaccatttggctaacatggggaagtatgtttcagcaatggttgcagcaggagctagagtcacatatagtaggcaagataaccatctatggtttgctatagtcttgatcacttctgtggtggccacagtttaccaattgtattgggattttgtcaaggactgggggtttttcaatcccaaatccaaaaacccattgctcagagatgatttaattctaaagaataaaagcatatactacatgtctatggcattgaatgttgtcctaagggtggcttgggtggagactatcgtgcacctcaaagtggggcctgttcaaacaaggctactagactttttgttggcttcactagaggttattcgacgaggacattggaatttctacagattggagaatgagcatctaaacaacgtgggtcgttatcgggcagtgaaggcagttccactaccatttcgtgacatagactcagacagctga

SEQ ID NO: 3616 - DNA, 765 bp, Glycine max var. Williams 82
atggcaactcgaagatatgagtttggaaggatgaatgaggctagccacccagactccatcagagctgccttggctgaattcctctccacttgcatctttgtctttgctggagaaggctctgcccttgctttgcgacaaatttacaaggaaccagggtcatcagcgggtgagctagtggtaattgcactagctcatgcatttgctctatttgctgctatttctgctagcatgcatgtgtctggtggacacgtcaaccctgccgtcacttttggcgctcttcttggtggaaggatctccgtccttagagcagtttactattgggttgctcaacttctaggttctatagtggctgctctcttgttgaggcttgtcactaacaacatgagaccacaggggttcagtgtgtcaatcgggcttggagcgttccacggtcttgtacttgagattgctctcacatttggtctgatgtacacagtctatgcaactgctattgatcctaaaaggggtagcattggctcaattgcacccttagccattggattcgttgttggggcaaacatccttgctggtgggccgtttgatggagcatgcatgaaccctgctcgggcttttgggcctgccatggtgggctggagatggcactaccactggatcttctgggtgggcccattcattggagctgcccttgcagcactcctgtatgaatacgttatggtcccaaatgagcctcctcatcaccaacctttggctgctgaagattactag

SEQ ID NO: 3617 - DNA, 3627 bp, Glycine max var. Williams 82
atgacagtcagagagacgctggatttttctgggcgctgcttgggagttggaacaaggcatgagctactattagaattgataaagcgagaaaagcaagcaggactcaaaccagatccagagatagatgctttcatgaaagccacagcagtggaaggtcaagaaacaagtctcattacagattatgttctcaaggttcttggattggaaatatgtgctgatactttggtgggagatgagatgaggaggggaatatctggtggagaaaaaaagaggttaactactggtgaaatgttagtaggaccttcaaaagttttcttaatggatgagatttcaactggtttggatagttccacaaccttccaaattgtcaagttcttgaggcagctagtgcatgtcatggatgttacaatgataatctctcttttacaacctgcaccagaaacatttgacctctttgatgacattatcttgctttcagaaggccacattatctaccaaggtccacgagagaatgttctcaatttttttgagagcgtaggcttcaaatgccccgaaaggaaaggaattgcagactttttacaggaggttacttccagaaaggaccaagagcagtactggttcgcaagggacaaaccatatcgatatgtcagtgtgcccgagtttgtagctcacttcaacaattttggcattggccaacaactttcccaagagcttaaggttccttacgaccgtgccaaaactcatcctgctgcattggttaaagataaatatgggatctcaaaactagaactcttcaaggcatgctttgcaagagagtggctactgatgaagcgcagtgctttcatatacatatttaagactactcagattatgataatgtctttgattactatgacagtgttttttaggacagaaatgagaagtggtcaccttgaagatgggagaaaatattatggtgcattgttctttagcctcactaatataatgttcaatggaatggctgagctttcattgactatttttagacttcccgttttcttcaagcagagagattcattgttttttccagcatgggcttttgcaattcctatatggatctttcgaattcctctctcttttgtggagtcagggttatgggttgtccttacttattataccgtaggatatgctccagctccaagtagattttttcgtcagttattagcattcttttgctctcatcaaatgggtatgtctctgttccgattcattgctgctcttggaagaacactagttgtggcgaacacatttggtttctttgtactgctacttgtttatgtgcttggggggttcattattgccaaagaaaaccttgaaccctggatgaaatggggctattatatttctcctatgatgtacggtcagaacgccattgccatcaacgaattcctcgacgagagatggagtgctcccaacacggaccatagaattcctgagccaacagttgggaaggctcttctcaggattagaagcatgtttactgaagactattggtactggatttgcattggtgctctccttggcttttctctgcttttcaacatttgttttataattgctcttacatttctgaatccatatggagattctaaatctattattctagaggaggagaatgagaaaaagggaactacagaagagagttttgcttcaactgataaaccatttgaagatgccgacattgacatggcagtaaaaaacacccgagagagttcaactcccaaagcaggcactgcaacaaccaagaggggattagtgttaccctttaagcctctatcacttgcttttgatcacgtgaattactacgtcgatatgccaactgaaatggaaaaacatggagttgaaggtagtcggcttcaactactaagagatgtcagtggtgctttcaggcctggagtactaacagcattagtaggtgtaactggtgctggaaaaaccacattgatggatgttctagcaggacggaaaactggtggttatattgaaggaagcatcagcatatctggttacccaaaaaaacaagcaacttttgctcggattagtggatattgtgaacaaaatgatattcattctccacgtatcacagtgtatgaatctattctgttttctgcttggctgcgtcttggtaaggaggtcaagagagacataaggaagatgtttgttgaggaagttatgaaccttgttgagctacatccagtgagagattttcaagtaggccttcctggcatagatggtttatcaactgaacaaagaaagagactcaccattgcagtagaattggttgccaatccttctatcatctttatggatgagccaacctccggccttgatgctagagctgcagcaattgttatgcgtgctgttagaaacacagcggatacagggagaactattgtctgcacaattcatcaaccaagcattgacatatttgaagcttttgatgagctgcttttgatgaagagaggaggacaaatcatatataatggtcccttaggtcaacaatctcagaagcttatagcgcactttgagactattccgggagttcctagaatcaaagatggttataatccagccacatgggttttggagatcactactccagcagttgagagtcagcttagagtagactttgcagaattctacacaaaatcagaattgtatcagaggaatcaagaacttattgaagagctaagcacacctttagagggaacgaaggaccttgatttccctactaaatactccctttcctttattactcaatgtatagcttgcttctggaaacaacacttgtcctactggaggaatccacagtataatggcatccggttattcatggcagtaattataggtgttatttttggactcattttctggaaaaaaggaaatcaaacagatacggagcaagatcttatgaatttaatgggagctatttttgctgctgttttcttccttggaggctccaacacttccagtgttcaacccatagttgcaatagaaagaacagtcttctaccgtgaaagagcagctggaatgtactcagctctaccttatgcaattgctcaggtggcaattgaatgtatttatgttgcaatccagacatttagctttagtcttatccttttctcaatgatggggttcctttggcgagttgacaagttcttgtggttctacttcttcatgttcatttcatttgtctacttcacactttatggcatgatgactgcggctctgacaccaaatccccaaattgctgcaattgttatggccttctttctagtgttttggaacatattctcaggtttcattatcccaaaatcgcaaattccaatatggtggaggtggttttactgggtatgtccaactgcctggagtttatatggcctagtgacatcccaggtgggtgacaaagatactccaattctggtacctggaacagaatcaatgacagtaaaagcattccttgaggaagagtttggctatgaatatggcttccttggagttgttgctgtggctcatattgcttttgttgcattgtttctttttgtttttgcatatagtatcaaggtctttaatttccagaagagataa

SEQ ID NO: 3618 - DNA, 645 bp, Glycine max var. Williams 82; identical to SEQ ID NO: 1965

SEQ ID NO: 3619 - DNA, 915 bp, Glycine max var. Williams 82
atggccaaaagcaaaaactgtcatgctttgcctcttctccttgccctgatcctcttcttcactcttcttggaacctctcacgcaggtggcatagccatctactgggggcaaaatggtaacgagggcaccctctcagaagcatgtgcaacaggcaaatacacccacataaacatagcctttctcaacaaattcggcaatggccaaaccccagaaatgaacctggctggtcactgcaaccccgcaaccaattcctgcacaaagttcagctccgaaatcaaggactgccaaagcaaagggatcaaggtgttactttcaataggtggtggcattggaagctacactttggcttcagtagaagatgcaagaaacgtttcaacttttctgtggaacactttcttgggaggcaagtcatcatcatcttcaaggccactaggtgatgctgtgttggatggcatagactttgacattgaacttggttcaacacaaaactatgagcaccttgcacgttttcttaaggcgtatagtggggttggcgggaagagggtgtacctaggtgctgctcctcagtgtccaattcctgatagatttttgggcactgcccttaacactggcctttttgactttgtttgggttcagttctacaataaccctccgtgtcagtatgctaatgggaacataactaaccttgtgagttcttggaaccggtggactagtacggtgcctgccgggaagatatttttagggttgccggccgatccggccgctgctggcagcggtttcattccggctgacacgttgacttctgagatcctgcctgtgattaaggagtcgccaaaatatggtggggtgatgctgtggtcaagattctttgatgtccagaacgggtatagtacttcaattattggcagcgtgtga

SEQ ID NO: 3620 - DNA, 243 bp, Glycine max var. Williams 82
atgaaggttctaaacttcatttttgccctaattctggttgttgctgtgtttcatcatgttcagccaaacctagcagcaggtagggtattgaacaggaaggaacaactgagtcttattatgtccttagacaagggccctgtgactccctcagggccttcaacctgcacttatatacctcgaaccggtggcagaaactgcccccctgtggaagaaatgaatgtcgtaatgttgcacatatattga

SEQ ID NO: 3621 - DNA, 891 bp, Glycine max var. Williams 82
atggaacagaaaagatgttcttttgtgactaaatgcagagatttcaagccacacctgctcatggtcttagtccagtttggctatagcttcttatatctcatcactaatgcctccttcgatcatgggatgaacccttttgtgtatgtaacctatcggcatattctggctgcggttttgatgttcccttttgcatactttctggagagaaatgcaagaccaaagctgacattttctcttttcatggaaatctttgtgctttctctgttaggggttagtttaactattaatatgcactttgcaagcctgaaatacactaatccaaccttcattgttgcaatgctcaacaccatacctacccttactttcgtcattgctgtggcattcagagttgagttaaatgcagctggtgctttgatcattgcactatacaaaggaaaccttatgagaaatttgtggcgtccactaattcatattccaggaaaatctgctgctatcaatgagagctggttaaaaggttcacttcttacagttttgagctgtgttacatggtctatatgtgtgattggggaaattcaggcagccactttgaaacgataccctgcccaattatcactcgtgacgtggatgagctttgttggagcagcacaatcagctgttttcacagttatagtagaacacaaccgttcagcatggactatagggctcaacattgatttgtggtctacaatatatgtggcatttgtagcctactttatccttggagagaaactttatttgggcagcataataggagcatttacaatcatcattggtatgtacttgctactgtggggcaaaagtgagcaagaggtttcgcagtgcagtactgaagattcaggatgcagaatatag

SEQ ID NO: 3622 - DNA, 2061 bp, Glycine max var. Williams 82
atgaagtcatatgatatgattccggatctgacaaaagcagtctggaatgtattggaacttagacttctggttttaatcagtttcttcttgcaagtattcctaatagtttttggcaaccgaagaaaatgcatagccgatgcaaggctacaagtcagtgtctggttgacctatctctcagctgattggattgccactgttgcactgggaatgctttccaaagacagcaaaaatcctgaaaatgaccccgacttcataattatggccatttgggcacccttccttcttgtacatcttggtggccctgacacaatcactgcctactccctagaggataatgagctatatctacgacacttccttgggttattgtaccagctatcagtagcaggttatgttgtttacatttcatggaatggcaacaagcttaattatgttaccattccagttatggtggcaggaataatcaaatatgcagagaggacttggtccttgtggttgggaagcagccaaaagttcagaaaatccattctccctcctccggacccaggaccaaattatgccaaattcatggatgactacactgcaaaaaaagctgaaggatacaaagttaaattaaaggttgaacctacttccatagtattggatcattctccaggggcaatagcaaatcacaatgtagcagatgcttcttctttacacgatggattctatttctttacaatttttgagcggctatttgcagatctcatccttagcattcaagaccaccaaaacagccaacatttctttaagaacatatcatggaatgatgcatttcaagtgattgaggttgagcttggattgatgtatgataagctatatacaaaggcagtggtaacatactctcgcctaggctttttcctcaaatttgtgagcactttctgcacactctctgcatttgttacattttgctgtctgatacataaagcacacatagattatgagcggattattactttggtgcttttcgctggggctatttttcttgagatatatgcggtcattgttttactttcttcgagttgggcaatgctttggttaagcaagcgtaagaattggaaagtggatcttctccacaggtccatctcatgttttcaaagatgttttaaactctcgcacactaagaggtggtctaatcttgtgtcacaattcaatctcattagtttttgcttgaaagatgagccagtcagatgcatcaaaatccagaaattccttcgcatctatcagtttttcgagaagtcttactaccaacacacacaaactgtccccggggaattgaaaaaactcatatttgaacagcttttggagaagtctggggatgcaaaagataccaaagcatgtaaaaaattatgcgctaacaggggtgatagagttcttgacaagtggaactgccattccattgcctggagcactgaggtagagtttgatcatagccttctgctttggcatattactactgatctttgctattattcagatgtaactgctaactcaaattgtgcagagctagaaaactgtcaaataagcaaacttttgtcaaattatatgctatatattcttgttatgtgtccttttatgttgcccaacggaataggacagatcagatttgaagacacatgtgcggaggccagagaagttttgcaagaaaggaagtacatatcagacagagatcaagttttggaagtgatactgagagtgaagacagatgttctaccatcagaggttaaaggagatagaagcaagtctgtgctgtttgatgcacgtaggcttgctaaatcgatagagtctttagaaagagaaaagaaatggtcgaaagaagagaaatgggaaatgatgagtcatgtttgggtggagatgctgtgtcatgcagcaagccagtgtagagggtttcatcacgccaaacagcttagccgaggtggcgagttgcttacccatgtctggtttttaatggctcatttaggtataactgaacagtttcagatttcacaaggtcacgcaagggcaaagttgattctgagttaa

SEQ ID NO: 3623 - DNA, 1779 bp, Glycine max var. Williams 82
atgggaaacaactgtgttggatcgagaacttcttctaaagacgtaacaaatggctgttctaattcaagttcattttggtggtcacgcggacacaagaaagatgcttcttctcatgcacacaaaagtggcaacaaaaagagaaccaaagctgcggaaactgttcaaaacaagcctccagagatggtgaaaatcgagagggaggatgtgaagcctcctcatgaatccaaagagactaaaccggcttcggaaccaacaacaacaaaggagcagcagcaggcagcaaaaccaaagaggccacacaatgtgaagaggctagcaagtgcaggccttaaaactgattctgttttgctaaggaaaaccggtaaccttaaggagttttacaatttgggaccgaagctaggacaaggccaatttggaaccactttcctttgtgtggagaagatcagtgggaaagagtatgcttgcaagtcaatactgaagaggaagcttttgacagatgaggatgtggaggatgtgaggagggagattcagataatgcaccacttggcagggagtcctaatgtgatctccatcaaggaggcttttgaggatgctgtcgcggttcatgttgttatggagctgtgtgcagggggtgagctttttgataggattgtcgaaagaggacattacactgagagaaaggctgctaagcttgcaaggactatagttggtgtcattgagtcttgccactcccttggagtcatgcatagggatctcaagcctgagaattttctctttgttaatcagcaagaagaatcccctcttaaggcaatagattttggactgtctgcttttttcaaaccaggtgaaatttttggtgatgtagtaggaagtccttattacgtagcacctgaagttctacgtaagcgttacggccccgaagcagatgtatggagtgctggtgtcataatctacattctcttaagtggggtgcctccattttggggagaatcggagcaagacatattcgaggcgattttgcattccgaacttgatttctcatcggatccttggcctgctatatctgaaagtgcaaaagacttggttaggaagattcttgtcagagatcctactaaaaggatgacagcttatgaagttcttcgtcacccctggattcatgttgatggagctgctccagacaagcctcttgattctgcagttttgagtcgcctgaagcaattttatgcaatgaacaaactcaagaaaatggctctaagagttatagcacaaaatctctctgaagaagaaattgcagggttgaaagaaatgtttaagatgatagacacagacaacagtggtcaaattacttttgaagaactcaaggttggactgaaaaagtttggtgctaatctcaatgaatctgaaatttacgaccttatgcaatcagcagatgttgataacagtggcacaattgactatggagaattcatagctgcaacattgcatctaaacaaggttgaaagagaagatcatttagttgcagcatttgcttattttgataaagatggaagtggctacatcactcaagatgagcttcagcaagcttgtgaagaatttggcattggagatgttcgcttggaggaaatgatccgagaagctgatcaagataatgatggacgaatagactacaatgaatttgttgctatgatgcagaaaggcaatgcagatttgggtaagagggttcgaaagggtagcactagttttagagttggatttagggaagcactacctgtatgttaa

SEQ ID NO: 3624 - DNA, 1554 bp, Glycine max var. Williams 82
atggctgataggaagaattcaggaagcattcgtgttgaatcagcacaagaaaaaagaaggaagaaactccccaactttgtggtatcagtgagactcaagtatgtgaagctagggtaccattacgtaatctccaatgccatgtaccttatgctaataccccttataggcacagcttcagctcatctatcaaccatttcaatgaaggagcttgtaagactatgggagaatctcaagttcgacctagtctcggtaacactatgttcaagcctcatggtgttcctcggcacactctacttcatgagccgtccaaggggggtgtacttagtagattttgcatgctacaagcctgacgtggattgcaagtgcacacgggagattttcgtggagaggtctggtctcacaggctcattcacggaggagaacttgtcctttcagaagaagattctggagaggtctggattggggcagaagacgtatcttccgccggcgatcttgagtttgccgccgaaaccctgcatggcggcggccagggaggaggctgagcaagtcatgtttggagcaattgaccagctgctggcaaagactggtgtcaaggctaaggatattgggatcttggtcgtcaattgcagcttgttcaaccccacaccttcactctctgccatgattgtcaatcactacaagttgagagggaatgttttcagttataatcttgctggcatgggttgcagtgcttcccttatctctattgaccttgccaagcacctcctccaggtccatcccaactcttatgccttggtagtgagcatggagaacatcacactgaactggtacttcggcaacaaccggtcaatgctagtctcaaactgtctcttcagaatgggaggagcagcaatcctcctctccaaccgctccggcgaccgccgccgcgccaaataccaactagtccacacagtgcgcactcacaaaggagcagatgacaagtcctacagctgtgtcttccaagaagaagatgaaacaaaaagaattggcgtggcactctcaaaagacctaatggccgtggcaggagaggccctgaagaccaacatcacaacactaggacccttagtccttcccatgtcagaacagcttcttttctttgcaaccttggtggctaggaaagtgttcaagatgaagataaagccatacattccagattttaaattggcctttgagcacttttgcattcatgctggagggagggcagtgttggatgagttggagaagaatcttgagctctctgattggcacatggagccctcaaggatgacactgtataggtttggaaacacttctagcagttccttgtggtatgagttggcctacactgaagccaaggggaggatcaagaaaggtgataggacttggcagattgcatttgggtcagggtttaagtgcaacagtgctgtgtggagggctttgaggaccatcaatcctgctaaggagaacaatccttggatggatgagattcatgactttccagttcatgtgcctaaagtggcaccaattgcttcctaa

SEQ ID NO: 3625 - DNA, 837 bp, Glycine max var. Williams 82
atgacatcagataagaacaacaatatttcttttgggctgatggtgccactcattgttggttttttcgatgattattacaagataatgaacatcgacggctcaaaagaaactcttaaacttgctgtgaggatcagtgatctatggtttgttgggatgcctgacaaatctgagcaagctaagatggtttttgtcgactctgatggtgatgagatccatgttatttataaacaagaccagctgaagtcttggaagatggacttgaaggaaaattgtacttatgtcatgcacaattttaatgtgctcaaaaacaacggtcagtatagagtttgtgatcaccaatttaaattggtgtttactggagttattgttgtaaggcagtctattctagacgacctcccttttagaaaatacaggtttgctggatttgccaatgttgtggctgggcagtctgaacctggcctattggttgacattatcagtgtcatggacgaggttgtctttcaccatgtttcaggggttgtctttaaactaaaggacttaggatcttatccgccatcagtcagcaattctttcaaggcttcgaagttaattattaaccaattggtgatggagattcaagaattcaatgaacggtataggcttgaggtgatgatcaaccacaaagatgaaagcacaaaattcctgctttgggaccgtgaatgcactgaattgatttgtcaatcagctgatgcagttgataggcataaaattgcagatggtgatgttgatttgaatacttcaccccaagcacttgataagctactgggttatgtgcttgcttttaagataaaggtctaa

SEQ ID NO: 3626 - DNA, 999 bp, Glycine max var. Williams 82
atggctgcaattgtgcaccacggattgcagtcacaccttgagtcccaacacactgagtcaatagcactcaaactgaggctcccttcctcaaaaccaccccttcctcaactcattgatttagccttcaaaccctctttctgggattcaagttcaaccatcaaaccccacagcgaagaaaacaataacaacaagaagtccacacccgcaaaccccaattcttggagcttccgcgaagcactctccaacgtcacaaaagaaccatcacagaaccaaaccacctacgtgcaccctcagcagaaacgcttctccctgagcctcagtccaaagagcctccagctgtgcaccgaaaacctcggaaacgaaagtggcagcgacagtggcagtgacagtgatgaaaacagcattgacatgttctcctcagtgaacgggaattcggggacaagggaacaaacccaacaaaggcaacctcgtcaactttcgacagcgaagaaagcgaaaacccagaactttccaccccctttgacaacgataagggggggatcagaatctcttcgcgtgagacctcaccgcgaagatggacggctagtgattgaagtcaccaaggtcccacctagttcctcgtgctttcatgctgaacgaagccatggccgccttcgcctctgctttctgacaaaccacactccaagttttgagacggaagcagcagcagaagaagaagatgacgttgaagaaaaagaaccattcgtcaatgataaaggattcgaaaacgaaataggtggacaagtaaaagacactaccaaagaagaacaagaggaaacagaggacgaaacaggggaggaagaagaacaagatgaggaatgtgttgcatgtgggtatgtgaagagtgatgtcattatcatggaaaagtacgagaggctgagaaggtgcaaagaaggtggtgaccacgagaactatgaatttttaaattggagtgagccacgtttggtggctacttcgtaa

SEQ ID NO: 3627 - DNA, 1017 bp, Glycine max var. Williams 82
atggcactgagaaagaaccactcctacaacaacaagcttggttatgaagctttcccacccatcaaaacccaggctggaacactccaacacccaccacaacctgcttcctcagactatgcttttcccatattagtcattgttgttctcagcatcttggccactgtcttgttactcctcagctacttcacttttctaaccaaatactgctcaaactggcgtcaagttaacccaatgagatggatttccatccttcgagctcggcacgacgaggaccccttcatagcattctctcctaccatgtggaaccgagggcttgatgactctatcatcagagaaatcccaacttttaagttcataaaagaagaaggtgaggatcaaagtgtgtattatggttgtgtggtttgtttgactgagttcaaggaacatgatgtgctgaaagttcttcccaattgcaaccatgctttccatttggactgcattgacatttggcttcagaccaattccaattgtccactttgcagatcaggcatttcaggaaccacccactgtccattggaccacatcatagcaccaagttcttctcctcaggattctcagttactctccaacatgggaagtgatgaagattttgtggttattgaacttggaggagaacatggagcagcacttccacaggtgcaacaacaagagaggaatgactcaaggggaagcttggcacatagaaaccactctacaaggaagtgccaccatgtttccatcatgggagatgagtgcattgatatcagaaagaaagatgatcagttccatattcagcctattagaagatctttctcaatggactcagcacatgatagacaaacttacttggatgctcaagtcattatacaacaaagtaggcttcagaatgaggctagtgctagtgaggattgtaatagcagatgtcgaagaccattcttcccgttttgctatggaaagggatccaaaaatgcagttcttcctttggagaatgatgtttaa

SEQ ID NO: 3628 - DNA, 1245 bp, Glycine max var. Williams 82
atgcagtcctccgcggaggaaggctccggcaactccgccaccgccggcacggagtggacgttctccgcaaagtcccatgcgccctcctcggacccctcctgggacgccatacagcgctgcggtggcgccaccctggcactcggcgacctccgctttgtgcagcgcgtggggagcggtgacatcggaagcgtctacttggtggagctcaagggctccaacggttgcctctttgcggccaaggtgatggacaagaaggaactcgttgccaggaacaaagacaggagagctaaggtcgagagagagatattacaaatggtggatcatccttttttgcctactctttatgcctctctcgattcgcctcgctggtcttacctcctcaccgagttctgccccggcggcgacctccacgtcctccgccagcgccagcccgataaacgcttccaccacgccgccgttaggttctacgcatctgaagtagtggttgcgttggagtacctacacatgatggggataatataccgtgatttgaagcctgaaaacgtgctcataagatcagacggtcacataatgctcacagactttgacctatcattaaaaggtaacgataccacatcaacggctcagatcgtgtttgatgaagatcgacccagcaacaccggtagtaacgaacattcgaagaacatgtcatcatgcatgttgccgaattgcatggtcccatcggtcccatgcttccatccaaagcaaggtggtagcaagaggtcctctcgcagtgggtcccttgagatcatagcagagccaatagaagttcgatcaacgtcgttcgttgggacccacgagtacttggcgccagaagtgatttcgggggaaggtcatgggaacggcgttgattggtggacattgggtgtgttcatttttgaaatgttctatgggatgacacccttcaagggacttgagcatgagctaaccctagccaacatagtggctcgagcccttgagtttcctaaggagccgatgatccctggagcagccagggatttgatctcacaacttttggtgaaggactcaagaatgagactagggtctagaatgggtgccgtggcaattaagcaccatccatttttcaacggggtcaattggccattgttgaggtgtgctacccctccctacatcccttcatcagacaagtgcaaggagttgcttcctctctataattgcacaaacaacgctctagacttctattag

SEQ ID NO: 3629 - DNA, 2073 bp, Glycine max var. Williams 82
atgaaccaattactctcggacgagaaaagtcgctgcattacttcaattgttggaattgaaggtacagtgcctccaagttgtacggttgaacaacttctacaagaagtagccgaagaggctgccaaacaaattatgggtggccagcaagacagatggacaacacaagttgtattcacaactttggcgaatacaaagtatctcattgttgttgatggcatcaaaacttcccatgtcttggataccttgagagagaccatacctgacaagtcgacaagaagcagatttcttcttaccacttgcaatgcaaatgtattgcaacaagcgggtacaagatcctttgttcttcctatccagttactagacgatgaaaatagttggattctgtttacaagaattttgagggacgttcccttagaacaaacagatgctgaaaaagaaattgtaaattgtgggggcctgccatcggaaatattaaaaatgagcgagttgcttttacatgaagatgccagagagcagtccattataggtcaaaacccttggtctgaaacacttaacacagtctgcatgaacttaccttcatacctgaggagatgtttattttatttcaagctattccctgctgattttgggattccagtaagaagattgattgttttgtgggttgcagagggtctagtgcatcaaggggaagaccaagggccaccagagctaattgcagaaaagtacttggcagagttgatagatctgaacatggttcaaattgccaagagaaagcccaatggcaaggtgaaaacatgtcgtctccctaatccttttcgtgaattcttgctgaatgcagcagtaccaacaaattccagaatacgtcaagtggcagatcgttttgacgaaaatgatacctggcacagacatattcatggcaacactactacaagtgattcagcttccctgttaaccaactacaaggatgttctctccttcctgtcctttgatgctcgagaaggaagtaaacctggccaagatataagtaactttctaaacctgtgcatctcgagcaattgtcttctactactgcgggtgcttgatctagaaggtgtttacaaggccaaattgcctaaaaacattggaagacttactcgattgaggtatcttggcctaagatggacttatgtagagtcacttccatcatctataagcagcttgctgaaactccagactcttgatctgaaatacacttacatacatactctaaccagctccatctggaagatggaactgagacacttgttcttgagtgaaacttatcgcaccaaatttccacccaagccaaaaggtatacgcataggtagttctctatctgacctccaaacattgtggggactatttgtagacgaagagactccggtcaagggtggtctggacaaattggtcaatatcagaaaattgggaataacatgccaatcaatgtcaaaaaagcaagaggcaatggaatcgcaacttgatgtagtagctgactggattgtgaaattagactaccttcaatcactgaggctaaaatcaagagatgaagaaggtcgaccttggaatatacacttgaagtctttgaaaaatcacattaatctcacagacgtgtatttgctgggatgcttgagcagtccatccattttgaaccaattgccctcaagccttgttgaacttactctatcacattcaaaactagaggatgatcccatgcaaactttgaaagatcttccaaatcttcactcattgtctttacttgcagaatcctacctgggaaaagatttggtttgcagttctcaaagctttcctcagcttcatgttttaaaattttggaagctggagcaattagaggaatggaatatagagccagaagcacttccctctctcagacagctggaaatccgatcatgtccgggcatgaaaatgcttcctgatggactaaagcatgttaacactctccttgagttgaaattgacaaacatgccaacggaaatcaatactgacaagcattccattccgcccaaatgtgaagtccacagagatgattctcagtag

SEQ ID NO: 3630 - DNA, 513 bp, Glycine max var. Williams 82
atgaaagaaaaaaatatgattggaataaagatttcaataaaagtaattattcaaacaaaaattagtcatcacatagctagtgaatattccgcatcacttaggcaaaaccctcttgtctctctctttcatttatttattcctttcttcaaaccttctttgaggcatgcttacttattttcttttgctttgatacatctctattggtctctctctcattcccttaatattgaaccaatgaagcaacaaattggtttgcttttctttgttctccttctttcctctttcttagcttctgcccgtctccttgaaccactgaaaggtccaagacaaggtgagaaggaagtggagatcaatgaaaacgcttttcctcaatcatctcatgagctaaaagatgatatggaagaactcatgggatcagaggagtgctatatgaaggatgaagaatgcattagcagaaggatgatggtggaggctcacttggattacatctacacccaacaccataaaccttga

SEQ ID NO: 3631 - DNA, 252 bp, Glycine max var. Williams 82
atgtctcgcttcatctttctcgtgtcaagtcttacaagtctattaaacagtcaaaagttaagaattgaagttacgtggattaaaaaattatctcgaaggtctctaagtacttgtttggagacaccaacaaaagttcattcaaagggcgcaatcatgctttggattttgcgtaaacatgtttgtacacgatctcagcgttgccactttccttgcaacgtttcagaaatgaggatttgctctcgtccttggtga

SEQ ID NO: 3632 - DNA, 1383 bp, Glycine max var. Williams 82
atgatgacattccaaagcaaggcaggtatcttcttcctgtgcttgttaatcattgcattttcatccattaatcttgctgttgctgtgccaaaagagcaagagcaagatcgaatcttggcgctcccggggcagccacgtgtggcattctctcagttctccggttatgtcactgtgaacgagcaacatggccgagcactcttctactggctcactgaatcccccacttccccgcagaataaaccacttgttctctggctcaatggagggccgggttgctcatcagtagcatacggggcatcagaggaaattgggccgttccgtataaacaaaacgggctcttctctatatctcaacaaatatgcatggaacaaagaagcaagtattctctttcttgaatctcctgctggtgttggcttctcatacacaaataccagctctgatctcaaaacttcaggggacaaaaggacagctcaggatgcactggtttttctaattagatggatgtcaagatttcctcaatataaatatagggagttttacattgctggagagagctatgcagggcactacgtcccccagttggctaagaaaattcatgattataataaaaacaatcctcaaattattaatctcaaagggttcattgtgggaaatgctgtgactgatagctacaatgatggaattggaactgtcacatattggtggagccattctatgatatctgatcagtcatacaaatctatcctcaaatactgcaatttcacagcagaagaaacatctggaaaatgtgatgatgtttatagttatgcggttaactatgaatttggaaatatagaccagtacagcatctatacgcctacgtgcacagcatcacaaaacaataccgttaggcacatgcgattcaagaatcttcatctgatttctgggtatgatccgtgtactgaaaattatgcagagaaatactataaccttccagaagtgcagaaagcaatgcatgcaaatgttaccaacattccttacaaatggactgcttgcagtgatgtgctcctgaaaaattggaaggattctgcaatttcagtgttgcccatatacaaagagttaattgccgcgggattaaaaatatgggttttcagtggggacacagattctgtggttccagttactgccacaaggttttctctcaaccaccttaacctcagcatcagaactcgctggtatccatggtactctggtggacaggttggtggatggacagaggtgtatgatggactaacttttgcaacagtaagaggagctggccatgaagtacctttatttcagccaaagcgagcttacattcttttcaagtcttttttggcagcaaaggaactgccaaaatattga

SEQ ID NO: 3633 - DNA, 483 bp, Glycine max var. Williams 82
atgggagtcacaacctttacacaggaatactcctcctctgttgccccatcacgcatgttcaaggccttgattgtagactccagaaatttgcttccaaagctcttacctcagtttgtaaaagatgtgaatgtgatccaaggtgatggtgaagctggaagcattgaacaagttaacttcaatgaagctagccccttcaaatatctgaaacacaggattgatgtgcttgacaaggacaacttggtttgcaaatacactatgattgaaggggatccattgggcgacaagcttgattctataggttatgaggtgaagtttgaggctactagtgatggaggttgcctatgcaaaatgacaagcaattacaataccattggagagattgatgttaaagaggaagaggtaaaggaaggaagggaaagcggtattgcagtttacagagttgtggagtcatacctgctcgagaacccacaagtgtatgcttaa

SEQ ID NO: 3634 - DNA, 1902 bp, Glycine max var. Williams 82
atgaatcatcatgttgtgtttctcttcacactaaccttgtttcttgtttcttttgatgccaaagcacagcagaattacacaggaaattcaatattcagctgcaagaatgatgacaaaatgggggcttcaccttccttcctttacacttgcaatggcctcaacaaatcctgcctggccttcctcatcttcaaatcaaaacctcctttcaattccatagccacaatctccaacctcacatcatcaaacccagaagagcttgcaagaatcaatgatgtcaatgtgctcaaagtgttcccaactgggaaagaagtgcttgtccctttgaactgttcttgcttaacaagggactattaccaagctgaaaccaactatgtattggggcaatccccaacatatttgacagtggcaaatgatactttacagggtttgaccacttgcgattcgcttatgcgtgctaatccatacggggaacttgatttgcatcccggcatggaattgcacgtgccactcagatgtgcttgtccaacatggcatcagatcacaaacggcaccaagtatttgctgacatactcagtgaattggggtgataatattacaaatattgctgcaaggttcaatgtagcagcaggtaatgtggttgatgccaatggtttttccacacaaacacaaactatttttccattcacaactgttctgattcctttgccaagtgaacctgtgagttcaatgacaagaattgttagtgatccaccagatgtgtcacctcttgtttgcagctccaaaaagtgcaactcaaagaggaaactttacactgttattgccaccactgggggttccatgctggttctttgtgtcgtcttatatggggtttttctgttcagaaagagatcagcaatgttcattaagcgaggtgaacaaggtgagaaatcaaagaagttgtcttcagaagatatccgtggtgagatagcaatcattgaacatcactccaaggtgtacaagtttgaggaaatagagaaggccactgaaaactttagttcaaagaatagaatcaaaggttctgtgtatcgtggggtattcggtaaagagaagaacatattggctgtcaagaaaatgagaggggatgcatccaaggaagtgaatttgctggaaaagatcaatcatttcaacctgataaagctgcaaggttactgtgaaaacgatggttgcccctatcttgtttatgagtatatggaaaatggctctttgagagaatggctaagcagaaacgggtcaacggagcaccagagtttggcaaggaggatcctgattgctctggatgttgccaatggtcttcagtatcttcacaacttcacagaaccttgctatgtgcacaggaacataaacagtggaagcattctgctaaacaaagatctaagggccaagatagcagactttgctcttgctgaagaatcagaaagtaaaataacttccggttgtgcctcatcacacatcgcgaaatcaaggggctatatggctccggagtatctggaggcagggaaggtcactaccaaaatggatgtttttgccttcggagtggtgctgttggaattgatcacgggtaaagatgctgttaccctacaagatgggagagaagtaatgcttcgtgcattcatagtaaatctcattggtaaagaggatgaagaagagaaggagagtttgttcattgatccgagcctcaatggaaacattgagaaagtatgggctctccagctagttaaacttggtctagcctgcttgatccaggaatcagcagagagaccaaccatggtagaggtagtctctagcttattgaaaacatatacaagttatatggagcaaataataccacctagcatcagcaacagtcctagcatggagaggtga

SEQ ID NO: 3635 - DNA, 1398 bp, Glycine max var. Williams 82
atgggtgctacttacctcggagaacggccactgaaacttcacttcattccctaccctgcacctggccatatgatccctctctgcgacatatccacactcttcgcctcaagcggccacgaagttaccatcatcaccactccctccaacgcccaaatccttcacaaatccatccctccccaccgccgcctccaccttcacaccgttcccttcccttccaatgaagtgggcctcccggagggcattgaaaacctctccgcagtctccgacctagtaaacgctgccaaggtccaccaagccaccgccctcctccgctgccccatcgagcaattcgtggagcaccacctacccgattgcatcatcgctgactttctgttcccatgggtggatgacgtggccaacaagcttaacatccccagactggccttcaacggtttctctctctttgccgtctgcgccattgacaagttacagtctaacaatactaactctgaggaatattcctctttcattccgaatcttccgcatcctatcacgttaaacgcaacaccaccgaagatattgaccgagttcatgaagccactgctggaaacagagctcaaaagctacggcttaatcgtcaacgactttgcggaactcggaggagaagagtacatcgagcactatgagcaaaccacgggtcacaaggcccttgacgagaaagcggagaggggaccgaagagtgtggtgggagcggacgagtgcatgagatggctcaacgggaagagagtgaaatcggtggtgtacatatgctttgggagcatgtgtcatttccaggataaacaactatacgagattgcaagcgggatggaagcatcagggcatgacttcatatgggtggttccagagaagaaagggaaaaaggaggagaaatggctaccgaaggggtttgaagagagaaatgcagagaaggggatgattataaaggggtgggcaccgcaggtggttatactggggcacccggcaattggggcgttcctgacgcactgcgggtggaactcgacggtggaggcagttagcgctggagttccaatgatcacgtggccggtgcatgacgaacagttctacaacgagaagctgataactgaggtgagtgggattggggtggaggtgggggccaaggaatggagcatccttggctttggggagaggaaacacttagtgccaagaaattccatagagaaggctgtccggaggttgatggacggtggtgatgaagctctcgcaatcagacgtcgtaccaatcactattcgatcatggctgcacgtgctgttcaagaaggtggatcatctcacaccaacttcaaagccctcattcatcatctcaagctattcagggaccgtaagtcgcttcatcaatag

SEQ ID NO: 3636 - DNA, 2226 bp, Glycine max var. Williams 82; identical to SEQ ID NO: 3082

SEQ ID NO: 3637 - DNA, 1344 bp, Glycine max var. Williams 82
atgggtaaggcgtcgaagtggtttcgcgggcttcttggtctcaaaaaaacagagtatgccacctcacccgccaagcctcccaaagagaaacgccggtggagcttcgttaaatcatcatacacagaaaaagacaacaccactgccgccacgtgtccaccactaagaaacaacaacaaccacgcaatggcagtagcagcagccaccgctgcggtggccgaagcggcggtggctgccgccgaagcagccgccgtcgtggtgagactaactagtaacagcggcaggtgcgccgacggcggacccacccggattcgccaacattgggctgctgttaagattcaagccgcttttcgtggctgtttggcaaggagagcactgcgagcattaaagggattggtgaagttgcaagcattggtgagaggccacattgagagaaaacggacggcagagtggctgaaaagattgcaagcactcttacatgcacagacccaagtttctgcagggttgaccctgcatgcctcaccttcgagttcaaagttatcaagccacctccaaggtccagaaacacccgaaaaatttgaaagccccattagatctaagagcatgaaacatgagcactcacctatactcaagagaaatggctccaaatcctgtgccctgatcaatggctatcaagagatatgtgggagtagatcagagagtcaagggaatgaacaattatggaactcaggaagatcaatgaatagagcacacggctccaatgatgaaagaaatggcaaggttcttgaagttgattctggaaaaccgcacttcacactaaagcgtcgaaacctctcttactccacaggctctgatctttatagtaagagtttgaacagcacaaaggaatcaacatctcttcaatctgctcaaagtccatgttgtgaggttcagtctcacagttacagctcgcaaaaagtgaacaatgaggttgaggagagtccattctgcactgctgacaatagtccacaatacttatctgcctcttctaaagatgatggcttcaaaagaagcccttttactcctactagaagtgatggctctagaagctacattcgcggttaccctgattatcctagttacatggcatgcactgaatcttcaaaggcaaaggccagatctctgagtgcaccaaaacaaaggcctcaaagtgagaggtctggttcatcggatagatactcactcaatggatttgatatgtcaagattggccactcaaagggcaatgcaagcaagcttcaccaacaaagcatatccaggttctggtcgtttggacaagcttggtatgcctgtggggtacagattctga

SEQ ID NO: 3638 - DNA, 327 bp, Glycine max var. Williams 82
atgaatagtactatggatgtgtcagctttgttactaattgaggatagtgcagattctgaagatgactatggctttttcactgtgtgtcccagcagcatagctatcagtgatgataatgaggatgatgctgagtcatgtagctgtgacacgactagtactcgtggcctacctaaggatagtgaagatgataaagaatttgctgaattttgtggcaatgaagttgcagcattagaagatgaagcagaaacaaggatcgatgaagttattgtgaatgaatccgaagatagactattttgggagacctgcatggcggtggggtatccatga

SEQ ID NO: 3639 - DNA, 2808 bp, Glycine max var. Williams 82
atggcacctgaaaacccttcaacgccagatcccgaatcgccaacctctccttccgttggtttcaacaccgaccagcttcctcacacccacaccagccatgcctcccaagacgacgaggcttccgtcgatcccgatatcgtacgagacgacattgaagaacagcccgaggaagaagaagaagatggagaggatctttacaatgacaattttttggatgattataagagaatggatgaggctgaccagttcgaatcgttcgggctggacgactcgttggaagacgacagagattttgatcagatcatgcaagatcgaagggctgcggaggttgaactcgaggcgcgcgatggtcgcgcttccaatcgtaacaagcttccccagcttctccacgaccaggatacagatgatgacaatcacaggtcttctaaaagggctcgagctgattttagaccttctgtagcaagtgatgatgactttgatggtatgcaaagttcacctggaaggtcacaacggcactcaagagaggatattcttatgactgatcaaacggaggatgatcgagatgacgatgattttgatgatggatacgagatgtatcatgttcaaggtacacttagagagtgggttacaagagatgaagtgcgccgcttcatagccaggaaattcaaggacttcttacttacttatcttaatccaaaaaatgaacatcgggacaaggaatatgtctggctgataaatgagatggtgtcagctagtaagtgcagtttggagatagattacaaacaatttatctatgttcatcccaacattgccatttggctagctgatgcccctcaatctgtcttagaagtaatggaagatgttacgaaaaatgttgtctttgaattacatccaaattacaggaatatacaccaaaagatttatgtgcgcataaccaacttgccagtttatgatcagattcgaaatataaggcagatccacttgaatacaatgatccgaattgggggagtagtaaccagacgttctggagttttcccccagttgcagcaggtgaagtatgactgtaacaaatgcggggcaattttggggcctttttttcagaattcatattcagaggtgaaagtgggatcctgtcctgagtgtcaatcaaaaggaccgttcactgtcaatattgaacagacaatttataggaattttcagaagcttaccctccaagagagtccagggatagttcctgcaggtcgacttccaagatacaaggaagtgatactattaaatgatctgattgattgtgcacgccctggagaagaaattgaggtcacaggtgtttataccaataattttgacttatccttaaacacaaaaaatgggtttccagtgtttgccactgttgttgaggcaaattatgttacgaaaaagcaagaccttttttctgcctacaaacttacacaggaagacatagaagagattgaaaatttggctaaagaccctcgaattggagaaaggattgttaagtctattgctccatcaatctatggtcatgatgacataaaaactgcaatagctttagctatgtttggaggtcaagaaaaaaacgtggaaggaaagcaccgcctgcggggagacataaatgttcttcttctgggtgatccagggacagcgaagtctcagtttctcaagtatgttgagaaaactggacagagagctgtatacactactggtaaaggggcttctgccgtgggtcttacagctgccgttcataaggatccagtcacaagggagtggactcttgaagggggagcacttgttctagctgacaaaggaatttgtcttattgatgagtttgacaagatgaatgatcaggatagggtgagtatccatgaagccatggagcagcagagtataagcatatcaaaagctggaattgttacatctcttcaggcacgctgctctgttattgctgctgcaaatcctgttggaggaagatatgattcctcaaaaacattctctcaaaatgttgaattgacagatccaattatttctcgttttgatatcctctgtgttgtgaaggatgttgttgatccagtcactgatgaaatgcttgcaacgtttgtcgttgacagtcacttcaagtcacaacccaagggtgccaagcaagatgataagtcctttagtgagttccaagatatccatgcatctgccatgccagctgatccagagatacttcctcaacagctactgaagaagtacattacatatgccaagttgaatatttttccaaggttacaagatgctgatatggataaactgtcacatgtctatgccgaactgcggagggaatcttcacacggacaaggagtccctattgctgtaaggcacattgaatcaatgataaggatgtctgaagcacatgcgagaatgcatctcaggcaacatgttacacaagaggatgtagacatggcaattcgtgttctacttgaatcattcatttcaactcaaaaatttggggtgcagaaggctcttcagaagagctttagaaagtatatgactttcaaaaaggactacaatgaactgctcctttatattcttcgcgagcttgtaaagaatgctctgcattttgaagaaattgtcaccggatctgcttctggtctaactcacatagatgtcaaagtagatgatctctaccacaaggctcaagagcatgatatttatgatctgaaaccattcttcaatagcagccacttttcaagggccaattttgtattggatgaagaacggagagtgatcagacatcaccttaccagatga

SEQ ID NO: 3640 - DNA, 1071 bp, Glycine max var. Williams 82
atggtgcttcagaaactgttatcgaagcatttctttgacggtgtcaaaatgaggccgtttgaacgcagtgtcgtgtcgtctccaactatgcaacaacaagtcatcgcgcctccgagcatgctgggagtgagttcggcagacggaggatttctccggcggtttttcctcctccggcaagcggtgtaccactccagtccggcacgtttcccggatttcctgtctctccccgtcggagagaagctccgggagaaactcaaaagcatcaacaacatagccggcataggagactgttgtgttgctctcgctccggcacctatggccagcgatgcggtgtttggaagtggaatgtctgtcagccacgcgaggaagattttgagggtgccgcaaatggagaaggtgaaggcaaagctgagaaacgtttcggagagttcggttccgtactcggagtttttgcggatctgcgttgagacgtgtgagaatcatgagcaaggggctgagtttgcaaagatcttggatgaatccggaaacgtcatcgttttggggaaagcagtttttctccggccagaggaggtggcaaaatcaatagagagcttaatctatcaatcaatagccaatccaaatgaccctagaaggaaggagctagagctgatggagaagcaaaagtggatgattgatgaaaaggccaaggcccaggtccgagctgagctttattttgggctgggcttcttgacagtccagaccctcgggttcatgaggctcactttctgggaactaagctgggatgtgatggagcccatatgcttctttgttacctcattcggcttcgctcttgcttatcttttcttcctcaagacctccacagaacccacctttcagggcttcttccatcaccggtttaaggccaagcaagagcgtctcatgaagacacacaactttgacatgagtaggtacaacgagttatttaaggcatgctatacaaattatcatggtggtgccaaatttgaatcttcttatcccttccactaccctggggagacacatctaactgatctaagagccttgcatcgttga

SEQ ID NO: 3641 - DNA, 1626 bp, Glycine max var. Williams 82
atgggaagcacaagtttgcttcatctattacttggtgttgttttggctctgctgagtgtgtctcttgtggaaggagaagatgcatacaaatactacacgtggactgtgacatatggcattctttctccactaggtagtcctcagcaggtggttcttatcgatggtcagtttcctgggcctcaactagacttggtaactaatgaaaatgttgttctcaaccttgtaaacaagttagatgagccatttcttcttacttggaatggcatcaaacaaaggaaaaactcatggcaagatggggtattgggaaccaattgccccattcctccaaactcaaattacacatacaagtttcaggtcaaggatcagattggaacctacacatactttccatcgacttcactgcataaagcagctggagggtttggaggactcaatgtctaccatagatctgtcatcccagttccttatccgtaccctgatggagatttcactttactcattggtgattggtacaagactaaccacaaggtattaagagaatctttggattctggaaaatctcttgcctttcctgatggtctccttatcaatggccaagctcatacaaccataaatggggaccagggaaagacctatatgttcagaatctcaaatgtgggcatgtcaacatcaattaacttcagaatccagggtcatcctctgaagctagttgagattgaaggatcacacattgtccagaacacgtacgacacgcttgatgtgcatgttgggcaatcagctgctgtgttggtaaccttaaatcagcctccaaaggactactacattgttgcctcaacaagattttcaagaaaagttctcacagcaactgcagtgttacattattcaaactctaactctcctgcttctggacccttgcctagtcccccaatttaccaatatcattggtctgtgaagcaagctagaacctacagatggaatctgacagcaaatgctgctaggcctaatccacaagggtcataccattatggaaaaataactcctacaaagacaattgtgttgtccaattcagcacctttgattaatggaaaacttcgttatgctgtcaacaaggtttcttatgttaactctgatacaccgctcaagcttgctgattacttcaacattcctggaatctacagtgttgactcaatccaaacccttccttctgaaagtactcctgcatccatagccacctccgtagtgccaacttctctccatgatttcattgaggttgtttttcagaacaacgaaaatgccatgcaatcttggcatcttgacggttatgacttttgggtcgtgggttatggttttggtcagtggacaccagccaaaagaagaacctataatctagttgatgctctgaccaggcacactacacaggtatacccaaatgcttggactacaatattggtgtccttggacaatcaaggtatgtggaatctgaggtctgcaatatgggaaaggcagtatcttgggcaacaattatatctcagggtttggacttctgagcgcagccttgctaatgaatatgatattcccaacaatgcattgctttgtggcaaagctgttggacataacaacccctag

SEQ ID NO: 3642 - DNA, 876 bp, Glycine max var. Williams 82
atggttccttgtgttaaagcaatggttgcgcttgtcctagcgtttctaatctctttgccttctatggttgcctatgctggcaacatgtaccaagatgttgatgtcacgtggggagatggcagaggcaagattctgaacaatggtcagcttcttactctgtctcttgacagagcctctggctctggctttcagtccaagaatcagtatctatttggcaaaattgacatgcaaatcaaacttgtgcctgcaaattccgctggcacggtcaccgctttttacttacgttcagaagggtcatcttgggatgagatagattttgagttcctgggaaatctgagtggtgatccttacatagttcatactaatgtgtacacacaaggcaagggtaatagggagcaacaattttatctttggtttgacccaactgcagattttcacacctattcctttctctggaatcctacacatgttgtattctatgttgatggaagaccaattagggagttcaagaacttggagggagtgggtgttgaatacccaaagaagcagcctatgaggttatatgccagtctatggaacgctgatgactgggcaacgagaggagggctagtgaagacagattggagtcaagcaccattcactgcttctttcaggaacttcaaagccaatggttgcgtttggtccaatggggtttcttcatgcaactccacctcctcttctgaaaaagcttggctatattctcaacggcttgattccacaaaccagaagaagctaaaatgggtgcacaagaattacatgatttatgattactgcacagaccttaagcgattccctcagggtctccctctcgaatgcacagtccgcaccaagtcataa

SEQ ID NO: 3643 - DNA, 1497 bp, Glycine max var. Williams 82; identical to SEQ ID NO: 3118

SEQ ID NO: 3644 - DNA, 3153 bp, Glycine max var. Williams 82
atggcagcaaagctattgcattctttagcagatgacaacccagatttgcaaaagcagataggatgcatgactggggttttccaactctttgatcgtcaccatattattcctcctcgccacattacccagaagatgcttcctccaggtaattcccactccaattatgacaacctggaaagaggttctaatagaatacaccaaagacaatcagcagctgatataaggggtgtgagtgaaaaacaaagaatttcaacggaatcatcaagaacctcattctcttcttcttgttcatcatcaatgtcctctttggagtataaagctcaagcaggcgctcccttcaaccggaatggttatcctaaaagtcctatgagggagccagttatgaaccaaacaagttcctctcccgatttaagatgtcagtcccttgatctgagggatgtggcgaaggactctatgtatagggaggccagaggactatctaaagaaaaggattccccaacacattttcagctgtccaaatccatcaaaggaaaacaaactcctattcatctaagggagtctctgagagtccttgctaaacttagagaagcacctcggcattatgttgaagctaaagaacttccaagattatcatatgaagtaaaaggacattggcattccatctcaaaggatgctcctcggttttcttatgatggaagagaaacaagtggtacatctttcgaatcacatgattcctttaaatgcccaccaaagctaaaagagcttgctagacattcacttgacagtagggaaggttcttggcgtgcatatggctctgattcaaaatccagtaacccctcaagaaatttcaatgcaggtgatgcctctacctcagttgacaacgtttctagtcgacaacaaccgtcagcatcccagagccggccacctagtgttgtagcaaaattaatgggcttggaagctttgccagaatcctataatgccagtgatactaactttagtttgagtgaaactggctcagctcaaggcaatgatcagtttttgaaaaatggactcgtcaagccacttcgagttcataattctcctaaaatctcattgaaagacacgacttcccctcgatggaagaatcctgacttggctgtgaaaccaatcttaagttcaaggtttcccattgaaccagcaccatggaagcagcaggatggaaaccaaagctctgagaaactaacttcccgggccataaaagctactgcaagatcaccagattcatttccatcagtttattgtgagattgaaaagagattgaaggatcttgaatttaaacaatctggaagggatctcagagctctcaaacggatactggaagcaatgcaagtaaaggggctgttagagaccagagaagaagaacaagctttaaatgttggaaataaaagagactatgaactaaatccgagtcttattcagcattctatatcagtgaggcaacaaacagccagggaaactgaatctgtaaaggctatagaatcaccaattgtgatcatgaaaccaggaaaacttattgagaaaagtggaatttctgcttcttcagtctttccaattggtgaactctctgattcccataaacttcggagtggtggtgtacatgcacatgataaaagggggacagcttccaatcaaatagcaaaagatcagtctcttagaaacagtcactggaatgctcctaccagttttagtgaaaagaaagaaaacagtatcaggactattaaatcagcacaatcccaaccaaggtctaaacaacttccaaaagaaaatagtccaagttcagtaaagaattcgggatctgttagcctgagaatgcaacagaagaagttagagtctgagaagcaatctaacctgcctaccccaccatccgattcaaataatcccagaaggcagtcctttaagcagccaacagaatcaggttctcccagtcaaaaactgagacctaaagttgctagttcacggtactgtgatgaccgacttagtgagactagcaatgaattgagaagtctaagtagtcagtgggatgaaatatctctgcaatcagacagtatcacagttgactcaaagatggatactgaagttaccagcagtttacaatctgctgaaattattgaaagccaatgctcatctatgaagcctattgagcatttggtttcaggatcaatgcataagaaatcaactctgaggtggaatgaggatgagtcaattgcagaacctgcaacatatgcctcagatcatccaagtcttgattcagtcgatgatgtctcggtatacaaatatgatatgccatccccagtaaagagtaaatccaatgctcctaaagctgataatgctcaagaaaataaagcaaatgataatacagatcagtggaaccctgcagatggtttcttcgttaacaacacgatcaactgcaagaaattgcaaagcatagattgtcttattcaaaagcttaggcagctaaattcgagtcatgatgaaactagaaacgattacatagcttccctttgtgaaaatacaaatccagaccacagatacattgctgaaatactattaacttcaggtctattattgagagctttgagttctgagttgctgacatttcaacatcactcatcaggtcatcccattaaccctgagttattccttgtgctggagcagaccaagttaagtagtttgctttcgaaagacaaaagcagatttggaaaagctgcttacatgaagctaaatacagagaagtggcagaggaaactcatctttgatgctgtgaatgagattcttggtgaaaaactaggctcttttcttgagccatgcttgaagcctaatgaactcgtagcaatgaaattcgtcagtgcacaaaagcttcttaaagaactttgctttgaggtacaaaaacttcaatatgtgaagccagattgtagcttagaagatgagggagatgaactgaaaagtatgctacgggaagatgtgatgtgtcactcagaaaactggacaggtttctcagttcaattacctggggttgtgttggatgctgagagacagatatttaaggacttaattgatgagcttgtgattgatgaaatggctagtttgcaagtgaaatccggtaggcacaggtag

SEQ ID NO: 3645 - DNA, 1221 bp, Glycine max var. Williams 82
atggccaccacttttctctctctcctcttcctcctcttctctctcctcaccccgaccctcatttcctcttcccctgtccaagaccctgaatttgtggcccaagaagttcacaggaaaatcaatgcttctgtagctagaaggaatttggggtacttgtcctgcgcaacagggaaccccattgatgattgctggaggtgcgacccaaactgggagaagaaccgccagaggctagcggattgtgcgattggtttcggcaaaaacgccatcggaggaaagaacggaaaaatctacgtggtgacagattccggcgacgacgatccggtaacccccaagccgggaactctccgttatgcagttattcaagacgagcctctctggatcatcttcgcaagagacatggtgatcaagctgaaggaagagctgatcatgaactcattcaaaaccattgatggaagaggtgctagcgtgcacattgcgggtggtccatgcataacgatacagtatgtaacaaacgttataatccatgggattaacattcatgattgtaagcaaggtgggaatgctatggtgcgggactcaccacggcactacgggtggaggaccatatcggacggtgatggcgtgtcgatctttggagggagtcacgtatgggttgaccattgctctttgtctaactgcaatgatgggttgatcgatgccattcatgggtctactgggattaccatctccaacaattacatgactcaccatgacaaggtcatgcttttgggccacagtgattcctacactcaggacaagagcatgcaggtcactattgctttcaaccactttggtgaaggcctagttcaaagaatgccaaggtgtaggcatggatattttcatgtggtgaacaatgactatacccactgggaaatgtatgccatcgggggaagtgctaatcctaccatcaatagccaaggaaacaggtttgttgcacccgatgacagattcagcaaagaggtgacaaagcatgaggatgcaccagagagtgaatggaaaggatggaattggaggtcagaaggggacttgttggtaaacggtgcgtttttcacggcatcgggggctggagcctcctctagctatgcaagagcatctagcttgagtgcaaggccatcttcattggtggggtccataaccactggtgcgggtgcactcagctgtaggaagggttcccgctgctga

SEQ ID NO: 3646 - DNA, 645 bp, Glycine max var. Williams 82
cattctcatgtcccaaagtttggtaattgggactgtgacaacatcccatacacagtatattttgataatgcacgcaacaaaaagccttttataaatccgaacgacccagaacaaaatccggaggtcttcaatctttacatgagaggagttgaaaaaagtgacgaagcagtgaaggcttcttctactcgtatgcgcatgcgctcctatagtactagttctttagaacaaacaagccatgaacatgaccatgaggaggggagaagcaatactaaaagccattcccatcacacgacagaatctgtcagtgaaagaagcaattccgattactctgtcattcagagagtgaagtcagatttcattggtagcttctcttcatcaaatcacaatattaaaggcagaggtggaagccattcccttattaatgaccacgtgaaccatgaagcagcactagtaccagaatttggtgcttgggatgtcacagaccctaaatcaggagaaggatatactgctatattcagcgaaataagaaaagaaaaggaaattgcgtctggccgcatgcctaaatcaatgtggcagaccttcctccattttatccaaggtaatataaaaattagtttagttggttacaagttaattaaatattaa

SEQ ID NO: 3647 - DNA, 219 bp, Glycine max var. Williams 82
atgggagcgcaaggttcggcggaatctatggatatagatgaactgagagttcttaatgtgtttaattgcctttgttcagggtgtgggggtgcgagatatatagaaattcacggcaatgtcaattccgtatggaggtctacttcgttgctgtcaatgagttggaagataataaacttcttgttcttcatggagcaatgggaatatcgattttcaatgtaa

SEQ ID NO: 3648 - DNA, 882 bp, Glycine max var. Williams 82
atggttgcctttgctggtgacttaaacaaagactttgacatcacttggggagatggccgcgccaagatactaaacaatggagagttactcactctttcattggacaaagcatctggttcaggttttcaatcaaagaatgagtatctctttgggaagattgacatgcagctcaagctcgtccctggaaactctgctggtaccgtcactgcctattatttatcttcaaaaggatctacttgggatgagatagactatgagtttcttggaaacttgagtggtgatccatacatccttcacacaaacgttttcagccaaggcaaaggggacagggaacaacaattctatctgtggtttgaccccactgctgatttccacacttactctatcacgtggaacccccagaggattatattctctgttgatggcactcccattagagagttcaagaacttagagcctattggggtccccttcccaaagaatcagccaatgaggatgtactctagtttgtggaatgctgatgactgggccacaagaggtggccttgtgaagacagattggacacaagctccattcacagcttcctacagaaacttcaatgctgagacttgcatatggtcttctggagcatcttcttgtgctaaaacttcttctacttccaccactagcagtggttcatggctttcacaggaactggactctgcaggccatcagaggttgaagtgggtgcagaagaactacatgatttacaattattgcacagacactaagcgtttcccacagggccttcctccagaatgcaacatctctggagagaaaaacaaagcaacgcattcctcttatattttctatgatcagaatgtcataccaatattagtttaa

SEQ ID NO: 3649 - DNA, 1035 bp, Glycine max var. Williams 82
atgggtatctgcatatccgttgcagaagaagctcatgatgatgataatgtgacaatatttgaagcaagaaaggttctaaatgggagtcagagactttgctctgtttactccaaacagggtagcaaaggactcaaccaagatgctgcctctgttcatgagggttatgggatggaggatggaacattttgtggagtttatgatgggcatggagggaatggacacaaagtgagcaaaatagtaagcagtcgtttatcttccctcatactggaccaaaagaatgttcttgaaaggattgatgagatagaaaatggttacaacaacaccacaaaaaagcatgttaactcagtgaaagaggaattgcctgcaaggaactttcagaaatggaaagaagcaattgttagtgctttcaaggtgatggacaaagaggtgaagcttcaaaagaatctagactgctttagcagtggaaccacagctgtagttatcataaaacagggtgaaggtcttgtcatagctaatctgggtgactcaagagcagtgttgggaacaatctatgatgaaaaactcgtagccattcaattgaccactgatttgaaacctgaattacctcgagaagcagaaagaataaggaggtgcaatggttgtgtgtgtgggtcgaatgaagaaccagatatccagagagtgtggatgcccaacaatgagaattcacctggcctagccatgtctcgatctttgggagatttcctgctcaaagatcacggtgtcattgccatccctgatgtttcctatcaccctctaacatcaactgaccaattcattgttcttgcaagtgatggggtgtgggatgtactaagcaacaatgaggttgcatcaattgtgtggagtgtagacagtgaagaggcagcagcaatggcagtagtggaagcagccactgctgcatggaatgagaagtatccttcctatatggcagatgactgcaccgtggtttgcctcttcctgcacaagaaatcacaacttactaacttaagtgccccttaa

SEQ ID NO: 3650 - DNA, 864 bp, Glycine max var. Williams 82
atggcttctaccttctctcgaagcctagcacttgtaagcttttacattgtcgtttgtgctgccggtaacttgaaccaagactttcagcttacgtggggagatggtcgtgctaaaatactcaacaacgaaaatcttctcactctctcccttgacaaggcctctggctctggcttccaatccaaaaacgaatacttatatggcaagattgacatgcagctcaagctcgttcctggaaactctgctggcactgtcaccgcctattatctgtcttcaaaaggatcaacatgggatgagattgacttcgagttcttggggaatctgagtggcgatccatacattctacacaccaatgtgttcagccaaggcaagggcaacagagagcaacaattctatctctggtttgacccaactgcagatttccacacttattcaattctttggaatccccaacgcattgttttttctgtggatggcacccccatcagggaattcaagaatttggaatcaataggagttccttttccaaagagccaaccgatgaggatatactcaagcctatggaacgctgatgattgggccacaaggggtggactcatcaagactgactggtccaaagctcctttcactgcatcctacagaaacttcaacgccaatgcttgtgtttggaactctggaaaatcctcatgcaaatcaaattcttcaccttcctctgcatctcccactaatgcatggttatcacaagagcttgattccactgctcagcagaggttgcgttgggtgcagaagaactacttgatttacaattactgcaccgacaacaagagatttcctcaaggccttccactcgaatgcaaacactcctag

SEQ ID NO: 3651 - DNA, 729 bp, Glycine max var. Williams 82
atgtttcatagttttagattttcagtttcagatgcatgtgcaatttatatgccttcacatgaagtaaatgcagtgcaggtggacatggaaagccttttgatgactggccaactgagcgtcctcgtggttggacaagatgtcttaaacactactggcgaggttggatcccaatgcacagttgttactgataattactgtgaggatgcctatgatttactacaaaactctgcgctaaagaaactactgcttgctggtattctgttagacacacagaatctaaaagcatctgcagcaatatcaatgacaagggatgcagaggcagtccagttgttattggttggctcagccccaaattacagatatgctttatttgatcaattgatgcaagaccaaaaaaccgcttcttttgtcgaagctttgaaccataactacgggaggcctccggttgaaagtgaacaaaacagtgaaggaaatacgaagcataaagttcgtgagagaaagtcaagctctaaatctgaccgtgaacccatcatatcaaattcaaagacaaattccttcgacacaaaaagttctaaagctagcaaggtttcgccaaatccagtcaaacttgttacgccacctttgctatctccttctccagcaccagcaccacaacatgcagaaaaggaggtccctcgtgggaaaaacaagtttttcttgacaaggtggcttggttttggttcaaaatga

SEQ ID NO: 3652 - DNA, 1608 bp, Glycine max var. Williams 82
atggctctaaactacccttttttaacctacttcatactactgctagtaaccataacccgtttgatattcactgtgggaaaaactgagcaatggaaagctccgattctaccagagcttgacattgataacatatcccacaaactccatgatgaccctgaaaccattcaaatggcttcaagggactatggccatttaacgcatgaattcccattagctgtgtttcgtccatcttctatagatgacatagtcaccttgataaaatcttcgtacaatagctttgccccttttgacatagctgcgaggggccaaggccactccactcatggacaagccatggctcgtgatgggattgtggtggacatggccagcctaagaaaacaaagaaatggggttgcgattagtgtctctaaggaccctttgatgggtcactatgctgatgttggaggggaacaactctggattgatgtgctacatgccacacttgaatatggacttgcaccagtttcttggactgattatttgtacttgaccgtgggagggacactttctaatgctggaatcagtggccagagcttccgttatggacctcaaatcagcaacgttcatgaaatggatgtcatcactggaaaaggagagttcgtaacatgctcttcacagaagaacttggagttattccacgcggttcttggaggcttgggacaatttggagttatagcaagggcgagaattgctcttgagccagcacccaaaagggttaagtgggtcagactactttatagtgacttttctgcttttaccaaagaccaggaacgattaatctcaatcaatggaaggaaacaaaagaacgcattggattttctggaagggatgctgctaatgaaccaaggccccataaataattggagatcctctttcttccctctatctgaccatcccagaatagcttctttaataactgaacatagcatcctctactgtcttgaagtggctaaatattatgacgaacaaaccgagttaaatgtggacaaggaaattgaagttttgctccaaggactagcctatatccctggatttaattatgagaaaaatgtctcgtacgttgagttcttgaatagggtccgaagtggagagttgaaacttcagtcacaaggactgtgggaagttcctcacccgtggcttaatttgtttataccaaaatctcaaatcttggattttaattcaggagtattcaaagatatagttcttaaaagaaacatctcctctggaccagtcttggtttatcccatgaatagaaacaagtgggacgataggatgtcagcatctataccagacgaggatgttttctacacagttgggtttttgcactcaagtgggtttgatacttggaaggcatatgatgctcaaaacagagaaattttggagttctgtagagatgctggcatcatggtcaagcaatatcttcccaaccacagcacacaagaagattggacaaaccattttggtgctaaatggatgaaattcttagaaagaaaacatcagtttgatccaagaatgattctatcacctgggcaaaaaatcttccacaaaaaattacagccagtgttttaa

SEQ ID NO: 3653 - DNA, 1371 bp, Glycine max var. Williams 82
atgagtttcaagaacagtcctaaaattcagcacataggagcctctccaaacgtgtctcgccaatcatccacttctagttttagggacaaacaacagaagaatgtggagccaccaagccctttacctgttggatgctgcagaggcttcagcattgccaagactattgggtcccctgcctccacatcacaacaaaatatgcaacagttacaataccaaagacttgaagtaaaggtggcggatttggaaaagaaagtgcaaaaacaatcagaactacgagtaatgtacaagaaaagaatggaaaggactcaagattacttgaggaactgccttcagatagcacaagaaaatggaatattagatgtcattgtgaactgcaaaggtgaatttcaacaatctccagtctctatccacaccataagctccattaccagccctcaaattcaaattcccactccaccacaccatggccaccacaccaatcttgcgtccatcatagatcaagcaaaaatcaatggatggtatattgatccaaatgagattcaactggaagagaaaatcgggcagggcagcaccgcagaaattcacagaggaaaatggcgtggatttgaagtggcagtgaagtgcatatccgaagaatttttccgcactaaccaaaacggtgtcgcatacttctcccaggagctcgaaacgttgtcgcggcagcgccacaggttcgtgcttcagctcatgggcgcgtgcatcgaccctccccgacgcgcgtgggtggtcacagaacatctcagcaccacgttgaaggagtggctgcacgggcccgggaccaggctcagagagcgaatggtgccacttccactcttcaaagacagagtcattagggcccttgaaatagcccaagccatgcagtatctgcacgagcaaaagcccaagctcgttcaccgtgacttgaagcctagcaacatttttcttgatgatgccatgcatgttagagtcgcggattttggtcatgcgcggttcttgggtgatgaggaaatggctctcactggagaaacaggaacatacgtgtacatggcaccagaggtgatccgatgtgaaccttatgatgaaaagtgtgatgtgtacagttttggggttatgttgaacgaacttttaactggacattacccatatgttgagacagaatatggtcccaccaagattgccattgaagttgtggagggtaacctgcgacctaagcttccgtgtgatgatgttggccaaccgagagagcttattgaccttatatgcctttgctgggacaaaaatccatctactcgaccatcttttgctacaatcaccctttgcctcaaaagttatgccaagaaaaatctcctttaa

SEQ ID NO: 3654 - DNA, 828 bp, Glycine max var. Williams 82
atggcgtcgagtataggcatgatggacagtgcctactttgtcggcaggaaccagattctgacctggatcaacaacaggctccacctcaatctctcacgcattgaggaggctgcatctggggctgtgcaatgccagatgatggatatgacgtttccaggggttgttccaatgcacaaggtgaactttgatgcaaagactgagtatgatatgatccagaattacaaaattctgcaggacgtgttcaataagctgaaaattgacaaacatgttgaagttagcaggcttgttaaaggccgacctttggacaacttggagttcctccagtggctgaaacgttactgtgattccgtgaatggtggcattatgaatgagaactataatcccgtggagcgaagggtaaaggttggaaaggatcgaaatcacaagtgctctgtgaagagctcaaaatcattgcaaacaaatatgattaattctggttcaggcaacactctcagtcctaacagaacctctgggaccaagcaattcaggtcaaatgaagcagcaggaggagttaattcttcagtagagattcaggctttgtctaaagagattactgatctcaaatctgcagtggatctcctggaaaaagaaagagatttctactttgcaaaattacgggatatagaaattctttgtcaaactccagaagtggagaatttctctatgtctgtagcaattaagaaggttttgtatgctgatgatccaaaggaatcagcattagaagaagctcaggattaccttaatcaacgtttgaatgctgtggaagatgaagctgaaattgaagcctga

SEQ ID NO: 3655 - DNA, 219 bp, Glycine max var. Williams 82
atggcaaccatcatggctatcgagtttgatgccagcaacaaccggtctaagctatggctggaaacaaattctcagctccttgtccatgctttcactcatcctacgatagttcattggacactctacaccaaatggatgaattgtatgaagtttaaggttaactataagcttgtgtttggatcaggaattttaaaatttcaggaaattttaaaagtctag

SEQ ID NO: 3656 - DNA, 756 bp, Glycine max var. Williams 82
atggaacttagttttaagcaccaacttggccttgcttgtgttgtacttcttttacctgcattgtgtagctcacaggactcttttactgactccagagcaacatattatggtagccctgattgctatgggaatccaaggggagcttgtggctttggcgaatatggaaggactgtgaatgatggaagtgtggcaggagtgtctaggctatggaggaatggaagtggttgtggtgcatgctatcaggcaaggtgcaaaataccacaatactgtgatgaaaatggagcatatgtggtggtaacagactatggtgaaggagacagaacagacttcataatgagtccacgcgcctactcgagattgggacgcaacgcggatgcatctgcagagttgttcaaatacggtgtagtggatattgaatacagaagggtcccctgcagttacactggttataacgtggtgtttaaggttcatgaacacagcagaaaccctgactactttgctgttgtggttctctatgttgatggaacatacgatgtcactgctgttgagttgtttcagcaagattgccaagaatggaagccaatgcgcagggcatttggggcaatgtttgactatagcaacccaccaaacggtgagatctacttgaggttccaagtgagtggcagtgcagggctttattgggtacagtccaagaatgctatctctggtgattggaaggccggagcaacatatgacaccaatgttcagcttaattag

SEQ ID NO: 3657 - DNA, 888 bp, Glycine max var. Williams 82
atgaaattcgggaagagcctgagcagccagatcgagaaaaccctgccagagtggcgcgacaagttcctctcctacaaggagctcaagaagaagctcaagcaattcgaccctcccgcccccgcctccgccgccgatgaacgccccggcaagcgcctcaagaccgacgccggcaacgccgacgccgacgccgtttccgacgcctccgacatgtcgaaggaggagagcgacttccggaacctgctggagaatgaactcgacaaattcaacaccttcttcgttgagaaggaggaagagtacattatcagactcaaggagttacaagatagtgtggcccaagttaagggttcgcgggaagagatgatgaaaatccacaaggaaattgtggatttccatggagagatggtcttgctggaaaactacagtgccctcaactatacagggctagtgaaaatacttaaaaagtatgacaagagaaccggtgctctcattcgcttgcccttcattcagaaggtcttgcaacaacctttctttaccactgacttgctctacaagcttgtaaaggagtgtgaaacaatgctggaccaccttttccctgtgaatgatcctgctccagtttccactgagacaactccccaagctgaaggttttgatccttcaacttcaaccactaccaagagtgatggtttggtgattccgaaggaattagctgagatcgagtacatggagagcctttatatgaagagtactgtatcagcattgcatgttttgcaggaaattagaagtggaagctcaacagttagcatgttttcattgccaccgttgaagataagtggttcagaagaagaaacatggaagaaaatccctgttctggaacaagcagccaagtaa

SEQ ID NO: 3658 - DNA, 378 bp, Glycine max var. Williams 82
atggattggactcagttggagacatcaacactacttgatattctcaacaaaaagtcctcctttccaggaagtttcatctcaataccagaaatccaagcccaaaacaaggttttgaagcattgtgggttgcctgatgatgaatacctggttctcttaaagcattgggtctcagaggctcacaggaactactggcgtgttctgcttgatgcttctgcattggtgctgggaaagggcaggctgtatcttggccttcacaggcctgacttcttagtctgttgtcttgataacactcactccaatccttcaagaatcacttgcctcttagtgagaacgaaatcttttgacacctccactgcttcttctcaggtcaatggatga

SEQ ID NO: 3659 - DNA, 858 bp, Glycine max var. Williams 82
atggctttttcaagagttgcactgctaatatgcacggtcgggtattttgtgattgcctctgccggcaatttccaccaagattttgatatcacatggggagatggtcgggctaagatactcaacaatggagagcttctcactctgtcacttgacaaagcctctggctcgggtttccaatccaagaacgaatacctttttggcaaaattgacatgcaactcaaactagtccctggcaactctgctggcaccgtcactgcctactatttgtcttcaaaaggagcgacatgggatgagattgactttgaattcttgggcaatttgagcggcgacccatacatccttcacaccaacgtgtttagccaaggcaagggaaatagggagcaacaattctacctctggtttgacccaactgcagattttcacacctattccatcctatggaaccctcaacgtattgtcttctcagtggatggaagtccaattagggagttcaagaacatggagtcaaagggtgttccattccccaagaaccaggcaatgaggatatactcaagcctgtggaatgcagatgattgggccacaaggggaggtcttgttaagacagattggacacaggctcctttcacagcttcttacagaaacttcaatgccaatgcctgcactatgtcctccggaacttcatcttgcggttcaaacaacccttcctcttctaacaataatgtttggctctcagaagagttggattcaactgatcaggagaggctcaagtgggtgcagaagaattacatgatctacaattactgctctgacactcaaagatttccacagggccttccttcagagtgcaacacagcctaa

SEQ ID NO: 3660 - DNA, 348 bp, Glycine max var. Williams 82; identical to SEQ ID NO: 3054

SEQ ID NO: 3661 - DNA, 711 bp, Glycine max var. Williams 82; identical to SEQ ID NO: 3046

SEQ ID NO: 3662 - DNA, 741 bp, Glycine max var. Williams 82
atggacactttcttcaagtccccatcgtcttcttcttctagaagcagctggagttacgatactctcaagaatttccgcgagatctctccgctcgttcagaatcacatcaaactggtttattttacgttatgttgcgctgtggtggctgctgctgttggagccttccttcatgttctgtggaacattggcggttttctcaccacggtggcttccattgggagcatgttttggttgctatctacacccccttttgaagagcaaaagaggttgtctctgttgatggcttcggccctgtttcagggtgcttccattggacctctgattggtttggcttttgccattgatcctggccttatcattggcgcatttgtggcaacttctttggcttttgcttgcttttctgcagtagccttagttgcaaggcgaagggagtacctctaccttggtggtttgctttcttcttggctttccattcttatgtggttgcactctgattcctctctctttgggggctctatagctctattcaaatttgagttgtactttgggcttttggtgtttgtgggctacgttatagtagacactcaagtaatcattgagagggctcactttggtgacctggattatgttaagcatgcattgacactgttcactgatttggctgcaatctttgtgcgaattcttaatataatgttgaataattcatctaagagaaatgagaagaagaggaggagagattaa

SEQ ID NO: 3663 - DNA, 1581 bp, Glycine max var. Williams 82
atggattctcaaatactcaactcattagcccttatcttgccctttttcctcttcatgattgtggtgctgaaactagggagaaaactcaagaaaactgagccatctctgaacatacccccaggaccatggaaactgcctattgtaggaaacttacaccaacttgttacatcttcaccacataaaaaattcagagacttggccaaaatatatggacccatgatgcatcttcaacttggggagatcttcacaatcgttgtttcctcggcagagtatgctaaggagatactgaaaacccatgatgtcatctttgcatcaaggcctcactttctagtttcagaaataatgtcctatgaaagcacaaacattgctttttcaccttatggaaattattggaggcaggtacgtaaaatatgcaccttggagcttctctcccaaaaacgtgtcaactcattccagccaattagagaagaagagctcaccaatcttgttaaaatgattggttcacaagaagggtcttccatcaacctcacagaagcagtgcactcatcaatgtatcatatcattacaagagctgcgtttggcataaggtgcaaagaccaagatgaattcatatcagcgataaagcaagctgtgctagttgcagcaggtttcaacataggagatttgtttccttctgctaaatggcttcaacttgttactggtttgaggcctacccttgaggcgctttttcaacgaactgatcagatactagaagacatcatcaatgaacacagagaggcaaagtcaaaagccaaagaaggccatggtgaagcagaggaagaaggtttgttagatgttctcctaaaattcgaggatggtaatgatagtaaccagagcatttgcttaactattaacaatatcaaggcagtaatcgcggacatcttcggtggtggagtagagccaatagctactaccataaattgggcaatggcagagatgataaggaatccaagagtgatgaagacagcacaggttgaggtgagagaggtattcaatattaaaggaagggttgatgaaacttgcatcaatgaactcaaatatttgaaatctgttgtcaaagagaccctaaggttgcacccaccagctcctcttatacttcctagagaatgtcaagagacgtgtaagattaatgggtatgacataccagtaaaaaccaaggtattcattaatgcttgggcaattggaagagatccaaactactggagtgaaccagagaggttttatccagagagattcattgacagctctgttgattacaaagggggtaattttgagtacattccatttggtgctggaagaagaatatgtcccggcatcacctttggtttagtaaatgttgaactaactcttgcgtttttgttgtatcacttggattggaagcttcctaatggaatgaaaaatgaggactttgacatgactgagaaatttggagtgactgttgcaagaaaagatgacatatacttgatacctgctacttctcgtcctttcctgggaaatggtgcagaaagcatggaagcagtgcagtcaaagaaggttgagtag

SEQ ID NO: 3664 - DNA, 1014 bp, Glycine max var. Williams 82
atggccaaagagactagtgttgtttatctatatcccagcaaatcacaagtttggggtgagaattttgatcataaaaaacttgtaataacaacactagctgctaatggaaagaaggaggagagtaatggagcacctaatgacacatatcctgcgtttcccgggtggtatgctgatgtttcctggccaggagaagcacacacatataaaatagaaaagattctattccacgggaaatcagaattccaagagcttcttgtatttgagtcttctagacaaggcaaggttgcaattcttgatgggcatatccagctgacagaaaacgatgaatttgcttaccaagagatgctcactcaccttgcactctgttccattccagatccaaagaaggtgctgcttattggagggggagatggtggaattcttagggaaatatcacgccattcttctgttgagcatattgatatatgcgaactagaccaaatggtcattgatgtttattcggagtttttcccggatatagctgttggttacgaggatccccgagtgcatgttcatatcagcgatggagttgcgtttatcaattctgttcctgagggcacttacgatgtcattatatcggatgcttttccagcaatggggcatagtgctgatgttcttgctgatgaatgcttcttagaatcagtagcaaaggctcttcgacccggaggagtgttctctgctccagcagacagcctgtggcataagaactttgtggttgcagacaccatagcaaattgcaagaagatattcaaaggctccgttaactatgcttggaccacggttcctacatatgcaagtggggtgattggattcatgctttgctctacggagggtccaccagtgaacttcaaacatccaataaataaattgaatccagagaaaaatggggtggcaaagggacctactaagttttataacccagagatccatgctgctgcattctgtctgccttcttttgtggacaaggttgattga

SEQ ID NO: 3665 - DNA, 393 bp, Glycine max var. Williams 82
atgaactataaaagcagtgtcactgccacttccattaaaaccatacttctagatagaatggctgctcctactccagtagctataggcacaaggggcacaattgggtctcttgtaaggaaggaaatcgaatacttctccaagtttgagttagggagctcacaaaggcctcagccacactttgtgaacatggtttctcgcagaggctattccacttccaggcccagtttctgggtcttgctaatgacagggaagaggaggaagcgaaggggtaacaatgtgtttcttccaaaaatgtgttctgttgctgaagtggtagaaagcaataagtggaacagggttcctggttacagctacaggatcctcaaggatgatatcaacaactttcagctctga

SEQ ID NO: 3666 - DNA, 1704 bp, Glycine max var. Williams 82; identical to SEQ ID NO: 3080

SEQ ID NO: 3667 - DNA, 1176 bp, Glycine max var. Williams 82
atggcagagacacggctcagggaaaaacctgcgccggacctcacggacttcatgaacgacatgtttttcggggcagcagacatggatcacaaaacctacgacctcacaggtagcacaggtgtggcggtggacgacgacgacgactacgacgaggaagggttcgacgacagcactagaagcaacagtgcaaggttgacacaagaatggttacaagaggcacggcgaatcgtggcttcctctccttcacgctgtgattctcctgctcgctctttagggtccccaaggttcggagctacacaaccaccctcaccccttccttcctcctcggaccgaagagacgccctctctagaactagatctgcccgaagatacagagcagtggaagggatcagtgatgagatactgtcgaaaacagcaaaacacactcgcaacaaatcagacactttcactcagccttcatcagatggggatggatcccctgcaacggcgctgcacaactggttcgccaacattctcaaaccgacctatagcaataacaataacacacaacaaccacctccttctcctcctgattctcctaaaccttctctccctccacgtcagcatcatcctcgaaagtcccgcttcaaaaccgagccctctgctgcacctcacccgcaggggatccatcctcccaattcgagacgaaccttcaagacttctacgccgccgccggagaatcctccgtcggattctgctcctctttcgccgccgaggaacctcgtggaatccgctcagcggagaacgatatcgtcttccacgtgctcgcaggagaggatcgcgccaaggcatgttcttgcaaagggagaggaagcgagcctcaacggcttcctcaaagagcagaggattttgttgaagaaaatctcgagcggagagttacatgcaaatgcgcaaatcgtgctttctgggccttccaacagcacggcgtcgatggtggctgccatttgccacgcgtggctcttgggttataggcagaaggagaaggagggtggaagcgagcgcgcagtggtggtgcctgtgatgaatgtgatgcgaggctccatgtggaagctgaagcaggctgcgtggctctttcaccatgctgctcttgatgccaatgcattgcttttcaccgatgagatttcaccagacttttaa

SEQ ID NO: 3668 - DNA, 2247 bp, Glycine max var. Williams 82
atgaaagttaaggcactgaatgaagcaaggctagaagcaaatatcagagtgtatggggacgaaaagcaccaaaagagatggccaagcccttactcaattgcctctggagtgttacttttgctttctctcctcaaatttgtgttccatcccttgaaatatttggcactaggagcagttgctgttgctgtctatcctctcatcttaaaggccattgtctccattcggaaccttaggctggacatcaacattcttatgctcattgcagttattgggacaatttctatgaatcattatttggaagccggcaccattgttttcctcttctcaattgcacaatggctagagtcaagggcaagccacaaggcaactgcagtaatgtcatctttgatgaacatagcccctcaaaaagcagtcatagctgaaaccggagaggttgtggatgctgatgaggtgaaaataaacaccgttttagaagttaaagcaggcgaggtgatacccattgatggtgttgtgatagatggaatctgtgaagttgatgagaaaaaattgactggggaatcattccctgtggcaaaacaaaaggattctactgtatgggctggcaccatcaatttaaatggttatattagtgtgaaaactactgcactagctgaggattgtgtgatggctaaaatggcaaagcttgttgaagaagctcaaaacagcaaaaccaacatccagagattgattgacaagtttgcccagttttataccccaggcgttgtaatcatatcagctcttgtagcggtgattccacttgcgctaaaacaacataaccataaactttggcttcagttttcgctggttgttttagtaagtgcatgtccatgtgcactcatcctttcaacgccagttgcaactttttgtgcttacaccaaagcagccacatcaggtcttctcatcaaagggggtgatcatcttgaaacacttgccaaaattaaggtcatggcctttgacaaaacgggtaccataacgaagggtgaatttgtggtcacacattttcaatctctttcagatgacattgatttcaacacattggcttactgggtgtcaagcatagagagcaagtcaagccatccatcggcagcagcaattgttgattatggaaggtctctctccgttgaaccagagccagaaaaggtgacagaatttgaaattttccctggcgaaggaatatgtgggaaaattgaaggcagagttatttacattggaaataaaagaattgccgcaagagctgggtttgaaacagttcctatcttacaaggtgaagttgaaagaggaaagaccacgggatacatatacttgggagcaatcccaattggatttttctctctttcagatgcttgcagattaagagttcaggaggcaataggacagttgaagtcattgggaatcaaaaccgctatgctcactggagataatcaatctgctgcgatgcaagtacaggatgagctggggcattctcttgagttagttcatgcagaacttttgccagaggacaaggtgaaaatcatctcagaatttaagaaggaaggtccaacagccatggttggggacggcctaaacgacgcgccggcattggctgcagctgatattggaatctcgatgggcatttcaggttctgcattggcaagtgagacgggcaatataattcttatgtccaatgacattatgaagataccagaagccattaagcttgcaagaaaagctagtaggaaagtggtagaaaacattgttttttcaatcatgactaaggctgcgattcttgatttggccattggtggtcatccacttgtttgggcagcagttgtggctgatgttggaacatgcctattggtcatctttaacagcatgttacttctgcgaaaaggacacaaccatggaggaaaatgttgtagatcttctactaaaccgcataaccacaaaaatggatgtggtggctctcatgataattcctctcatcatcaccatcatcatgagcatgatcaacatcaacatgaagatcatagccacaaacgttgttgctcagaaaagacaaaaaaattgttcccacctcagaaatgtggtggtgctcatggtagttcctctcatcatcatcatcaccaccgtcaacatcaacatgaataccataaccatgaccaacacgatcaacatcatcagaagtgtgcctcacaaacaagtttctcaacatgtccaccctgctcttga

SEQ ID NO: 3669 - DNA, 6555 bp, Glycine max var. Williams 82
atgtcgaaggaaactcgaacctccgctcgaagaaaccctcaaaccgaatcaaacgagaacgaattcgaaccatgccccccgaaccaaatcaacttcccacctccccgaacccccttcagctccatacctgacccctctcggttcggaaacgccactcccaggctctccgttaggttcgggaagccgcattccgaacctaactcggcgcagagcacgccttctagaaacacttccaggctttcactcggcggaggaaggttaagttcgtgtgcgttcgttaaagagaccgaattctgcgtccacgttccgcatttcgacctcaaagacgacccgtcgttctggacggatcataatgtgcaggtgctgattagaattcgaccgttgagtaattcggagaaggtttcgcaagggcatggtaggtgtttgaagcaggagagtgcgcaaactttggtctggctcggtcatcctgaaaccagattcacctttgatcatataggatgtgagaccttatcacaggaaaacctgttcagagttgctggagtgcccatggtggagaattgtttgtctggttacaacagttgtatgtttgcttatggtcagacgggtagtggcaaaacatataccatgatgggtgaaattaaggaaacagaaggataccttactgaagatagtgggataacaccaagagtttttgactatttgtttacgaggattaaagcggaagaagagagaaggaagtattacaagctgaaatacagttgcaagtgttcctttttggagatatacaatgagcaaataactgatcttcttgaaccttcatcaactaatctgcaactcagagaagatttgaagaagggggtatatgttgaaaaccttaccgaacatagtgtggacacagtttatgatgttctcaggcttttgttacagggcactgcaaatagaaaggtggctgctactcacatgaactgtgaaagcagtcggtctcacagtgttttcacttgtattattgaaagccaatgggagaaagattctatgacccactttaggtttgctaggttaaatttagtagatttggctggttctgaaaggcagaaaagctctggagcagatagtgaacgtttgaaagaagcagcaaatataaataaatcgttgtcaacacttggcttggtcataatgactttggtggacttagcccatgggaagcctaggcatgttccgtacagagattcaagacttacatttcttcttcaggattctttaggtggtaattcaaagacaatgatcattgcaaatgtcagcccatccatttgctgtgctaacgaaacactaagcacactgaagtttgcccagcgagccaagctcattcaaaacaatgcaaaagtgaatgaagatgcttccggtgatgtaagtgcactgcagtggcagattcaacagttgaagggtcaactgtcctttctgatgaacaataaaaaatttccaagctctgttccaaatttagagccaaatcctgaaagctgtaggttgagtgaagtgtcagaagaatatgaatctttgggagaaagagtaacaacagatcaccaactacttattccaagcaaagaggttcgacaaaaggaagaggaaattcaacatacttcaagtatgctgaggcattataaggagaaaattaaacaacttgagttattggtagatgggaaactgtcagctgagaagtatctaatggaggaaaacagggctttacaggaggagattcagttgcttaaagtgaatattgataaaaattcagaatcatccagacttgctttggagaatgatagacttttgcaacaacttcaactatttcaaaacttctatgagcatggagagcgggaaagattgctgactgaactatctgaattgcgtgatcagctccttgtccatctccaagaaaaatttacatactccatgaaaaatgaaaatcaggatactgatactgcacaagagttagaagagtgccagaatatgaattctaaattacttagagaagttggtatattacaagcaaatcttggaaaatatttgaactacaatcaaattctgaattcttcttttgagcatcctggtgaaattctaaagactgataaatgttcattggttgagacaatatcaatgagaagtgattctggagatgaaattccgtcctctacatgggaagctgatgatgctttagcaaatataattgaaggaaatgctttgcgatcctcaataatgcttgctaaagataatgaatataacaacgaagagttagaggccaaattggaaaaaatgagcaaggatcttgaagaagcgaggttagttaatgaccaatatcaagagaaatgggcattacaattatatcaaaaacgacagactgaaacaatctgtcaagaggttgagatggagacaaccaatacaattcttcatttacaggaagaggttgcccatcttcagtcagagtttgaagagaggttatgcaccattgctcaagaaaatacagagctaagaaatatggttgcagaaaaagaagaggaaattaggtcacggtgtttggactgggaaaaggcaatcttggaactgacaactttcctcctagaaggctccagatctctcaaagatgcctgtggtcaggtgaaaaacatttcttgttcatttcctcaggccaatgcttggattagcgaacatgttgacatggcggtcaaaaagtatattgagaaggaggaaacaattcagcagctacaaagtagcttgaaggatgcacagaagatggtatcggacatggagctgaaaataagttccttaaaggaagcaacagtagccttcaatgcacttcaacagttagacaacaatgaaggcaatgaggaggtgattgagttgcaagtgttgttaaatgagaagaccaatatgataaggatgctggaaaatgaaataaatcataaaaacaatcaactttgtaaggtaaccaaacaagctgatgctgcattccttgtagcaaagtggctctctgattgttataatgtagctcacatgaatgatgatattcaagatatttccattcctgaacttgatgtgcaagccagacttggaaattgtactatttctgagaatcaagatgttcaaaataatttgatactgaatgatcttatggctcaagttgagttaacaaaactagaggtactggagatggagaatgctgtaaaagcctcttttgttgatacagaaacacagatagaagctttccaaactggtgtttcaggcctttattctgcttacaggaacttgattcaggacattgtcaaggaaactcaggatacaaagaaagaaataagggatttaaagatttatcatagaagttccaagggttatagagtagactccttaacatcaaatgcaaacaaatgtaaggagtatgcaaaccagcatcacacactacatcagataaaagagcaacttgttgaagtgaatagaagattgaatgtcatagacaattttatcagagcagaaaatatgtctagctttcaactactggatgaagatctcatagatgctgatgatttgagcgctgatagttcttcagtctctgatttatcaactgaaactgacagctttgcttctggaagcaagtcacatgaatccacatatacttgcaactttaagttccctggaaaaacaactgaacaaattgtacacctaaaatccgaaagatgttctgtaattcaatctcatggtagttgcaaatcatcaaatacaggaaagcttgtggaaaggcgaattcataatgaagcagtagtgtgctgtctgagtaaagaattaaatgtcacatatgatagttttcaaagattgtatcttcgtttgtctgcactcctccaagaattggatgatggatcctgtttttacccaaaagaactgaaaaaggtggctccatatttccagttggagatgcagaaagacaaagcaggttgtgagaatgacaaagagatattgggttatatggaaattaagcctgatgatggcttcttgaccaaatttatggaagctcatgcaacagtgcaggaagctgatcttacactgcatgccttgacggaagcttatgaagattcaaaacagttgactgctatgtggaagcaagctggtgaagacttgatgattgagagagcgagcttggtagaagagattcaaaaactcaaattttcaatttttcataaagaagaagagaatcgattactgaaggaccacatacatttcagtttgatggatatgacaaattcagtttctatgctagaagagcatttcttgcaaatgcaaattgatgtggagaagaaattcttgacaatgtattctgatattcttgtgactgggcaggagatgctatactttatgcacaacctgaggtcatcagtagaagatatttgctctcaaatggtgggtgaagggtttatatcttttgttctgtacaattgctgtgtaacagagcttgtcagtaaatttgcctgcactagtgtgaaccgtgatttacaatcagccagaccaggggaattgcataagttgccacaaatttgctctagtgttgcagcgccagcaattagtacaggtaaagaaggtgcagagaaaagagatcaatgtgtgctaatccaaaaggtgcaagagcagccagacttgcccaatgtcaatgtattatatgaaaatatggctcttagaaaggagttagagaggaagcaagagctattagagggcttactttttgactttaggctattgcaggaacaggcttctaacagcaaggacattaaggatcagactgagaagttaatattttctctaacccaagttcggtatgagctagagattaaagcaagtcagcttgatgatatactggttcaaaacagaaaacttgaaggttctcttgctgacactgagaaggccttaactacatcaaattatgaccttcaacttgctaaagaatcaattgagaagctttctaatcaaaatgtggagttaagggagcttctgaaagaactatatgccaacaaaactgaagctgatgggaaattggaggaacataaagaggtgattagaggtttggaaaaagaaatttctaatttgacagcttcacaggaaaatcaatcacttgccttgtttgaaagcattgaggatgaactaaaccaggtgataatagagagagaccaactccatgaagaagtttgcgtcttgaatggtaagcttgagatggcttattccttggctgacgaaaaggaagctattgccatggaagcgcgtcaggagtcagagtctagtaagctgtttgctgagcaaaaggaagaggaagtcaagattctggaacattctgttgaggagcttgagtctaccataaatgttttagagaaaaaggtacatgaaatggatgaggaggtgggaagacatcggttaattagtgattcactgagaatggaactccaagctttgaaagagagattattgttagttgacaattttcccaagaatgcttattcagaaagcacaagtggtcaaactgatgagcatatatctagacaacccagtaaaatactggaacttcgcgaggcactaagtcggataaggtttcttgaaaaggaaaatgcagaacaagataaagagattaaaaagtgcaaagagtatatatctgaaattgtgttgcatgctgaagcccaagcattgcagtaccaacagaagtacaagtgcctggagtccatgttccatgaagtcaaaacagaagtgtcaaattcaacgtcaatggtatcagcatcagagaaaattgagaaaagttcagtaaggacaagaggttcaagctcaccattcagatgcatttcaaatattgttcagcagatgaatcaggagaaagatcaagaactgttagtgtcaaggctccgtgtggaagaactagaagcacttgcagctagccggcaaaaggaggtatgcatgctacaaacaaggctggctgctactgaaagcatgactcatgatgtcattcgggaccttcttggtgtcaaattggacattaccgactatgcaaatttgatagacgaaaaccaaattgtgaaattagtggaggaggctcatcatcatagagaagagttcattgcgaaggaaaaagagaatctcgatttaagactgcagataaatgatctcattgaagaaagagaatgctgcatatcggaactgaaaaccaaagaggcagatatacttgccactcagatagcaatgcagcaactgcaagagcgagatcaattgctttctgcacaaaatgaaatgttgaagatggacaagaccaatctcatcaggaaggttgcagaattagatgacatggtgaaaacactagttgggacacgaaatacccaacctgctccacagtcatcaaagactaaggacaagggtgcattaaatttgggtaacggtggatacaataaaaggttgtctttgtctcaacccgaacgacgcctttctcgttttaatgacgagccttctcgttaccgcaaatttgctggtaataattcgcaaggctaa

SEQ ID NO: 3670 - DNA, 2199 bp, Glycine max var. Williams 82
atgtcaggctgggacgaaggagccgtctactacagcgaccaggccctcgccggcgacgacggtgccggcgcccgcggtgaagctggcactgattccaaccacactctcatccagaaattcaaggaattcatccgaaacttcgagacaaccaacaatgtcttcccttacagagagagtctcatccacaaccctaagttccttctcgtcgatatgggagatctcgacaccttcgactccgagcttcccgcgaaactccgctctaaccccgccgatgtcttgcccttgttcgaaacagcagcggctcaggttctcgtgaatttaaagacgaaggtggctggggataccggagatatggaggatcagacgcctggtgatgttcagattctgctcacatccaaagaggatccagtgtcgatgagatcgctcggggctcaatatatatcaaagcttgttaaaattgctgggattactattgctgcatccagaactaaggcaaaggccacttatgttaccttgatatgtaaaaattgtaagaaggggaaacaggttccatgtcggccaggacttgggggagcaattgttcctcgatcttgtgatcatgttcctcagcctggtgaagaaccttgtccaattgatccctggctcgtggttcctgacaagagcagatatgttgatcaacaaactttgaagatgcaagaaaatccagaggatgttccaactggagaacttcctagaaacctgcttctctctcttgatcgacatctggttcagacagtggtgcctggctcaagattgacaatcatgggaatttttagtatctaccaggcttctaactctaatacatctaacaaaggagcagttgcaattagacagccttatattagggttgtaggaatagaagaaacaaatgagaccaattctcggggtccagctgcatttacacaagatgagatagaagaattcaaaaaatttgctgctgaacctgatgcgtataaaaatatctgctccatgattgctccctctatatttgggcacgatgatgtcaaaaaggctgttgcctgtcttctgtttggagggtcaagaaagaatttgcctgatggagtccggttaagaggtgatatcaatgtattgcttctgggtgatccatctacagcaaagtcacagtttctgaagtttgttgaaaagactgcccctattgctgtttatacttctggaaaaggctcatcagcagctggcctaaccgcttctgtaatccaagatagcggcactcgtgagttttatcttgaaggaggggctatggtcttggccgatggaggtgttgtctgcattgacgagtttgataagatgaggccagaagacagagttgccattcatgaggccatggaacaacaaactatatctatagccaaagcaggaataacaactgttcttaattcaaggacttcagttcttgctgctgccaaccctccatcaggccgatacgatgatcttaagactgcacaggataacattgacttgcagacaactattctttctaggtttgatttaattttcatcgtgaaagacgtcagaatgtacagtcaagacaagataatagctaatcatatcataaaggtccataaatcagctggtggaaggatgggagagagcagaactttgaaagaagagaattggctgaagaggtatttacaatattgtcgaactcaatgccaccctcgtctatctgaatcagcaacaacattattgcagaatcattatgtgaaaatcagacaggatatgagacaacaagcgaatgaaactggagaagctgcagcaataccaattactgtgaggcagctggaagctattgttaggttgagtgaggcacttgcaaagatgaaactatctcatcttgctactgaggagaatgtgcaagaagcagtaaggcttttcaccgtgtcaacaatggatgcagccaagtcaggaataaaccaacaaataaatcttacacctgatatggcaaatgagataaagcaagctgaaacacagataaagagaagaattggaattggaaaccacatatcggaaagaaggctgattgatgacctcagcagaatggggatgaatgaatctattgtgagaagagctcttataatcatgcaccagagagatgaaatagagtacaagagagaaaggcgtgttgtatttagaaaagcatga

SEQ ID NO: 3671 - DNA, 1860 bp, Glycine max var. Williams 82
atggccgccaaaacggtaacccctgacgccgtttcgatgctcctggcaaacacttgccccgattcctcatcggatctccccgaaatcgttgttcaagttctcgatctcaaggcgacaggcaataaatacatgtttactgctaatgatggaaaaacgaaactgaaagctatgatttcttcggatatgtgctctcaggtgctctccggggctattcaaaacctaggtcttattcgcgtccttgattacactgtcaacgtaatacccaataaatcggacaaatacctcattgtcactaaatgtgaacctgtatctcctgcgcttgaaattgagataaagagtgaggaatctggatctgggattcttttgaagtccaaggtagagggtggagtcaatactgaaggtcctgctgctgctgggattcttctcaagcccaaacaagtagtgacaaaatctgccaatcagattctacgcgaacatggaaattcggctcctgctgcacgaatggcaatgacgcgtagagtgcgtcctcttgtttccttaaacccttatcagggtaattggacaataaaggttagcgttacgagcaaagggaacatgcgtaactataaaaatgctaggggtgatggttgtgtcttcaatgtcgaattgacggatgaagatggtactcagattcaggcaaccatgtttaataatgctgcgaggaaattttatgacaaatttattctgggaagggtttactacatttcaaaggggactttgaaagttgctaacaagcagttcaaaaccgtgcaaaatgattatgaaatgacgcttaatgagaattctgaggtggaagaggtagccggtgaagcaagttttgttcccgaaacgaagttcaactttgtgcagattgatcagctgggtcctcatgtaaataagtccgagcttgtcgatgtcattgggattgttaagaatgtgtcttcaacaatgaccattcgtaggaagagcgacaatgagagtattccaaagcgtgacattactattgctgatgacaccaagaagacagtagttgtgtccttgtggaatgaacttgcaactaccacaggacaagagttactggacattgttgataaatctccagttgttgcaatcaaatctctcaaggttggggacttccaaggtgtttctttgtcaactataggcaaaagtgtggttctggtaaatccagtcatacccgaagcaaaaaatctcagaagctggtatgattttgaaggcaaggatgctgcaatggactctgtaggctctggttcaagtccaacatctaacaatgggattagatcagtgtacactgatcgtgttttactttctgacataacctcaaacccatcattgggggatggcaagcccgcatttttcagtcttagaggacatataagcttcataaagcctgatcaggcaatgtggtatcgtgcctgtaagacatgcaataagaaagttactgaaagcgttggttctggatatttgtgcgatggatgccagaaaagcgatgagcagtgcagtttaaggtatattatggttgccaaggtttctgatgcaagcgctgagacttatatctctgcctttaatcaggaagctgagaagatcattggatgctctgctgatgatctagataaccttaaatcacaagagggagaagttaatccttatcagatgacattgaaggaagctacttgggctcaacatctttttcgggtaagtgttactccgaacgagtataatggcgagaagagacaaaggataacagttcgggcagttgttcctgttgacttcgctgctgagtcaaggtttctgctggaagatttatcaaagatgagagcataa

SEQ ID NO: 3672 - DNA, 354 bp, Glycine max var. Williams 82; identical to SEQ ID NO: 3036

SEQ ID NO: 3673 - DNA, 1746 bp, Glycine max var. Williams 82; identical to SEQ ID NO: 3081

SEQ ID NO: 3674 - DNA, 1113 bp, Glycine max var. Williams 82
atggccaaaaaatcacagctgcgtacccagaaaaacaatgttaccaccaatgacgataataatcttaacgtaaccaacactgtgaccaccaaggtgaaacgaacaaggagaagtgtccctagagactccccacctcaacgcagctcaatataccgaggagtcactaggcaccgatggacaggccgatacgaagctcatttgtgggacaaacattgctggaatgaatcacagaacaaaaaagggcgacaagtctaccttggcgcttatgacaatgaagaggcagcagcacatgcttatgatctagcagcactgaaatactggggtcaagataccattcttaattttccgttatcaaactacctgaacgaactgaaagaaatggagggtcaatcacgggaggagtatatcggatcgctgaggaggaaaagcagtggtttttctcggggaatttctaaatacagaggtgttgcaaggcatcatcataacggaaggtgggaggctcggattggcaaagtttttggcaataaatatctttacctcggaacttatgctacccaagaagaagctgctactgcctatgacctggcagccatagaataccgtggactcaatgctgtcaccaatttcgatctcagccgttacattaagtggcttaagcctaacaacaacaccaacaacgttatcgacgaccagattagtattaatctcactaacataaacaataataataattgcactaacagcttcaccccaagtcctgatcaagaacaagaagctagcttcttccacaacaaagattcactcaataatactattgtagaagaagtcacgttggtgccacatcagcctcgtccagcgagtgccacgtcagcattggagcttctacttcagtcatcaaagttcaaggaaatgatggagatgacatctgtggccaatctttcatcaacacagatggaatctgagttgccacagtgcacatttcctgatcacattcagacgtactttgagtatgaagattccaatagatatgaggaaggagatgatctcatgttcaagttcaacgagttcagctccattgtgccgttttaccaatgtgacgagttcgagagttga

SEQ ID NO: 3675 - DNA, 345 bp, Glycine max var. Williams 82
atgatcagaaaatggaaaagagtcattgaagagttgctagatcctcaagtcaagtgcaattcgagttacacggatcaagtggctcgcatgattgatgttgtagttgcctatgttacaagtgaagaatataggagacctagcataggtgagattgttgcaatattgaaaggtgaagtagagcttgttctctctagaagaaggaagtctagttattttggcaatggatatgtgattgattattaccatcaattacaagaaacaaataatgagatgaaaagtcaattggctttgacaatgctaagagttctagagtgtgaggatgatgattttctctatggtcattga

SEQ ID NO: 3676 - DNA, 2070 bp, Glycine max var. Williams 82
atgccacctactattatgagctctgaggaacagcctcggatgatttattcataccggaacgtgatgagtggttttgctgcaagactcacggaagaagaactgagagctgtgcaaaagaagaatggctttatttatgcgcaacccgaaaggatactgcatcgtcaaaccacgcataccccacaatttctggggttgcagcaagacatgggattttggaaggaatcaaacttcggaaagggagtgattgttggggtggtggattctggaatcacacccggtcatccttccttcagtgatgcaggaatgccgccaccaccaccaaaatggaaagggaaatgcgaacttaatgcgacagcttgtaacaacaaactaataggagcaaggtctttcaacctcgctgcaacggcaatgaaaggagcagattcaccaattgatgaggatggacatgggactcacacagcaagcacagctgctggtgcttttgttgatcatgcagaattactaggaaatgccaaaggaacggcagctgggattgcccctcacgctcacctggcaatgtacagagtatgctttggtgaagactgccctgagagtgacatattggcagcattggatgcagctgtggaggatggcgtggatgtaatatcaatatccctcggcctaagcgagccacctccatttttccatgatagcactgcaataggtgcatttgcagcaatgcagaagggaatctttgtaagttgtgcagcaggaaactctggccctttccatggctccttaattaatggagccccttgggtcctcacagttggagcaagcaatattgacagaagcattgcagcaacagcaaagctgggaaatgggcaagaatttgatggggaatctgttttccagccttccgatttctctccaacattattacccttggcatatgctggaaagaatggcaaacaagaagctgcattttgtgctaatggatccttgaatgatagtgatttcagaggcaaggttgttttgtgtgagagaggaggaggtataggaagaattcccaaaggagaggaagtaaaaagagtaggtggtgcagccatgattctcgcgaatgatgaaagcaatggcttcagtctctcagctgatgtgcatgttctacctgcaacacatgtaagctacgatgctggacttaagattaaagcctatataaattccactgcaatacctatagcaaccattttattcaaggggactataattggaaactccttagctcctgctgttacatccttctcttcaagaggtcccaacttgccaagtcctggtattttgaaaccagacatcataggaccaggcgtgaacatcctagctgcctggccattccctctgaataacgatactgattcaaaatccactttcaactttatgtctggcacatcaatgtcatgcccacatcttagtggcatagctgctttgctcaaaagctctcatcctcattggtcaccagctgccataaaatctgccataatgacttctgcagacataatcaattttgaacgcaaactcattgttgatgaaacacttcaccctgcagatgtttttgccacaggttctggtcatgtgaatccatcaagagcaaatgaccctgggttagtttatgatattcaacctgatgattatataccttatctgtgtggtctagggtacagcgatacccaagttgggatcattgcacacaaaacaattaagtgctctgagacttcaagcattcccgaaggagagcttaactatccttcattttctgttgtgcttggttccccgcagacattcacaaggactgtgacaaatgtgggtgaggccaactcatcttatgttgtcatggttatggcaccagaaggggttgaagtgaggatccaaccaaataaacttaccttttcaggagaaaaccagaaagagatatattcagtgtcattcagccgtatagaatcgggtaatgaaactgcagaatatgctcaagggtttttacaatgggtctcagccaaacacagtgtaaggagccctatcttagtcaactttgtctaa

SEQ ID NO: 3677 - DNA, 1299 bp, Glycine max var. Williams 82
atggatcccgaggtccaaggcattttaactgctgctcaaaagcagtggccacatatccatttatctgattcactggtcatggcagattcagcagtcaaaatggcaaaagctggatgccaattcataacagttctaggtgtcgattttatgtcagaaaatgttggcgtgtataggatgtcaaataagcaaattggctgttctctggctgatgctgcagctactcctacttacatggaatatcttgcggctgcttctaggtctacttctttgcatgtcatatacattaacactaagttagagacaaaggcatatgctcatgagcttgtgcctacaataacctgtacttcatcaaatgttgtccagactatcctacaggcatttgctcaagttccagattttagcatattttatggacctgattcttacatgggtgcaaatatcaaagatttgttccaacaaatgacaaaaatgactgatgaagagattgctgcaatacatcctaagcacagtcaagactctattaggtcattactgcctcgacttcactattttcaggatggaacatgcattgttcaccatctatttggccatgaagttgtggagaagataaaagaaatgtactgtgatgcattccttactgcccaccttgaggtacctggagagatgttttctttggcaatggaagcaaagagaaggggaatgggtgtagtaggctccacccagaatattttggatttcataaaggataggattcaggaagctttggatagaaatatagatgaccatctccaatttattttaggaacagaatctgggatggtgacttcaattgtggcaacggtccgtagtttgttggagcctgcgaagtcctcttctcaaagagcaaaagttactgttgaaatagtctttccagtttcatcagactcaatctcaacaacaacctcaagtttatcctcaggtcttaattctgtcaaagtgggagatatcatacttcctgttgtgccaggaatagccagcggggagggttgttccattcatggtggctgtgcatcttgtccatacatgaagatgaattctcttagctcactcctgaaagttagccatcacctacccgatgaagaaaatatcctttcagcatacaaggcagagcgatttaagttgcaaacaccaaatggcaaatcagtggcagatgttggatgtgaacctattttgcacatgaggaacttccagagaagctcgttgatcagattcttcgtccccaacacagttgaagttcagtgtgataaacttgagaaataa

SEQ ID NO: 3678 - DNA, 1554 bp, Glycine max var. Williams 82
atggctctcaaacaatggctgtacgagcaaatgaaagaaatggccttctctaccttttatctatctcttttcttcttcatcagcgtcctctacttgtttaacctcacaagaaaaaccaaatccaaaaccaatctgaatttgccaccatcaccaccaaaactaccactcataggcaatcttcatcagttaggctcactaccacatcgatctcttagagacttgtcactcaaacatggtgacatcatgttgttgcagttagggcagatgcagaatccaacggtggtggtttcatccgcagatgttgccatggaaataatgaaaacgcatgatatggccttttcgaaccgaccccaaaacactgctgcaaaagtcttgctctacggaggcattgacattgtttttggactctacggggaaaggtggagtcagaaaaggaaaatatgtgcccgtgaacttctgagcactaaaagggttcaatcatttcatcaaatcagaaaagaagaagttgccatattggtgaataagctacgtgaagtgagctccagtgaagagtgctacgtgaatctaagcgacatgcttatggcaacagcgaacgacgtcgtgtgtagatgtgttctcggacggaaataccctggtgtcaaagagttagcaagggatgttatggttcagcttacagcttttactgtgagagattacttccctttgatgggttggattgatgttctcactggaaaaattcaggaacataaggccacttttcgtgcattggatgctgtttttgatcaagcaattgcggagcatatgaaagaaaagatggaaggagagaaatccaaaaagaaagactttgtggatatcctactccaacttcaggagaataacatgcttagctatgagctcaccaaaaatgacctcaaatcacttctactggatatgttcgttggaggaactgatacatctagagcaacattagaatggactctttcagagcttgtgagaaacccaaccataatgaagaaagtacaggaagaagtgagaaaagttgtaggacataaatctaatgtagaagaaaatgacatcgatcaaatgtattatttgaagtgcgtagtcaaagaaactctaagattacactcacctgctcctcttatggctccacatgaaacaatatcgagtgttaaactgaaaggatacgatattcctgcaaaaactgtggtgtatatcaatatatgggcaattcaaagagatcctgcattttgggaaagtcccgaacagttcctgccagagagatttgaaaatagtcaggttgattttaaaggtcagcattttcagtttattccattcggttttgggagaagaggatgtcctggaatgaattttggacttgcttttgttgagtatgttcttgccagccttctttattggttcgattggaagctgcctgaatcggatacacttaaacaagacatagatatgagtgaggttttcggacttgttgtctcaaagaaaacaccactttatcttaaaccagtaactgtttcatctttatctgagttctaa

SEQ ID NO: 3679 - DNA, 2406 bp, Glycine max var. Williams 82
atgagcatttgcagaattgagtttctatcagctacaagggtttttcttgttctgtgccacacgatgaaggaagaaaacccatcagagaacaggtccaaagcttcaaaattttcagaccaaaaccaagccccaaagcctcaaaacaccaaaggagccaacctcaacaacaacaacaaaacaaggttgtggggtgctcacattgtgaaaggcttctccgctgacaaaaaaaccaagtcatttgccagcaaaaaactaacatcttcaacaacaacaacagcaatatccgagaatgttgttacaaaccagaacaacagcaataaaccttttgtgccttcttctcattctcgagtgaaaaggtccctcataggtgacttatcatgttcaataaaccctgctcaggttcatccacacgctttcccaactcatagaagacaatcttcaaccgatttgttcactgagttggatcacatgagaggattgctgcaagagtcaaaggagagggaaagcaagttgcatgctgaactttccgagtgcaggaagaaaatgactgaggtggatgaggttgtgaagagggttggtttgttggagcaagagaaggccactctcaccgagcaattgggtgctgcattgagttgtgaggaagtgaaaggggaagaagagcagcacaaggaggtgaaggtgcagaatcttgagctggaggttgtggagctgaggaggttgaacaaggagctgcagatgcagaagaggaacctctcttgcaggctctcttctcttgaggctcagctggcttgtcctaacaaatcttctgagagtgacgttgttgccaaaattaaagccgaggcatcattgctgaggctcacgaatgaagacctgtgcaaacaagtagaaggtttgcagataagcagattgaatgaggttgaggagcttgcctacttgaggtgggtgaattcatgtttaagaaacgagttgaagaacacatgctcagcgttggattcggataagccatctagtcctcattcagttgtgagcagtagtgatgattgtgttagttctttctctgatcaaaccaataggtattcaaattgtggaagtgcaaataggttcaatatggtgaagaagccaaaaaagtggcctataactagtgatgatttatcacaagtagagtgccaaggtagtctcattgagaagaataggattgaatcagatgtagggggaagccctagaagaagacactctatcagtggatcaaactactcagaggaagaggtttctttgagtaagagaagacagtcagattgttttgtgtgttcaaaagaaatggaaaaggaatcagtggcattgtctgttcaacaatctggtttggagattgtccaaagaccacaatattttagcaattgccaagaagctaacaagcttttggtttcttcagatgtcgagaaaagagccctacgcattcctaatccacctccaaggccttcatgttctatatctatcaagacaaaacaagaaacttcagctcaagttccactgcctccacctccacctcctcccccacctcctatgaattttgcatcaagaagtaacatggcatcggtgaaacgagcgccacaagtggtggaattgtaccattcacttatgaagagagactcaagaaaggattcttcaaatggaggactctctgatgcaccagatgtttctgatgttcgtagcagcatgattggagaaattgagaaccgttcatcgcatttgcttgctataaaggcagatattgaaactcagggagaattcgtgaattcattgataagagaggtgaacgatgcagtttatcagaacatagaagatgtagtggcatttgtgaagtggctggatgatgaactttgcttccttgtggatgagagggctgtccttaagcattttgattggccagaaaagaaagctgacacattaagagaagcagcatttggctatcaagatttgaaaaaattagaatctgaagtttcctcttacaaggatgatcccaggctacctggtgacattgctctaaagaaaatggttgcattgtcagaaaagatggagcgtacagtttataaccttcttcgcacaagagattcattaatgcgtcatagcaaggagtttaaaattccaatagaatggatgcttgacaatggaattattggcaagataaagctaagctcggttaaattggctaaaaagtatatgaaaagggtagctatggaacttcaagtaaagtcagcattagaaaaagatcctgcaatggattacatgcttctccaaggagtgagatttgcttttagaatccatcagtttgcaggagggtttgatgcagaaacaatgcatgcattcgaggagcttcgcaatctggcctctcttcttaacaaaacatga

SEQ ID NO: 3680 - DNA, 573 bp, Glycine max var. Williams 82
atggagtcctcaaagatctatgcttacctcttcctctgcatgatctttctctcttccgccactcccattctcggttgtggctactgtggcaaaccccccaaaaagcacaagcctggtaaaacaccaaagacacccaaaacacccgttgttaagccaccagtcaccatccctcccattaatgttcctcccgttgttcttccaccaatagtgaagcccccaggtattctccctccaattccaattattaacccaccaaccacaccagggaagggagggaacactccatgcccaccaccaaagtctcctgcgcaggctacgtgccccattgacacgctcaaacttggtgcctgtgtggatcttcttggagggttggttcacattggtttgggtgaccctgttgcgaaccagtgctgccccgtgcttcaagggcttgttgaggttgaagctgcggtgtgtctttgcaccactcttaaactgaagcttctcaacctcaacatttatgtcccacttgcccttcagctccttgtgacttgtggcaagtctcctcctcctggttacacgtgctccctctaa

SEQ ID NO: 3681 - DNA, 1023 bp, Glycine max var. Williams 82
atgagttcgattccaacaaccacctacgaagattcttcagcagttaacatttcagaattccaacctcaatctcacgcaccgaaggaaattgagtggcacatgctcgacaagtcaaagttcttcttcctgggagcagccttgttctcctctctctccgccgccctctaccccgccgtggtcttgaagacacgtcagcaagtttcctccgccaaaatctcgtgccgcaacatgtcacgcgccatcattcgctacgagggtttccgaggtttctaccgaggtttcggcacttccttaatgggaacaatccccgcacgtgcgctttacatgtctgcgcttgaagtcacgaagagcaacgtcggcaccgccaccgctcacttggggttttccgatgcgtcggccgctgccatcgctaatgccgccggaggcgtagcttccgccatggcggcacaattggtgtggaccccagttgatgtcgtgagccaaagactcatggttcaagaaagcaacaaaatgtgttacaggaatggttttgatgcatttaggaaaattctgggtgttgaagggccaagggggttttacagagggtttggggtttccatagtgacttatgctccctctaacgcagtttggtgggcttcgtattcaatggtaaacaggcttatttggggcgtgtttggtggttgtggtaattcaaattttggacgcgattcgaaggtgatggtgggtgtgcaagggttgagtgcagttatggctagtggggtttcgactattgtgactatgccacttgacacgatcaagacgaggttgcaagtgttggatgcagaagagattaatggacgaaggaggccattgactcttgtgcaagcggttcataacttggtgaaggaagggggaatcttggcttgttacagaggcttgggaccaaggtgggcttctatgtccatgtctgcggcaaccatgattactacctatgagttcttgaaacgcgtgtctgctaagaatctggatagattcattgtgtag

SEQ ID NO: 3682 - DNA, 1368 bp, Glycine max var. Williams 82
atgccagtgaccttgaaagcttgttacactgtgaagcctatagagacaacatggtgcggacgcgtatctttatctgaatgggatcaaacaggaaatgtaactcacgtccccataatctacttctaccgtactccctcgcaagagagcaacaacaacagcattgcttccaccttgaaagactcattaagcagagtcctagtgccattttatccactagccggtcgtttacactggataaacaatggtcgtttagaacttgattgcaacgccatgggagttcaattcattgaagctgaatcctcatcaagttttgaagatctcggtgatgacttttcaccctcttcagaatacaactaccttgtccccactgtagactacactctcccaattcacggcttgcccttggttctgattcaattaactaacttcaagtgtggtggcgttagtatcggcataacactttcacacgcggttgtggatggaccaagtgcatcacactttattagtgagtgggcaaggcttgcacgcggcgagcctttgcaaacggtgccgtttcatgatcgaaaagtgctacatgccggggacccaccttcggtgccactagcaaggtgtcactctcacacggagtttgatgagcctccgttgttgctcggaaaaacggacaacacggaggaaagaaaaaagaagaccgcaatggttatcctcaaactgagtaagacacaagttgagacattgaaaaagacagcaaattatggcggttatggtaatgatagttatagccgttacgaggctatagctggtcacatatggagaagtgcatgtaaggcaagagggcacaaagaggaccaaccaacaacgcttactgttatcgttgactcgagaagtcgaatggagcctcctttgccaaaagggtattttgggaatgcaactttggacactgttgctactagccttgcgggtgatttggtgtcaaagccgttagggtatgcgtcaagtagaataagagaggctattgagagggttagtgatgagtacgttaggtcggggattgagttcttgaaaaaccaggaggatttgagaaggtttcatcaagatcttcatgcaatagagagtgagaagaaggagcctttttatgggaaccctaatctggctgtggttagttggttgacgttgccgatctatggcgttgattttgggtgggggaaggagctttatatgagtccagcaacgcatgacttcgatggagattttgtgcttcttcctggtccagatggggatggatctttgctggtttgtttaggtctgcaagtggagcatatggatgcgtttaagaaacatttttacgaggacattgagtcaaaatcatga

SEQ ID NO: 3683 - DNA, 1362 bp, Glycine max var. Williams 82; identical to SEQ ID NO: 1909

SEQ ID NO: 3684 - DNA, 1572 bp, Glycine max var. Williams 82
atggctttagctcctacttcaaaagttgtccttggttcaatagcctttgcaatcttctgggtactagcggttttcccagctgtgccttttctacccattgggagaactgcagggtccctgctaggtgcaatgcttatggtaatattcaaagttcttagtccagaccaagcttatgctgcaattgatcttccaattcttggtcttctttttgggactatggctgtcactacttttcttgaaagagcaaacatgttcaagtacttggggaaattgctttcttggaaaagtaaaggaccaaaggacttactttgtagaatttgcctcatttctgctatctcaagtgcttttttcaccaatgacacatcttgcattgtgttgactgaatttgtgttgaaaattgcaaggcaacataacctcccaccataccctttccttcttgcacttgctacaagtgctaatattggatcctcagcaaccccaattgggaacccccagaatttggttatagctattcaaggtaaaatatcatttgggaggtttctgatgggtattcttccagctatgcttgtaggagttgtggtgaatgttgtatttcttatagccatgtattggaaggtgttatcttgtcctaaggatgaagaggatccaatctcagaaattgtagtagaagaggaggttgtttctcatcagttttctccagccagaatgtctcattttacatcctttaattctcaagaatgtaatggcagtgtagaccaatcaactccaagtgaaagcgaagttcagatgattcataggagcacaaaggattccacaaaaaactcaaatgcatccaaggaggggacaaatgacacaaaggaggaaattaataatccttcaaaaaatgttgcaatagtagtagataaacctattgaagcacatgttatactctcttcagaagaaaaggactacatgaacaacaaatggaagagggtactgtggaaatcttgtgtttatgcaatcacattagtgatgttgatcgcaatgcttataggtttgaatatggcatggacagcaattgcagctgcaataactttggtggttcttgatttcaaagatgcagggccaagcttagagaaggtctcatatgcacttttggtattcttctgtggaatgtttatcacagtagatggatttaagtcaactggaattccaagtgctatgtgggacttaatggagccctattctcgaatagatcatgctagtggaacagctatacttgccgtggttatacttgtcctatcaaatttggcttcaaatgtaccaactgttctattgcttggagcaagagttgcagcctcagcggctgcaatttccaaaggagatgaggagaaggcatggctaatcttagcttgggttagcaccatagcagggaacctttcactattaggatcagctgccaacttgatagtttgtgaacaagctcgtcgagctccaaaccttggatacacattaactttttggacccatctaaaaattggccttccttctactcttatagtcactgctattgggttgacactaataaaatga

SEQ ID NO: 3685 - DNA, 816 bp, Glycine max var. Williams 82
atggccaaccatgcagctcaaaaccctatatctgttttccttatgaccttcctcttgctaattaccagctccaaatcagactcattttctttcaacttcccaagttttgagcctggtgttagaaacatactagtcggtgatgatgccaagacaacaggtggagtgctacaactcaccaaaaaggaccaaagcggaaaccctactcaacacagcgttggcctctcagcatactttggaccacttcatctctccgaccgaagaaccggtagagtcgcggacttcgccaccgagttttccttcgtcgtgaacacaaagggtgcgccactccacggcgacggcttcaccttctttcttgcatcaatcgattatgaattcccggacaagtcaagtggtggcttcctcggactcttcaacaaaaaaacagccttcaacacttccctaaaccaagtggttgctgttgagtttgatagctttgcaaatgaatgggaccctaattttccggagtctgattctcctcacataggaattgacatcaactccattaggtctgtggcaactgcgccatggccacttgatattcaaccacaaggatcaataggaaaggcacaaataagctatcaatcttcctccaaaatattgagtgtgtcggtggattatccaaatagtcctgtcaaattaaaacccactgtgttatcgtatcccgttaacttaggggctgttctgtcagaatgggtcctaatcggtttctctggagccaccggtgacttggttgaaacgcatgacattctttcatggtctttcaattccttcttgtag

SEQ ID NO: 3686 - DNA, 1302 bp, Glycine max var. Williams 82
atgcctcttcgagtactccaagcagaagttacttcaccctctaatgagtcacatgcaccaccgcaccaatccgaatcattgttttacatcctcggaggaatagttgtgctggccatagtgttgatttttttgtatgtagttcgcaagcgaattaaacggccagcacagacgatgacagttgcaactaatgagcagcaagagtttgggggacacaatgaatcggcagaggtgatgaagatgatattttcatctaatcaacactcaggatcaaaggagttctttagtgggaaccttcggactattagctgctttgactaccagacattgaagaaagcaaccaggaatttccatcctgataaccttcttggaagtggtggatttggacctgtttaccagggaaagttggtagatgaaaggctagttgctgttaagaaattggctctaaacaaatcccaacagggagaaaaagaatttctggtagaggtgagaacaatcactagtatccaacacaaaaatctggttcgccttcttggatgctgcctagatgggcctcaaaggttacttgtctatgaatacatgaagaacagaagtttggacctctttatacatgggaacagtgatcaatttctgaattggagcacaaggttccaaattattctgggagtagcgcgaggactacaataccttcatgaggattcacacccaagaattgttcaccgagacatcaaagcaagcaacattcttcttgatgacaagtttcatccaaggattggagactttgggctagctagatttttccctgaagaccaagcttatcttagcacacagttcgctggaactttaggttatacagctcctgaatacgctattagaggagagttgtcagaaaaggcagatatctatagttttggagttctggtgcttgaaataatatgttgcaggaaaaacacagagcatactttgccatcagaaatgcagtacctcccagaatatgcatggaaactgtacgagaatgcaaggatattggacattgtagatccaaagctgagacaacatggattcgtagaaaaggatgtcatgcaagcaatccatgtggctttcttatgcctgcagcctcatgcacatttgaggcctcccatgtcagagatcgtggcattgctgacattcaaaatagaaatggttacaacaccaatgaggccagccttcctcgatcaaaggccgagagaggatggtgagaaccatcctttggaagcattatcccagggtttcacatctcccatttatgtaaaagcatctgattga

SEQ ID NO: 3687 - DNA, 1620 bp, Glycine max var. Williams 82
atgaagaccgaatcgcgttcgaaagaggaaacaaagacgtatcaggaatggtttaatttggcagattcagatggagatggtcgaatctctgggaacgacgccacaaagttcttcgctctctccaacttgtcgcgctcgcaactgaagcaactctgggctctcgccgatgtcaaaaggcaagggtttttgggcttcacagagtttgttactgcaatgcagttggtttcgctagcacaagcagggcaggaacttaaatcagatatcctcaaaacgcaaattgacaaggaaaatattaaacctcccgtattggaaggactcgatgctttagtagcacaaatgagtttaacaattagtgccccgccggaagtaaatgggactcctcagcctcaagtgttcccaactaaccggtggtttggttcaaaatcttcaaagaaattatctctgaattcagttacatcaatcattgatggcttaaagagattgtatattgaaaggttaaagcccttggaagttgcttatcaatacaatgattttgtgtctccattgttgaccaacactgattttgatgctaaaccaatggtcatgcttcttggtcaatattcaacaggaaaaactacatttataaaacatttgttaaaatgtgattatccaggagcacatgttggaccagaacctaccaccgatagatttgttgttgtcatgtctggacctgatgagagaagtattcctggaaatactattgctgtcgatgctgacatgccttttggtggcctgacaacatttggaggttcatttttatctaagttccaatgctctcaaatgccacaccctttgttagatgaagtaacatttgtggacactcctggtgtcctatctggagagaaacaaaggactcaaagaagctatgatttcactggtgttgtatcttggtttgctgcaaaatgtgatctcatccttctcctatttgatcctcataaattagacatcagtgatgagtttaaacgtgtaattgcatctctacatggtaacgatgacaagatacgagtggttttgaacaaggcagaccaagttgatactcaacaacttatgagagtttatggagcattgatgtggtcactgggtaaagttctaaatactcccgaagttacacgtgtatatattggctcatttaatgataagcctatggatgaaggcttcgtcagtccattaggacaggatctctttgagaaggaacaaaataatctgcttgctgatttgatggatattccaaagaaggcatgcgatcgtcggatcaatgaatttgtgaaacgtgcaagatctgctaaaattcatgcatatataattagccatcttaagaaggagatgcctgctataatgggcaaagccaaggctcgacaaagacttcttgataatcttgaggaagaatttgcaaaggttcaaagggagtttcatctaccagccggtgattttcccaatgttgaacacttcagagaagttctaaatggttataacattgacaaatttgagaaactaaagcctaaaatgattcaagcagtagatgacatgcttgggtttgaaataccagagcttttgaagaaattcagaaatccttacgattaa

SEQ ID NO: 3688 - DNA, 954 bp, Glycine max var. Williams 82
atggagatggagaagacgggcgcaggagtagcagtgttgtcggcgaaggaggcattcgagaagcttgagaaggtcggagaagggacatacgggaaggtgtacagggcacgagagaaggccaccggaaagatcgttgctctcaagaagactcgcctccacgaggaccaagaaggcgtccctcccaccactctccgcgaggtttccatcttgcgaatgctctctcgcgatccccatgtcgttaggttaatggatgtgaagcaaggccagaacaaggaagggaagacagtgctctacttggtgtttgagtacatggacaccgatctcaagaaattcattcgctctttccgccaaaccggacaaagcattccaccccaaactatcaaaagcttgatgtatcagctttgcaaggggattgctttctgccacggtcatgggatcttgcacagggacttgaagcctcacaatctgttgatggaccggaaaacaatgatgcttaaaattgctgatcttggactcgctcgggcatttactgtgccaattaagaaatatacacacgagatattaaccctgtggtatagagctcctgaagtcctcttgggtgctacccattactcaatggcagtggacatatggtccgttggctgcatatttgccgaacttgtcaccaaacaagctctctttgctggtgattccgagctgcaacaactcctgcatatattcaggctattaggtactccaaatgaagaggtgtggccaggggtgagtaaactaaaggactggcatgaatacccccaatggaaccctaaaagtctgtcaacggctgttccaggtttggatgagcttggacttgatttgctatcccaaatgttggaatatgagccttccaagaggatttctgcaaagaaagcaatggaacatgcttacttcaatgacctggacaaggggcatctttag

SEQ ID NO: 3689 - DNA, 312 bp, Glycine max var. Williams 82
atggctctcagatgggttctctactcagcttgccatgttttggggtaccctatgagcaacactgaagaagaggcggagtgcaaaaaggggttgtgccttgcaaacaatttcaatgaggttgatcaatactacccttcttcagggtttcaaatgccacttcactatccacgctacaccaaacaagactatgagagcatggaggagtggactgtggacttgcttcttaagcaatatgggttaagtttcaagggtacccttcacgagaagagagcttttgcaatgggagcattcttgtggccggatcaatattga

SEQ ID NO: 3690 - DNA, 1782 bp, Glycine max var. Williams 82; identical to SEQ ID NO: 1832

SEQ ID NO: 3691 - DNA, 2832 bp, Glycine max var. Williams 82
atgggagttgaaaaagatgggacaaaaagtggaggaggttatgttggtggttttttccagttgtttgattggagctcaaaatctcgtaaaaaattatttgcagccaagtcagatttaccagagtctttaaaactaggaagaaaagtcgattacaatgtggtaatgacacagccctcctatctggttgatgaagatgaaattggagtaggggcaagtgttagaggaagttgtgatcatagttatgcttcatctgttacggatgatgacgcatatggaacaagggcccctagtgttgttgccaggcttatgggattagattccttgcctccttccagtttttctgatccttattctaccccatactttgatacccggtcccttcaagactctcattacttcaagaaaaaccttggtcaccagcatgaccatcataccccatattctggaaagctggttgaaaaggttgagggctcttctaggaacttcatggatccaaagccgcaaaaggtcattaccagaccaattgaaaagttccaaacagaagtattgcctccaaaatcagcgaaatcaattcctgttacacaccataaactcttgtcccctattaagaatcctggctttgttccaaccaataatgctgcttatataatggaggctgcagcaagaattattgagcctggatcccaaactagtaccaagtccaagacacctctggcagcaccatcaacaccattgagagttagagatcttaaagataaggtggaggcttcacaaaaaggacctctaattgggccatcttccatgacctctagaactcgagatctaaaagagaaaagggaaatttctcatagaacaaccaggagctcagaatcttctcaaagatcagttgagtcaaatgctgccaagtatctaaaggggcagtctttgaacagaagctggaatggatctgcggatacatctgtatccgtcaaatctcctacaaacgaggaagaagattcttcttttaagaataagggaaagtccatctcacttgcaatccaagcaaaagtgaatgttcaaagaagggaaggtttgagtttgattggtggcagaagtatgacaggccagaaagagcatcctgatgttaaatccaaccaaccaatgaaggcaactgttcagaaaaatttacataagaaatcttctgttcagaattcttctggtgctctcagacagaataatctgaaacagaattattcaattgacagagacaaattaccatcaaagccattggttaccaattcacacaataggaaagttccgactggggattcctcttatggacgccatagaagctctagtaataaatccaatgcaaaatctaaagttgggtccagaaagtcagccatggaggtgacagatagtgaaaaggaagtcttatataccagcacaaacagttttcctagaaagaaaaggtctacagacaaggactggaatgatagggttgtggataatttgttcattgaaaaaacgcagaagcctgctaagtctaacccagtgagtaataaacaaagtagttggactgaagaagtcaaaaagaaagacatggatgtagtttccttcacatttaccacaccattaacaaggaacaatccaggttttgagacatctggacaagctggccagaatactaatggtctttcattggatcaatgcattaaaagagtgttacttgacccagacaatacaaagtctccaataggatacaatataattggtggtggtgatgccttaggtatccttttggaacagaagttgagtgaattgactaatatggaaatcacttgtcatgactcttctaaagtgaggcaacctgccatcactgcgccaatgtcagatgatcaagtagccagacataatatagttaatctcaatccaaggttgcgacagaaaaaagaccaaggtgtgttattttcagacaagttaagcagtaactatgattcagacatctccttcactggtcctcctgaattgtcattgacgcgtaactcatggattgatgagatggaatcacagttactcaattgccgacacccaagtccaatctctgttctcgagccttctttttcaattgaaagctgtgaatcttcattgagcacagatattactagtacagaaggaagcaagttaagctcatctgttcaagctcacgaagttcatggcttgagtttttcacggaagttctatccttgtgaatctgataccgagttatctgactcagcttcttcaacattagctgggaacatgatgagaaagcacacaagtacaacattttctgtcacaaggtttggaaggtcaagcacatgggagttgaactatgtgaaggatatattgtgtaatgttgagttgatgtatgtagacttttcccttggccaagcaagtgaggttatagactctcatctattcaaacagttggaaggctgcaagggagggtttaagcgcgatgacgagtctaggatgagaaggaaagttacatttgattgtgtgagtgaatgtctgggcttgagatgcaggcgttacgtagggggaggatacaaaatgtggaccaaagggtttgaaatggtgaaaagaaaagaatggttggcagaagatgtgtacaaggagatatcaggttggagtggaatgggagattcaatggtagatgagcttgtggacaaggacatgagcagccaatatggaagatggctagattatgaggttgatgcttctgaactcggatcagaggttgtggaccaaatatttaattctttggttgatgatgttgtcactgaaatgttgcaattgtatacaccttaa

SEQ ID NO: 3692 - DNA, 327 bp, Glycine max var. Williams 82
atgcctctggtgcagggtggtcgaatcaacttcgatgcacagattgacacctatgcaaatactaggcaagaaatcatctcattaattggtgttcctgcggctcgcaatttgtttaagaaggccctctttacaatagcactaggctcaaattccagaaagggtgttggtatctccggaaacatttgtggtcacattgatatcaagactcagactacaactcactctaatttttctaagaacctagaaagctttgttttaaaaaaaaatgtttctattttctttgttgatcacgagcaatttactatttgcggcggctattcagtctag

SEQ ID NO: 3693 - DNA, 339 bp, Glycine max var. Williams 82
atgtttgccaatctgggattttcagaatctgattcttcctttgtcctggaaataagtcagagaagttctgtacatgaaaccagtttaaactctagtgatgcagaatttcatagtccaacattaaaaaatgtaatggaactagatggtgaagtacatcgagaatccaaccagtgggaacaagaaaatgaatatttctcacaagaacaaatagagtctcttccagatgttataaatgaggaggttattggcatcatcacaatggaagatgtcatggaggaactgttacagggagacatactggatgaaactgatgaatatgttcacgttcaaaagaagtga

SEQ ID NO: 3694 - DNA, 414 bp, Glycine max var. Williams 82
atgaagttgctgcaaacccacaaccagaggacaaaggggacaacacatacgaacaaatcgaggaggaggacccacacgtgcttggccttgttgttatggttgcggagctgctgctggtgttggggcttgagcgaaacggcgtcgtcggagatgtcaagcatggcaagcgcgtcattaggccttttctttttcttcaagccttgggttggagggttgagaggaggaaagggttgtttttcttcaagccctaaggaggaaatggttgtcgtgaagcgcattttggaagatggtgtggaattggggtgggattggaaggagagaggggacaaagtggtgattgttgttgttgatggtgcattggaactcgaaggaagtgggtggaaggggaaggttttggagaaaagagtagagtga

SEQ ID NO: 3695 - DNA, 435 bp, Glycine max var. Williams 82
atggacaaggcttatgtgcttcgtgaagctgtcaattacacaaaacaacttcaagagcgagttaaagagttggaaaatcaaaacaaagtagattcagcaacattcataaggaaatctgaagcctcctcagataaaaacaccggcaattgtgaaacgaacaaagaaatatcactatttgaggttgaagcaagagtcctagataaggaagtactcattggaatccattgtgagaagcaaaaggacatagtgttcaaaatacatgccttgcttagaaacctccatctatctacaaccagtagcaccgtattgccatttgggacttctactcttataatcaacattattgctcagatgaatggcgaatacagcatgaccaaggatgacctagtgaaaaaacttagagaatatctgttggaggtgtatgacatgcaatag

SEQ ID NO: 3696 - DNA, 1404 bp, Glycine max var. Williams 82
atgactgctgaggttatggctcaagaggagacacaagcagctgaggttgttgttgttgctgttgctgagccccagaaagagaaggatgctgaagaaaatgtggaaccaagagagccatcatcagtggatgaaaccaaacccaaaacggtggagaaaagctcttcttacaaggaagaaagcaactacctttctgatctcaaggagtttgaaagaaaggccttgagtgaactcaagtcaaagcttgaagaagctatcttggggaacaccctttttgatccaaagaaggaagctttaccagagaatgaagagaagaagaatgaaggtgaagagaaagaggaagaggaggagaaaaaggttgaagtagaggagaatgatgtgtctatttggggagtgacccttttgccaagcaaaggtgcagaaggtgttgatgtggttctgttgaagtttttgagggctagggagtttaaagtcaatgatgcatttgagatgctgaagaagacccttaagtggaggaaggaatcaaagattgattctgtggtggatgaggattttggctctgacttggcctctgcagcttacatgaatggtgttgatcatgaggggcaccctgtgtgctacaacatctttggtgcatttgaaagtgaggagtcttatcagaagacttttgggactgaggagaagcgcagtgagttcttgagatggaggtgccagttgatggagaagggtattcagaggcttaatttgaagccaggtggtgtgtcttcattgcttcaaatcaatgaccttaagaactcccctggtccttcaaagcttagggttgccacaaaacaaactcttgcaatgtttcaggacaattatccagaaatggtggcaaaaaatattttcatcaatgttcctttctggtattatgctctcaatgcacttttatcccccttcttaacccaaagaacaaaaagcaaatttgtggttgctcgtcctaacaaggtcactgaaacattgaccaagtacattccaattgaggagatcccagttcactatggtggtttcaagagggaaaatgattctgagttctcttcccaagatgttgctgtttcagaactcattctcaaggctggatcaactgcaaccattgagattcctgcattggaggttggatactctttgtgctgggatttgactgttctgggttgggagttgagttacaaggaggaatttgttccaactgatgagggttcttacacagttattgttcaaaaagggaagaaaatgggttcccaagaagggcctgttaggaacactttcaggaacaatgaaccagggaaggttgtcctcacaatagagaacacttcaaacaagaagaagaaggtattgtaccgttacaagagcatcaagagctccttctga

SEQ ID NO: 3697 - DNA, 984 bp, Glycine max var. Williams 82
atgtgcaaatggaggggagcattttgttacttagatttgcttatgtccccattagcacatatggttggatatgatccaaagctagcgagtgtccttagaaacgcatgtatgaaggataagacagtgataatcacaactctaaatgatgcatgggcagagccaggttctatatttgacctctttcttgagagtttccgcctagggaaccagacaaaaaagtttttgaatcacttggtggtaataacttgggaccaaaaggcacatgctcgttgccttgctttgcacaagcattgttaccaagttgagactaaaggtgacaatttcaccggtgaagcatttttcatgacagcagactacctacacatgatgtggagaagaattgaattccttggtacagtccttgatatggggtacaactttgtgttcacggatactgatataatgtggcttagagatcctttcaaacaattttacaaagacacagatttccaaatagcttgtgattttttcaatggcaattcctatgacttaaacaaccatccaaatggagggtttaattatgtgaaatcgaataaacgaactattttgttctacaagttctggttcaactctaggaatgcctacccaaagttgcatgaccaggatgtgctcaacaagataaaaaaggactccttcgtttccaacatgaagctgaaggttaggttccttagcactagttattttggagggttttgccagcatgcagaggacttcaacaaggtctcaacaatgcatgccaattgttgtgttggtttagaaaacaaagtcaatgatctcaaaattttgcttgaggattggaagaagtatgtggcattgcctgaaagtaagaaaaatcagtcgcatccttcttggagcgtaagttgcaggacgtcctttgaacgtgccaaacaaaagaagcagaagaataaagggagattgcgacgggcattggttgtaactgtttga

SEQ ID NO: 3698 - DNA, 882 bp, Glycine max var. Williams 82; identical to SEQ ID NO: 1824

SEQ ID NO: 3699 - DNA, 276 bp, Glycine max var. Williams 82; identical to SEQ ID NO: 1915

SEQ ID NO: 3700 - DNA, 462 bp, Glycine max var. Williams 82
atggttctgagtgggaaagtggagactgaagtagagattcaagcacctgcagctaagttctaccacgtctttagaaagcaaattcatcatgttcctaacatgtctacagaaagagtacatggagctaaagtgcatgaaggtgactgggaaaatattggttcagtcaaacactgggactttaccatagaaggtagaaaaacaagtgctaaggagaaaattgaagctatagatgatgataacaagataatatcatacagcctctttgatggggaaatcagtgaaggttacaagagtttaaggggcacattacaagtgattaataaggaaaatggaggaattgtgaaatggaccttcgaatatgaaaagctgcaggagaatatcactgctgcatctcctgattcttttttggactttgctgctaaggtcactaaagatattgatgatcatcttgtcaaggcatag

SEQ ID NO: 3701 - DNA, 1014 bp, Glycine max var. Williams 82
atgataccaacttatcgttactcagtgtcttcgcctatgcctatagatcttaatgaagatcacacccaccacgtcttcagtacaagccatcaagcctcttcttcgtcttcttctctatctttttctattctcttcaacccggatcatcaaggtcaaggaggatcttgttgccactgggaatcaaagcacttacaaagtgatgaagaggcccagaagattgttccttctagtgaatcatgggagcatccagtatctgaaaaggatgaaaacagaagtgatctcaagctgagagtttggaagaaagaagataagtgtgaaaattttcaagttgaagataattcaactaagtggatgcctttaaagatgagaatgatgcggaggatgatggtgtcagatcaaacgggttttgatacagaaggcatgatctctaactctaagcagatcaagaatgaagagaaaaacccaccactgacacctctaggaactgatgatagtaataactacaattcttctgcaaaccacagcaagatcactgttagggtttgttctgattgccacaccactaagacccctctctggagaagtggaccaaaaggtccaaagacactttgcaatgcttgtggaattcgacaaaggaaggcaaggcgtgccattgccgtggctgcaacggcaaacggaatgaatccagtggaggctgagaaatctcaagtaaagaaaggaaacaaattgcatagcaaagggatgaagtccaaaactaagggtgcaccacatatgaaaaagaagcgcaaacttggagcgaagtatagaaagaggtttggtgcttttgaggatttgacagtgagattgagtaagaacttggctctccaaaaagtcttccctccggatgagaaggaggctgcaatcttgctcatggctttatctttatggccttcttcatggctttcccacagatcgttacgtcaattacttagatttatgagatatattggtggtaaaaccataattattgtatga

SEQ ID NO: 3702 - DNA, 444 bp, Glycine max var. Williams 82
atggggtttctagataatcttcaagaatggttcactgcttgtaccaaaccaaaggagaaacttgtgcccaagaagacagttaatgtcagggtgaaaatggattgtgaaggttgtgaaagaaaggttaaaaatgcagtgaaggacttggaaggagtggaatcatatgatgtgaaccgaaagctacagagggtaagtgtgactggttatgtggattcagaggaggttctggaagaagtgaggaacacaggaaagaccgctgacctttggccatttgttccctacgatttggtggcatttccttatgtgaaaggggcatatgacatcaaggcaccttctggtttcgtcagaaatgtcccagatgcaatgggtgaccctaagtctccagagatgaagcttatgagggcctttgatgatgataacccacatgcatgttcaatcatgtaa

SEQ ID NO: 3703 - DNA, 837 bp, Glycine max var. Williams 82
atggaaccaaacgttaacaacaacccaaagatgttagagaaaaagtggctttctactgctttgaatgttagaagccaaggattaggaagtgaaacaatagtctttgctcatggctatggaacagaccaatccatctgggacaagatcactccttcctttgctgaaaactaccgggttgtgctgtttgattggcctttttctggagctgtgaaggatccaagcctctatgaccctttgaagtatacctccttggaagcttttgcagatgagtttatcactcttatggatcagatggacctcaaagttgtcacctttgttggtcattccatgtctggcatgattggttgcttagcatccatcaaaaggcctgaactttttaagagacttattctccttggtgcttctcccaggtatattaacacagatgactatgaggggggctttactagctcagatattgagcagttattgcagaacatagaatccaactatgagaactgggtttctgccttctccttactagtagtggatccaaatgatgagccatctgttaacaaattcagagagtgcttgaaaagaatgagagctgaagtagcagcttccttagcgaagactgtgttctatagtgactacagagatatacttgacaaagttgaaactccatgcaccatcattcagacctctagtgacattgttgttccacacaatgcagcggtttacatgaagaacaaaattaaagggaaagttacattagagtttgtagacaccaaagggcactttcctcagctaactgcatggcttcagctagttgatgtgattaagggtgtacttggctag

SEQ ID NO: 3704 - DNA, 387 bp, Glycine max var. Williams 82
atggcttccaagggcacagttgcatccacttatgttgctctattcctatgtctcaacatgctttcctacactatggtgagctccacctacaatatccctgtaatccctgatccatcagtgccttatcaaaagggtacctgccctatagatgcacttaagttgggtgtgtgtgccaatgtgttgaacttggtcaatgttaaattagggtcaccaccaaccctcccatgctgcaacctaattaaaggtcttgctgatcttgaagttgctgcatgcctttgcactgccctaaaggctaacgtccttggcatcaacctcaacgtcccaatctccttgagcgtaattctcaacaactgtggaaggaataacgctggcttccagtgcccttaa

SEQ ID NO: 3705 - DNA, 741 bp, Glycine max var. Williams 82
atgtgctcagaaacaagtcctccccgtctctctttctcccatgatctctctgaactacaagttttaccaatgaaacaaggtgctccttgtagagacacattgttgcatgactcaaattctgacttcgagttcatcacaagcaccgaccttgagttcgaatcgtcttcagcagatgaactcttctctaatggggtgatccttccaattcaaatgcaagaaaaaaccacagctagaaaactcactcaccatgtggaatctcctcacccaaaacttcctcctcgtccgtgtgcctcaagtgttgacaaagtgaagaaagaaaccattagagaactcctagatgtgaattctgataatgagaagaagcctcattccaaatccttttggggattcaatagaagtaaaagtctcaattgtgatacaaagaagaacttggtatgctcttcacctcttttgtcaagaagcaactcaacaggttcagtgtcaaatccaaagagagtgagttcaaacaagcatccatcagctgctaaatcatcatcatcatcatattcattttctaccttaaatatgtatcctatgcaaaaatctccttcaggtaagagttatggagggtcttatcccaatggccttaggattaatcctgtcttgaacgtaccgacaccttgtgtttcgaagggaagtgcaaatctcttaggtttgggttcatttttacgtgttgggaaggttaagaagagcaagaagtga

SEQ ID NO: 3706 - DNA, 1413 bp, Glycine max var. Williams 82
atgagttcatattttgaggaaagagcaccttgttgtggaactcacttttggattttactaagcatgtgttcggcatttgtgttatttgctgctatcacatcaggtctttctctaggactcttgtccttcagccaagttgatcttgaggttcttgttaaagctgggcagcctaaaatccagaagaatgcagcgaaaattatgtccattgtcaagaatgagcatttacttttatgcaccctcctcatagctaaatcaatggcactggagggggtttctgtttttttggagaaaatgttcccagagtggctttctgtattaatagcagctaccattttgggtttgaccgcagagattatcccacaagccttgtgttctcaatatggtttaagtgttggggcagcaatgtctccctttgttcgagttcttatgatggttttcttcccaattgcatatccacttagtaagttgttggattggctttttggcaaggggcatactgcacttctaggacgagcagagctgaagactttagtccatttacatgctattgaggcagggaaaggtggagagttgtcacttcatgaaactagaataattgctggagctttggacttgacacagaagactgctaaagatgctatgactcctataagtgaaacattttctcttgacataaactccaaacttgacatgcatacaatgggcttaataatgagcataggtcacagccgaataccagtctactctggaaaacaaacaaacattgttggcattatcttggtcaagaatctaatcttctgtcatcatgaagatgaaatgccaattaagtttatgactatcaggagagttcctagggttggtgaagattggccactatatgatatcctgaatcaattcaagaagggtcaaagccacatggctgttgtcctcaagtgtgggggtaacatcagaactgctgcaactggtacagaaggacattgcccttcatttgaaccgggagatcatttccgcatatcaactgatgcatcaaattggcattcacaagaaacagaatattatagtgcaacactgaagagtgtcatgcatcgagagggtgactcagatcttctgcaaagaagatcagaacaacctgatgcaagttcatcctttgagaatttggagtctctttcaacagaagtcgaggaagtgattgggataatcacattggaagatgttatggaagagttacttcaggaagatatattggatgaaactgatcaatatgttgatgtccatcaaaatatcagaatcaaactagaacatgcaagaagagtgtcatcagggtcctccagaagggcttcaagtactcgtcaacaacggagaagttcagatgcatctcgagtttttacatatgtttcatctgtttctccataa

SEQ ID NO: 3707 - DNA, 612 bp, Glycine max var. Williams 82
atgaaggtctcccccttagcattttcaatcctttttttgtccttcaccatagaactcttcattggcattgcttcagcagcacaagaaccagtgcttgacacctcaggccagaagctgagaacaggtgtcaagtactacattctaccagtcttcagaggcagaggtggaggcctaacagtttcaagcagtggcaacaacacatgccccctctttgtggtgcaagagaagcttgaagtctcaaagggcaccccagttaccttcacaccctacaatgccgaaagtggtgtcattctaacctcaaccgatctcaacatcaagtcctatgtgaaaagcaccacttgtgataaacctccagtgtggaagctcctcaaggtgctaactggggtgtggtttttgagcactggtggtgttgaaggcaatccaggggttaacactgttgtcaattggttcaagattgaaaaggctgagaaagactatgtgctttctttctgtccctcgtttgcacagactttgtgcagggaacttgggttgtatgttggtgatgatgggaacaagcatttgtctttgagtgataaggttccatccttcagggttatcttcaagagggcttaa

SEQ ID NO: 3708 - DNA, 1467 bp, Glycine max var. Williams 82; identical to SEQ ID NO: 1845

SEQ ID NO: 3709 - DNA, 2589 bp, Glycine max var. Williams 82
atggaagcatacggtggtttcatgattgacgagaaagccgttagggttgagaacgctttccttgatttcctcaaaagcttcaagtccagtagccatcggaacgaactttattacgaagcggagatcgaattgatgaagagcaatgactccaacaccatgttcgtcgatttcgaccacgtcatcagattcagcgacctcctccagcaaaccatttccgatgaatacttgagatttgaaccttatttgaagaacgcctgcaagcggttagttatggatctcaagccgtcaattgtatccgacgatagtcctgacaaggacatcaacattgccttctataacatgcccatcgttaaaaggttaagggaattgggtacatcagagatcggaaggcttgtgtctgtgacaggagtggtgacgaggacgagtgaggttcgacctgagcttctccaaggaactttcaagtgcctagagtgcggtggtgttataaagaatgttgaacagcaattcaagtatactgagccaacaatctgcacaaatgctacctgtagcaatcgaacaaggtgggtactgctgcgccaggagagcaaatttgctgattggcagagggtcagaatgcaggagacgtccaaagagatacctgcaggctcccttcctaggtcattggatgttattcttcgtcatgagatcgtggaacaggccagggctggcgacacggtgattttcacaggtactgtagttgctatacctgacataatggcattggcatctccgggagagagatcagagtgccgccgtgatgcttctcaacgcaggggttctacggctggaaatgagggtgtgagtggtcttaaggctctgggagtcagagacctcaactatcgtctagcttttatcgccaactctgttcagatttgtgatggtagaagagaaatagacatcaggaacagaaagaaggatgctgatgatgacaatcaacagtttactgatcaggaactggaagaaattaaacgaatgaggagcactccagattttttcaccaaacttgtcgaaagcattgctccaactgtttttggtcatccagatattaagagagctatccttcttatgcttttgggtggtgttcacaaatttactcatgaaggcatcaacctcagaggagacataaacgtttgtgttgttggagatcccagctgtgcaaaatctcaatttcttaagtatacttcaggcatagttccaagatctgtgtatacatctgggaaatcatcatctgctgctggcttgactgcaactgttgccaaggaaccagaaactggggagttttgtattgaggctggtgctttgatgcttgcagacaatggcatttgctgcattgatgaatttgacaagatggacatcagagatcaggttgcaattcatgaggcaatggaacagcagactattagtatcacaaaagcaggaatacaagcaacacttaatgctcgtacttccattcttgctgctgccaatcctgctgggggacgctatgataaatctaaaccacttaagtacaatgtggccctcccaccagctatactttcaaggtttgatcttgtatatgttatgattgatgacccagacgatcagacagactaccacatagctcatcatattgtgagagttcatcaaaagcgtgaaggtgctcttgctccagcattcactacagcagaactgaagcgttatatagcttatgcaaaaattcttaaaccaaagctttcgccagatgccagaaaactattggtagactcttacgttgctctccgtagaggtgatacaaatcctgggagtagggttgcatatcgtatgacagttaggcagttggaggcattaatcagattgtcagaggccattgcacggtgtcatttggacaatgaggtacaacctcgtcatgttcgtctagcagtaaaactgctgaaaacttccatcataagtgtggagtccagtgagattgatctgtctgagtttcaagaagaaaaccatgatgatggtgcaggtggtggcgatggaaatgataaaaatcgagatgctaatgaccaagtggggaatgatgcagcagctcagcaagctgccggaaatgctaatgatcaagtgggaaacgatgcaactcagcaaactgctaatgatcaagtgggaaatgatgcagctcagcaacctgctggaaataatggaaattcagcagatggatctaaaccccaagtgagaaaactcgttatgagtgatgaatattatcagagagttaccagcgcccttatcatgcgactaagacagcatgaagaggctgttgtgcaaggaaacggtttgtctgggatgaggcaaaaagatttgattcaatggtacgtagaccaacaaaatgagagaaacaactacagttcgatggaggaggtgcaagctgaaatttccaaaattaaagctattatagagagcttaattcggagagagggccatttgatagtggtagatgatgggcaagcagcagccgcagcagcagaacccccaggcgcaccaagaaattaccgaattttagcagtggctcctaattatgtcattgattga

SEQ ID NO: 3710 - DNA, 1203 bp, Glycine max var. Williams 82
atgggaactgaacttagaaccgattccactgactatagaaccgagcttctttcaccaacaatagcagtagagaatgtgtctatggctaggcaaccttcatggaggatcaacatggaagaacatcggttaccagaaaggcgaatggagtctcattttggctttggattcttcataaatacactaaagaggcaaaggaaacttgctgagtactacaagaggcaagaaaggcttcttaaaggctaccaagaagtggattcatacactgacttgggcatgataccaggaaatttaacagaggatgagatgaaggaacttgaaaggagtgagagggtggcaatttatgcatccaacatagggaacatggtgctatttgtggcaaaagtgtatgcttccattgagagtagatccctggctgttattgcatcaactctggactcactcttggatctcttgtcaggattcatactttggttcactgctcatgctatgagcaaaccaaatcaacacaaataccccattggcaagaaccggatgcaacctgtgggtatagttgtgttcgcatcagtcatggcaactctcggattacaaatattatttgaatcaggaagggaaatcatcacaaagactcaacctgatagggatccagtgaaggaaaagtggatgatagggattatggtcacagccacattggtaaaagttatgctcatgacttactgtcgcaggttcaagaatgaaatagtgagggcctatgctcaggaccatttcttcgatgtcattacaaactctattggtctagcaactgcagttctagccatcaaattctactggtggcttgaccctgttggggccatcctgatagctttatatacaatcagcaactgggcaaaaacggtgatggagaatgtgtggtcattgattggcaaaacagccccagcagaatacctagcaaagctaacatatctttgttggaaccatcacaaggagatcaagcacatcgacacagtgagagcctacacctttgggtccaattactttgtggaagtagacattgtggtgtctgaagaaatgtcacttagtcaagcacatgatattggagagacacttcaagataagcttgaaaagctacccgaaattgagagggccttcgttcacatggatttgaacacaactcataagctggagcataagacaaaggtgggataa

SEQ ID NO: 3711 - DNA, 816 bp, Glycine max var. Williams 82
atggccaaccatgcagctcaaaaccctttatctgttttccttacgaccttcctcttgctaatcaccagcgccaaatcagacttattttcctttaacataccacgttttgagccaggtgctttaaacatactactcgatggtagtgccaagacaacaggtggagtgctacaactcaccaaaaaggacaaaagcggcaacccaacccaacacagcgttggcctctctgcattctatgcagcacttcatctctccgacgcaaaaaccgggagagtcgcaaacttcgccaccgagttctccttcgtcgtgaacacaaagggtgcaccactccacggcgacggcttcaccttctatcttgcatcactcgactttgatttcccagacaactcaagtggtggcttcttcggactcttcaacaaaaaaacagccttcaacacttctttaaaccaagttgttgctgttgagtttgatagttttgcaaacgaatgggaccctaactttccacagtctgattctcctcacataggaattgacatcaattccattaggtccgtggcaactgcgccatggccacttgatattcaaccacaagggtcaataggaaaggcacgcataagctatcaatcttcctccaaaatattgagtgtctccgtggcttatccaaatagtcctgtgaatctgaatgccactgttttatcgtatcctgttaacttaggggctgttctgcctgaatgggtcctattcggtttcactgcttctaccggtgacttggttgagacgcatgacattctttcatggtctttcaattccttcttgtag

SEQ ID NO: 3712 - DNA, 489 bp, Glycine max var. Williams 82
atggaacgggggaagaataagagagcaagagaagatgatgaagttgagattgggtcttcttttgagaattataacaacaatattgcaaagaagagaaatgtatatggcataagcttcaagaaggagaagaataatgaagtggaagagaaagattgtttcaaggcatgggattattcccatttgacaatgggagtgtttgatttcccttggctgaaagatggtgtcatatccaaatcatatgaatgcttggattttgaagacaatttcttgtcatctctagaacgccaagacactttcttcaaagcttcttctggcattgatttctctgaggagtatggtttgtgtgaaattccagaggcatcaatggctcatattcaagaagccaagttggttgaggatatgtggaagccatttgagagtaatgggttggagctggagccagaaggtggagattgtatttggagctttttactcaataaacctctttga

SEQ ID NO: 3713 - DNA, 1587 bp, Glycine max var. Williams 82
atgctacagataaacatttcatcatctcaagaagctatagcattgtttttttttttttttatctcattttctgcattgttgagtcagaaatcccattttgcttttaccctcagatctcatctcaggatccataacatgacttccgcacggaataagcatcctttgcctcctgcagttcatttcgttaagattattctcacaacaagtcttgcagatggaatacttcttccaaaaaaattcactcgaaaatacggggatggcatgtcaaacccggtgtttctcaagcctgcagatggcactgaatggaaaatacattataccaagcatggtggtgagatttggtttcaaaagggttggaaagagtttgcaacatactattctctagatcatggtcacttgctgttctttgaatatgaaggaacttctcattttgatgtgcacatatttgacagtagtgcccttgaaatagactatccttcccatggtactcatgagggaaaggacaatcttgtggagatcagtgatgattcggtggaaattttgggtgagcaattttcctgccaaaacactagagggtcatctcctcaaccttgtaagaaaatgaaaaatagcataactacaaatgtcgaaagaagccccaatgtggtaaacttgcatcagcatgtcccaactataagtaatagctctcaaaaggcaacattcatgaagcaaatgttagatgaagatgatggcataggcatttttaacaccgaatacccaaaagtagagcagtcaacttctacggctttaaaaaaagcctcaacattcagatctgaacatcccttcttcaggcttgtcatgaagccatcctttattaatggatattacctggaaataccacctcaatttgccgaaagatatttgaagaaaacacatgcaattgtcatccttgagattttggatgggagaacttggtctgttatttgttctgcaactagacttactgagggatggcagaaatttgcatcagaaaataatttgaatgtgggggatgtttgtgtttttgaactgatccagaagatccagggcctttgttttaaggtttccatctatcaaggtgctgaagaaccaatttgccccatttcacaagtgcatccttcaaccaactggacaggtggaacttcaagtcaaagatcttcacaggtgaaaagccgctccaagttgaagatcttaacaatcagatacatagcactaaaaagagctagcaaattcacatcagaaaatccctttttcatggtcactttaactacaaaattaaagtcaattataaccagagacgtgcatgtgccgatggactttgtcagaaagcatttagtaaacgtgaagcagaagttgatgatgatacactttagaaagaaattgtggccggtaaggtttgtcgtccgtgaaagttctactgtttcaggcaatctctctactggttgggcctggtttgtaagagaaaatgaactgcaacgtggagatgtgtgtatctttgagcttttcaacagagaagatgcaacatttgatgctcatgttttcagaggacaccgtgaggtaatgcattag

SEQ ID NO: 3714 - DNA, 1056 bp, Glycine max var. Williams 82
atgaacttgaaacaatactgttgtttcctcaaagatgaaggtctaaacaaaatacaggtttccaacaagaagaacagtagggactatccatgggaaatgtacactttgaaggagttgcttcgtgcaacaaacaactttcatcaagataataagattggagagggtggatttggaagtgtttattttggtcgaacaagtaaaagcgttcagattgcagtgaagcgattgaagacaatgactgcaaaggcagagatggagtttgcagtggaagtggaagtgttaggaagagtgaggcaccagaatttgttgggattgaggggattctatgcaggaggagatgaaaggttgattgtgtatgattacatgcctaaccatagcttgttaactcatttgcatggtccacttgctaaggaatgtcagctagattggcctagaagaatgagcatagcaattggagctgctgaaggtttagcgtatctgcaccatgaatcaactcctcacatcatacacagagatataaaggcaagcaatgttcttctagaccctgaattccaagccaaggttgctgattttggttttgcaaagctggtaccggatggtgtgacccatcttaccacaaaagttaagggcaccctaggatatttggcaccagaatacgccatgtgggggaaggtttctgagagctgtgatgtttacagctttggaattttacttttggagattattagtgccaagaaaccaattgagaaattcccaggaggagtgaaaagggacattgttcaatgggtcactccatatgtcaacaaaggtctcttcaacaacattgcggatccaaagttgaaggggaaatttgatttggagcaattgaaaaatgttaccaccatagctcttagatgcaccgatagtagtgcggataagaggcctagcatgaaagaggtggtggattggctcaagaatggtgtagggagcacttggggagaagagaatattccaactttaagtatcaagaatggagacgaaggaaatgacaaagatgacaaattaaaaaataactag

SEQ ID NO: 3715 - DNA, 570 bp, Glycine max var. Williams 82
atgaggaggatcccaaccagtgtgtcttcttttgcaattcacattcttcttcttctagcttctatttctattcccttcacactatgccaaccctctttcccatggaaagatgggaacggcgatttggtagatcaagtgtgcaaaaagacacccttttatgatctttgcagctcgatccttcactcaaaccctctaagtccaaaacctgatctcaaaggggtggctctattaatggtgaacaacattcttgcaaatgcaactgacacactgagttacattgaggggctgatcaagcagaccccagaccgtgagttggagcaatccttggctttttgtgctgagtcttatatcccaattgtcaagtacattctcccacaagctgctgatgccataagccagggtcgttttggctttgccagttactgcatttctgatgctctcaaagaagtgagtagctgtgacaagaaattctctggtgctacacaagcacccttaggtgacagaaacgacattgtgcagaagcttgtgaatgtagcttcggccatagtcaaactacttctaaagggctga

SEQ ID NO: 3716 - DNA, 1173 bp, Glycine max var. Williams 82; identical to SEQ ID NO: 1900

SEQ ID NO: 3717 - DNA, 1536 bp, Glycine max var. Williams 82
atgtacttggaaatctcctctctaagtctatgtatacatgtccaatgtcgtgggagtcaggaaaagttgattccctcatgggatgaagcgatagagaatggtttgcgagaattggggtggtcggggatggcgcaatgcatccttgtgtccattgctatgtgctttgatgcacagcagtccttcatggcaatctactccgacgactacccaacatggcactgcacagagacagcatgcacctcatcacgttctgacatatgcaagcttccaaagtcctcttgggcatgggatggaccctcttctaagacaatcatatcacagtttggccttgaatgtgcaggcagcttcatcacaggtttacctcaatcttctttcttcgccggttgccttatcggttcctttcttcttgcctccttggctgatacatctcttggaagaaagaacctcctcttgctgtcttgtttatcaatgtccatatcttctatcttcattgtcttctccaccaatgtttggatctactccgcctttaaattcctcatcgggttttggcgttcatccatcggaacatgtgttctggtgttgctgactgagaaagtgagcactgagtggaggttcacagtgggaattgtcgaatatttctgcttcacattggggtatatgatcttgcctggaatagcttatataaacaagaattcttcatggaaaactctctatgtgtggacatccattcctgccattttttactctatcattgcttacctttttgttaccgagtctccaaggtggcttctcatgcaaggtcgagagcaagaagccatggcaatgcttaacggagtttcttcagtagaaaatggtgctaatttaactgctagcctgctgaaagttcctgctgctaaacaaaagtcttcaattttccaactttactcatcaatagcagagttgtttgagagaagttgggctcttaaacggatggtggccattatggtgcttggtcttgggattggaatggtgtattttggcatgcctttggccgtcgggaacttaggatttgacatttacttggcagttgtgcttaatgccttgatggaaataccttcttgtgtagtcacctacttcttggaaaactacagaagaaagccatctattcttgcattttcagtagcaagtgggatatgctgtgtattgtgtgtggtcgtaggcagtgggcagcaggtagctaaggtggggatatcattggtagccttttttagtgctgtcacggcttataatgtgtttctcatttacattatagagttgtttcccaccagcgtaaggaacaccacaacctcattggtgaggcaagcaactgtatttggtaacatattcatcccatttttgatatctgcaggaaggaaaaatgatattttctcctatggcgtatttggagtagttataatatcatcctgtttgactttagtctgtttgccagagaccacaggaatagcactttgtgataccatggatcaacaagagaaaaagcacagcttatctgtgtaa

SEQ ID NO: 3718 - DNA, 282 bp, Glycine max var. Williams 82
atgaaggcatcacccattgcttggttcactttggtggttgtgtttcttgtggctgaagttcaagtttcaatggcagtgacatgcagcccagtgcagctgagtgcatgtgtaagtgcaataacctcttcaacccctccatcaaacctatgctgctccaagatcaaagaacagaaaccatgcctctgccaatacctcaagaaccccaatctcaagaagtttgttgactctcctaatgcaaggagagttgctagcacttgtggaactcccttcccaaggtgctaa

SEQ ID NO: 3719 - DNA, 1521 bp, Glycine max var. Williams 82
atggccatggaaaataaaaaaattatagagtattgggttgtgtctatactttgcatgcttttgtcgggtcattggatctctgttcaagctgcccctgcaccctctctcatcacacaactccctggctttaacgccaatttcccatccaagcactattccggatatataagtattgatggaaatactgaaagtgggaagaacctgttctactacttcgttagttcagaaagaagtccagagaaggacccagttgtgctatggctgaatggtggacctgggtgctccagctttgatggctttgtttatgagcatggaccattcaactttgaggctgcaaattcgaaagggaatctacccactttgcatatcaatccttacagctggtctaaggtttccagcgttatatatttggattcccctgctggtgttgggttctcttactccaagaacacgagcaaatatgctactggggaccttgaaactgcgtctgatacccatcttttcctcttaaagtggtttcagcaatttccggaattccaggctaatccattttatattgctggggagtcttatgccggagtttatgtgcctactctagcttttgaagttgctaaaggaatccggagtggtacaaagcccgtgatcaattttaagggttacatggttggaaatggtgtcacggacgaaatatttgacggcaatgctcttatcccatttgtgcacgggatgggcctcatatccgacactatctatgagaatttacaatcttcctgcaaaggaaactactacgatgcttactctttggacgaaaatgatgtgtgttacaagaacattgaaaaatttgacagggccattgatgggcttaacgtgtacaacatactagagccatgctaccatttccctggtgatgccacagccaaagaaaatggaagcttaccaaagagtttcaagcaattgggggttactgagaggcctcttccagtgaggaatagaatgtttggtagagcttggccttttagagcaccagtcaaacctggccttgttacattatggccccaattgacagaaaccagtcatgtcgcctgtgttagcgatgaagtagcaagttcatggctaaacaacgttgcagtcaggaaagcaattcatgctgaatcggaaaaagtggcgggtccgtgggaattatgtacgggaaggatagagtaccatcacaatgctggaagcatgattccttaccacaagaacctaaccaggctgggctataaggcacttattttcagtggcgaccatgatatgtgcgtgccatttaccggaagtgaggcttggacacgatctttgagatataagattgtggatgaatggaggccatggaactcaaataaccaagttgctgggtacttgcaagcgtacgagaacaacctcaccttcctcacaatcaagggagctgggcacaccgtgccggaatataagccgcgggaagcgttggatttttacagccgttggttggaaggaaagcaaatataa

SEQ ID NO: 3720 - DNA, 1224 bp, Glycine max var. Williams 82
atgacaaagcaaaattttcctttgggttgctctgttgtttgcataagcataatcttaatccagttcattgcttcaatgaatttcagcacatcccagagcttcaaaaacgaaactagtagtatcagtacaactaccaccactactaaggcctttttcatatttggcgactctactgtagactctggcaacaacaactacctaaatactatccctgagaacaaggcagattacaaaccatatggacaaaacggcttttttcaagaacccacgggaagattctcagatggtcgtgtcattgtagattttatagctgaatatgctaagctgccactacttcctccatttttacaaccaaatgctgattacagtaacggtgccaactttgcttctggtggggccggtgttcttgctgaaacccatcagggactggtgattgaccttcaaacacaattaagtcactttgaagaagtgacgaaattattatcagaaaatctaggagagaagaaggcaaaggaattgatctcagaagcaatttatttcattagcataggaagcaacgattacatgggtggatatcttggtaacccaaaaatgcaagaaagctacaatcctgaacaatatgttggaatggtcattggaaacttgacacatgcagtccaaagcctatatgagaaaggggctagaaggtttgggttcttaagtttgtctcctttgggttgcttgccagctcttagagctctaaaccaagaagccaacaaaggtggttgttttgaagcagcttctgctcttgctctagcacataataatgctttgagtaatgttctcccaagcctcgagcatgtccttgaaggattcaagtactctaactctaatttctatgattggcttcgagatagaatagacaaccctgcaaattatggctttaaggatggagttaatgcttgctgtggaagtggaccttatgggggtgtcttcagttgtggaggaacaaagaaagtcatagagtacttcagcttatgcgacaatgttggtgagtatgtatggtgggattcttttcacccaacagagaagatccatgaacaattgtctaaggcattatggaatggaccaccttcctcggtagggccatacaatttagaaaacttcttcaacaaagagatcaagctcactattgctgatgtagttgatgctccacaaattcagaatggagaatttcactactga

SEQ ID NO: 3721 - DNA, 1665 bp, Glycine max var. Williams 82
atgcatcacaacatctccaacaatcattccttcattgtgaccaaattagccaccaacaacatcaccaccaccaacatgaactttttctccctcatttttttcctcttgcaacacgtccacatctttgaactcaccattgcaaccgcaatgttcatagcccttagagcttggcgttctaagaggcaccatggcctacccatttggccaatccttggaatgctcccttcccttctctatggaatcacaaccaacttgtatgaatggctcagtgaagtcctcatccgccaaaatggaaccttcacattccaaggcccgtggttcgctagcctcgactgtgtcctcacctccgaccctcgcaatctcgaatacctcctcaaaaccaagttctcctccttccccaagggaagattcttcaggtacacacttcgtgacctgctgggaaacggcatattcaacgcagacaaggaggcatggcagcggcaaaggaagacggtgagcctggagttccactccacaatgttcagaaacctaaccgcagagtcacttttggagctcgtccacaaaagactcttacccttgctagagtcatgtgtgaacaaatcacgtgtcatagaccttcaggatgttctactaaggctcactttcgacaacgtgtgcatgatagcttttggcgttgaccctggttgctcacagccccacttgccagatattccattcgccacagcttttgaggatgcaactgaaacctcaatgaggaggttcatcaccccggtgtggatgtggaagttcatgaggcatctcaatgttggtgtggaaaagaggttgaaggagtcaatagagaaggttgatgagtttgctgagagtgttattatgacaaggaaaaaggaacttgctttgcagcatgacaagtctgatttgttgactgtgttcatgaggcttaaggatgagaatggaatggcttattcagataaatttttgagggacatttgtgtcaacttcattttggctgggagggacacttcttctgtggctttgagttggtttttctggcttttgcatatgaatcctcaagtggaggagaagattttggctgagatttgcagggtggtgcttagtcaaagggaagggttaaagaaggaagaggttgttgttgggagttgtttggcatttaggcctgaggagataaagaagatggattatttgcatgctgccctttcagaagctctcaggctatatccttctgttcctgtggatcacaaggaggtggtggaagatgtgactttcccagatggaacagtgctattgaaggggacaaaagtgatatattcaatttatacaatggggagaatggagagcatatggggcaaggattgcaaagaattcaagccagaaaggtggctaagagagaatggacacttcatgagtgagtctgcttacaaattcactgccttcaatggagggcctcgcttgtgcttaggcaaagactttgcatactatcaaatgaaatatgctgcagccagcatcattttccgctaccgtgttaaggtgctggagaaccaccctgttgtgccaaagcttgctttaactctatacatgaagcatggcttgaaagtcaaccttcaaaggcgtgatgcagcagaaattgacaagtacttcaaagtttag

SEQ ID NO: 3722 - DNA, 594 bp, Glycine max var. Williams 82
atgtcaaatctcgacggtgattcgccgaagatacacgttgagactccgccggtggcgccttctgcgccgagtgagggccacctcgcgccggcgagccacggcggaatcggcggaatcctgcggcggtggaagagggaggacttgatcaagagagggtcgttgggactgagaggggtcgctctgcttttctctctgatttcgttctttatcatggccagcaataagcatggggattggagagagttcgataaatatgaagagtacaggtatttgcttgctatagcgattttgtctagtttgtacactggagcccaagcgttccgtctacttcaggaactctccaccgcaaaacaattgcttcagccaagaatggcagctatgattgacttttttggtgatcagatcattgcatatcttttgatatcatcagcatcttcagcaattccaataacaaatagaatgagggaaggggcagacaatatattcacagactcttcagctgcagccattagcatgtcaatttttgccttcttgtgtctagcagtatcagccctcatttcaggctacaaattatcaactcaaccttatatatga

SEQ ID NO: 3723 - DNA, 1179 bp, Glycine max var. Williams 82
atggcaatgatgaaagagaatattattgaagtgagccttggaaggaggcaaatgtctatgacagaaggtgagttccaaggaacacggagcgtcaagagacgacgaagagaggttgctgcagccgcaggcagtggtgatgataaccaccaacagcagttaccacaacaagaagttggtgaaaatactacagtcaacactacaaagagaagctcaagatttcgcggtgttagcagacatagatggacgggtcgatatgaagctcacttgtgggacaagctttcttggaacataacacaaaagaagaaagggaagcaagtataccttggggcttatgatgaagaagaatctgctgccagagcatatgatttagctgcacttaagtattggggaacttcaactttcacaaattttccaatatcagattatgagaaagagatacaaataatgcagactatgaccaaagaggagtatttggccactttaaggagaaagagcagtggcttttcaagaggtgtatcaaagtataggggtgttgcgaggcaccaccacaatggtagatgggaagcaagaataggaagggtttttggaaacaaatatctctaccttggaacctacagcacccaagaggaagctgcgcgtgcttatgacatagcagccattgagtacagaggaattcatgctgtaacaaactttgatttgagcacttacataaaatggttaaagccttcaggaggaggcaccctagaagcaaatcttgaatcacatgcagcactagagcatcaaaaggtggcatccccatctaattatgctctaacagaagagtctaagtctttggcccttcacaacagttttttcagtccatattctctggattcccctgtaaagcatgaaagatttggaaacaaaacctaccaattctcaagcaataagtcatcttctcccactgcacttggtctccttctccgctcttcgttatttagggaattagttgaaaagaattcaaatgtttctggagaagaagatgatggggaagccacaaaggatcaacagacacaaatagctactgatgatgatctgggtggaatcttcttcgatagctttagtgatattccatttgtgtgtgaccccaatagatacgacttggaattgcaagaaagagacctgcactcaatattttga

SEQ ID NO: 3724 - DNA, 1770 bp, Glycine max var. Williams 82
atgaccggtaaaagtccaattactcaacggacagcgagacatggctcacacaaactgtgcaaatttgatttatcggatctagaatggacaaatatgattccagagtgtccaacataccacccatcagagcatgagtttgagcatcctttagtttatctgcagaagattgctcatgaggcttctaaatatggtatatgcaaaattgtttctccaattgcagcctctaacccagctgcttttgtcttaatgaaagagaaaaaaaatttcaagtttgaaacaaatgtacagcctcttcgtctttctaaatggaatgaaaaggatataataaccttttctatgagaggcagaaaatatacatatcatgattttgaggttcttgcaaacaaggccttttttagtagatttcacagttctagagaccttccctcttcttatgtggaaaaggaattctggcatgagatggctcaaggagaaaaaggaacagttgagtacggagtcaatgtcgaaggtagtgccttttcatgtgatcctaatgacaggcttggaacaagcaaatggaatttgaagaatttttcacagcttccacaatccctgatacgtttagttgacagggaaattcccggaataactgatcctatgctttacattgggatgctgttcagtatgtttgcgtggcatgttgaagatcattatttgtacagcataaattatcatcactcaggtgcaaataaaacttggtatggcgtgcctggctatgcagcatcacaatttgaaaagacggtcttacaacatgtgtattgcaataagatcataacaaaacatggagaggatggagctttcaagtttctagcacaaaaaacaaccatgttcccaccaaatgtcatgttacaacatgatgtggcagtttacaaggctgtacaaaagccaggagagtttatcatcacctttcctagagcatatcatgctggatttagccatggttttaactgtggagaagcagtaaactttgcaaatggagattggtttccacttggggctgcagctagcaggcgttatacacatctcaaaatgatgcctttaattccatatgaggaacttctttgtaaagaggcaatgttggttttcaagtcctcaagagtcagaagttccaagaacaaacctgaagacacaacatcttatcaagctattatgctgcctttcatgcatcttatgcaatcttataagacctccctcttgcgactgaacagttcaagaaagttgcatagttcttcaaatacaacaggttctcagatatgcagcctttgctacagggattgttatgtagcttatttgttgtgcaagtactgcttttctcatccaatttgtcttttccacgacattgcaccacagacttgtttatgtgggagagattatactattttcaaaaggaatgacattttcgcactggaagaagctgcaaaaagttttcaacagggaaaagaatgtgttgacaaattctctctatcaagtatattctcctgtaacataaatgattgcatcaaagttcctgagaataatccttggcagagagaaaaaagtgtaagaggtactagttttctaggggttgcatctaaaccgaaaacaaaagtggctgacagcaccaagcacagtgatgaaaggaataagtcaacaacgaagcattggagaaacaatgggcttccatccgtgaggggtgccgaaaggccaggaatcatttataacttgagaaaacgcaaatcaaaattgatttag

SEQ ID NO: 3725 - DNA, 864 bp, Glycine max var. Williams 82
atgaagactcttgggtcatccaaatcaatcagttggtatatgaaacaaacctcaatcttgaacaaaatgcctgtttgcatataccaagtccctaaatcattatgttgtgccaagccagaagccttttccccacaacttatagccattggtccatatactcactttcaccctgagctctatcccatggaaaggttcaaagtttttgcagccaaaggggtcctagatcacttcgaaaaacatgacttcaagcaacttgttgagctactccgcaacacagggcaattcatccgtgctagttaccacaaatacttggatttcaaggaagataccttgttatacgtcatagcaattgatggtttgttcttattggatttcttccacaattatctcaacgaggaagtgtcttgttctttcatgacaggactacaagaccaagttcagctaagtggtgtgaagctaaccagggatgccatcataagggacatcatcatggtggagaaccaaattccaacctacatgttgttgaggatcttggtgcttgaaagctccaaacctgctgactcagttctagagtatttgggttcgatgctcttgtcattctgcaagaaacactctccactcaagctaactcacatccccacatgttctgaggctgtctctaagcattaccatatcttggatctcatgtaccatttggtggtgtctcacactgaaaagtctgaaacaccaacacctgatcaaagcgaaggtacttctacacttatgaaaagctcaaaatctgaagccacagcagcatctaatcactttaagaaagttaaaaatgtgttatatatcatggacactaggctctgtaaaaaagcttaa

SEQ ID NO: 3726 - DNA, 2424 bp, Glycine max var. Williams 82; identical to SEQ ID NO: 1896

SEQ ID NO: 3727 - DNA, 1551 bp, Glycine max var. Williams 82; identical to SEQ ID NO: 1870

SEQ ID NO: 3728 - DNA, 1449 bp, Glycine max var. Williams 82
atgtctggcgtgccattaccctcaaaccttctgcctggtgatggaagccctgaatggtttagcagagcagacaatgcatggcagctaatagctgcaaccctagttggtctccaaagtgttccagggctcataatcttgtacggtggagcagtgaagaagaaatgggcagtgaactcagcattcatgtcactctatgcttttgcatgtgtgtttttctgttgggttgtgtggggatacagaatgtcttttggtgatgagcttcttcctttctggggaaagcctgctatgtcacttgaacatacttaccttttcaagagggcctttttgggggcattcccaaatgccacaatggtgtatttccagtgtgtctttgctgccatcactttgattctcattgctggggctgtgttggggcgcatgaacttctatgcttggatgttgtttgtgcctttgtggctcactttctcatacaccttcacagctttcagcatatggagttctagtgggtttttgaccaaaatggggataatagactactcaggtggatatgtgatccatttgtcttccggggttgcaggattcacggctgcatattgggttgggccacggctaaacaaggacagggaaaggttccctccaaacaacattcttctgatgctggcaggggcagggctgctgtggatggggtggacgggcttcaacggaggagatccatacacagtaaactcggatgcttcccttgccgtcctcaacacccatgcttgcactgctaccagcttgctcacttgggtcatccttgatgtcctctttttccgaaagccttctgtcattggagctgttcaaggcatgatcactggcttggtttgcataacccctgctgcaggtgttgtggagggatgggcagcacttataatgggagtgttatctggctcaattccatggttcaccatgatggtggtccataagagatcaaagctactgcagaaggttgatgatacaatggcagtgttccacactcatgccattgcaggaaccctaggaggactcctcactggactctttgctgatccaagacttaacaaattgttctatggaactgatggtcaatacgttggtttcttttatggtttaggttcgaagaaggtcagtaccgggttcaggcaaatgggggtccaaatccttgggattatctttgttatctttgtcaatgttatcagcacaagtttgatttgcctcttcattagaatttttgttccgttgagaatgtctgaagaggatatggagataggtgatgaggctgctcatggggaagaagcttatgcaatctggggtcagggtgataagcttgaaaactcaagttctaagtatggaagttcattatatgatgatgttgaagctggtggccccaagaagaagcgtggcggcacggttgagatgatgtcgaactaa

SEQ ID NO: 3729 - DNA, 3114 bp, Glycine max var. Williams 82
atgcaaaccttcttcttgtaccttttccttttcttcttgttatgtgcacttcaacaactagcctcatcccaacccttcttcctcaatagaaggatcctccatgaaccctttgttcctttaaccagtactcttccaccttctgaggcaccaaagccacaacctcttcatgcttctccttcaagccaaaaacaaaaaccaaatccaaaatatccatcatctaccattcccacaacctctaccactgccacagcagtaccaacaccaacaacagctacaactacaacacaatcaccatttttcccattatacccttcttcccctccacctccttctccaatcacctttgcttccttccctgccaacatttcctctctcattctccctcactctcccaaacccaattcttcctccaacaaactcctccctgttgctctctccgccgtcgccgctgcggtcctcgctataatcatctccgccgtcgtctgttaccgccgtcgccggaaccatcccctcgccgccgaaggcaaacttatccgatccgacaccgacctccgcctgctccggcacaatgccgaaaccgccgtcgaaactcgcaagctccggcacacgtcttccgccagctccgagtttctatatctaggaacagtagttaactcgcacgtaactgacgatagcgccgacgtctccgacgcccgcggcgaccggaaaatgaaatcgccggagctccggccacttccgccgctcgcgcgacaagcttccttgccgccgccgccgccgtgcgaggaggcggggttcaccaccgcggaggaggagggtgaggacgatgaggagttttactcgccgagaggctcctcgttaggaggctccggcggaaccggatcgggttcccggcgaattttcgccgctggaggaagaagcgtcatctctagttcgtgctcttcctcttcttccgcctcgccggaaaggtcacactctatcgcgaattcgccgtcggcgagttcgagttcccggagaacacagccaaagtctcctgaaaattacaaccaccaacacgtacaatcttcttcttctccttcgttgggctcaacaccagaaagggtttttactgaacataattcaaatgaagcattaagtgcatgtacacatgcacatgcatcatcatcatcatcatcattacatgaaggaacgttggagaaaaatgaaaatgcattatcatcatcactaccaccaccaccaccaccaccgagactatctaatgcttcttcgtcttcttcggctttttctcttccctcttcgccggagaaggtgacacgtaataacactttcgatcagtctccaagaatgtcgagtgtctccgacggactaatgttaccgggtttgtcatcggtgcctttgtcacccgccctattgtcatcaccggaaaccgaaaggggaacttttaatggatggagaacaagttcttttggtgcggctgcgccgcagaggaaacaatggaatcttccggtgctatcactaacaccaccctttgatgaaattggaacggttccggctcctccacctttgccacagaggaagcactgggagattccgggttctggtccgccaccgccgccaccattgccacggcaaaggaagcagtggggagtgccagcgcttgcactggggtcctcgacaccgatttcgaggccgccagaattgttgcctccttcgagaccttttgtgttgcaaaaccaaggaagcaatgtcgagttgccggcgagtttgggggaaattgaagagactagtaaaccaaaattgaagcccctgcattgggacaaagtaagaaccacctctgatcgtcaaatggtgtgggatcagatgaagtcccgctcgtttaaattgaatgagaaaatgattgaaacattgtttgtagtgaacacaccaaacccaaactcagtttttcaccagccgaatcaggaggaaagagtactcgatcctaaaaagtctcagaatatttcaatcttgctgaaagcacttaatgtcactatagaagaagtgtgtgaagcactcttagaaggtagtactgatacacttggaacagaattacttgaaagcttattaagaatggcaccaagcaaggaagaagaatgtaagttgaaggaacataaagatgactcaccaaccaagcttggtccggctgaaatttttttgaaggcagtgcttaatgtaccttttgcatttaaaaggattgaagcgatgctttatatagccaattttgagtttgaagtggagtatcttaggacatcctttcaaactctacagactgcctgtgaagagctgcgacattgtagaatgttcatgaagcttctggaggctgtacttaaaactgggaaccgcatgaatgtggggaccaaccgcggggatgcagaggcattcaaacttgatactcttctcaaactggttgacgtcaaaggcgcagatgggaaaaccactctactgcattttgttgtacaggaaattatccaaactgaaggtgcttgtctctcgggcactaatcaaactccaagctctactttgagtggagatgccaagtgtaggaggcttggactacaagttgtatcaagcctgagttccgagctagcaaatgtgaagaaggcagcagctatggattctgaagttctcagcagtgatgtcttgaaactttccaaaggaattgctagcttagcagaggctgtgcaattaaaccaaaccatggcatcagatgaaagcagtcagaaattcacagaatcaatgaacaaattcatcagaatggctgaggaggaaattccaaaaattcaagcccaagaaagtgttgcttcctcccatgtgaaggagattacagagtattttcttgggaacttgacaaaggaagaagctcatccatttagaatattcatggttgtaagagacttcctagcagttcttgaccgggtctgcaaagaagttggaatgataaatgagagaactatggttagttcagctcataaattccctgtgccagttaaccctatgcttccgcaaccccttcctggattacatgagagacaacagtataatgactcttcagatgatgatagttcatcttcatcaccatag

SEQ ID NO: 3730 - DNA, 513 bp, Glycine max var. Williams 82
atgaaggaaggtggtggtagaaagcaaggtgcagcctcaccttgtgctgcatgcaagcttctgaggagaaggtgtgctcaggattgtgtttttgctccatattttccagcagatgaaccacaaaagtttgcaaatgtgcacaaggtgtttggtgctagcaatgtcaacaagatgcttcaggacctaccgatgcatcaacgaggggatgcagtgagtagcatggtgtatgaggccaatgccagagtccgagaccctgtttatgggtgtgttggggccatctcttcgcttcagcaacagattgatgtgttacagacccaattggcccgggcccaggctgaggtggcccatcttcgggtgagacaaaacagatgcttttccaatcatgggcttaggcccactagcccaacccatagtgggtttccatcatccaagaccttggactcacatgccaagcctatttttgacatagacatggtggaccaggccagctatggtggttcaatgtggtcatga

SEQ ID NO: 3731 - DNA, 1863 bp, Glycine max var. Williams 82; identical to SEQ ID NO: 1872

SEQ ID NO: 3732 - DNA, 1005 bp, Glycine max var. Williams 82
atggacacaatagaacaagaaaacatgcaatttctcgggttcttgggcatctacaaagaatcctacaagctcatattttcatggaggaagatcttcacccagatcaccttcaccctaatcctccctctctccttcatcttcctcatccacatccaagtatccgatctcctcttcgggaaaatcacacacgacgccaaggacttaaccgaaaccctacccggcacaccccaacaccaaaagctccttgacacattctcttccgattgggccactttctttctcttcaaactcctttacttcatttccctactcatcttctccctcctctccacctccgcaattgtttacaccgtcgcttccttctacaccggcaaagaagtaaccttcaagaaggtcctaagcgttgtccctaaggtatggaagaggctcatggtaacatttttgtgcaccgttgttgctttcttcgtttacaatgttatggcagtgttggttctaggcatatgggcactcacaattggtgtgagaaatggtggtggtgcaattttgtcggtcttagcgatattatatctagtggggtcggtgtaccttaccgtggtgtggctattagcgagtgttgtgacagtgttagaagactcttatgggtatgaagccatgatgaagagcaaggagttgataaaggggaagatgggtctgtccgtgatgattgttttgaagctcaacttcttgttctttctaacacagtttttgttctcgatggtggtggtgaacggatggaaggtgttcggtttggggtcggtggacagaacagtgtttgggattgtgtgtttcttgctgctgtctcatttgttcttgctgatgcttgttatccaaactgtgatgtattttgtttgcaagtcctaccaccgcgagattgttgacaagtctgctttgtcatatcacttggaagtgtatgagtgctatgagcctttgaaggctaaagatgttcaactggattaccatgtctaa

SEQ ID NO: 3733 - DNA, 1998 bp, Glycine max var. Williams 82; identical to SEQ ID NO: 1027

SEQ ID NO: 3734 - DNA, 1344 bp, Glycine max var. Williams 82
atggggctgaatgttcatcgcgtacattctcctacgctgaagtcgataatactattacttgctctctgcactttatcagattgttatgacccattggatcctaatgggaacatttccgtaacttttgacatcttccaacgtactccagataatggatatctggcaagggtgacccttcaaaactactatcaatatcggcatgtagacaaacctgggtggaaactaggatggacgtgggctaacaatgaagtgatatggtcaatgagtggtgccatagcaactgatagagggaattgttcatcttacagcggctctcagatgccacattcatgcaagaaagatcccaccatagttgatctctctctagatgcctcacaaaacaggtcagagcattgttgccgtggtggcctcctctctccctggtctattgatcctttctatgcattctcttcatttgaacttgaagtgcgcaacgtgggagataacccacttggacaagcacctattaatcttacattgatggccccaggtcctggttacacttgtagcccccttcttgacactgatctctcagtgtcctcagattttgggggactaagacaagttcctgttctcagaacttggaagtcaacatgtgcatactccagtttcttagcaaacacaataccggtatgctgtgtttccctctcatcattttacaaccccgccatcacatcttgccgtaattgcagttgtggatgcagagaagcagataaaagtacagcaacttgcataaggtctagttccttgtcacggtctaatgaggacaacacaattgatgaaatgattgaatgcaccgaccacatgtgcccagttcgagtccattggcatttcaagaacaattatatgaaccaatggagggtgaagcttacaatttctaactacaactacaacagaaactactcaaactggaacgtactcgttcaacatcctggtttcacccaaaaagcgagaacttacagcttcaacagcactaaacttcccacccttgggctccaagatggagtttcccttttttgggggatagattattacaacaatgagctagtgcattctgataaggatggagtgggtcttgtgactacagaaatactattggataaagatccaaattctttcacagtaagtaatggatgggcatttccgagaagaatatatttcaacggggagaactgcgaaatgcctttacctgacacgtttcctatgttaccaaatggtggctccattttaagagctacttactgtggtttcagtcttttatatatccttttgtttcttgccctactactgatcctttggttttga

SEQ ID NO: 3735 - DNA, 2310 bp, Glycine max var. Williams 82
ttgataattgatgagaagtttgagaagtttgattgtttgtgttttcttgcaaatgtgagggaaaagtcaaacaaacacgggttagaacacctccaaacaatccttctttcagaaatactaggagagatgaacatcaacttaacaagtaagcaacaaggaatttcaatcatacagtcttggctcatgggaaagaaggttctcttgattctagatgatgttgacatacacaagcaattacaagcaattgctggaagacctgattggtttggaccgaacagcaaaatcatcatcacaactgggaacaaacagttgctagcatctcatgaagttaataaaacatatgaggtaaaggaattgaatgtgaatgatgctcttcagttgcttacatggcaagcttttaaaaaggaaaaagcttgtccaacttatgtgaaggtcatgaaacgtgcagtgacttatgcttctggtcttccattggcgttggaagtaataggttcccacttggatgaaaaaaaagaagagaagaatatttttcttgacatagcttgttacttcaaaggatggaaagtgacagaggttgaacatatactttgtggacattatgatgactgcatgaaacatcatattggggtgttggttgaaaaatctctcatagagtttagttgggatggtgtaggaactagtgagattgaaatcatatgtctggatttatccttatccgtgaaagaagcaacaatagaatggaatgaaaatgccttcaaaaagatgaaaaaccttaaaatacttattattagaaatggtaaattttccaaaggtcccaattattttccagaaagtttaagagtactggaatggcaccggtatccttctaattgtttaccatctaattttcatccgaaggaacttgccatatgcaagttacctcaaagttgcattacgtcatttgggttccatggctcaaggaaggcaagtttaaggagtatattttgttcttcttatttcttttttccattattttttcttttgcagaagttcaggaatctaaaggttttgaattttgacgattgtgaatttttaacagagataggtgacgtatctgatctcccaaatttggaaaaactttcatttgatcggtgtgggaatttaatgacagttcaccgctcaattggttttctaaataaacttaaaatattgagagctagattttgcagcaagcttaccacatttccacctctcaacttgacctctcttgaaatacttgaactttcacaatgttccagtcttgagaattttccagaaatattaggagagatgaaaaacttattgtaccttgaattggttaaccttggcttaaaagaattgccagtttcatttcaaaatcttgttggactcaaaactttatccctgcgtgattgtggaattcttttgttaccaagtaacattgtcatgatgcctaaattggattttttggacgcttcaagttgtaaggggctgcaatgggtgaaatcaaaagagggtgaagaaaaagtgagctcaatagtatgttcaaatgtatatggcttcgctgtcgatgattgcaaactgtatgatgattttttttcaagaggtttcttgcagcttgatcatgtggtgactttaaacctaaggaacaataatttcacattccttcctgaatgcatcaaagaattgcaatttttaagaatacttgaggtgggtggttgcttgcatcttcaggaaattaggggggttccaccattcttaacatatttcacggcaagagaatgtatatccttgtcttcctcgagttcaaggatgttgtcaaatcaggaattgcatgaggctggacaaactaagttttggtttccaggagcaactattccagagtggttcaataaccaaagtaggggacattcaagttctttctggtttcgtaatgaattccctgtcaatgttctttgtcttcttctagcacgtgtggaacgcatagatgtagatgatattttcatgcctgcggtgttcatcaatggcaaacttcataaaaatccctctcggggcactaaagtaggaaaggtgaaattggattatacatatctatttgacctaaaatcagctttggagcttaatgatatatatgaagtggctttagaaaaggaacggaaccaggtggaaattacatacgcaggtctgatagagacctcactggttaaagcaaccggaacccatgtactcagacaggatgatattcgatatgatgatccttattatggttgttttgcaggttatcgaggtgggttggtcctgaaagaattataa

SEQ ID NO: 3736 - DNA, 453 bp, Glycine max var. Williams 82
atggcattgtctttcactcaacgattcttcctttctccttcacttcttcttctcctcctcctcattgctctctcttcttcttctcttactggttgtcctgtgaatttcgagtttttaaactacacaataatcacatgcaaatgcaaaggagcccaagttgttgcttgcccttatgccaatgttttaaacgatttaacgaatgattgtgccacaatcatgtttagtttcattaatctctatggaaaataccctcccggcttctttgctagcatgtgtcacgaagggaagaaaggtattactattaactgtcttcctgctgctgctgcatcgccaccatcagtatcagcagatgacactgggatgaaaactcaccagatgcgtgtgagtgtgactgtagtagtagtagtctattttcatgttgtaatgttacatgtaataaggtttgttcagtaa

SEQ ID NO: 3737 - DNA, 324 bp, Glycine max var. Williams 82
atgactccatcgttttcggccggctttgtcaccttcttaaagctcaattcagatcactgctaccatttcttctttctggaatcacttaatccatgggtgacaatgatggtcatgatcccttatcaagcaaccttgttatcctcctcattgccgtgccgcagctttcgttgtctcaatctaccatgtcatagctatgtgctggttcaaccagcgcatcgcaaaccgaaacccacaacaacaacggccaccacagacagagggcacttccttggtgtcggtggcgcacatgattccaacccacacatatcacaagaagaaaattga

SEQ ID NO: 3738 - DNA, 249 bp, Glycine max var. Williams 82
atgggtttcagtttgcgtggtcttcaaaggcgtgtggatgtcccaaagggcagtgtagcagtgtatgtaggagaaagccaaaagaagcgctttgtggttcccatatcatacttgaaccaaccttcatttcttgagttgctgagtcaagctgagcaagaatttggatttgatcatccaatgggtggcctcacacttccttacacagaagaagtcttcctggatgtcacttctcgcttgcacaggcgataa

SEQ ID NO: 3739 - DNA, 1572 bp, Glycine max var. Williams 82
atgaaatatgaaaatgaaactgttactcttttgaatgtgaacattattatatttgacagggccctgcatgaaaaggaaaagaaacgtgggcgcatgtcaaaagaaaccttctttctgatagcacttacttgcagcttcgtgtggtacgtggtccctggctacctatttacggcgctgtcaattatttcgtgggtgtgttggatatttccccattctgtaacagcacagcagattggatccggcgaaaagggacttggtttgggttccttttcccttgactggaccaccgttgctgcattccttggcaacccacttgtttctcctttctttgcaacagcaaacgtgttggtgggctacatcttattgatctacctcatcatacctgtctcatattggggacttaatatctacaatgccaagaacttcccgatatactcttctagtctattcgttgccaatggcacggaatacaatgtgaaggccattgtaaatgaaaagtttgagatagatatgctggcatacgagaaacaaggtcgagtcaacttgagtgcgttctttgctattagttatggcattggttttgctgccattgcctcttccctcactcatgtggccatattcaatgggagggagatatatgaacagttccgatcttcacgatctaaaaaagaagacattcacgcaagattgatgaagaagtacaagcgaatacctagttggtggtttcatgtgacgcttttggtttcttttgcacttgcacttttactgtgcattgtcatgaaagatcagatacaaatgccatggtggggtctcatctttgcatccgggattgcacttacttttactcttcccgttagcatcataacggccaccactaatcagactccaggtttgaatatcattactgagtacatcatgggtgtgattttacctggcaaaccaatagcaaacgtttgcttcaagacatatgggtacataagtatgtcacaggctgtttcctttctatctgatttcaagctaggacattacatgaagattccgccacggtccatgttcattgttcaggttgtagggacgctgatagcaggaaccatggacgttggtgtcgcatggtggttgctgggttccgttaagaacatatgcaaccaagatttactgcccgcagacagtccatggacttgcccgggtgacaaagttttctttgatgcatctgtgatctggggtttggttggcccaaagagaattttcggtactcttgggaattacccaaaactcaattggttcttcttaataggagcattgggaccacttgttatatggctgctccagaaagcctttcgaaaacaaacttggatatcattgattcaccttcctgtgcttcttggagcaactgcgaacatgccaccagctagctccgtgaacttcaatgcatggattactgttggcacaatctttaactacttcgtgttcaaatatcgtaagaattggtggcagcggtacaattatgtgctccccggcagctttggacgctggattggcttttatgacggttcttctatactttgcggttaa

SEQ ID NO: 3740 - DNA, 2187 bp, Glycine max var. Williams 82
atggaaaatggaaacacagccaacgaacccgcaagcttctggactcaagcaaacgctcttcttaggaagaatttaacctttcagaaacgaaatgttaaaacaaacgttggactcatcctgtccccgttcattttgtgtctcttgctggttctgctccaaaggttgctggagtaccaattggacaaggctgagaacaagtgtggctgcgtttgtgttaggagacaaggggacacgtgtctcgaggaggagtgcggcattgagcattcggatttggaccagtttgccacgtgtcctattcccagccctccagagtggcctcctctgctgcaagttcccgcaccacagtaccgcgctgtgagaacggattatttccccttttctgattttccaaacacgtcctgcaggaagaatggctcttgccctgtcactatgctcttcactggcactaaccaatcttttggagaaatcatatctaggaatatgattccaagtaccttgagtactatatacagctctgatattatggctagtttggcatcaaatgtagtgggatcagaatcagagccagggaacaccaattttctggaacctgctttcttttcggaccttcctatttattatctacagaatcagtgcacgcagaactctacattctccgtttctgttcagatgtcagggattagcaagcagcaagaggtaatatgtgctcagggtttacgtttatggcgtaatagttcttctgaggtgaacaatgagctatataaaggttattggagaagtaacatagagagacagatcaatgagatagctgcaggttatgattttttaaattcaaatgggagtatatttaacgtcagcatatggtacaactcaacctacaaaaaggacactggctttaatccaattgcattggcgcgtattcctcgttctgtaaatttggtatcaaatgcgtaccttcagtttctgttgggacctggtaccaaaatgttttttgagtttgtaaaggaaatgccaaaacctgagaccccaattaaattggatttggcttctcttttgggtggtgtcttctttacatgggtcatcttgcaacttttccctattcccttgacatcgctagtatatgagaagcaacaaaagttaagaatcatgatgaaaatgcatggtcttgatgacgggccatattggatgatttcgtatggttattttcttgccatatccattgtctacatgctgtgttttgtgatatttggctcagtcatagggttgaatttcttcacaatgaatgactacagcatccaatccgtgttttatttcatctatataaatttacaaatttcactggcttttttattggcttccctgttttcaaatgttaaaactgctacagtacttgcatatataggtatgtttggaactgggctattagctgactttcctttccatttttttgttcaagacacattatatgttttttttatcttgctgtgggaatccctaaccggaagagagcacctactcttttatggcagacttaaaaatcttaaaggttcagccttaacccaagcagtggaagaatcgttgaaaagtgtaaacctttttcacggaggagttgctgataagcaagctggaaaatacagtggaggaatgaagaggaggcttagtgtggcaatttcgttgattggagatcctaaagtggtttatatggacgagccaagtactggacttgaccctgcatcaagaaaaaacttatggaatgttgttaagcgtgcaaaacaggatcgtgcaatcattcttaccacacattccatggaagaagcagaagtcctatgtgatcgattaggaatatttgtagacggtggcttgcagtgcataggaaatccgaaggagttgaaagccaggtatggaggaacatatgtcttcacaatgacaacatctattgatcatgaaaatgatgtagagaatttggtgcgacagctcttcccaaatgctaacaagatctaccatatctctggcacccaaaaattcgagctaccaaaggatgaggttaaaatagcaaatgtattccaagctgtagaaaccgcaaagagaagcttcaccgtttcagcgtggggtttagctgataccacattggaagatgtcttcattaaagttgcacgtggggctcaggcatttaacaccttgtcataa

SEQ ID NO: 3741 - DNA, 747 bp, Glycine max var. Williams 82; identical to SEQ ID NO: 1007

SEQ ID NO: 3742 - DNA, 1464 bp, Glycine max var. Williams 82
atggttgagatggatggcgttggcagcaagtatcatcaacaaacacttaacttctccatcgacattcatcaacaaggaatctctaaatgtttcgacgacgatggtcgccccaaacgaaccgggacggtgtggactgcaagtgcacacataataactgcagtgattgggtctggggtgctgtctctggcttgggctatagctcagcttggatggattgctggtcctattgtcatggttctcttttctgccatcacttactacacttccactcttctctctgattgttatcgtactggtgatcctgtaactggcaagagaaactacacttacatggacgctattcagtctaactttggtggaaatggctttaaggtcaagctgtgtgggctagttcagtacattaaccttttcggagtcgccattggttacactatagcggcttccactagcatgatggcaattgaaagatctaattgttaccacaagagtggagggaaagatccatgtcatatgaacagtaacatgtacatgatttcatttggtatagtggaaattattttctcacaaattccgggcttcgatcaattgtggtggctctccattgtagctgctgtcatgtccttcacatactccactattgggctaggccttggtattggaaaagttattgaaaatagaggagtcgggggaagcctaaccgggataacaattggtaccgtgacacaaactgaaaaagtttggagaaccatgcaagctcttggtgacatagcctttgcctattcatactccctcatccttgtagaaattcaggacacagtgaaatcccctccatcagagtcaaaaacaatgaagaaggctagtttcatcagtgttgcagtaaccagcattttctacatgctttgtggttgctttggttatgctgcttttggagatgcaagccctggaaaccttctcactggctttggtttctacaacccatattggctccttgacatagctaatgctgccatagtgatccaccttgttggttcataccaagtttactgccagcccctcttcgccttcgttgagaaacacgcggcgcgtatgctcccagatagtgattttgtgaacaaagaaattgaaattccaatccctggtttccattcctacaaggtcaacctcttcagattggtttggaggacaatatatgtaatggtgagcactgtaatatcaatgctcctcccattcttcaatgacatagggggacttcttggagcatttggattttggccccttactgtgtatttcccagtggagatgtacattaatcaaaagagaataccaaaatggagcacaaagtggatctgcctccaaatacttagcatggcttgccttttgatgactataggagctgcagctggctctattgctgggattgccattgatcttcaaacttacaagcctttcaaaaccaactattga

SEQ ID NO: 3743 - DNA, 234 bp, Glycine max var. Williams 82
atgagactctccaaaccaacattgcttctcttcctggttttcatcttcactactgttcaagggcaagcagttaccaacgaacgagttgttggttctgagagtgtcgtgagttttgaattgagaagatcaggtggctgtgaaaaacaaggctttgagtacagggaaggaaatggtgggttggaagatacagttttggagaatgaagactacatctacaccaactctttgccttag

SEQ ID NO: 3744 - DNA, 753 bp, Glycine max var. Williams 82; identical to SEQ ID NO: 1040

SEQ ID NO: 3745 - DNA, 303 bp, Glycine max var. Williams 82
atggctttgagaaaatcaagtaaacttcctcagacagcactaatcaagcaaatcctcaagaggtgttcgagtttagggaggaaagatgatcaaggccttctggacgtgccaaagggtcactttgttgtatatgttggagaaaacagaagcagatatattgttcctatttccttcctaagtcgccctgagttccaaacacttctccaccaggctgaagaagagtttggctttgatcacgaaaagggtctcactattccatgcgaagaggacgtttttgagtctctcacctccatgctcagatga

SEQ ID NO: 3746 - DNA, 501 bp, Glycine max var. Williams 82; identical to SEQ ID NO: 923

SEQ ID NO: 3747 - DNA, 450 bp, Glycine max var. Williams 82
atggaaattgtgatttccttgatcatactctttgtggggatagcaattttggtggtcatccatgtctgcgtcgtggggagggccttcagagggaacaacaacgaagaagaagaagaaggtactcatcgcagcatcaatgccatgaagagaatgtttggcggcgacagcgttggtgacctgaaaaaccttccttgctttccttatgaagagccaaaagagagtactaaagggtgttgtggcctagtggattgtgctgtttgcttggagaatttcaaggttggtgatgtgtgcagattattgcccaattgcagccacagcttccatgtgcagtgtatagactcatggatactgcagacacccgtttgtcccatttgtagaacatgggttcattcaccagttgtgagggaacaaagtgttgtttctgaaagtttagaaattgtaacggaatag

SEQ ID NO: 3748 - DNA, 879 bp, Glycine max var. Williams 82
atggcgattgaagcacagttgtatcccaacaatgctcctccgtttccttttcacgtgtcaagggtagacaaatctccagcagcatatagtcatagtcacaggcaacaacaaccaggtggctggcagatgaatcagaacattcctcttgttcctcccaacttttcttgtttttccaattccaattccaattccaattccaatgtcctccaaaacgccttcaataagaatgttgttcagccttcagcctcatatcctcaatgcttggctattgagtttgatcaacagagggagattgatcaccatatcagatcacataacgaaaaattgaggattttgttgcaagagcaaaggaaacagcatgtggcagagttattgaagaaggtggaatcgaatgctcttcatttgttgagacagaaagatgaagaaatagcgcaggcaacaaagaaaagcaccgagttgaaagaatttatgacaaggttggaggtggagaaccaatcatggcgtaaggtagccgaggaaaacgaggctatggtattgtcccttcacaacaccttagaagatatgaaagaaagagctctgtatcgggtgacaaaagaggatgcagagtcgtgttgcgatgaaaacatgagaaacagggcaatggaagaaggaacaggagaaaacagactgtgcggtggtggtggcgctggtggggtagaagaggttgagcaaattaggaaaaggacaatggattgcaaatgttgtaattctcaaaattcgtgctttatgtttcttccttgcagacacctctgttcgtgtaaaacttgtgagccttttctgcaagtttgccctgtttgtagtatgcctaaaaagtctagcatagagacattaattgtatag

SEQ ID NO: 3749 - DNA, 348 bp, Glycine max var. Williams 82; identical to SEQ ID NO: 969

SEQ ID NO: 3750 - DNA, 279 bp, Glycine max var. Williams 82
atgttcacacaaatcaaaatgtctccatgttctatttgtttctaccacatgggtctttcccttgtcgtctctctcttcctcctttttgttaaccattttgttttgctaaagttcaatgatgtcttctatatactctctcaacatcttccatgtcttcttcaccttcacctccgtgacaattcacgcactcatctttctcttgagcaagatagcataaagtggcactgcatgccttgttcaacatgggaagagtctgcagcagaggtttccttaatctag

SEQ ID NO: 3751 - DNA, 1155 bp, Glycine max var. Williams 82; identical to SEQ ID NO: 951

SEQ ID NO: 3752 - DNA, 1383 bp, Glycine max var. Williams 82
atgactactacccctgtcgttcaacgcatttcagaatgcttcgtcaaaccacatggtttaacccaagtgtcaaaccaaatatgtcatttaacacaatgggatattgttatgttgtctaagcactatatccagaagggtctactcttcaagaaacccacacctcttgttgatcaacatgatttcatagagaatctcttggagaagctcaaacactctctttctctcactctctcccatttttatcctttggctggtcgccttgtcacccaaaaatcccaagaccctccttcttatgctgtttctgttgattccaaaaacagtgatggagccagattcatctatgcaactctggatatgaccatatctgacatcctctctcccgttgacgtcccactcgttgttcagtcattgtttgaccaccacaaagcagtcaaccatgatggtcacaccatgccccttttgtccatccaagtcaccgaaatagttgatggtgttttcttaggttgttccatgaatcacgctgtcggtgatggcacctcttattggaatttcttcaatacatggtctcagatctttcaagctcatgctaaagggcacgacactgatgttcccatttcacaccaacctattctcagccgctggtttccgaatgattgtgctccaccaataaatcttcctttcaaacatcatgacgagtttatcagcagaattgaagcacccttgatgagggagagagtcttccacttctcagcagagtctattgcaagactgaaagcaaaggccaacatggaatccgataccacaaaaatctcttcattccagtcactatcagcacttgtttggagatgcataactcgtgcatgttccctaccttatgagcaaagaacaagttgcaggttaaccgcaaacaatcgaacaagaatggaaccacctttgcctcagcaatactttggaaactcagtaagtaggttgaatgcacaaacaacagtaggggaattacttgagaacaatctaggatgggctgcatggaagttgcacctggctgttacaaaccataacgacaaagtggttctgcaatcactcaaaaagtggttacagtgtcctttaatctatcaaattggtcagcccatggatccgtacgatgtgttgataagtagctcacccaggttcaacatgtatggaaatgagtttggaatggggaaagctgtagcagtgagaagtggttatgccaacaaatttcatgggaaagtgacatcatacccaggtcgtgaaggagggggaagcatcgatttggaagtgggccttttgccacatataatgagcgctctggaatctgatgaggagtttatgaaggttgtttcggtttccaatcccttatgctag

SEQ ID NO: 3753 - DNA, 2100 bp, Glycine max var. Williams 82; identical to SEQ ID NO: 1060

SEQ ID NO: 3754 - DNA, 1083 bp, Glycine max var. Williams 82
atggaagaacccgtcatggaacaacaaccctccgctgctgcctctgggaacactgccagacccaggcttcagaagtacgcactccgatctgccaataagttgaaggaagagaagtcagaaactcccaattgctccattcctacttctgaaaccatgagggggagaagtgtaggtgcttcaagtgtaagtaaaagtgtgagtgttcttgatttttctggcaaggacaagtctggtagtgccaagccacccagaaggctctcaattcctgccaaaacaccagccacttcaagacccaagctgggtggcaacagtaccccaatcactgagactagaactgggaggagtgcttttggtcaaggcagaagcaaaacaccaatttcagacatttccaagacatcttcacgaaccaagttaaatctcctaacttcggcttcgtattggttaaaccagatcaagctctctgaatccgcggccaagcactcaatttcacttggcttcttcaaactagctttggaggcaggatgtgagcctctcgggccaatgcaagaagggctaaaatcatatgtgggcagacatcagcttgatggtcttgaagaaactgtgaaagcattgtttgagagctataacatctcagaaacaatggagcagtggcaggtgtctgagactatttcacatgtgccagaagagggaactcggtcttccgatgatgatgtgcgtagctcttcttctaccatggggactagaaaactgaaaccaaagtgcttaaacactgattctactcaactcacaccttcgacagagtcagcaaagaaggagacaagtcaaaagagtaatcctggatccaggttgagagggaatctcagcacaaacaccacaactccaaggcctgctctagacaacaggaataataggttggttaaaaaatctgagaagccaagcaagcaagaaccaaataaggaaaagggcatgataaagaggcagggaaagaaatctgatgttaaagaagttagcactccaaagggaggcaaagaaaatatggaagctcggaccactgaagaaaacagcgtgacagaagtggtgtaa

SEQ ID NO: 3755 - DNA, 1380 bp, Glycine max var. Williams 82; identical to SEQ ID NO: 1005

SEQ ID NO: 3756 - DNA, 2244 bp, Glycine max var. Williams 82
atgattttatcacgggatgatacaaaagttgtgctagttgcatggtttctattaatgatctcagcaatgtcgcaaacaattcgtcctagctgccaaaataaatgtggaagtgtgaacattccatatccttttggtacaactgagaactgctgcttgaacagaaacttttatgttgcttgtaacacaagtcacaaccctcccaaaccatttctgtggaatgtgacaaaaaatattgagattttagaggtgtcgttgaatggccatttgaggataaaatcccctgtagcttatgtttgctatgatgaaaagggtgtgctagtggattccggaaattcattcatgactttgcaagcattccacttctcatactctcagaacaagttcattggaattggatgtgacaccctttcaaccatcaatgcaacaattgggaaaaactactcagctggagggtgtttttcactttgtagtagtgtagaaagttcagccaatggatcctggtttggcattggtttctgccaaacctctatcccaaaaaacattttggcatatcaagctcgtgtcctgagatcaaatttgatgcatagtgatatgaatattccttgtgcctactctcttttggttgaagaggactctttcaagttctccacggatgacttcatcaaacttcagaagacaaaaacagctaccacagtgcttgattgggctgttggaaatcagacatgtcaagaagctaagaagaatttaactagttatgcctgccaagcaaatagtgtatgtattgattctgacaatggaccagggtacctttgcagatgcttagaaggttatgtgggaaatgcataccttcatggtggatgccaagatattgatgagtgcgccaatccgagtctaaatgactgttcagatatttgccttaacctacctgggagctataattgctcttgtcccaagagcaagagttatgagggagatggcagaaaaggaggtagtggctgtgtctcgaatctaccacatgtggttaatcagattgtgataggcactggcataggccttatgctgttgttaattggtagtggctggctattccatgtgttccgtaaaagaaaaatggtgagactcacagcaagatattttaagagaaatggtggcttaatgttgcagcagcaaattgcgaacatggaaggatcatctgagagagccaaaattttcactgcaactgagctaaagaaagcctccgaaaactttcatgagagcagaatcattggcagaggaggatacggtacggtttataggggaatacttccaaatgacaaagttgttgctatcaagaaatcaaaactagtagaccacagccaaattgaacaattcatcaatgaagtggttgtactgtcccaaatcaaccacagaaatgttgtcaaactcctaggttgctgtctagagacagaaatgccactactggtttatgaatttgtgaacaatggcaccctctttgaccacattcacaacaaaaacaccacacttccctgggtaacacgtctaagaatagcagcagaaacggctggtgtgcttgcatacttgcattctgctgcctccataccagtcatccatagggactttaagtcaactaacatactgttggatgacaaatacacagctaaggtttctgactttggaacctcgagattggttccacgtgacaagtgtcaattaacaacattggttcagggaactcttggctaccttgaccctgagtactttcagaccagccaactaactgagaaaagcgatgtgtatagcttcggtgtcgtgcttgcggagttgctaactggaagaagggcactttcttttgacatgccagaggaagagagaaacttagccttgtatttcctttcagctgtgaaggatgattgcttgttccaaattgtagaggattgtgtgagtgagggaaatagtgagcaggtgaaggaagttgctaacattgctcaatggtgcttgaggcttagaggtgaggaaagacctaccatgaaggaagtggcaatggaattggatagtcttagaatgatgacaacaacaactacatggattaatgccgcatcaaattcaacagaatatgtgattggtgaaagatcaggtcgaacagaaacaacagactatgctaattgtcattatactacatgtgctgggcatgaggatgacaccatttgcaacgatgtgatgtcaccgttatgggatggtagatga

SEQ ID NO: 3757 - DNA, 1017 bp, Glycine max var. Williams 82
atggacacaaaagtgctttcttccggagttcagtactcaaatctaccggagagttacatccgacccgagtcggagcgacctcgtctttccgaggtttcggagtgcgaggatgttcctatcatcgacttgggttgtcaaaatagagcccagattgttcaccagatcggtgaagcctgcagaaactatggttttttccaggtgattaatcacggggtggctttagaagccgcaaaggaaatggcagaggtggcacatggattcttcaagttgccagtggaggagaagctgaaattgtactctgaagacccctcaaagacaatgagactgtccactagttttaatgttaaaaaagagacggtgcataattggagggattatcttagacttcactgctatcctttggacaaatatgctcctgaatggccttctaatccaccctctttcaaggaaactgtgacagaatactgcacattagttagggaattggggttgagaatacaggagtacatatcggagagtttgggcctagaaaaagattacataaagaatgtattaggggaacaagggcagcacatggcagtgaactactatccaccatgcccagaaccagaacttacctatggattgccagggcatactgacccaaatgcactcactattctgctccaagaccttcaggtttgtggccttcaagttctcaaaaatggcaagtggctcgccgttaatcctcaacctaatgcctttgtcattaacattggcgatcaactccaggctttgagtaatgggctttacaagagtgtgtggcatcgtgctgttgtcaatgttgagaaaccaaggctttctgtggcttcatttctttgtccaaatgacgaggcattgataagccctgcaaaaccactcacggaaggtggatccgaagcaatatacagaggatttacatatgcagaatactataagaagttttggagcaggaacttagaccaagaacactgtttggaatttttcaagaacaagtaa

SEQ ID NO: 3758 - DNA, 1713 bp, Glycine max var. Williams 82
atgtcttcgtttccgatagatagatcccataatgggagtcttaagtgtctagaggcactaagtagtgtatcagaaaaggaggaatttgatttctcaaaagcattagataggcctagggctctgaatatagagagacagagatcatttgatgaaagatcaatgaatgaactatccttaggcttttctccacgtcaattggccacaaaagttgatagttcatctcgcctgggagatcttcttgatcatgtacattctcctaggccaaagtcagatattaatactccgggatcagtgacattggatccacatccattaacatcagaagcttgggaagagctgaggcgttccttggtatatttccgtggtcagccagttggtacaattgctgctttggataattctgatgagaaacttaattatgatcaggtgtttataagagactttgtcccaagtgctttggcttttctgatgcatggggaaacggacattgttaaaaattttcttttaaagacccttcgccttcaatcatgggagaaaaagattgacaggttccaactagcagaaggggtgatgcctgctagttttaaagtattccatgacccagttagaaatcatgagaccctgatagcagattttggtgaaagtgcaataggcagggttgctcctgttgattctggattttggtggattatactgcttcgcgcatacacaaaggctacaggagactcttctttggctgaacggcctgaatgtcaaaagggtatgcgcttgatcttgagtttatgcctgtcagaggggtttgacacgtttccaactttactatgtgctgatggatgctgcatgattgatcgaagaatgggtgtttatgggtatccaattgagattcaagcattgttcttcatggctttaagatgtgccttgcaattgcttaagcaagacatggaagggaaagagtttgtggagcgaattgtgaaacggttgcatgccttaagctatcatatgaggagctacttttggttggatttgaagcagcttaatgatgtataccgcttcaaaacagaagagtactcgcatactgcagtgaacaagttcaatgttattcctgattcattaccagattggatatttgatttcatgcctcatcatggtggatactttgttgggaatgtgagcccggctaggatggatttcaggtggttttgcttgggcaattgcattgcaattttgtcgtgcatggcaactcctgagcagtcaattgcaatcatggatctcattgaatcacgctgggaggaattaattggagagatgcctgtcaaagtttgttatccagcaattgaaaaccatgaatggaggctcgtaacaggatgtgaccctaaaaatactagatggagttaccacaacgggggatcctggccagttcttttatggcttctggctgcggcatcgatcaagactgggaggccccaaattgcaaggcgtgcccttaacattgctgagagcaaattgctgaaggacaactggcccgaatactatgatggaacgacgggccgatatgttgggaagcaggcccgtaagttccagacctggtccattgctggttacttgtccgctaggatgatgctcgatgatccatcccatttaggtcttgttgctctcgaagaagacaaacacctcaagcctttgctcaagagatcaatttcgtggactttatga

SEQ ID NO: 3759 - DNA, 318 bp, Glycine max var. Williams 82
atggttacagtccaaattaagcaattcaagtccaagaattctctaagcatcaaaaaagaattaagcataatgggtttcagtttgcgtggtcttcaaaggcgtgtggatgtcccaaagggccgtgtagcagtgtatgtaggagaaaatcaaaagaagcgctttgtgattcccatatcatacttgaaccaaccttcatttcttgagttgttgaatcaagctgagcaagaatttggatttgatcatccaatgggtggcctcacaattccttgcaatgagaatgtcttcctagatgtcacttctcgcttgcatagccgatag

SEQ ID NO: 3760 - DNA, 603 bp, Glycine max var. Williams 82; identical to SEQ ID NO: 1024

SEQ ID NO: 3761 - DNA, 1359 bp, Glycine max var. Williams 82; identical to SEQ ID NO: 976

SEQ ID NO: 3762 - DNA, 780 bp, Glycine max var. Williams 82
atggccaaacgcttcaaattgaagttcaatatcccttcatttcaaatgtgtcgctcaaaagacccttcctctttccctggaaatcccgttcctgccatataccgtctttctcccgttaaccacaacgcgcgtcacacgagacatccaagcattccttctccgtcaccgtcaaagataacgtccatcgcgcagggatgcaaaatgtgccatgacaagcagagtttgaagaaactgaaatccatcagaggccggaaaagcacgtccagcgttccgtcgaggcgaagcgattttcgaatcgacaacatcgaggaagaggagagcgagactctgatttcttgcatgacaagtttctccgacgagttttgtctcggcgaggagaaggagctaagtactggtagtagcagccagagaaggaagatgagcagcgtaaagaaggttcggagtgtgaggtttcagagttcggagaaacggagaggagcggaggtgaagaagacgacggtgacacggaaaagtgtggaggggaaggtgagggagagttttgcggtagtgaagaagtcaaaggatccttatgaagacttcaagaaatcgatgatggagatgataacggagatggagatgtctgaggccgaagatttggagcagcttttgcagtgtttcttggctttgaactctcggagtcatcatgcagttattgtgcgggctttcatggagatttggcaacaaatgttcttttggaaccctacgtcaatgaaaaatctccaaacagatctggaaaagtaa

SEQ ID NO: 3763 - DNA, 891 bp, Glycine max var. Williams 82
atggcagcctcttcattgaaccacaaattccataaccatgctcgttctaatagcttgccctctaagccacaccctctcatcctacaatgcaatgaacgcttatctagactaggggcctatgataccatctcttcttcattgctaaggcaaaatcttactaaccttctagatttgcatgggtgcattgaaaagttggttcaactacccttaactcaacaagcacttgttcaggaatgccaagagaaatgggtggatgatctcttggatggatctctaaggctccttgatgcatgtacggcaaccaaagatgccttacttcacaccaaggagtgcacccgtgagcttcaatcaactataagaagaagaagaggaggtgaagtggaactcacactagaggttaagaaattcttgacctcaaggaaggtggtgcgaaaggccatattcaaagccctggagaatctgaagggtaatgcaaataaaggaaaccttgccatcactaattacaaagactaccaaaccatggcattggtaaacttgttaaaagaagctgaagtgatcactttttccacgtttgagtcattgctgaatttcttttctgggtcaacacaagcaaaacgaattagcagctgggctttggtttcaaagctgatgcacaacaaaagggtaggctacgcacaaggagcagatgagaatgagtttgcaaaagtggatgctgcatttcagttatttgcctttaacatgtcaaccaagtcaaatgatgatatcagtgatttgctaaagaagctagagaacttggggacttgcataccagatcttgaagaaggacttgagtccctgtttaggcgtttgattaaaatcagagttgcacttctcaatatccttaatcactag

SEQ ID NO: 3764 - DNA, 1227 bp, Glycine max var. Williams 82
atgacaagcactcttctgtctttgctcttcttgctcttctctcttctcactccaactctaatttcctcttcaccagttctaaaccctcaagaggtcgtacaagaggtcaacaagaaaatcaatggctctatagcaagacccagaaggaacttgggctacctctcatgtggtagtggcaaccccatcgatgattgttggaggtgtgaccccaactgggagcagaacaggcagaggctagcagactgcgcaatcgggttcggcaagaacgccattggcggcagagacggcaagatctatgtggtggaggacgacggcgacgacgacgcggtgaacccgaagccgggaaccctccggcacgccgtgatccaagacgagcccttatggataatcttcgccagagacatggtgatccaacttaaagaagagcttctcatgaactccttcaagaccatcgacggaagaggtgccagcgtgcacgttgctgggggtccatgcataacgatacagtacgtgaccaacgtcatcatccatgggattcacatacacgattgcaagcagggagggaacgctatggtgcgggactccccacggcactacggctggagaaccgtatcggacggtgacggcgtgtccatcttcggagggagccacgtgtgggttgaccattgctcgctgtctaactgcaacgacgggttgatcgacgccatccatggctccaccgctattaccatttctaataactacatgacccatcatgataaggtcatgttgttgggtcacagcgattcttacacccaggacaaggacatgcaagtcactattgctttcaaccactttggtgaaggccttgttcaaaggatgccaaggtgtaggcttgggtatttccatgtggtgaacaatgattatactcactgggaaatgtatgccattggtggaagtgccaatccaaccatcaactgccaaggcaacagatttgttgcacccgatgacagattcagcaaagaggtgacaaaacgtgaagataccccagagagtgagtggcaggattggaattggaggtcagaaggggacttgttagtaaacggtgcctttttcacagcatcgggtgctggagcctcctctagctatgcaagggcttctagcttaagtgcaagaccatcttcccttgttggttccataacaacaggtgctggtgcactcagttgtaagaaaggttctccttgctga

SEQ ID NO: 3765 - DNA, 708 bp, Glycine max var. Williams 82; identical to SEQ ID NO: 960

SEQ ID NO: 3766 - DNA, 684 bp, Glycine max var. Williams 82
atgagaatggagagtgttggttggtgggggcatgggagtaagtacaatctaggagttgctgttaaggatccatctgctccccatggagttcgacttttgattgaggactatccttatgcttctgatgggctagagatatgggatgctatcaagtcttgggtggaagaatatgtctcattctactacaagtcagatgaggaacttcaaaaagaccccgagctccaagcttggtggaaagaacttatagaggtgggtcatggggatttgaaggataagccatggtggcaaaagatgcaaactcgtgaagagttggttgaagcttccgctaccctcatatggattgcttcagctcttcatgttgctgttaactttggacagtatccatatggaggtttaatcctgaataggccaactattagcaggagattcatgcctgagaaagggtctcctgaatatgatgcgttggctaagaaccctgagaaggagtttttgaagactattactggcaagaaagagaccctcattgaccttacaattatagaaattttatcaaggcacgcatctgatgagttctaccttgggcagagagatggtggtgactactggacttctaatgtcgggccattaaaggcctttaagaggtttggaaagaatcttgaagagattgaaaagaaacttatatag

SEQ ID NO: 3767 - DNA, 1056 bp, Glycine max var. Williams 82
atgaaggaactgggcgtggttgcaatcctgttgtcaatagagttctttgacgtgattgtctacactgtaagcaaagcagccatgaagaagggcatgaatgactttgtgtttgtcatgtactccaatgccttcgcaacttgcctccttcttcccataacttttatcttttataggaaaagagctcttcctccactcacatatttcatagttggccaattatttattaatggcttcttaagttgcagtgttcagatgctcaggttttttggaataggttacggctctcccactttggccactgcaatgtctgatttaatccctgcttttaccttcatacttgccatcgtcttcaggatggaaattttggattggaaaactaacagtactcgggccaagtccattggcacattggtatcaatcgctggagccttaataattactctgtacaaaggccaggcagtcataaacaatcatccatcaaataaattgttccccaaaaaacatgtttcatctgagcaatttgactgggtaataggggcagtgttgcttgcgggtcatagctttgttctctcattgttgttcatagttcagacatggataatcagaaattaccctgcagagcttgtgatagtgctcactcgcggtacattagttgctatgctatctatcccaccttcactgatttcagtaacggatccaaaagctttgagattaggatttgatgtgaatttgatagctattgcattgcaagcaatttttggtgtatcccttcgaagtattgttcatatatgggtcatgagcaagaagggccctctctatgttgcaatgtttaagccaattggaatcatctttgcggtcatcatgggaattgcctttcttggtgactctatctatcttggaagtgtgcttggagcagccatagtggttattggtttttatgctgttatttgggggaaaagccaagagcaagcaaaggaagagtgtgaagtttatgatgactcggaatcatactcacccgttgtccctcttttgaagaacaagagaatggaggaatag

SEQ ID NO: 3768 - DNA, 2358 bp, Glycine max var. Williams 82
atggaatatggtgggttggtgcagaatagtgcatatgggagcttctcagaaatttttggcccagaaacggatttcatagatgaactgtttgtggaaggatgctgggtggaaacaagggttggatcgtacctgaattgtgggggggaggctaattcctcaaagccaaacacgatggctagcatggagacgtcggcgcaaataatattccaagaagaatcattatcagacccggaaattagtttgatggtggggaagagatggtggattggaccaagggagaatccggggccatcttcctctgtgaaagagagattagttattgcagtcgggtacttgaaagaatacgccaagaattccaatttgctgattcaggtatgggtacccgaacggaggagatctgcacgtgctcagcctcaggataactacccatacgccgcgcttcttaatacaacatcagcttttcagtttcaggaggattgggttcatgaccagtggactcccaacatccgcttcttcagaagtcacgagtacccgcgccatctacgacgtcctggatctctcgcacttcctgtctttgagagtggctccgccatgtgtctcggtgttgtcgagattctcatgcccaacaaccccgaccttcacgcccttcagagtgttgattttacaagcagtacttgtcatcagaactttattccacctgcagccgtgaccgcgaagggttttgacgagttgtaccaaagtgcattaaatgagatagtagaagttttgacgtgtgtatgcaaggcgcataacttgcctttagctctcacatgggctccctgcatccaacaaggaaagagtggatgtgggcattcaaacgatgagaattatgtgtcgattgtggatcctgctagttttgtggcggatgtagaggtactgggtttcctggaagcgtgctctgagtgtcaccttttgggggggcaaggagtagttgggacagctttcacaaccaccaaaccttgttttgcaaatgacataactgccttcagcaaggcggaatatcctctggcgcaccatgctaacatgtttggcttgcatgctgcggtggccattccactcctgagtgactccgctgattttgtgttagagtttttcctgccaaaggattgccatgacacccaagagcagaagcagatgctcaactccttgtctatgctagtacaacaagcttgcaggagtttgcatgttgtcatgggaaaggaggaggaggaggaggaggaggaggaggaattaatcgcgttgccgcccgttggcaaagaaatggagtcatcatcatcatcatcctggattgcacatatgatggaggcccaacagaaggggaaaggtgtctcggtgtccttggaatacctccaagagccaaaacaagagttcagagtgacaaccaactgcaatgaacaggttagtgttggtgttgagagtgggggaggagaagaatcatatactgcagcttttggtggccgccggggtgccaggaaatcagctggcgacaagagacgaaccaaggcagagaagactatcagcttgccggttcttcgacaatactttgcaggaagcctgaaagacgctgccaagagcattggcgtatgtcctaccactcttaaaaggatatgccgacaacatgggatcacaaggtggccttcaaggaaaattaagaaggtaggccactccttaagaaaacttcaacttgtcatcgattccgtccagggtgccgaaggtgccattcaaattggctccttctataccagtttcccagagttgagctctgccaatggtgtttctgaatcatccaacatcaataataagtttttttctgaatataaccaaggagctactactttcaaatccccaacttcgccttgcagtcagaccactattctgatttcagagaaccaacaaccacttgtacttggtgcatcaatccaggtccaagaggaagcaaaacatttcgcccaccatcttgagcctctaccaccagctcccttgccccaatctagtactagtctctggaacacggccggcacttttagagtcaaagctacttttggggatgaaaaaatccgctttagcttgcaaccaaactggggattcagagatttgcagatggagattgctagacgtttcaatctaaacgagattagcaacattcagctcaagtatttggatgatgctcgagagtgggttcttttaacatgcgatgctgatcttgacgagtgtaaagacataaatacatcatctcagagccgtacaattagactcttcctctttcaagcttcgcctctaaatcatgcaaatgcatttcgaggcaccagcccctcctag

SEQ ID NO: 3769 - DNA, 1257 bp, Glycine max var. Williams 82
atgaatttctggaagctttacattgcttcatttatgtcaattctgaaacttttgttgattactgctcttggggcattccttgcacatgatcgatttaatatactcagagagaatgccaggaagcacctcaatgctatggtatattttgtcttcaccccggctctaatttacagcagcatgtcgaataccttaacctttaggagcatggttatgctgtggttcatgccgttaagtattcttttaacatatattgctgggacagttcttggatggatacttattaaaactattagagttcctcatcatctacatggccttgtgttggggtgttgtgctgcaggaaatctggccagtttgcctcttattgtagttccaactatctgtaaagacaaaaacagtccttttggagatgaggttgtttgccacaaaaatggactggcatatgcttctctatcaatggctataggctacacttatgcttggtctattacattcaacgttgtccgcatatattcacccaagatctccaatgaagtcaaagttgatgaaaccactgaaaattcaaagtctgcaacagaaaatgatccagaaaaccttttaaaatgcccttgtggagcattagtcatggctgaggatatagcaaagcctaatggtggcatggatcaacctgattttgaatgtaaagtgcctaatggacaggcaaaggtaccagaaaggctaaacattatgaaaatattagctcacaagatcaacaacatgaagacactaattgctccttcaactatggcagcgattatgggtttgacaattggtgttgtccctcaatttcgaaaactactggttgctgacaatgctctcttccatgtggttcaagacactataaccatgctgggggatgcaagcgttccagcaatggtcttactgcttggggcaaatcttgttaagggtttaaaaggattaggacaacaacttccacttattgttggcattattatggttaaatttcttgccttgccagcaataggtataggcattgttaaaggtgcagctcatttcaacttgatccaccatgatccattgtatcagtttgttttactgcttcaatatgccctcccacctgcaatagtcgtgagtacaattactcaaatgtttggatttggtgagggtgaatgctcagctatcatgttagcaacatattcatgttctgcaattttgcttacactctggtgcacaatgtttatgtggcttgtactataa

SEQ ID NO: 3770 - DNA, 618 bp, Glycine max var. Williams 82
atggccaccacaatatcttgtgatttctcttcaatggaatctattcaacactatcttcttgagcctgaacacgattccaacgctctcatgaacatttccaaccacgaagtttgctattctgcaacgtacaatgcattcccaagccctacgttcagcttggagggtgtcgtccatgatgcaaacgattccttagcatgcaaaagagaacaccctagggaggagcgtgaagttcacgcgccaccggtatggaagcattaccggggtgtgaggcgtaggacttggggcaagttcgcggcagagataagggatccaaagaagaatggtgcaaggatttggctaggcacttatgaaactgaagaagcagcgggtttagcttatgatagagctgctttcaaaatgcgtggcagcaaagctaagttaaattttcctcatctcattggctctcacgcgcctccgcagccagtgagagtgacaaaggctttgaagcgaaactcgccagagaagaggaaaaatttggctgacttgttaaacaggttggccaagaatagaagccaaatacttatacaggtgcttgaaatgggtttacatgcaaattatgtcaatgttgaacaatggtag

SEQ ID NO: 3771 - DNA, 1860 bp, Glycine max var. Williams 82
atggcgacattgactgcttcaagtaacttagtctctagaaattctcatgtccaccatggaccaacaactgcttcatatgagtctaaagcagtagcaatgggacttagatctctgaagcagacaaatactcataatggactaagaattttgaacccggtggatgagctacttaacagaaccccaattaaaaccaatgcagtgcaagctatgaggaagggacctcaaggcaagaatgccaggcctaaaggcatgatcacatgtggcatgactttcataattataggaaccgaggtggctccatggtgcaaaactggtgggttgggagatgttcttggaggtctaccaccggcattggcaggttttgggcatcgagtaatgactattgtgccgcgctatgaccagtacaaagatgcatgggatacaagtgttgtaattgaggtgaaagtaggagatagaacagaaaaggttcgcttcttccattgttataagaggggagttgatcgtgtctttgtggatcacccttggtttcttgaaaaggtatgggggaaaactggacaaaaactttatggaccaactactggaaatgattacgaagacaaccaactgcgttttagcctcttttgccaggctgctttggaagccccaagggttctgagtcttaattccagtaaatatttctctggaccatatggtgaagatgtcatttttgttgccaatgattggcacactgcccttatcccctgctacttgaaaagtatgtaccagtcaaggggcatctatacgaatgcccgggttgttttttgtatccacaacattgcttaccaaggaagatttgcattcgccgacttctcacttctaaatctcccagaccaatttaagagctcctttgactttattgatgggcatgttaaaccagtggttggaaggaaaatcaattggttgaaagctggacttatagaatcatggtttgtgataaccgttagtccaaactatgctaaagaactggtgtcaggtccagacaaaggagtggaattggacaacatcattcgcaaaattgatgatgatggtcgtttggttggaattgtgaatggcatggatgttcaggagtggaatccaaccactgacaaatatatagctgtcaaatatgatgtttcaacagtattggaagcaaaggctcttctgaaagaagccctccaagcagaagttggattgccagtcgacagaaatattcctctcattggtttcattggtaggcttgaagagcaaaaaggttctgatattcttgcagaagccattccccaatttatcaagcagaatgttcagttggtagccctaggaacaggaaaaaaacaaatggaaaagcagcttgaggaacttgaaatatcataccctgataaggccagaggagtggcaaaattcaatgttcccctagcccacatgataatagctggagctgattttatattggttcctagcagatttgagccttgtggtctcattcagttacaagctatgcgctatggatctgtaccaattgttgcctcaacaggtggattagttgacactgtcaaagaaggcttcactggatttcagatgggtgccttcaatgttgaatgtgatgctgtggatccggctgatgtggatgctatatcaaagactgtcaaaagggcccttgcagtctatggaactccagcttttacagaaattatcaagaactgcatggctcaagatctttcatggaaggggcctgctaaggagtgggaggaagtgctgctaagcttgggagttcctggcagtgaacctggaagtgatggagaagaaattgctccacaggcaaaggaaaatgtggcaacaccataa

SEQ ID NO: 3772 - DNA, 408 bp, Glycine max var. Williams 82
atgccatccatgtctaatgacacaaacaacatgaagaagacgattatgcacagcagtctctactggggcaaagatgccatagtgcttttccctaggtggcctgagaacagtgttggcatgtacatcttagccctaatttttgtgttcttcctagctatggctattgaagtgttatctaaccagccactcctcaaacctgggactagtccccttgtgggagggcttattcaaactagtgtgcacttatttcgtatcagcttcgtttacatggttatgcttgctgtcatgtccttcaacgccggaatcttcatagctgctgttgtagggcactccttgggattcttcgtcgccaagtttcgcgctcttgccgtcgccaatagggaagacaaagggtcttcctccatctga

SEQ ID NO: 3773 - DNA, 1131 bp, Glycine max var. Williams 82
atggtgtgtcaatctctgaatcctgaggtcccaaatgggaatcaaaatgaggtgctgatgaaaactgttgaaatggtaattcagaaaattgaagaggaactggacaaactgagggaaacaaaacaggatccatcattgaccccatctgtattccagcaaggtgcatttctttctgatatattaggacttcttgagtcggcggcagcgtctcatcaacaaaatgaaggcaataatcagcaaaatgagattcgcaagtatgttaggatcaaacctaacagattaggaaaacaaaattttatgggggaaaatgcaagcttcaccagcataggacacacgtgctttgccatgaaggaagagctagaagaatacatggattatgatgttggtgagatctgcaacgatgactggaaactggctcaaaagcttatggttcatggctgtgatcctttacctaggagaaggtgcttttcaagatcccctaagctatacaaacaaccatttcccgtcaatgaatccttgtggaaactccctgatgatagaaatgtcagatggagtcaataccagtgcaagaactttgcttgtcttgctggcaatgccactcgtaagggattcttcaagggtgttgattgcttcaacctcaccaatcatgagatgccaagatggattttccttataggattggacttaagtgttggaactgggatttttgctgctaggatgagggaattcaatgtgactatagtttcagccaatatcaattttggagcacccttcaatgaaatgattgctctaagaggacttgttcctctctacttgactataaaccaaaggcttccattttttgacaacaccctagatttgattcacacaacaaggtttcttgatgggtggattgatcttgtgctccttgagtttatattgtatgattgggatagagttctgaggccagggggattgctttggattgacagctttttctgcttgaaggtagatttgtatgattacttgcaggccttcaaaatgctgaggtataagaagcacaaatgggtggttgttccaaagcttgataaggatgagcaggaaatgttcttctctgctgttttagagaagcctcataggccattcaggtga

SEQ ID NO: 3774 - DNA, 1065 bp, Glycine max var. Williams 82; identical to SEQ ID NO: 1428

SEQ ID NO: 3775 - DNA, 738 bp, Glycine max var. Williams 82; identical to SEQ ID NO: 1432

SEQ ID NO: 3776 - DNA, 1068 bp, Glycine max var. Williams 82
atggcaccaaccttaatcccctcagatctcactgaatttgtgatgcttcaagggaatggagtaaagggcctctctgaaatgggcctaaagagcctcccaagtcaatatgtccaacctttggaagagagggtgatcaatgttgtacctcaagagtccattcccatcattgacatgtccaattgggatgacccaaaagtacaagatgcaatttgtgatgcagctgagaagtggggcttcttccaaatcatcaaccatggggtgccccttgaagtattggacagtgtcaaggatgcaacttataggttttatgggctgccacctaaggaaaaagttaagtacacaaaagagaattcttcaacaaagcatgtgaggtatgggtctagctttagccctgaagcagagaaggccctagagtggaaggattatctaagcctcttttatgtttctgaggatgaggctgcagcaacatggccccctgcatgcaggaatgaagcgctggaatacatgaagagatctgaaatcttgatcaaacaacttttaaatgtgttaatgaagaggctaaatgtgagtgaaattgatgagacaaatgaatcattatttatgggttcaaagaggatcaacctcaactattatcctgtttgcccaaatcatgatctaacggtagcaatagggcgacactctgatgtctcaacactaactgttctccttcaagatgaaactggtggcctctacgtccgagcaccgaaccaccacggctggattcatgtaccaccggtctccggtgctatagtgatcaatataggtgatgcactccaagtaatgagcaatgggagatacaagagtattgagcatcgtgtgtcagccaatggaagcaagactagggtttcagtgcctatttttgtgaaccctagaccctcagatgttattggccctttgcctcaagtgcttgctagtggagagaaggccctgtataaaaatgtgttgtattcggattatgtgaagcatttcttcaggaaagctcatgatggaaagttgacagttgaatatgccaagatatgccaagtttaa

SEQ ID NO: 3777 - DNA, 2259 bp, Glycine max var. Williams 82
atgtttgaatctagttacaagtcacagtatattggaggccagaaggagaagttcgtaaggttggatgatctggattcgaattgttctatgccatcaagctcaagggggatgaaaaaattaagattcaatttagattctctgcctattcctcttcctggtcgtggaagaaaaagagcatcgaaatcatttaggctaggaatgaagaagagttcagatggactaaagacatttggaagatcactaaagactggagtgactacttgggcagtgttcccagaagatcttaaagtgtctgagaaaaaagtatttgatcctcaagataagaaccttctttattggaacaagttttttgagattctgtgcattgtttctatagcatgcgatcccttcttcttttaccttccttatttcaaccacaaatcattttgcctcgccatagataacagcctagcaagttttgctgtcacaatgagaacaatatgtgatttcatttatctcctccgcataagttttcaattccgcaccgcctacattgcgccttcatctcgggtatttggacgaggtgaacttgttatagatcctagaaagattgccaagagatatttaaaacgttacttcatcattgacttcatttctgtgttgcctatgccacagattgtagtgtggaaatatctttacagatcaggacgtgtagaggtattggaaacaaaaacatcaatgttgagaattgtgatcctgcaatattttccaagatttctacgctttttacctttagcttcagaagttaaaaagacagcaggtgttttctctgagaacgcattgctcggtgccatgtactatttgatctggtatatgcttgctagtcatataactgggtctgtctggtacttactagccattgaacgtaatggcacctgctggaaggatgcttgtaaagaagttgaaggatgcaatacacatttcttgtactgtgggaattcgaacaagcataggtcagggtatgatacttggagaaatatcagcgagactgttctgagaagtcgttgctttgttgaaggtgatgcctcagaatttaactatggaatcttctctcaagctatacagtctgatattgttgcctccgtagaagtttttcctaaattctgttactgtttgtggtggggccttcaaaacttgagtacacttggtcaggggcttctaaccagtacctaccctggagaggttatgttttccattgtaatagctattatgggacttatcctttttgctcttctgattggaaacatgcagacctaccttcaatcaatgtcagttcgtcttgaggaaatgaggatccaaagacgtgactctgagcagtggatgcatcatcgcttgcttcctccagagctaagggaaagagtgagacgctatgagcaatacaagtggctgaacacccgaggtgtagatgaagagagcttagttcagagtcttccaaaagatctccggagagatatcaaaaggcatctttgtttgaatttagtcagaagggttcctctctttgccaacatggatgaacgtttgcttgatgctatatgtgagcgattgaagcctagtttatatacagagggcacttacatagtgagggaaggagacccagttaatgagatgcatttcatcatacgtgggcgtttagagagtgttactacagatggtggaagaagtggatttttcaacagaggtcttctgaaggaagctgacttttgtggagaagagctactaacatgggcattggaccccaaatctgctgctagcttgccaacatccacaaggacagtgaaagctataaatgaggtggaagcatttgctttggaagcagaggagttgaagtttgttgcttcccagtttaggcacattcgcagcagacaggttcagcacaccttccgtttctattcgcagcagtggagaacgtgggctgctatctacattcaagctgcgtggaggaggcattgcaggagaaagattgcagaacatcgcaggagggaggaagaagaattctgtgactctgattatgaaaacagtgatgattcagcaaaggccttggtcaggcatagagatacttctttttcctcttctaagcctggacttggaacaaccatctacgcttctcgctttgctgctaatgctcttcgtggtcataggctttgtgattcaagttcgagggagatgatcaaacttcaaaagcccccggaacctgactttggtgatattgatgataactga

SEQ ID NO: 3778 - DNA, 402 bp, Glycine max var. Williams 82
atgagaaggaaaatccataaccccactgtgttccgctcttccattgttttgctacaagagagatttagacagttgcatagagtgaaagaaatgaggaagaagaaagaactgctgaaaatgctcactactagtgaacctaaacctttcaattctaaccccactatgaggcagtttttccaccctgagttgatcatcccatctaggtcatctcctcctcatgtttctctttctctagggcctacttcacagcccatgcaagagtacaccaaaagcactattgatgccccagtcgcaaacaacatgctctccatagattctacacacaaccaggtttcatgcaagaacatctatgattgggattcgggcactgactctattgttgatacttcccttcacctgtaa

SEQ ID NO: 3779 - DNA, 1653 bp, Glycine max var. Williams 82
atgggcagggtttggacttcgatgatagcattgttgctttgcctgatgacatcatcggttcggggcgaggacccttacatttactacacatggaacgtgacctacggcaccattgccccattgggtgtcccccaacagggtatcctcatcaatggtcagtttcccggccccgaaatcaactccaccagcaacaacaacgtggtcatcaatgtcttcaacaacctcgatgagcctctcttgttcacatggcatggtgtccaacagaggaagaactcttggcaagatggcacattgggtgcccagtgccctatcgccccaggcaccaactacacctaccgctttcaggttaaggatcaaattggaacttacttctactacccgaccaccggcttgcaacgcgcagtgggtggcttcgggggtttaaggatcttcagccgtctgttgatcccagtgccctatgctgatcccgccgatgagtactgggtgctcatcggtgactggttcggcaagagccacactgccttgaaacaaacattggacagcggacgcagcattggcaggcccagtggggtccacatcaacggcaagaacggcgggctcgaggccctctacaccatggagcccggaaagacctataagtacagaatctgcaacgttgggctcaaggaagccctcaacttcaggatccagggccaccccatgaagctcgttgagaccgaaggctcccacgttgttcaaaacacctatgactccctcgacgtccacgtcggacagtgcttcaccgtcctcgttaccgccgaccaggagcccagggactacttcatggtcgcctccacgcgcttcacgaagaaggttataactgccacgcgcgtgattcgttactcgaatggcgtcgggcccgcatcccctcttcttccccctgcaccccaccaaggctgggcctggtctcttaaccagttccgctccttccgttggaaccttaccgccagcgctgcaaggcccaaccctcagggctcataccactacggtcagattaacatcacccgcaccatcaagttggtcggcacccgaagcaagatcggcggcaagctccgttacgcactcaacggtgtctcccacgtcgaccccgaaacccctctcaagctcgccgagtactacggtgtcgccgacaaggtcttcaagtacaacctcatctctgacgccccagacgccgccatcgcctcccgcgaccccatcatcgcccccaacgtcatcaacgccaccttccgcaacttcatcgaagtcatcctcgagaaccccaccaaggtcacccagtcctacaaccttgatggctactctttctttgccgtcgcggttgagccggggcagtggagcccagagaagaggaagtgctacaaccttcttgatgctgtcagcaggcacaccatccaggtgttcccaaagtcttgggccgcaatcatgttgacttttgacaacgctggaatgtggaacttgaggtcggagatggcagagaatcgttacctgggacagcaattgtacgtgagtgtcttgtctcccaacaggtcccttagggatgagtacaacctcccagagacccagcttgtctgcggaatcgtcaaggatatgcctaagccaccaccttactccagttaa

SEQ ID NO: 3780 - DNA, 1572 bp, Glycine max var. Williams 82
atgtgtcgtttaagtctgtgttggtattctattttttgtaaacaaaactttgttggttttattttcggcggcttccatctgtttgttgatggttacattgcatttgcatggttttggatttatcacatttttcatttagaattggcagttctatccaattttatggcaaggattcctgacaagattaagtctattgatgggtcaagagagacgcttaagcttgctgtgagaatcaccgacctttggttcgttgggactcccaacaagtttgagcaagcggaaatggttattgttgattctgagggtgatcaaattcatgttgtttgtaaagcggaccacctaaagtcttggaaagctgatttgaaggagaattccacttatgttatgcataatttcaaagtggtcaagaatgatggtcaatttagagtgtgtgaacatgagtacaagttagcttttattggagtgactattgttagagaagttgatttgcatgaactaccttttaaggaatttagatttgttgaatttggaaatgtcgttgctgggaattttgtggttggcctgttggttgatattattggggtcgttgatcaggtgctttttcagcatgtttcatcaaaaaataccagggttgtttttagaatgaaggatttaagtggtgaagttttatcttgcacactttgggaaaattattgtatgcagttcttagcctatttgaatgaacgtggaaatgatgggccgatcgttattattttgacacatgccagaataaaagatgcgcagggaagttatctagcttcagtgagtaattcgttcaaggcctcaaaattattaattaatgaacctatattggaaatccaggaatttagagagaggcttttagatttaggtgttaaggtcagcccagttttgccacctggcgatcaaggaagttcacaactttcaaggggaagccaactatcatcaaaggatgcatttctttcgaaagttgaagccaaaactatttacgagatcaatggcatttctgaggatgttgtttgtgttacagtgggcactattagcaaaatagtcatgaataatcattcatggtgttatccagcttgcgttcaatgtcatagaaaaactgacatccaaacaggaccattcacatgcggatgtggcaaaaataatgaccagcctgttctaaggtatagagttgaagtaatggttagccaaaacaatgacagtagcaagtttttgctctgggaccgtgaatgtgctgaattgattggtcaaacagctgatgaagtgaatagggtcaagattgaagatggtgatgttgatttaaatgcttctcctcaagcagttgataggctgttgggttatgtgcttgcttttaaggttaggattcaatcaaaattcaggaatgtcgttgttcttagatgctcaaatgaattagatttgatcaatgttgtgctcgacatgctggctgatactgaggcatgttcgaaaatagatgcttcgaacgttgattgcaataatgctacgcatcctgaatgtcggaccattatccaattgcaggattccctttaa

SEQ ID NO: 3781 - DNA, 1353 bp, Glycine max var. Williams 82
atgccaaactcaatggaaaacaaacatgtagctgtctttgctttccccttcggcacccactttatgcctctcttaaaccttgtcctcaaactagctcaagccgctccaaactgttcattctcattcatttgcacacagaaatcaaatgcaacacatttcaacagaccccacatccccaacaacatcaaggcctatagcataagtgatggaatcccaatgagtcacgcacaactagccaatcacccaattgaaaaagtaaacctttttctcaaaactggtcctcagaacttgcaaaaaggtatactattggcggaggcagatatagagaagagagtcacttgcatcattgctgatgcttttgtagcctcttctctccttgtggctcagagcctcaatgttccttggattgcattttggcctcccatgtcatgctcactctctctatacttttacattgacttaatacgcgatcttgctcgccgagctggaaatataaccttggatttccttcctgggttgtctaactttcgtgtcgaagacatgccgcaggatctgctcattgttggagaaagagagacagtgttttcaaggacactggcttccttggctaaggtgctgcctcaagctaaggctgtagttatgaatttctttgaggaattggacccacctttgtttgttcaagacatgagatccaaattgcagtctttgctttatgttgttccacttccctcctctttgttgccaccatctgacatagattctagtggatgcctttcatggttggacaccaagagttctaaatcggtggcttatgtttgctttgggactgtggtggcaccgcctccacatgagcttgtgactgtggcggaggcattggaagaaagtgggtttccatttctgtggtctctcatggaaggtctgatggatcttttgccaaatgggtttcttgagaggaccaaggtgcgagggaaagttgtgtcttgggctccacaatcccaagttttagcacatgattcgtcaggagtttttgtttctaactgtggagctaactcagtgactgagagtgtttgtggtggggttcctatgatctgcaggccattctttggcgatcaaggggtggctggaagattggtagaagatgtttgggagattggggtggtaatggaaggaaaggtgttcacaaaaaatggattgcttaaaagcttgaatctgattctggcgcaggaagagggaaagaggattagagacaatgctcttaaggtgaagcagactgtgcaagatgcaactaggcctgaaggacaagcagcacgggatttgaagactttgattgaaataatttctactacatcttaa

SEQ ID NO: 3782 - DNA, 1017 bp, Glycine max var. Williams 82
atgttggactatgaatgggggaacccgtccacgataatgctcaccggaaatgaagacagctccgccgcgggctccgaccaaacccaccgtcaaatcttcgaccactacgcgtcccacacgctcatccccgaccacttcctacacgcgccaatgcactccaccgccaccactgccgcggcaaccaccgtggatttcacccaccaccacttcaacccgcaaccccaccaccataaccacatgaaccaccaccaccatcaccacgccttcttcgacccacgcgccttccacggcgcgtcgaacacgtcctaccccccacccccttccatgctttcccttgacccactgcctcacgtcaacgctgttgggtctgggcctggacacgggcccgggccaggacccgggccaggcggacttctccttgtccccaagtctgaagaagtcggtcggcccatggactttgtcggctcacgaattggactcaatctcggaggacgaacttacttctcgtcctctgaggatgatttcgtgagccgactctaccgtcggtctaggcccgtggaaccgggttcgactatctcgtcgaactcgccgcgatgccaggccgagggttgcaatgctgatctgtcgcaagccaagcactatcaccgccgccacaaggtgtgcgagtttcactccaaagccgccaccgtcatcgccgccggcttgactcagcgattctgccagcaatgcagcaggttccatcttctttctgagtttgataacggaaaacgtagctgcaggaagagattggcagatcataatcgccgcagaagaaaaactcaacaaccaactcaagaaattcagaaatctcagccttctttggataatgttgcaagatctccaccggactccggagctcagtcttcatcgtcagtaacggtggcagtgtcgccaccggattatttccggcagaggccataccaaagcacaaacaacccttcatcgatttcaagctcactgtttttctcaagcgggtag

SEQ ID NO: 3783 - DNA, 1059 bp, Glycine max var. Williams 82
atgggagaggttgacccagctttcattcaagaaccacaacacaggccaaatctctccaccattcaagcagaaggaattcccataattgatctctctccaataaccaaccacacagtttcagacccttctgcaattgaaagcttggtgaaggagataggacgtgcatgccaggagtggggcttcttccaagtaacaaaccatggagtgccactcactctaaggcaaaacattgagaaagcctcaaaactgttctttgctcagactctggaggagaagagaaaggttagcagaaatgagagctctccaatgggttattatgacacagaacacaccaagaacgtcagggactggaaagaagtctttgattttctagccaaagaccccactttcattcctctcacttctgatgaacatgatgatcgagtcaatcaatggactaatcaatcacctcaataccctccactcttcagggttgtaacacaagagtatattcaggagatggaaaagctgtcctttaagctgttggagctgatagctttgagcttaggccttgaagcaaagaggtttgaggaatttttcatcaaagatcaaactagctttattcgactcaaccactatcctccatgcccttaccctgaccttgctcttggcgtcggtcgacacaaggaccccggtgccttgaccattcttgcacaggacgaagttggaggacttgaagtgagacgtaaacgggatcaagagtggattagagtgaaaccaaccccaaatgcttatattatcaacattggtgatactgttcaggtttggagcaatgatgcatatgagagtgtggatcacagagtggtggtcaactctgagaaggaaaggctttccattccgttcttcttcttccctgcacacgacaccaaagtaaagcctttggaggagctgataaatgagcaaaacccttcaaaatataggccatacaattggggcaagtttcttgtccacagagggaacagcaatttcaagaagcaaaatgaggagaacattcaaattcatcattacaagatagcttaa

SEQ ID NO: 3784 - DNA, 3333 bp, Glycine max var. Williams 82; identical to SEQ ID NO: 1443

SEQ ID NO: 3785 - DNA, 609 bp, Glycine max var. Williams 82
atgggatttattgttatatatatatatatatcatggtgtgttgtttgtgcagacgatttattaaatatatgtgattttgtatattgtgggaaaggaacatgccaactttcttccgctgaattgctcggtttcacatgcgattgtgaatctggttggaagaagcctaacattggttctatcgaattaccgccatgcagttttcctaactgtactgttaatttcaattgtggtaatggatctccggcacccccttcttctccacctacacaagtgtctgacccttgcttgttgaatttctgtggggatggaaactgtgtgagtcatcatggctttgattttaggtgtcaatgcaatgaaggctcagaaaatctacttaacgatccaaagttgttttgctttaagaaatgcactttcggtggagattgcaatggttttgatcttgggttcagctccgaaactccgccacccccagcaacatctggaactgcctctcctggaactactgcaagttcaggtgaaaccctgagttgtacaggggagcttcatatgctagctatgacgatattagcattaatatttcaaatctatctggacttaaagggaacatga

SEQ ID NO: 3786 - DNA, 366 bp, Glycine max var. Williams 82
atggtggataacgttggaggcagttcctctaatgccgaaaatagtggcatcagggaacaggaccggttgttgccaatagccaatgttgggaggatcatgaagcagattctacctccgaacgcaaaaatctccaaggaatcgaaggaaacaatgcaagagtgcgtgtcggagttcataagctttgtaacgagcgaggcgtcagagaagtgcaggaaggaaaggaggaagactgtgaacggggatgacatatgctgggccttgggttcgcttggttttgacgactatgcagagccattgagaaggtatttgcaaagatatagagaactagaagtcgatagaggaaatagcccccccaaaagagaataa

SEQ ID NO: 3787 - DNA, 1176 bp, Glycine max var. Williams 82
atggaggagaagagagagaaagagggaaactcaaagtcatcatccaccatggcaaattctgtggcattttccgacgagattccgaacatgagcatgagcacaagcttccctttctcccctgctttctctagcatctttgacatgatgccacctccaccaccttcctcatctcacgatcctaaagctcccaacaactttgctggcttcatggacttgctcgctgtccctgctgattattatgccccttctttattcgactggccccaaaacaccaccgccacgtcagcaccaccacctctcaccgcccaaatcaaccaccctcttccgtctccggccagctccaatgtccccgacggctccgaggttctcaacactccggcatctcccaactattcgtctatttcgtcgtcgtcgaacgaagccgccgccgccgccgccgccaacaaagcaacgggaaatgataatgatgtcgatgatgaaacaacaatagatgcagctgcaggcagaggagaagaagatcaagaccaagacaagactaagaaacagctcaagccaaaaaagaagaaccaaaagaagcaaagagagccaagatttgcgttcatgacaaagagtgaagtggatcacctcgacgatggctacagatggcgcaagtacggtcaaaaagccgtcaaaaacagccctcatccaaggagctattatcgttgcaccaccgcgacatgcggcgtgaagaagcgcgtggagcgttcctcggaggatcctacggtggtggtgacaacctacgaggggcaacacacgcacccgtgccctgccacgtcacgggctagcctcgggttcatgcattccgaagcaagtggtgggttcggacccactagtggattaggttcggcacactttatgctgccacaacaacaacagtttcgggaccaagcacaagcagcaatgttgttgtacaactccaactcatcgtcattgtcattgccactgaatgttgttaactcagcttcttgtgttaataatagctaccccaatacgtcgtcgttgagtggcttccttcaaggccaagagaatcatcagcgaagtgtgttggctcctcacgctttcttgagggacaatgggcttcttcaggacattgtgccaacgcatatgaggaatgaggagagtgaagatcgtgtttag

SEQ ID NO: 3788 - DNA, 2289 bp, Glycine max var. Williams 82; identical to SEQ ID NO: 1400

SEQ ID NO: 3789 - DNA, 1281 bp, Glycine max var. Williams 82
atggcgttgggcatgagcaggttcaagagggagcaatgcaaccgcacaaaacatgattctagcttctcccattggaagattctgattggccctcgtgattgggaagaccattcgaaaggaaaggaagggtgttcaaggtacaggattcataacctcccacaacaatcgggtccaggagtctatgagcttggaatagctgctgcggcatcagtgtcagagcgtaaaatttacaagcttgtccctcaccgtcaccgcatagtggttgtttacctcggacaaactgaaaatgtgagagaacgactccggcgttatggcggaaatggggaccacttggaggattcttctctccacttgtttcagcaagtcttttcacaaggattctcaatcctttatagatgggctcctatgcaaaacaaggaagatgccctgcgaacagaaactgagctgctcagtacatttgattatgcatggaacacaagaagtaattgtgtccggaggcctgatgatattcttcaaaagctccatcaaattgcttcaggcactagaacactttcagatattgccagagctcttctgcctttcactcagaagcaagtgggcatccaaattaaatcaatcaagttagatgaagcagacaatggcagcagctataacaatctcctatctcgactattcagctttaacagatctcgtcctaggttagttcaagatatcactggtgccattcaggaacaagagaatggtaaaatttgtggagtggcgctgggtgatggttcaatttgtacaaggccaccagctgaaaaacgaatgaggtgtcctgaacacaaaggaatgagaacaaatgtgtccactgccaaagcaataataggggcacccatgtcagagagccatgatttagaagaccctcctcaaacagtggttgatgaaagtctcacaaacacagattatatatgtggaatcctcttaagtgatggctccacctgtacaagacaaccagttaaaggaaggaaaaggtgccatgagcacaaagggaggagaattcgtgcagcatctattcaaacaaaggacaatggatacaaataccaaaataatgtcagcaatgatgtggaagaccctccacaaacacttgttgatgagagtatcacaaacaccaatatatgtggaatcatattaaatgatggctccacttgtacaagacatccagttaaaggaagaaaaaggtgccatgagcacaaagggaggagaattcgtgcatcttttcatatagcaaataaaaaataa

SEQ ID NO: 3790 - DNA, 543 bp, Glycine max var. Williams 82
atgggcactccgctgaacctcacatccaacatcttcttcttcatcttcaccttgaccatcctctatgtggcctacaccttccccaggctccaaccaaaccaaaccaacctcgtattctacgtccacgaccacttcaccggcgaacactccaccgccgccacggttgccggaaaaagtggacccgcctccaacatcctgcacttcggcaccgtggcaatcgtagacgacccagtaacagtgggacccagcgatgactcagcgctcattggtagggcccagggcatgtacgtaaattcgcagcttgatggcaaaggcctgtacatggttttctccgtgatcttcaccgacggggaattcaaaggaagcagcttggaaattcagggatctgatatcttcacagtgaaagaacgggaatttggggttgtgtctggaacggggtatttcaggtttgtgaaggggtacgggattatggaaacggtgtttatggatattgctaatcttagggctacacttaaactcaatgtaacagtcaagcattattag

SEQ ID NO: 3791 - DNA, 210 bp, Glycine max var. Williams 82; identical to SEQ ID NO: 1406

SEQ ID NO: 3792 - DNA, 1515 bp, Glycine max var. Williams 82; identical to SEQ ID NO: 1471

SEQ ID NO: 3793 - DNA, 1308 bp, Glycine max var. Williams 82; identical to SEQ ID NO: 1505

SEQ ID NO: 3794 - DNA, 1713 bp, Glycine max var. Williams 82
atgaagctttctgtgttctggtttgcatgggctttttctcttctaatttccatggcttctgctgctacagtagaacacactttcattgttcaaaacaaggctgtcacacgcttgtgcaaagagcgagtgattgtcacagtgaatggactttaccctggaccaaggatagatgtccgagaaggggacgctgtggttgttcacgtaatcaacaagtcaccctacaatatcactattcattggcatggagtatttcagctctttagtgcatgggcagatggtcctgaatatataacccaatgcaatattcgtcctcaaaatagttatacctataaattcaatgttatacaacaagaaggtacattgtggtggcatgctcactcaggagttttacgtgccacggttcatggtgctttcatcattcaccctcgttcgggtctgtttccttttcccaaaccccacaaacaagtaccaataatattaggtgattggtatgacggtaatattgtggatatttatcagcaagtactccttctcggggatgtaaggccatctgctgcctacaccatcaatggtttgcctggtgatctctacaattgctctagaaatcagatgttcaagctaaaggtaaagccagggaagacctacttgctaagaatgatcaacgctgcattcaataacaaccttttcgtcaagatagccaaccacagcttcacagttgttgccatggacgcttcctacatcgaaccctatgtgaccgacatcatcaccatcgcccctggccaaactgctgacgtgctcttcaaagccgaccaacccataggctcatattacatggcagcctctccttacgttgtgggccagccagaagccctattcgacaccacgacaactcgcggcattgtcgcttacgaaggctacacgacatcattaaaagactcgaagcccattgtgccactacttccacccttcaacgccacaccaattgctcacaaattttttagcaacatcacgagcttggtgggggccccacattgggccccggtcccacttgaggtggaccagcacatgttcatcaccattaacattaacctagaaaggtgtcccaagaatggcacgtgtcaaggtgtatttggacagaaattctccgcaagcatgaacaatgaatcatttgtgcaccccgttggaaaagggtactctatgttggaagcatcgttttataatgtgagtggtgtgtatactactgatttccctgacaagcctccaatcatatttgatttcacaaaccctaaaattgctttggatacgaagtatttgtttacgccgccaaaatcgaacaaggtgaagaaactcaagttcaattcgaccgtggaggttgtgtttcaaaatacacaaattatgaatgcgcaaagccaccccatgcaccttcatgggtttagtttccatgttttggctcaagattttgggaatttcaattacaccaaagataaatacaagtttaatttggtgaatccaatatttcgcaacacgattgctgtgccagctggaggatgggctgttataagattcaaagctaacaatccagggatgtggtttgtgcattgccatgtggatgatcatcagttatggggactagacatggttttcgaggttgagaatggaccaactccttcaacttctctccctccaccacctgctgatctacctaaatgttag

SEQ ID NO: 3795 - DNA, 882 bp, Glycine max var. Williams 82
atgatctcacagttaatttatcataacatttgtttttggtgcattcaaaaaatggctgggattgtagtgatttttgactttgactcaacaatcattgagtgtgatagtgataattgggtgcttgatgagaccggtttaactgaaaagttctatcagcttcttcctagcacgcattggaaccctctaatggataagatgatgaatgaacttcattcacaagggaaaaccattcaagacattgtacaaattctgagtaggacaccaatgcatcctcgcattgtccctgctattgaggcagcttattctcttgggtgtgacctgaagattgtgagtgacgcaaatattttctttattgagacaattctgaagcatcatggagtgtggaactgtttctcagatgtcattgccaaccccatccatgttaatgaagggaggctcaatatttgtccataccatgattatcttaaatcttctcatggatgcaatctttgcccaccaaacatgtgcaagggattggtgatagaaaggatccaaaactccctcgctgcagcaggaaagaagaaactaatctatcttggagatggaaatggagatttttgcccaagtttgaggctcaaagatggtgactatgtgatgcctagaaaggactttccattgtgtgatttagtttctaaaaattctaataagataaaggcagaagtacatggttggagagatgggaaagagcttgaacatgttctgctccatgttatcaacaaagaaattggggaaggaaacaacattaataattctactcagaaagtctcagttgattgcaagatggggccaattgcaattgacactcgtcaacctttgcctaaagccctatcagttcctcaataa

SEQ ID NO: 3796 - DNA, 309 bp, Glycine max var. Williams 82
atggagagggtgacaaagatggtatcagagaggccagtggtgatcttcagcaagagctcgtgctgcatgagccacaccatcaagaccctcttctgtgactttggggtgaatccagcggttcatgagctcgatgagatcccaagaggcagagacattgagcaagctctttccaggctaggttgtagtccctctgtgcctgctgtcttcattgcaggtgacctcattggtggagccaatgaagtcatgagccttcaccttaatcgctccttgattccaatgcttaagaaagcaggtgctctttgggtttaa

SEQ ID NO: 3797 - DNA, 1425 bp, Glycine max var. Williams 82
atgagggtacaagtaattagattggtttgtgctctccttttggcaacactggtgagctcagaggcaactgagagaaaagccaaaattgttgacacttcctttgagtacaatgccttaaattgcagggctcatagtgcttcattgactgattttggtggtgttggagatggaaatacatcaaacacaaaggcctttcagtctgcaatcagttatctgagtcagtatgcttctaaagggggagctcagctgtatgttcctgctggaaaatggcttacagggagttttagtatgaccagtcatttcactttgtatctaaacaaagatgctgttctccttgcttctcaggatatgaatgagtggcctgtgatcaagccactcccatcatacggtagaggaagagacgcaccagcgggaagatacaccagcttcatatttggaacaaacctcactgatgttattgtcacaggggacaatggcaccatagatggtcaaggagcattttggtggcagcaattttacaacaaaaggttgaactatactcgaccctacctgattgaattaatgttctcagacaagattcaaatctccaatctaacgttcctgaattctccatcatggaatgttcatcctgtttatagcagcaatattattattaagggcctcaccatcatcgctcctgtcccatctccaaacacagatggcattaatccagattcttgcacaaataccagaattgaagactgctacatagtttctggggatgactgtgtggcagtgaaaagtgggtgggatgagtttggcataaagtttggatggcccacaaaacaactagtaatcagaaggctgacatgcatttctccacaaagtgcagccattgccttagggagtgaaatgtcaggtggaattcaagatgttagagctgaggacattacagccatccacacagaatcaggtgtcagaatcaagacatcaatagggagaggagggtatgtgaaggacatatatgttagaagaatgaccatgcataccatgaaatgggcattttggatgactggtaactatggttcctatgctaataacagccactatgatcctaaagccttgcctgagatcaaaggcattaactatagagatgtggtggctgataatgtgaccatggctgctaccttggaaggaatctccaatagcccttttactggaatctgcattgctaatgtgacaattagcatggcagacaaagccaatgaaaagccatggacatgcactgatattgaagggatcacaagtggggtgactcctaagccatgcaattctttacttgataaggggccggagaaaatcaaaacatgtgattttcccccagagattctaccaattgatttgttagagcttaagaagtgtacttataacattaagcatgcatga

SEQ ID NO: 3798 - DNA, 282 bp, Glycine max var. Williams 82
atgaaggcatcacgcattgctttgttcactttggtggtgcttctttttgtggctgaagttcaagtgtcaaaggcagtgacctgcagcccagtgcagctgagtgcatgtgtgagtgcaataacctcttcaacccctccatcaaacctatgctgctccaagatcaaggaacagaaaccatgcctttgccaatatctcaagaaccccaatctcaagaagtttgttgactctcctaatgcaaggagagttgctaacacttgtggaactcccttcccaaggtgctaa

SEQ ID NO: 3799 - DNA, 555 bp, Glycine max var. Williams 82
atgaatcacaaggcacctaatttttttctggggatggatgtgaagagaatcatgggtggtgatagagatgggaacaccaattgggtgattaaggaagatggtgaagaagatagcaatgattcatcatccattggactcaactcaatggactctatgtgctcgtcttcttcatcagagctgagcgaggacgcttcatcttcaacatcatcaacacattcaaatggacctttgtttgaattatcagacctcatgagccacctccctatgaagagagggttatctatgttctatcaagggaaggcccagtctttcacttctttagcaagggtggagagcatagaagatcttcccaagaaaggcataccttatagaaagagaacgaaatcatgcaagagttttgggggaggcttggatagtcagagaatattgtgctgtccaaaggctacaatatcaaagaaaacttcaagagtgtcttttgcatctgtactaagcaaaagaggaagtttcctaggagggtctagatcttccattgcagttcaacacaagaacttctga

SEQ ID NO: 3800 - DNA, 309 bp, Glycine max var. Williams 82; identical to SEQ ID NO: 1518

SEQ ID NO: 3801 - DNA, 1344 bp, Glycine max var. Williams 82
atgaagaataataataaggagcaacaaggcaaaggtgcagcctcatatctgaaactcttcaatgctcaaatcgaccttctcaatttcttctctcatggtctagtttttggcattggtttactcattggtatcacactcactttctttctcaagaacttatccttcatcaactttcaaatccaacaattctccctctcatccaatagcctcatgaaaccaccaccttctttgtccccctctcctccatactccttcaacatttcattattaacatcaaataaccaaacaaaaaataaatttcagtacttcgagggattagtctctaactctcggttaagaaacgaccaaaccaaaccgtcttcttccaattcgtcctcgatcatcaaaaaaagggttatgaacttcaccagagtagggttgagggaattcttgaagccccccatggccatgcatgatatgagtgatgaagagttgttgtggagagcctccatggttcctatggttcataaactcccattcaaacaaacccctaagattgcatttatgtttttgacaaaaggtcctgtgctattggctcctctatggcagagattcttcaaaggaaatgaagggctgtattctatgtacgtccattcctatccttctttcaatgaaacagtgcctgaaagctctgtgtttcatggccgcaatatccccagccaggaggtaaggtggggtgagaatagcatgatagaggcagagagacgcctactagccaatgcacttgttgatttcaccaaccaacgttttgtacttctctcagagtcatgcattcctttgttcaatttctccaccatctacacttatctaatgaactcaaccaagacctttgtggaagcctatgatctgccaggtgaagtgggccatggcaggtacagtccccaaatgaggcctcaaattaggctctcccaatggagaaaagggtcccaatggttccaaatagaccgttctcttgcccttcaaatagtctctgatcaccaatatttctcagtgttcaagaagtattgcaaacctagttgctatagtgatgagcactacttgccaactttggttagtatcaaattttggaagagaaactctaataggaccttgacatgggttgattggtcaaggggtggacctcatccttcaaggtatttcagaacagatgttactattgagttttttaacaagttgaggtttggaaggtcgtgtgagtacaatggacgtaccaccaatatttgccatttgtttgcaaggaagttcacacctcatgctttggatagactgctgcgatttgctccaaagatcatgcaattcaattga

SEQ ID NO: 3802 - DNA, 1011 bp, Glycine max var. Williams 82
atgatgaacatgctttcggtgtcagcagcgctgtgcaagcccgtagcgagtttcaacccggcatcacattcactgaggaatatgaactcgctgtccctcttcatgaacaagaaggaaaaagtagtggtaatcatgggcgcaacggggacaggaaagtcaaaactggccatagagttggccacgcaattcccaccagcggagatagtcaactccgacaaaatgcaagtgtacgaaggcctaaacatcaccacaaacaaagtcaccgaagaagagcgtcgcggggtcccacaccatctcctaggcacggtgaatcccaacaccagtttcactgcacaagacttttgcgaccaggccactctcgccgttgggtccatattgggccgtgacggtttacccatcattgcgggtgggtccaactccttcctcgacgcgttggtcaaccatcacaccgagtttcggttacgctacgactgctgcttcctctgggtcgatgtctcactccccgtcctccattcctctctctccgcacgtgtggatcgcatgatccactctggccagctccacgaggttcgacagagttttcaataccacaaccaggattataccttagggatacgaaaggccattggcgtacccgagtttcatgattttttcagagccgaagccgacggagccgatcagaggaccaaacagcgcctcctccaggctgccattgcttccctcaaaaccaacaactgcaccctcgccaagcggcagctccagaagattcaccgcctttatagcatgtggaaacggaacatgcaccgcctcgacgccaccgaggttttcctcaagaccactcgccaggaggcagaggaggcctgggaggatcacgtcttgtccaagaccagaaggattctccataagttcctgtatgaggacacgcatgttgttcccgcaggtattgcgtctgttgttattgcttcttcgccgccgcccatgcctgccaccgccgccgccgcaactcactag

SEQ ID NO: 3803 - DNA, 1929 bp, Glycine max var. Williams 82
atggctgctactccaaaacccaccatcaaatcttgcactcccaagaaactccccaacgctctaatctcagtttccaaggtgagggtcattgtcagggtcagacccttcctcgcacacgaaacctctgcaagaaacggcgacgtttcgtgcatctccgtcctcgatcaagattccgagtctccgcaggacgagattgccgtttatctcaaagacccactaaccagccggaacgagtgctaccagttggactctttctttgggcatgaagataacaatgtgggtcagatattccaccgagaagtaagccccttgattccgggaatgttcagcggatgcaatgccacagtgtttgcttatggggctactggcagtgggaagacatacaccatgcagggaaccgaggaacaaccaggcttgatgccactggcaatgtccgcgatcctgtctatttgccagagcactggctgcacagcacagatttcatactacgaagtctacatggaccgatgctacgacctcttggaggtcaaagcaaaggagatttcagtttgggatgacaaagacgggcaaattcacctccggggactatctcaggtttctataaacacaatgtctgaatttcaagatgttttctcttgtggagttcagagacgcaaggttgcacatacaggcctcaatgatgtctctagtaggagccatggagtgcttgtgatatctgtgtccactccttctgctgatggcactggaactgttgtatgtggaaagttgaatctcatagacttggcaggtaatgaagacaacagaaggacatgtaatgaagggattcgtctccaagagagtgccaagataaaccagtccttgtttgcattgtcaaatgtgatatatgcattgaacaacaaaaaaccaagggtaccctaccgagaaagcaaattgacccgtatattgcaggactctctaggcggaacaagtcgtgcactgatggttgcttgcctgaatccaggagaataccaggaatctgttcatactgttagtttagctgctcgatcaaggcatgtttctaattttgtaccttctgctcataaacaagagaccccaaaagttaaagttgacatggaagcaaaattgagagcttggctagaatcaaaaggcaaaacaaagagttcacaaagacttggaccattaaattctccacttccgaaaaaaactcccagttccattgttacccctgctaagagatccattacctttaacagttcagtgaagaaggggggaagaactgctatcaacctagatgctcaacatactaatgaaagggcctttgctgtagcttttggaaatttactagatgttgaaggttcttttgattcatgcatggagaatgcgccatctggtgtcaaggaaaatgatgacaaagggactgagcatgatgccaataagcctgcatggaaatcatacaaaaatctacctgttgagtcattgagcaagggagtgaactcaattactattaagagtaaagatgcagcacaaagtcctttaagaaaagccctctcccccatcaacatcaatggtaatcagaaaccccttgaatcacaaacaccttttctggcaacctgctccactaataaagggccacaaaagaatgacactccacttggcaaattcagcacacgaagttctacactgaagaactgtctagttcaagaatacattgatttcttgaataatgcaagcagagaggaactacttgagttaaagggcataggagagaaaatggcagaatacataatagaccttagagaagaaagtcccctaaaatcgttaaatgacttggagaagattggcctctcttccaagcaggcccataacctgttcacaaaagctgcaaaaacactatttgaagataaagctgaagattcaatactcagttga

SEQ ID NO: 3804 - DNA, 465 bp, Glycine max var. Williams 82; identical to SEQ ID NO: 1476

SEQ ID NO: 3805 - DNA, 1986 bp, Glycine max var. Williams 82; identical to SEQ ID NO: 1414

SEQ ID NO: 3806 - DNA, 531 bp, Glycine max var. Williams 82
atggctctgaagttaggacatggcgtgatgatactagttattataagtgcttcaatgttttcagtgagcatggccaacaaggattggtcctttggtttcaactacactgattggtggtctagattcggaaatcatcctcagaacaaaacacagcaacaacccaagcaaattgtcgtgggtggttctgagcattggcactacggattcaactacaccgattgggcattcaagagtgccccattttacctcaatgatactctagttttcaaatatgatgctccaaatgccaccagtttcccacacagtgtgtacatgttcaaaagttttgggagcttcttgaagtgtgacattgaaaaggctaaaatgctagcaaatcccatgcaaggtacaggagagggcttcaagtttgtgttgaagaggtggaagcctcactactttgcctgtggtgagcgaaacggcttccattgcaacaacggcaccatgaagttcgctgtgatgccaatgattcgtcccttctggcagtggccttga

SEQ ID NO: 3807 - DNA, 2790 bp, Glycine max var. Williams 82
atggcatctgatcctgaatcgccaacctctccttccgttggtttcaacaccgaccagcttcctcacacccacaccagccgtgcctccgaagacgacgaggcttccgtcgatcccgatatcgtacgagacgaaatcgaagaacaacccgaggaagaagaagatggagaggatctttacaatgacaactttttggatgattataagagaatggatgaagctgaccagttcgaatcgtttgggctggacgactcgttggaagatgacagggattttgatcagatcatgcaggatcgaagggccgcggagattgaactcgaggcacgcgatggtcgcgcttccaatcgtaacaagcttccgcagcttctccacgaccaggatacagatgatgacaatcacaggtcttctaaaagggctcgagctgattttaggccttctgcagcaagtgatgatgaccttgatggtatgcaaagttcgcctggaaggtcacaacgagggcacccgagagaggatgttctcatgactgatcaaactgaggatgatcgagatgatgatgattttgatgatggatatgagatgtatcatgttcaaggaacacttagagagtgggttacaagagatgaagtgcgccgcttcatagccaggaaattcaaggactttttactcacgtatgttaatccaaaaaatgaacatagggacaaggaatacgtgtggctgataaatgagatggtgtcagctagtaagtgcagtttggagatagattataaacaatttatctatgttcatcccaacattgccatttggctagctgatgcccctcaatctgtcttagaagtaatggaagatgttaccaaaagcgttgtctttgaattacatccaaattacaggaatatacaccaaaaaatttatgttcgcataaccaacttgccagtttatgatcagattcgaaatataaggcagatccacttgaatacaatgatccgaattgggggagtagtaaccagacgttctggagttttcccccagttgcagcaggtgaagtatgactgtaacaaatgtggagcaattttggggcctttttttcagaattcctattcagaggtgaaagtgggatcctgtcctgagtgtcaatcaaaaggaccattcactgtgaatattgaacagacaatttataggaattttcagaagcttaccctccaagagagtccaggaatagtccctgcgggtcgacttccaagatacaaggaagtgatactattgaatgatctgattgattgtgctcgtcctggagaagaaattgaggtcacaggtgtttataccaataattttgacttatcccttaacacaaaaaatgggtttccagtgtttgccactgttgttgaggcaaattatgttacgaaaaagcaagacctattttctgcctacaaacttacacaggaagacatagaagagattgaaaatttggctaaagaccctcgaattggagaaaggattgttaagtctattgctccatcaatctatggtcacgatgacataaaaactgcaatagctttagctatatttggaggtcaagaaaaaaatgtggaaggaaagcatcgcctgaggggagacataaatgttcttcttctcggtgatccagggacagcgaagtctcagtttctcaagtatgttgaaaaaactggacagagagctgtatacactactggtaaaggggcttctgccgtgggtcttactgccgcggttcataaggatccagtcacaagggagtggactcttgaagggggggcgcttgttctagctgacagaggaatttgtcttattgatgagtttgacaagatgaatgaccaggatagggtgagcatccatgaagccatggagcagcagagtataagcatatcaaaagctggaattgttacatctcttcaggcacgctgttctgttattgctgcggcaaatcctgttggtggaagatatgattcctcaaaaacattctctcaaaatgttgaattgacagatccaattatttctcgttttgacatcctctgtgtagtgaaggatgttgttgatccggtcactgatgaaatgcttgcaacgtttgtcgttgacagtcacttcaagtcacaacccaagggtgctaatcaagatgataagtcctttagtgagtcccaagatgtccatgcatctgccatgccagctgatccagagatacttcctcaacagctactgaagaagtacattacatatgccaagttaaatatttttccaaggttacaagatgctgatatggataaactgtcacatgtctatgccgaactacggagggaatcttcacacggacaaggagtccctattgctgtaaggcacattgaatcaatgataaggatgtctgaagctcatgcgagaatgcatctcaggcaacatgttacacaagaggatgtggacatggcaattcgtgttcttcttgaatcattcatttcaactcaaaaatttggggtgcagaaggctcttcaaaagagctttagaaagtatatgactttcaagaaggactacaatgaactgctcctttatattcttcgcgagcttgtaaagaatgctttgcattttgaagaaattgtcaccggatctgcttctggtttaacgcacatagatgtcaaagtagatgatctctacaacaaggctcaagagcatgatatttatgatctgaaaccattcttcaatagcagccacttttcaagggccaattttgtattggatgaagaacggagagtgatcagacatcaccttaccagatga

SEQ ID NO: 3808 - DNA, 936 bp, Glycine max var. Williams 82
atgactatcctcattgagcaatctgatcactttggggctgaagtagaggcaaagactgaaccaataaatgagagggaactggtgttggatggtggatttctgataccacagaccaactcatttgggcacatgtttagggcttataatgatgctgtaagtgagaggcgtgaaggagtggagaacttctacagaaaaaatcacacttaccaatcagttgatttcgtgaagaaaatgagagaggagtatgcaaaattgaacagggtagagatgagcatatgggaatgttgtgaactccttaatgaagtggtggatgagagtgaccctgacttggatgaacctcaaattgagcacttgctccagacagctgaagctataaggagggactacccagatgaagattggttgcacttaactggccttatccatgtttggttgaatgcagatctcggcaaggtgctgaatttgcctagttttggaggacttcctcaatgggctgtagtaggggacacattcccagttggttgcagatttgatgaatccattgttcaccataagtattttaaggaaaatccagactacaacaatccagcatacaacactaaatatgggatttactcagagagatgtggacttaacaatgtgatgatgtcatggggacacgatgactacatgtatctagtggcaaaggagaatagtactacactgccctctgcggctttgttcattataagataccattcattctatgcattacatagggaaggagcctataagcacctgctgaacgatgaggatgttgagaatctgaaatggctccacattttcaacaaatatgacctttacagcaagagcaaagttcgaattgacgttgaaagggtcaaaccatactatctctccctcattgaaaagtacttccctgcaaagctgaagtggtga

SEQ ID NO: 3809 - DNA, 2574 bp, Glycine max var. Williams 82
atgcttgggggtcttctccataggggtcataagataaaagggacagtggtgttgatgcgcaagaatgtgttggacgtgaatagcgtaaccagcgttgggggaattattggtcaaggtctcgacttagttggctcaacactcgatactcttactgccttcttgggccgatccgtgtctctccagcttattagtgctaccaaagctgatgccaacggaaaagggaaacttggaaaggctacctttttggaaggtatcattacttcattgccaactttgggagcaggccaatctgcattcaaaattaattttgaatgggatgatgggagtggaattcctggagcattttatatcaagaattttatgcaaactgagtttttccttgtgagtttgactcttgaagacattccaaaccatggaagcatccactttgtttgcaattcgtggatttacaatgccaaactcttcaaaagtgaccgcattttctttgccaaccagacatatcttccaagtgagacaccagctccactagtcaaatatagagaagaagagttgcataatttaagaggagatggaactggagaacgcaaagagtgggaaaggatctatgattatgatgtctacaatgatttaggtgatccggataaaggtgaaaatcatgcccgtcctgttcttggaggaaatgacacctttccttatcctcgtagggggagaactggtagaaaaccaacaaggaaagatcctaatagtgagagtaggagcaatgatgtttatcttccaagagatgaggcttttggacacttgaagtcatctgactttcttacttatggactaaaatccgtatctcaaaatgttcttccattattgcaatctgcttttgatttgaatttcacaccccgtgagtttgatagctttgatgaagttcatggactctattcaggcggaattaagctgccaacagatataatcagcaagattagtccactacccgtgcttaaggaaatcttccgaactgatggtgaacaggcccttaagtttcctcctcctaaagtaattcaagtgagtaagtctgcatggatgactgatgaagaatttgcaagagaaatgcttgctggtgtaaatccaaacttgattcgttgtcttaaggatttccctccacgaagcaagctagatagccaagtctatggtgatcatactagtcaaataaccaaagaacacctagagcccaacttagaagggctcactgtagatgaggcaattcaaaacaagagattgttcctactagatcatcatgacccaatcatgccatatttgaggcgaataaatgcaacctccacaaaggcttatgctaccagaaccatccttttcctgaaaaatgacggaactttaaggccacttgccatagagttgagtttgccacatcctcagggagatcaatctggtgcttttagtcaagtttttctgcctgcagatgaaggtgttgaaagttctatttggctgctagcaaaggcttatgtagttgtgaatgactcgtgctatcatcaacttgtcagccattggttaaacactcatgcagttgttgagccattcatcatagcaacaaacaggcatctcagtgttgttcaccctatttataaactccttcaccctcactatcgtgacaccatgaacataaatggccttgctcggttatcactggtcaacgacggtggcgttatagaacaaacatttttgtggggaaggtattctgtggaaatgtctgctgtagtttacaaggattgggtttttacagatcaagcattgcctgctgatcttataaaaagaggaatggcaattgaggatccatcgtgccctcatggcattcgccttgtgatagaggactacccttatgctgttgatggacttgagatatgggatgctatcaagacatgggtccatgaatacgttttcttgtactacaaatcagatgacacacttagagaagatcctgaactccaagcctgctggaaagaactcgtagaggtgggtcatggagacaagaaaaatgagccatggtggcctaagatgcaaactcgtgaagagctagttgaagcttgcgctatcatcatatggactgcttcagcacttcatgcagctgttaattttggacagtatccctatggaggtttaatcttaaaccgtccaactcttagtaggcgattcatgcctgagaaaggttctgctgagtatgaggagctgaggaagaatccccagaaggcttacttgaagactattacaccaaagtttcagacccttattgacctttctgttatagaaatcttgtcaaggcatgcatctgatgaggtgtaccttggggagagggacaatccaaattggacatctgatacaagagcattagaggcttttaaaaggtttggaaataaactggcacaaattgagaataaactctcagagagaaacaacgatgagaaactgagaaaccgttgtggaccagttcaaatgccttatactctgcttttgccttctagtaaggaaggattaactttcagaggaattcccaacagtatctctatctga

SEQ ID NO: 3810 - DNA, 321 bp, Glycine max var. Williams 82; identical to SEQ ID NO: 2847

SEQ ID NO: 3811 - DNA, 789 bp, Glycine max var. Williams 82
atggagcaatcatattcatgggagaattgggctcttgacaaggaaatgggggaggatgaggaggagttccttcgcgacatccttagtaaaccggctttttcttccgagagtgaaagtcaagcaccagttgtctcatgctctgccaaaagcaaaagggctccgatgacatacattttgtcttttgataactccaccataacaccagcaccttcttccccccccaccctagaggcccaacctggaaagagggctaaaagagcttcccacattatggctgaaagaaaaaggagacagcaactcacccagagcttcattgcactttcagccaccatccctggcttgaacaagaaggacaagagttctatgcttggcaaagcaattgattacgtgaaacaacttcaagaacgcgtgacggagcttgaacagagaaagaagagaggcaaagaatcgatgataatcctcaagaagagtgaagcaaattctgaggattgctgtagagccaacaaaatgctccctgatgttgaagcaagagtgacggagaatgaggtactcattgagatccattgcgagaaggaagatgggcttgagctgatcaaaatattggaccaccttgaaaatcttcatctctgtgtcaccgccagcagcgtattgccctttgggaattcaactcttagcatcactattatcgctcagatgggtgacgcgtacaaaatgaaggtgaatgatctagttaaaaaactaaggcaagtgttgttgaatcacacgaacgtcaataccaatccgtactag

SEQ ID NO: 3812 - DNA, 1098 bp, Glycine max var. Williams 82
atgcctcccgtacctatttcccccatcaaagttgggcatattgatgatgtccaagagctaagaaaaaccaagccaaggacaattcctcaaagatttgtacgagacatgacagaaagaccaacactcactacacctcttcccccaccatatagtgacatgccagtcattgatttctataagcttagcaaagggaacaaagaggaagtcctcactgaacttttcaatcttgcaactgcttgtgaagagtggggattttttcaggtaattaatcatgaaattgacctcaatctgctggagagcatagagaacctgagcagggagtttttcatgctacctttggaagagaaacagaaataccctatggctccaggaacagtccaagggtatggacaagcttttgttttctcagaggaccaaaaactggactggtgcaacatgtttgctcttggaattgaacctcaatatgttaggaacccaaatctatggccaaagaaacctgaaaaattcagtgaaactgtggaagaatactcaggagaaataaggaaactctgctataatctgttgacatacatagctttaggccttggtttaaaaggggatgagtttgagaagatgtttggaatatcagtgcaagctgtaaggatgaactactacccaccatgttcaagacctgaccttgttttgggtctgagtccccattcagatggaagtgccctcactgtactgcagcaagcaaagggaggcccagtgggacttcagatactcaaggacaatacatgggttcctattcaaccaattccaaatgctcttgtcatcaacattggagacacaatagaagttcttacaaatggaaaatacaggagtgtggagcatagagctgtggctcatgaggagaaagatagactctcaattgtgacattttttgctcctagctatgaagtagagcttggtccaatgccagagtttgtggatgaaaaccacccatgcaagtataaaagatacagtcatggagagtacagtaaacactatgtaacaaacaagttacaaggaaaaaagaccctggactttgccaagatccaaaccaaaaacaaaaactag

SEQ ID NO: 3813 - DNA, 1383 bp, Glycine max var. Williams 82
atggctgaggagtttcaagctgctatttgtggtgaaagttggtggaatattattaatccaacaagaagtgtgtttcctcttatgccatcaacttgttctgtggcagcagctgatgcaggaaactacagcacttggcaaagtactactgatttcgtggatttgaagggaacaaggtcttgtgctgaggagactgatattaacttggtttcttctgatacttctctgagttttcttgatgccgagaagccacaccagagcggaactggtagcatcttgatcgattccaccttacaaatgatgggttttggcatgtcatcttcaacttcaccgaattggagtcaatctttattagggagcagttttgattctgtgcttcaagaagaaacaggcataggtggtggtggttcttccaatgattcacaaatccaaaaggattggagtccaaagaatttctcatctgatggtggcagcgagcaagtttccaccgttgatgctttcaagccaatgaaccaagaattttccttggatcagcagagtctgaattctgttgttacaagcactgatggatcattatctggtggtaatttcccagttgtttcagcctcctacggttacccttcaacattgatacaaagcttatatgagcatcaaccacaaccacagaattcacttttcaccaacccctccatgtcctatgggacatgttccaatgaactgtcaccaacttggtccaaagtctcttcctttctcaaaccctcaatgccaaagcaacagctccgtggattgcacttttccaacaacactactcctttctggaattcttcagccgaagcgcttaatgacataagagcaggtgtttttgcttcatcacaggcccaatatcaaactccaaaatttgaagagaaacccaactgcccccatactctattaaagaagctcaagagagaagaatcaccagacgcagcgaagaaaaattctcctgagcctgccgcattcaagaggcaaagaattgagactccatctccattaccaacttttaaggttaggaaagaaaagctgggggaccgcatcactgctcttcagcaattggtttcacctttcggaaagacggacacggcatccgttcttcacgaagccatcgagtacatcaagttccttcatgaccaagtcagtgtattgaggactccatatatgaaaaacaatggagctcccattcaacaccagcaggattgtgataatctgaaggactcagaagggccaaagcaagatttgagaagccgagggctgtgtttggtgccggtttcaagcacattcccggtcgctaatgagaccattgttgacttctggacgcctacatttggaggcgcactcattggcaagtag

SEQ ID NO: 3814 - DNA, 651 bp, Glycine max var. Williams 82
atgcaactccaacccactctctccactctctacctctcccttttgttaacaataacgttaacatctccaaccttggcagcacaaagcaagccgcaggatctggtccggtcctcgtgcgtgcacgcgcggtacccgcgtctgtgcctgcgcaccctctcgaactacccgggtcccgccaacacgccgttagacgtggccagggcagctttgagggtaagcctggcccacacgcgccgggcctccaaattcctccatgcactttctcatggaggcgctgccgccatgagcaagcgccagcgctccgcgctgcgcgactgtaatgaacagatttcggactccgtcgaccagctgcggcggagcctcgacgagctgcagcacctgcgctccgagacgttcaagtggcagatgagcaacgccctgacttgggtcagcgccgccctcaccaacggcgacacctgcctcgacggcttcggagggaatgccaggcccgacgtcaaacgcagagtcacggatgtggcgagggttactagcaatgctttgtatatgattaatcggctcgggcaaagtagaaccgggaagcccaagcccaaacccaaacccaggtccaggcctcagcctcgctctgcctcaagtactgaaaaattgaattag

SEQ ID NO: 3815 - DNA, 342 bp, Glycine max var. Williams 82
atgtctaatgtgtcccttctccttttccttgtgttcttgtctctctcatcaggagcgaatttgatcatggctaatggacagaaaacttggtgtgtggcaaagccttcatcagatcaagcaacccttttggccaacctcaattatgcctgctctcaagttgattgcaggattctgcagaaaggatgcccctgctcttaccctgacaatctcatgaaccatgcttccatagccatgaatctctattaccaatctagggggaaaaaccactggaattgtgatttcagggcctctggccttgttgttgtcactgatccaagttatggtaattgcatttatgcatag

SEQ ID NO: 3816 - DNA, 534 bp, Glycine max var. Williams 82
atgacagcaaagtggtatctcattgtgtgtgttgtagcgatctgggccgttgatctgggttcatcatcacaccatgcccgtgccccagcaccagcaccgtcagtggagtgttcaaacctggtattgaccttatcggattgcctcaccttcgttagcaacggcagcaccgtcaccaagccacagggaacatgctgctcttccttgaaaactgtgctcaacacagcccctaagtgcctctgcgaggctttcaacagcagcgctcagttaggtttagccatcaatgtcaccaaggctgtcacgcttcccgctgcttgcaaactctctactccttctgccgctaattgtggactgtctgcaacgcctgctgctgctcctggcccctctcctacatctgctactgcaactattgggactccaggaggagctccatcatcaactcccgggaacgcagcatcagcattaatccccatatcagctggatcctctattgtttgccttttagtagctctatctctcgtttcactttcagagtag

SEQ ID NO: 3817 - DNA, 1155 bp, Glycine max var. Williams 82
atgatgcagatggaagagaagaaagaaacaaaagttgtgctcacaaggccattaacaatacaaagggattctgattcagacgcgtcttataaagcccctaatcttttgcaacgaatactgagtttattcgagaatgtacgcccagggtctgatctcacacgcttccagctgccacctctgttcaacttaccaaagtcacaacttcagtgctatggtgaatcagtgtattgcacagcttcagacttgctaagtatgtgcaacaatggtcagagtccacttgataggttcatatctgtggtagcatggtgcatatctaccactcgccctctgacttttggtgttgctccttataatcctattcttggtgagacacatcatgtttcaaagggaaatcttaatgtgttattggagcagatttcacatcaccctccagtaacagctctccatgcaacagatgaaaaggaaaacattgaaatgttatggtgccagcgacctgatccaaagtttaatggcacatcagttgaagctaaagtgcatggtatacgccagttgaagctcctaaatcatggtgaaacatatgaaatgaattgtcctcaccttttacttagaattcttccagttcctggggctgattgggctggcacagttaatatacggtgcccagagacaggtctagtagctgaattatcctacagatcaagtttttttctaggaattagggggaatcatagagtgatcaaagggaagatccttgactcttcatcattgaaagttctatatgaagttgatggtcattgggataggaccgtaaaagtgaaggatacaaataatgggaaagtaagagtgatatatgatgcaaaggaagtgatgtcaggtctcgtaactcctatattcaaggacacggagagtgtgtggcaaacagaatcagctcatgtttggggtgaattgaaccaagctattatgagcaaagactgggagaaagcaagagaagcaaagctaaaagttgaggaaagacaaagggagcttgtgagagaaagagaatcaaaaggagaaacatggatttctaagcattttgtagtgtctaacaacaaagaagggtggcaatgctcacctattcataagagtgtaccagctgcccccatcatagccctataa

SEQ ID NO: 3818 - DNA, 486 bp, Glycine max var. Williams 82
atgatgtccccatcccatgtgatcctatccatatttttcttggtgtgtacaacaacaccaccactgtcccttgcccagaacacccctcaagactttcttgatgtgcacaatcaggctcgtgccgaggttggtgttggtccactctcatggaaccacacccttcaagcctacgctcaaaggtatgccaatgagagaatccctgactgcaacctcgaacactccatgggacccttcggcgagaatctcgctgaagggtacggcgaaatgaagggttcggatgctgtcaaattttggctcactgagaagccttactatgaccactactccaacgcttgtgtccatgatgagtgcttgcattatactcagattgtgtggcgtgattctgttcatcttgggtgtgctagagcaaagtgtaacaatggctgggtgtttgttatttgcagctattccccaccaggcaacattgaaggggaacgaccttattga

SEQ ID NO: 3819 - DNA, 306 bp, Glycine max var. Williams 82
atgaagactcttcactttctcctagtttctttctttgctttccaggcgttgttgcttggttctagtcctacagaagctacacgtttgcggacactgtcactgggctattcttcaagtactggagcaactctgaagaaagtgagtttaaggccaccaacacatccacgacgacactcgcctccaccaccaactcctggctattctcctgaacccggtccaggacgaactcgaagatctcctccgactccaagacctttcatcgttgtaccagcaaataattctgatccttctgctgcatcagcatga

SEQ ID NO: 3820 - DNA, 384 bp, Glycine max var. Williams 82
atggcttccaagggcacagttgcatccacttatgttgctctattcctttgtctcaacatgctttcctacactatggtgagctccacctacatccctgtaatccctgacccatcagtgccttctcaaaagggtacctgccctatagatgcacttaagttgggtgtgtgtgccaacgtgttgaacttggtcaatgttaaattagggtctccaccaacgctcccatgctgcaacctcattaagggtcttgcggatcttgaagttgctgcatgcctttgcactgccctcaaagctaacgttcttggcatcaacctcaacgtcccaatttccttgagcgtaattctcaacaactgtggaaggaataacgctggcttccagtgcccttga

SEQ ID NO: 3821 - DNA, 1125 bp, Glycine max var. Williams 82
atgcattttctgactcttgctatggacaaatttctgagtaatatggaaagagaaaagccaatcaggtttactagtgagcagctcaggattgcaactgataactactcatcattattgggatcaggaggttttggagaagtttataaaggaaatttgagtgatggaatcactgtggctgtgaaggttctacgtggtaactcagataagagaattgaggaacaatttatggcagaagtgggtacaattggaaaagttcatcatttcaatctagttcagttgattggattttgcttcgaaagagatctaagagcactggtttatgagtacatggagaatggctctcttgacaggtatttgttccatgaaaagaagaccttaggatatgaaaagctttatgagattgcagttgggatagccagaggcatcgcatacttgcacgaagattgcaaacaaagaataatccattatgacatcaaaccaggaaatattctattggaccacaatttcaatcctaaagttgctgattttggattagccaagctttgcaacagagacaatactcatattactatgacaggaggtaggggcactcctggttatgctgcacctgagctttggatgccatttcctgtgactcacaagtgtgatgtttacagctacggaatgctgttatttgaaatcgtaggtaggagaagaaacgttgacactaaccttccagaaagccaagagtggtttccagtatgggtttggaaaagatttgatactggagaattggtagagttaagaatggcttgtggaatagaggagagacatcataaaatggctgaaagaatggttaaggtagctttgctatgtgttcagtatagaccagattcaagaccaataatgagtgatgtagtgaaaatgttggaaggttcggtggaaatttctaaacccatgaacccatttcagcatatgatggatgggactatccctggtcattcagcccaagcatcacaaactgatgctaatacaagtgttaattctggctcttctgctacggtaacccaaccaggcattgtatatgataatcctatgatgaggaatgatgacattgaatggacctctaccattgctgatgaatga

SEQ ID NO: 3822 - DNA, 648 bp, Glycine max var. Williams 82; identical to SEQ ID NO: 2730

SEQ ID NO: 3823 - DNA, 1107 bp, Glycine max var. Williams 82; identical to SEQ ID NO: 2746

SEQ ID NO: 3824 - DNA, 513 bp, Glycine max var. Williams 82
atgaaggaaggtggtggtagaaagcaaggtgcagcctcaccttgtgctgcatgcaagcttctgaggagaaggtgtgctcaggattgtgtttttgctccatatttcccagcagatgaaccccaaaagtttgcaaacgtgcacaaggtgtttggtgctagcaatgtcaacaagatgcttcaggacctaccaatgcatcaacgaggggatgcagtgagtagcatggtgtatgaggccaatgccagagtccgagaccctgtttacgggtgcgttggggccatctcttcacttcagcaacagattgatgtgctacagacgcaattggccctggcccaggctgaggtggcccatcttcgggcgagacaaaacagatgcttttcccatcatgggcttaggccaactagcccaaccactagtggttttccatcatccaagaccttggactcacatgctaagcctatttttgacatagacatggtggaccaggttcgctatggtgcttcaatgtggtcatga

SEQ ID NO: 3825 - DNA, 1242 bp, Glycine max var. Williams 82
atgggggtggagtatacgtgctgtgacatggagttttacaaacgcatactaataattgtgctgcttgtgatgttcgctggattgatgtcagggctcactttaggactcatgtcattgagtatcgttgatcttgaggtccttgctaagtctggaacccctcaggatcgcaacaatgccgcaaagatattgcctgttgtcaggaatcaacatttattgctttgcaccctcctaatttgcaatgctatagccatggaggcacttccaatttttcttgatagtcttgttgtggcgtggggtgctatcctgatttcagtgaccttaattcttctgtttggtgagataataccccaatcaatttgttctcggtatggtttagcaattggtgcaacagtggctccagttgtccgtgttctggtatgggtatgttttcctgttgcatatccaatcagtaagttgttggactttttgttggggcatcgacataaagcacttttccacagagctgagttgaaaacactagtaaatctgcatggccatgaggctggaaaaggtggggaactgacacatcatgaaacaacaatcattgctggagcactggaacttgctgagaagacagccggtgatgccatgacccccataactgaagcattttgtattgacattaattctaagcttgacatgtatctgatgaatctgatattggagaatgggcatagcagggtccctgtcttttatgatcagcctacaaatattattggacttatcctgatcaagaatttattgacaattgatccagaagatgaagcacccgtgaaatgtgtgaccatacgcagaattccaagggttccagaaacgatgccactatatgatattttgaatgagttccaaaagggccatagccacatggctattgttgtcaaacactgtgacaagacaggttatcaatcttccaataataatgcctatgactcagcgagagatgtgaaggtggatattgatggtgagaagcctccccgagagaaaaatttgaaaaccaagatgtcatgccataaacgtaaaagctttccaaacgcaaacaacttaaacaagggtagtcctcagagcagaaaatggtcaaagaatatgtactcagatattttggaaatagatggaaattcaattccaaagctaccagaaaaagaagctgctgttggaataattactatggaggatgtcattgaagagcttttacagtttctttaa

SEQ ID NO: 3826 - DNA, 1668 bp, Glycine max var. Williams 82
atgaaaggcataaacaggtggctatccttctatatggatgaaagtgttaaccacgatttcgccatccgaaggtattgccctgcaagaatggagcaagagcaaggaggagataagtgccaagaccaagaggcactagttttttatgacactgaattatgttcttctgatgctaccagcagcactccttgtttggcttcatctgaggttgatgactttgttgatagcttcatcaacatggatcagtatgagtacgtgaatgaagatcaagggttccaagagaagcatcgaagttttgaccactttgtggtgaatgatgaggatgaggctgatgcatactccattgtgaatggtgtctttgaatatgttccaaccaccttggaggattcagaattggagatctatgaagatgtcacaacagccatgttggaggaagaggttgcaatgaatggctctttttgtgctatacctgagtttgttgtgccttgtacacaagaggccaatcttggtgtggaccaagggttagacttggttcacatgcttttggcctgtgctgaagctgtggggtgcagagacaaccagcaggcagagttgcttcttagcagaatttgggctttggcaagtccttcaggagactcgctgcagcgagtctcctactgttttgccaaaggattgaagtgtaggttatcactgcttcctcataatgtcattgcaaatgctacactttccagtatggatgtgcctttcattactagggagaataagctggaagcttttcagcttctgtaccaaaccacaccttacattgcctttggtttcatggctgcaaatgaagccatatgccaagcatcacaaggaaagagctcaatacacattgttgatttaggaatggagcatacccttcagtggtcttccctaataagggccctttcttcaaggcctgaagggcctccaacactccggatcaccggattaactggcaatgaagaaaactcaaaacttcaagctagtatgaatgtgcttgtggaagaagcaagctcattgggaatgcatcttgaattccacataatttctgagcatttaactccatgtcttcttactatggagaagctgaacttgagaaaagaagaagctttatgtgtcaatagtatcttgcagttgcacaaatatgtcaaagaaagtagaggctatctgaaggaaattcttctatcaataaagaagttaggtccaactgcacttacagtggtagagcaagacacaaaccataatggccctttcttccttgggagatttttggaatcactgcactattactcggccatatttgattctcttgaggcaagtatgacaagaaatagtcaacacaggatgaaaatagagagattacattttgcagaggaaattcagaacgttgtagcttatgagggtccagatagaatagaaagacatgaaagggtagatcaatggagaaggcaattaggccgagcaggatttcaggtaatgccactgaagtgcactagtcaagttagaatgatgctttctgtttatgactgtgacggatatacattgtcctatgagaaaggaaatcttttacttgggtggaaaggaaggccagtaatgatggcttctgcatggcaagttgcaagttcttatctgacccgaataggatag

SEQ ID NO: 3827 - DNA, 459 bp, Glycine max var. Williams 82
atgtcacttgctggtaaaatcagcattgaaattggggtgcatgcaagcgctgcaaagtggttcaacctctttgcaacgcaactccatcatgttcaaaaccttaccgaaagagtgcatgaaaccaagctacatcatggtgatgactggcatcacaacgaatcgatcaaacactggacttgtaccatagatggtaaggttacaacatatcacgagagtattgaatccgttgatgaacctaacaaaacaatcacttacaagatcttcggtgaagatatcgatcaccagtataaggtctttaaggtcatctttcaagcaattcataaggatcatgggggtgcattcatcaaatggactattgaatatgaaagggttggtgaggaagttgatcttccatttggcttcatcgaatacctcaacaaagggagtagagatgttgatggtcatcttctcaaggcatag

SEQ ID NO: 3828 - DNA, 522 bp, Glycine max var. Williams 82
atgaaagaaaacgtaggaaaccctctgcacctaaagtctgtgaaccatatctctctcatctgtacctccgtgaaagaatctatcaacttctaccagaaccttctcggattttttcccatcaggaggccgggatcatttgattttgacggggcatggctattcggatacggaattggaattcacttgctgcaagccgaggaccccgacaacgttccaagaaagacgaaaattaatccaaaagataaccatatatcattccagtgtgaaagcatgggggcagtggagaagaagcttggggagatggagattgaatacgtgcatgcaacggtagaggaaggagggattaaagtggatcagttgttttttcatgacccagatgggttcatgattgagatatgcaattgtgatagccttcccgtgatccccttagcagcgagtggcaataacaatggcatggtcagatcatgctccagactcaaccttcaaattcttcaacagatacaccaatttctcaaccaatag

SEQ ID NO: 3829 - DNA, 1929 bp, Glycine max var. Williams 82
atggccaacattgggtcttcttcacgtaggcatggagatactttgccacatattcacaaggtgggagctcctcctaagcaaacacttttccaagagatcaaacattctgtggttgagactttcttcccagacaaacccttggaacaatttaagggccaaaccggctctagaaagtttcatttaggcctgcaatctctcttccccatttttgaatggggaagagattacaatcttaaaaaattcagaggtgatttcatttctggactaactattgcaagtctatgtatccctcaggacattgcatacgcaaagctggcaaatttggatccccaatatgcactctacaccagttttgtgtgtcctcttgtgtatgctttcatgggaagctcaagagatattgccataggacccgtagctgtggtgtccctcttgcttgggactttgctaaccgatgagatcagtgacttcaaatctcatgaatacctgcgtcttgcatttactgccactttcttcgcaggagtcactcaaatggcactcggtgttctcaggcttggtttcttgattgactttttgtcccatgctgccattgtgggattcatggctggagctgccattactattgcactgcaacagcttaagggttttcttggcataaaaacgttcaccaagaaaactgatattgtttctgttctgcactcggttttcgatgcagcacaccatgggtggaattgggagacaatagtcattggagtatcattcttggctttccttcttataaccaagtatattgctaaaaagaataagaagctcttttgggtggctgcaatttctcctatgatctctgttatagtgtctaccttttttgtctacattaccagggcagacaagaaaggcgtggcaattgtgaaacatgttaagaagggtgtgaatccatcatctgctagtgagatttttttcagtggaaaatatctaggccctggtattcgggttggtgtggtagctggtatggtagcactcacggaagctgtagcaattggaagaacatttgctgccatgaaagactattcactggatggtaacaaagaaatgatggcaatgggagcaatgaacatcattggttcactaacatcttgttatgtggctacaggatctttttctcgctcggcagtgaactacatggctggttgtaaaactgctgtatcaaacatcgttatgtccattgttgtgttattgacactgctactcattacgccactctttaagtacactccaaatgctgtgcttgcatctattataatagctgcggtgcttggccttgtgaacattgaagcagttattctgctgtggaagattgacaaattcgattttcttgcttgcatgggagccttctttggtgtgatcttcataagtgttgagattggtcttctaattgcggtggctatatcttttgccaaaatcctcttacaagtgacaaggccaagaactgcagtactagggagacttccagagactactgtttatagaaacatccagcaataccccaaagcaacccaaattaatggcatgctcattataagggttgactctgcaatctacttctcaaactccaactatatcaaggagagaattttgagatggctggctgatgaagaagcccaaaggagaagtggatcgtcaagaatagagtatctcactgttgaaatgtcacctgttactgatattgacactagtggcatccatgcttttgaagagttatacaagacccttcagaaaagaaaaatacagcttatcttggcaaaccccgggccaattgtgatggagaagctccacgcatccaagttagcagacttaattggggaagataaaatatttctaacagtggctgatgcagtttcaacttttggtccaaagggtgaagcagtagtatga

SEQ ID NO: 3830 - DNA, 675 bp, Glycine max var. Williams 82
atgagaaaggcttccactctgcaatgctcactttggcgcttcggtgtttcgctattgctggttgccagcttcatttgtgcttcttctgttatggcaacatctgaagtttcagggaatgaagtggataccgatgggaagcttgtaaatgaagagccagcaaaaacaagccttcaaggatatgatgaagaagaaaaatttaaagggctttttccaaaatctattcctatagttaagcctatcccaaagttagttaaacctattcctattcccgtgtataagcctataccaaaaccaattcccttggtgaagcctatttcaaagccaattccaattataaagtcaatttctaatgaagaagaaaaatttaaaggacttccaaaacctattccagtaattaagccgattccaaaactaattcctgttgtaaaacctattcctgttccaatatataaacctacaccaaaattaattcccatcattaaaccaattccaattgttaaacctgtaccaaaaccttttacagtgcaaaaacccatccccgctattgacccagagtcttttctaaagccgaagcctttctttgagaaacctattcctaaattgccacttgaccctaaattcaagaaaccacttctgccacctttcccaattcaaaagccaatttcaagtccataa

SEQ ID NO: 3831 - DNA, 366 bp, Glycine max var. Williams 82
atggcattctcttccactctacttcttctgctcgtggcgatgttcgtcttctctgccgtcgcacaatctccggcgtcgtctcctgagttcgctgctgctccaccgaaaaccgccactccctcgccttcttcgtccatgtctccacccgccgctgctccttcaccttcatcctccgtcgtgagctctccgccgtctcctcctacttcagttccggcgtcttctccgtcgccttccatctctccgtcgtcgatctcttcccctccgtccgatgcccccgcaccgtccgagaatgccgccgtctcgaatggattcgccgctgtcggatctgtcgtagtcggtctcgtcgccgccgcatcgatcatgtga

SEQ ID NO: 3832 - DNA, 1518 bp, Glycine max var. Williams 82
atggaaatcgaatttgaggatagacaagaagaaacagtttcagatatgataccaagcaatcagcagaggaaaaaacagtcgtttctatggaaagttttggccatgagagaaagaaatggaaggacaatggagagaggttcaaatgcttcccttgatccactttctgattcatcctttgacaatcgaggctcagaaccttctatgtcttctagtgaagcaattcaaaatttcagagtttttgcagcaacatggaatgtaggagggcaatgccccactggaaaccttgatctgaatgattttcttcaagttcgaaacgaaccagatatgtatgttttgggctttcaggaaattgtccctttaaatgctggaaatgtgctggtattagaggataatgagcctgctgcaaaatggcttgctttaatcaaccaatcactcaatggttcttcagatttggcttctaagggactaaaactgactgcatcttttggaggcccattgttctcgcaaaagccttctttgaagaagattaagaaaactttcaagaaactaaatggaaagaggctaaaaagttgtaactgtgttcttgaaatggaaaggaaggctgctaaggatttctgttttcgctgccaagaatcaaacttcaattcagatgattcttccacagaagaggaggatgagaatttcacaattcctgttgcattggcaactagtcagatgaaatacagtcttgttgcatgtaagcaaatggttggaatttttgtaagtgtctggatgaggagggaacttgttcagtatgtaggccatttgagaatatgctgtactagccgcgggatcatgggttgccttgggaacaaggggtgtatatcagtgagcatgtcattttatcagacaagtttttgctttatctgtagtcatttggcatctggagagaaagagggtgacgagcttcgtagaaaccttgatgtcatagagattctgaagaacactcaattcccaaggatttgcaagacaccacatagtaggatgcctgacaaaattttagatcacgaccgaatcatatggtttggggacttgaattacagaatttctttgagccatgatgatgcaaaaaggcttgtggaaaagagggactggccagctctttttaacaaggatcagcttaaaatggaaagggaagcaggtcgtgtattcaaggggtggaaagagggaaagatctactttgcacctacttataaatatgccttcaactcagacacttactatgttgaaggtgtaaaagtttcaaagaacaaaaggagaactccagcttggtgcgatagaatcttgtggcatggaaggggaatacaacaacttttgtacgtccgtagagaatttaagttctctgaccatcgacctgtttgtgcaacatttaatgtagaagttgaggttatgttcaggggacagaagaagaaagtttcaacttgcaactttcagaacattgatgatcttgtatccacaagaagtccatatttttcttga

SEQ ID NO: 3833 - DNA, 555 bp, Glycine max var. Williams 82
atggacaagctcacctcacatgtggcgtatgatagcatttcatattcattggactcgctctcttttagtggccttgttgctattcaagaccaccaaccaaagctcccttctcctaaccgggctaaagactaccaggtaagcaagcatgactcagaatttgaatttaccagcactaaagcaaacttgaattctgctgtcaatccaatcaagatcactcctgctgaccaacttatttccaatggtcgacttcaaccacaagcacttgccatccaaacaaatcagtctctgatcagaaatctacccagttcttcaagctcattactagcaacccatagcagcagtaagatgtcatgcagtaaaacaggcagcaatatgaaatatcacgaacaacttaacgaagcaagcaaacatgcaaacaagaaaagcacggtgacaaggacagggtttggccagaaaatgaagtcttttctatcaccatgccgagaatgtcgaaccattaagcaaggtgctgttaaagcacaaacagttccaggagaaaatctcaaaattgactga

SEQ ID NO: 3834 - DNA, 453 bp, Glycine max var. Williams 82
atggaacggaggaagaataagagagcaagagaagatgatggagttgagattgagtcttcttttgagaattataacaacaatattgcaaagaaggagaagaatgaagtggaggagaaagactgttccaaggcatgggattactcccatttgacaatgggagtgtttgatttcccttggatgaaggatggtgtcatatccaaatcatatgaatgcttggattttgaagacgattcctggtcatctctagaacgccaagagactttattcaaagcttcaggtattgatttctctgaggagtatggcttgtgtgaaactccagaggcatcaatggctcatattcaagaagccaagttggttgaggatatgtggaagccatttgagagtaatgggttggagctggaggcggaagatggagattgtatttggagctttctgctcaataagcctctttga

SEQ ID NO: 3835 - DNA, 1371 bp, Glycine max var. Williams 82
atgtcagttccttgtgtagcaggccggcagagagacaaagatctcatcaaaggcaagaagaagaacaacaaagcaagagaaattggaatggaaggcaaaggtggaggagaagtgagaaggcttcacatcatttacttccttagtcagataggtggtcgtgcagatcatcctcatctaattcgtgttcttcatcttgcccgaaatggggtttatcttagagatgttaagagatggcttggggaattgagaggaaaagacttgcctgatgcttttgcttggtcctacaagaggaggtacaagagtggatatgtgtggcaagacttgttggatgacgacctcataacccccatctctgacaatgaatacgtcctcaaaggatcacaaatccaccctaccccatttacaacaactccttcacttgcagaaaagaaaattgcggtttgtgatatccatgctgagaagaaatgtactcaagtacaacttgtagaggacgaaaaccagcagccacagcagcagcctctagcggaagaagaacctcgaattcaacaagacttgaattcgaaaatagatactctgacaaaagggtcatcagaaatcagccaggactcatcattggtcttcagctcagacaggtcatctgtgacagatgatgactcttctaaggtcgaagaagagaagcatatagaggctacaggcaaaaagggattcaacgaaatcaaccaagagaagttagagacttgctcattgccttccttgtatcacaatctgttgattacgaaggctagccacaaagatgacttgaataaaaccagctcacctgagtcatccttctccactatatcatcatcatcatctcaatcctcttttactaagatcagaagcaattctactaaagtttctaatgtgttccgcaattggattacctgtggcactgtggaaacaaaggatgcagcactggtcctgatgaacccggctcaaaagaatttatccaaggaacctatcaacatacctgaaagaagggttgagatttgtaagggagacaaattgggaggatcagccaggtgttttagaacttcttggggccctcatcaccagaaacaacaatatggggcaagaaaaagctttgaaggaaatgaaactaaccggagcaggaaaaagttaggggagttgctaaatcaaacttcttccaaaccatttggtggaccaacttgctcgcaatgcgggaagtcgtttaagcctgagaaaatgcacaaacacatgaagtcttgtaaaggaatgaaagccttgggaaagtcatccacaactgttgaggaggcacagcttcagggatcatcatcttcatcttatacagattactttttgaccaactaa

SEQ ID NO: 3836 - DNA, 711 bp, Glycine max var. Williams 82
atgtccacctcccatgccaccattattaattccaccacatccaccagctcctcctcctttaccacctccataaccgccaccaacaccaactcctcctcctccaacaccaccaccatgtccacctcctatgttgcctccagccccactaccaccaccagctcctcctccaattccactaccatgtccacctccaatgccaccaccatgtccacctccggcttgaccacctccaccagcacctccagctccccctccaatgccaccaccatgtccacctccggcttgaccacctccaccagcacctccagctccccctccaatgccaccaccatgtccacctcctacgttgcctgcagcaccacttccggctccaccacctccaccccctcctcctccaatgccaccagcatgtcctcctcctatcccaccagcaccacctcctccagctcctcctccaacaccaccaccttctcctccaataccaccatgtccaccttctatgccacctccagcacctccacccttatcgcctccataacctccaccaacaccacctccatagcctcccccagctccaccacctccgccagctcctcctcctacaccactcccgtgtccacctccaaacccaccacctgcacctcctccagcaccaccaccaaatccacctccaccaccgccaaaaccatctccttcaaagccatcgattaa

SEQ ID NO: 3837 - DNA, 411 bp, Glycine max var. Williams 82
atggcacgtaccaagcaaaccgctcgcaagtccaccggcggaaaggcgccgaggaagcaattggcgactaaagccgctcgcaagtcagctccggccaccggcggagtgaagaagccccaccgcttcaggcccggaacggtggctctgagggagatcagaaagtaccagaagagcactgaacttctgatccgaaaactcccattccagaggctcgtcagagaaatcgctcaggatttcaaaacagatcttcgtttccagagcagcgctgtttctgcgcttcaggaagccgcagaggcttatctcgttggactcttcgaggacaccaacctctgcgctattcacgccaagagagtcaccattatgcccaaggatattcaacttgctcgcagaatcagaggcgagagagcttaa

SEQ ID NO: 3838 - DNA, 1785 bp, Glycine max var. Williams 82
atggccactggacaactattctcccgtactacacaatctttattttacaactacaagcaactttacatccagaggatgcttgattttgacttcctttgtggcagggaaacaccatcagtttctggaataattagccctggttctgagggatttcaaaaacttttttttggtcaggaggaaattgccatcccagttcatgctaccattgaagcagcttgtgctgcacatcctactgctgatgtcttcatcaactttgcttcatttagaagcgctgcagcagcatccatggctgccttgaagcagccaacgatcagagttgttgctattattgctgaaggagtacctgagtcagacactaagcaattggttgcgtatgcccgggcaaacaataaggttgttattggtccagccactgatggaggcattcaagcaggtgcttttaaaattggcgacacagctggaacaattgacaatataattcactgcaagctctataggccaggatctgttggatttgtatctaaatctggggggatgtccaatgaattatataacactatcgcccgcgtaactgatgggatttatgaaggcattgacattggaggagatgctttcccaggctccacactttctgaccatgttttacggtttaacaacataccacagattaaaatgatggtagtacttggagaacttggtgggcgtgatgagtattccttagtggacgccctaaaacaaggaaaagtatcaaaaccggttgtggcctgggttgatcatgaaggagctaaaagtggcagtcagttggagtctgctcaagcaaagaatcaggcactaagggacgctggagctgttgttcccacatcatatgaaacttttgaagctgcaattaaggaagcatttgacaagttggttgaagaagggaatatcacaccagtcaaggaaaccactcctccaccaatccccgaggaccttaactctgcaatcaagagtggaaaagtccgtgctccaactcatattatttccaccatttctgatgagagaggtgaggagcaatgctatgctggtgtatccatgtcttccattattgaagaaggttatggtgttggtggtgtggtctctcttttatggtttaaacgcagccttccccattactgtactcaatttattgagatgtgcatcatgctatgtgccgaccatggtccttgtgcctcaggtgctcacaatgctatcgtgacagcaagggccgggaaggacctaatttccagtattgtatcaggtatgcttacaattggtcctcgatttgggggtgccattgatgatgctgctcgctacttcaaggatgctcatgacagggggcttacgccttatgagtttgttgaaggtatgaaaaagaagggaattcgtgtgccaggaataggacacagggtaaagaataaggacaacaaagataagagagtagagctactacaaaagtttgcacgcacacatttcccttgcgtgaagtacatggaatatgctattcaagttgaagactacaccctctcaaaggcaaataatttaattctaaacgtggatggtgcaattgcatctcttttcttggatctttttgttggcagtggactgttcagcaaacaagagattgatgaaattgtggagattggctatctgaatggcttctttgtgctggcacgctgcattggtctgattgggcacacttttgaccaaaagcgattgaagcaaccactttaccgtcacccatgggaagatgttctctacacaaagtga

SEQ ID NO: 3839 - DNA, 1416 bp, Glycine max var. Williams 82; identical to SEQ ID NO: 2720

SEQ ID NO: 3840 - DNA, 1308 bp, Glycine max var. Williams 82
atgcatccttgggtgttcatgattttagctttattctcactttctactttatcctctagagaagcccgtgaaggcctaaggggcttcagcgttgaccttatccaccgtgactcaccttcatcacccttttacaatccttcactcaccccatcagaacgcatcataaacgctgccttgcgctccatgtctcgattacaacgagtatcccattttctagatgaaaacaaactacccgaatctcttctaatcccagacaaaggtgaatacctaatgagattttacatcggttcccctcccgtggaaaggcttgctatggtagacacagggagtagtctcatttggctgcaatgttccccctgtcataattgcttcccccaagaaactcctttgtttgaacccctcaaatcttccacttacaagtatgcgacatgtgactcacaaccttgcacattactccaacctagccaacgtgattgtggaaaactaggtcagtgcatatatggaatcatgtacggtgacaaatcattctccgttggaatactgggcaccgaaaccctaagttttggttccacgggtggtgcacaaactgtttcatttcctaacactattttcgggtgtggagtggacaataatttcacaatttatactagcaataaagtcatgggtatagcgggtcttggtgcaggaccattgtcgctagtgtcacaactaggagctcaaattggtcacaaattctcctattgtttgcttccttacgattcaacctccaccagcaaattgaaatttgggagcgaagcaataataactacaaatggggttgtgtccactcccctcataatcaaaccctctttgcctacctattacttcctcaaccttgaagccgtcaccattggacaaaaggtggtgtcaacgggtcaaactgatggcaacatagtcattgattcggggacacccttgacgtatcttgaaaacaccttttacaacaactttgtggcttcgttgcaagaaacccttggtgttaagttgctgcaagatcttccatcacccctaaagacttgttttccaaatcgtgccaacttggctatccctgatattgcgtttcaatttactggagctagtgttgcactgaggcctaagaatgttcttattccgctcacagatagcaacatactttgcttggcggtggtgcccagctcaggaattgggatttccctctttggaagtattgcacagtatgattttcaagtggagtacgatctcgaggggaaaaaagtttcttttgctcctacggattgtgctaaagtttaa

SEQ ID NO: 3841 - DNA, 1122 bp, Glycine max var. Williams 82
atgggttcactcccttcaccaccaagaccaacagccccaccatccccagaaaatcttctttccaatcatgtagtggttgctgtgttttgtcctagagaaccagccccaggtgtcagtctccctaattcaattgagctatattacccttccatgaacacatggacctatgttggctcaattcctggcctaagtgatcaccaaatcttaaaggggtttgctatagtctccctaggggactttatttacataattggtggccaaatttgtcacaaagaaatggttcatgtgtctgatgagtgtgctgactacgttgatcagggcatcaaagttgtggcaacagttctccgttacaacattagaaccaatcaatggttcgattgtgcaccactaggtgtggcacggtatgattttgcttgcaccgtttgtgaaaacaaaatctacgtggctggggggaagtccacgctggcatgtgccgggccagcgcatgggatctcatcggctgaggtgtacgacccggatcatgacaggtggacccctttgcctaatttgcgtattttaaggtacaagtgtataggtgtgacgtggcaagggaaagtttacatagtgggaggatttgctgagagagaggactcggataagacaatggcaagcatagtggaacgtagctcagctgaggtgtatgacacgcaagcaaggaagtgggacctgatagcggggatgtggcaattggatgtgccacctaatcagatagtggcagtgaatggtaccctttttagttcaggggattgcttgaatgcatggaagggacatattgaagcctatgatgggaaactttggaatgaagttgatggatcacacaagcgaaacctgtccacattagaggacaactatgagaattggcctcagaatgatcaaagactgtaccttactatggcaccaattgggactcgtttgtttttcttggcaggttacaggataggaggggaactaccaagaactatgtctgttgtgcacatgtttgacacttcagccaccagggatgcttggaggagctttgaaccaatggaattggagggtgagaaagagctttgtagccattgctgtgttgtgcaactctcttaa

SEQ ID NO: 3842 - DNA, 1110 bp, Glycine max var. Williams 82
atgtggctttctttcttccatgaatttggtgatattagcttgatagcttcagctgtttttcattgcatgaggagttctcatatggagatttcatcaatcagagggctacctgaactggggataatagaggatcctaacttcctccatcagtggcagttaaactctattgatacaactagcttaaaaggtgctgcttttggagatattttgcaaaagcactcattctctgataactcaaacttcaaccccaaaacatccatggaaacatcacaaactggaattgaaagatatgcaaaacagctcggtgataacagctggaatcacaacaaaagtcaacaacagacaccagagacacaatttgcttcatgctcaaatcttctttcatttgttaatacgaattacacaagtgaattgggactagtgaagcctaaggtggagatggcgtgtcctaaaattgacaacaatgctcttgcagacatgttgatctctcaaggaaccttaggaaatcaaaactatattttcaaggctagccaagagaccaaaaagattaaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtatttgaagcaaatgcaagagaaagtgagtgctcttgaggaggaacagaacaggaagagaactgtggaatctgtggtaattgtgaagaaatctcagctatctagtgatgccgaagactcttcttcagagactggtggtacatttgtcgaggcactacctgaaattgaagcaagattttgggaaagaaatgtcctcataagaatacattgtgagaagaataaaggagtcatagagaaaacaatcagcgaaattgagaaactccatctaaaagtcatcaatagcagtgccttgacatttgggagtttcatcctggatataaccattattgctcagatggatatggaattttgcatgacagtgaaggatcttgtgagaagtttacgctcagctttttcatatttcgtgtga

SEQ ID NO: 3843 - DNA, 1050 bp, Glycine max var. Williams 82
atgaaagtaacagttgtgtgttgtgtattggttgtgctagttggtgcactaccattctcttcagatgcacaactagacccctccttttatagggacacatgtcccacagtgcattctattgtacgtgaagttgttagaaacgtttctaaatcagacccccgaatgcttgctagtctcataaggctccactttcatgactgctttgttcaaggctgtgatgcatcaattttgttgaacaacactgccacaatagaaagtgagcaacaagcttttccaaacaacaactcaataagaggtttggatgttgtgaaccagatcaagactgcggtggaaaatgcttgtcctggtgttgtttcttgtgctgatattcttgcccttgctgctgagatatcttctgttctggctcatggtcctgattggaaagttccattgggtagaagggacagtttaacagcaaacagaacacttgcaaatcaaaatcttccagctccattcttcaatcttactcaactcaaagatgcctttgctgttcaaggtctcaacactactgatctagtagcactctcaggtgctcatacaattggcaaagctcagtgcagatttttcgtcgaccgattatacaatttcagcaacactggcaaccctgatccaactcttaacacaacctacttgcaaacacttagtgcaatatgccccaatggtggacctggcactaacctcaccaattttgacccaaccacacctgacacattggacaagaactactactccaatcttcaggttcacaagggcttgcttcagagtgatcaagagctgttttccacaaccggtgccgataccatatccattgtcaatagcttcagcagtaaccaaactcttttctttgagaacttcaaggcttcaatgataaaaatgggtaacattggagtgctaacgggatctcaaggagaaatcagacaacaatgtaattttgttaatgggaattctgctggactggccactctggccaccaaagaatcatcagaatatggcatggttagctcaatctaa

SEQ ID NO: 3844 - DNA, 1314 bp, Glycine max var. Williams 82; identical to SEQ ID NO: 2849

SEQ ID NO: 3845 - DNA, 1830 bp, Glycine max var. Williams 82
atggctgatgatggtgctgatccatttccagtgttgacaagtgtgtatagagtatctggttccaaaaacagtcagctgggctggaatgtagccaattctcagcaaactgttgactccagtgtaaacaactcaaggcagttacagagcatttctgatggcagtgctccaagaccctggttttctcaaaattttagaccaaatgcatgggaagttccaggtgtgattcagaagctgaggccggcaaagcggggtaatgacggattggctttgacgggaagtggaattttgaacgacaagttgcctcctgagtcagtaatatctccaacatcagagacagagagagggacagggttaaattcatctgttggagtcgttacaactacatccaaggattgtgaaaatgttgaatgcaaggacaaggataagagaatcccagaaccccaatgtgaaaacaacaatgatcagattgttgacaatggatctgatattgtttttgatagtgatgatgattgttttttagatgacattgactcagatactggagagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggctgcatccccttttggatcattccagaacaatacaaacaaagagggcaagactgcaccggatgtttgctgaaactttggaggaagagtgtttcaggagaagagctccattaacaacagtcagtgacgtccatgatatatgggagggtcttgataagaaagtcaaggatcatgaaatagtttggcccccaatggttatcatcatgaatacaagatacgagcaggacgaaagtaacaagtggaatggaatggggaaccaaggactccttgattgcttctgtgactatgcagcattgaaggctcgacactcgtatggtccacaagggcaccgagggatgagtgccttaatttttgaggaatccacggcaggttatctagaagctgtgcggctccacaagcattttaaagagcaaggaagagatagggaggcttgggattgctatcggaatccatttctcccaggtgggaagcgccaactttatggttacttggcttctaaagaagatttagatattttcaacaagcactctagaggaaagacaaaattgaagtttgaaatgagatcatatcaagagatggttgagagcaagataaaacatattaatgatgatagtcggaagcttgactattataagagcatggtagccaaagaacaaatcaaatcacaagtaggtgcagactctttattgagattaagtgagaagttaagcttgacaaccgaagaaaaccgtgttgatcaacaaaataaggagatggatgcactagaaaaaaatttccagagccaaatcctagacattcaacaagccatagctgcaaaggaagataagtttgtgaaattacagcaggcaatgcaagaaaaagtgaaagagtcctgcggagaatcttctgagaaagaggacaaggtagaaaatatctcttgtttcctgaagccccaagacaaggagatgaagcagtttgaggcagagagagagaaaatcataaaaattcatgaagagaaaaggttggctctgaagaagaagcattggcaagagcaggttgaacttgagaaggagttagagaatgaacggacgcagctcatggacaagtacacttgcaaccagactcaagaagaaaactgttatgtggatcattaa

SEQ ID NO: 3846 - DNA, 957 bp, Glycine max var. Williams 82
atggcaaactttccagttgttgacatggggaaacttaacaccgaagagagagcagcagccatggagattataaaagatgcctgtgagaactggggtttctttgagttggtgaaccatgggatatccattgagttgatggacactgtggagaggctcacaaaagagcactacaagaagactatggagcaaaggttcaaagaaatggtggccagcaaagggcttgagtcagttcaatcagaaatcaatgacttggactgggaaagcacctttttcctgcgccatcttccagtctccaacgtttcagacaactcagatcttgatgaagaatacaggaagacaatgaagaaatttgcactggaattggagaaacttgcagagcagcttctggacttgctgtgcgagaatctcgggctggagaaagggtacctgaagaaggtgttctatggatcaaagggtccaaattttgggactaaagtgagcaactaccctccttgtcccacccctgatctcatcaagggcctaagagctcacactgatgctggtggcataatcctactgttccaagatgacaaggttagtggattgcagcttctcaaggatgatcagtggatcgatgtcccaccaatgcgtcactccattgtaatcaaccttggtgaccaacttgaggtcataaccaatggcaagtacaagagtgtcatgcaccgagtgattgcccaagccgatgataccagaatgtccatagcttctttctacaaccctggtgatgatgctgtcatttctcctgcaccggctttggtgaaggaattagatgagacaagccaagtgtacccgaaatttgtgtttgatgattacatgaagctctatgctggtctcaagtttcaggctaaagagccaaggtttgaagctatgaaggccaatgcaagcgtggttgatgtgggggccatagccacagtttga

SEQ ID NO: 3847 - DNA, 756 bp, Glycine max var. Williams 82; identical to SEQ ID NO: 2752

SEQ ID NO: 3848 - DNA, 204 bp, Glycine max var. Williams 82
atgcagttttcttcacctgagcaccattattgtattgtcaccttgtgtttgctcttatcagcaaacgttttggcactaactcttctttcttccagccaaggtcaatatgaatcccaagttcagatcatgggacagcgtttgcaatcatcaagggagcaaaaggaagaaagggagctcttcatatatgttagtccgactagttag

SEQ ID NO: 3849 - DNA, 393 bp, Glycine max var. Williams 82
atgaaagcaacattctgttgttttatgctagctctactaatagttagttgggaatccgtagtagtagtagtagcaaggaggccctttcctccaactgatggaatgtcccatccaggccccaaagcggcaccaggaccagggccagtgtcttcaccatctaatactgtagagccagaaaagggtttaatggaagaagcatactactatagaggagtgagcaaaatagggtcaagtccaccaagttgtgagcacaagtgttatggttgcactccatgtgaagcgattcaagtgccgagcaccagcagcaggcgcagtcatttgggattgcagtacacaaattatgagcccgaaagttggaaatgcaagtgtggtccttccctctacagcccgtga

SEQ ID NO: 3850 - DNA, 1236 bp, Glycine max var. Williams 82
atgtcagattatcttcctgaagcattggtgctgcaaatactgtatcgcctaccacccacaacccttgtgaaatgcacctcagtgtgcaaagcatggaataaaatcataagaagtcacgacttcatatcctcccatctcctacactctctctccaaccacactctttctctcctcttcccacactacattttttataactttaacgagctacgcttccgttcctccggcaccattaataccagaaacgactttcacacaattgcaaaactgtgctactcattccatgttgtaaatactgttaatggtgtcatttgtctttctcgtaacagatcaagccacacatcctacaccgatcttgtcatcttatggaacccttttattcgaagacacatccaacttccaacaccctatttcgctttcaaaacgttgctgtgtagctattaccagcttccttctatgttctttgtcgggtttgggttcgactccaaaacaaatgactacaaggtggtcagaatttgttatctcaaatactatgaaaataacgatcctcctttggtagagttgtattccctcaacgagggggcttcgaggatcattgagacttcctctattgatgtaagaatagagagccgtctgttgtctcaatgttttttacatgggaatgtgcattggattgccttcgagaatcacatgcgtgaactacattttcaatattgtgtgctcatattcaatgtggaggaggagaatttcaagaaaataaggcttccaatagagttgagtacattacgttcacatgatgacttgaccatttctgtgatcaatggttgtctatcagttatacattatgcttgtgaccgcgaacgagcaacccatacggtttttaacatatggatgaagagagagccagagttatggaataagatgtacaaagttaattattttcaaacagtatttgatagtgtttcattggcatcaagtacaagtgatgagatttttgagtttccattgtgtggacaatttgttcctttgggcttggttgaatatgacagagaagagattaccaaactccgaattcaaagtagagcataccatttatttttcaatgaatacacaccaagcttggttttgtttaatagagaaaatggtccaatttggtgccctattagtaagaggtgtctattccatctttcggggagaaaagttcgcaattgcatagctttccccttgcttcgttag

SEQ ID NO: 3851 - DNA, 1143 bp, Glycine max var. Williams 82
atgttaagagaaaaaacacaactcacatacattcagacacacactcacactgacaaacacacaataatgtccagccataatgggatgcatcacaacaacgttgttgaagaccatgaggctctcatgtaccaaaactacccgtgtgcatactacgtccaaagcccctccactctctcccacgccaacagcgcagatattcgcagcaacatccaaaacgacgccgaatccaccttccactccccgaaccgatccgaaacaacccacccgctaaacccgacccacgaagaggacgaagcctcgcgcttcgccctctgccgctacacctcctcccgtggctccagccactccttcttgcaccacaagaagatctcctacgacgggagtcacgccaccgccaccgagaacggagacgttaatcgtctcgttatcatcgatggcggtggtgacgacaagggagatgagaatgagaatgtggaggaagggtcgttttatgagtactattatgggaagagaaaaggagggtggaagaggttcttctcttaccgcaactctgattcttgtgcttggatttggttgcaaatgggttggagaattttggtgagcttcggaattgcgctgcttgtgttctacattgctacaaaacctccaccacccaatgtctccgttgagatcgcaaggtttccagaatttaaactagcggaagggattgacagaagtggcgtgacaacaaagatcctgacctgcaattgttccttgaatttaatcatagagaataaatccaggttctttggtcttcacattcgtcctcccacgatggacatgaaattttccaacttaccctttgcattttcaaatgcccccgagctctatgctgagagtggcataacaatctttgcattacaattgggagcaaagaacaagcccatgtatggtgcaggaagaagcatgcaagatatgctagattctggaacaggattgcctctagtaatacgtgtaatcttgagctctagtttcaaagtggttcctagcctcataaagcccaggttccatcaccatgctgaatgtttggtgtttctcaagaaggcttacgacaaaaaacatcgaaccctagcatttgatagcacctgtaaagtaacatcttga

SEQ ID NO: 3852 - DNA, 1260 bp, Glycine max var. Williams 82
atgactatttctaatgaaaataaagcaccgagaaggttggaggggaaatttcaagcaacggtggtgtgtttcattcttggattggggtcccttgttgcatggaacagtatgttgacagtaggagattattactacaatctgttccctacataccatccttcccgtgtactcactctcatttatcaaccatttgcacttgtaactatggcaatactggcgtataatgagtcaaggatcaacactaggaagcggaacttaattggctacactcttttctccattagtactttgctagttcttgttttagatctagcaacatcagggaaagggggaattggaccttacattggtttgtgtgcactttctgcttgttttggagtcgcagatgctcatgtccaaggtggcatggttggagatttgtcttttatgtgtcctgagttcatccagtccttctttgctggtttggctgcctcaggagctctagcttctggtttgagacttctcaccaaagtgggttttgagaaatctgatcatggtcttcgaaaaggggctatgctattctttgcaatctctacactttttgaattcttctgcgtaattctctacgcaatatacttccctaagttgtccatagtaaagtattaccgttcaaaggcagcttcagaaggatcaaaaactgtgtcagctgatcttgcagctgccggcattcacaatgacaccaacctgcaagttggatttgatgctaaacagcaagaacggttgagcaataaacagctaattcttcagaacatggattatgcagctgatttgtttctgatatatgtattgacactgtcaattttccctggattcctgtttgaaaatactggatctcaccagctaggaacatggtacccacttgttttgattgcaatgtacaacctattggatctaatatccagatatattcccctcatcaaatgcctgaagttggaatccagaaagggcttactcattgcagtgctttctagattccttttggtcccagcattttacttcacagcaaaatatggtgaccagggatggatgatccttcttgtgtctttcttgggactaaccaatggttatctcactgtttgtgtatttaccgtggcaccccaaggttacaagggccctgaacagaatgcattgggtaatttgctcgtgctgtttcttttaatcggcatattttctggggttgctcttgattggttgtggctcataggaaaatcaggattctaa

SEQ ID NO: 3853 - DNA, 507 bp, Glycine max var. Williams 82; identical to SEQ ID NO: 2715

SEQ ID NO: 3854 - DNA, 3276 bp, Glycine max var. Williams 82; identical to SEQ ID NO: 2701

SEQ ID NO: 3855 - DNA, 219 bp, Glycine max var. Williams 82; identical to SEQ ID NO: 2810

SEQ ID NO: 3856 - DNA, 1260 bp, Glycine max var. Williams 82
atggatcctctccctgatgccattcttcaatacatcttgtcccgtatcaataacgctcgcgatgtggcagcttgcaattgtgtttctaagcgatggaaggactcaatggcttacatcagaactctctacttccctcgcaactcgtttgataacccttctctccgtgaaagtccggacgacatagtgaaaagaatggtatcaatggttgtgcgattagaagagctagttgtatacggccccttctccccttccggccttgcttcgtggctatcacttgttggtatgtctctttctcagcttgagcttcgaatggacaatcttgctgacaaccaagcctcccatgaaagcccttcaaaattggattgcattggtgcagcaaggaatttggaatctctaaaactatggggtgtcttaatgatgcattccccaaaatgggatgtcttccaaaatcttagaacccttgaaatagttggtgcaagattggaagaacctgtattgactgtggtgtttcagtcatgtccatatctgagaaggttgaaactgcttggatgtgaaggggtaggatcaatctcaattgaccttccctatttagagcagtgtaagctggatttttatggtctggggaactgttcacttacgctatcctccccgaaaattgaatcccttgaggtacaaggctgtagttggattagggttcctgaaacccagcatttgaggaatctttcaatatccaatagcgcagggagagtatatatggtggatttcggaaaccttccagctctggagttcctgactatgaggggggtccagtggtgctgggatgcaatatgcaaaatgctgaaaatggcaagtgaggtgaagcatatttatatgaaggtggaattcactggggactatgaggctcttcaaccctttccagagattgattttgttgattttttcaacaaccatcccaaactgcgcaagtttgacattcatggagccatgtttgcagcactttgccagaggaacagcctgaaacatgtggatccaggatttttaattccatgtttggaggaggttgtgatcacagtgagatcaccactaaatgccgaacaaaaaatgagtactcttgaatccttgttgaagtatggcaaaaatctaaggactatggttatcaagattcttcagatgaagagctcccatagcagcgctgatgatttttttgatgagatttgccggttgagatacatgaaccatggaatagttcgaatagaataa

SEQ ID NO: 3857 - DNA, 1080 bp, Glycine max var. Williams 82
atgatgaactttcaagcatgttcaaacaccatctcaaacttgttctatgtttgttttgtccttttaccaaccatggccttaggagattgcacttgtgacacaatagaggccacaaagagtgactcaattgaagtcctccactacaaaattggctcaattgcttctgtgcttgttgctggggctcttggggtgagcctcccattgttgagcaagagaatcccaacacttaaccccaagaatgacatattcttcatggttaaggcctttgctgcaggggtgattcttgcaactgggtttgtgcacatacttccagaggcatatgagagcctaacttcaccttgccttaaggaaaatccatggggaaagtttcccttcactggatttgttgccatgttgtcctccatagggaccttaatggtggactcatttgccacagggttttatcataggcaacattttaacccctctaagcaggttcctgctgatgatgaggaaatgggagatgaacatgctggtcacatacatgttcatacacatgccacacatggtcatgctcatggatcagctgtgtcctctgagggttcaattacatctgatgtaataaggcagcgcatcatatcacaagtgttggagataggaatagtgatccattcagtgatcattggaatatcattgggtactgcaggcagcattgataccataaagcctctcctcgtggccctgtctttccatcaattttttgagggtatggggcttggtggttgcatatctcaggcaaagtttgagtccaagtctatggcaattatggcaacctttttctcactgacaaccccaattgggatagcaattggaatgggggtgtcaagtgtgtacaaagagaatagccctactgctttaactgttgaagggattttcaattctgcttctgctggaattttgatttacatggcattggtggatttgctagcagctgattttatgagcccaaggttgcagaaaaatttgaagctccaactaggggcaaatatttcccttctcttaggagcaggttgcatgtctctattggccaaatgggcttaa

SEQ ID NO: 3858 - DNA, 309 bp, Glycine max var. Williams 82; identical to SEQ ID NO: 2765

SEQ ID NO: 3859 - DNA, 405 bp, Glycine max var. Williams 82
atgaatggtatcatggatgtgtcatcgtggttgcttattgaggacagtgcagattctgaaggagactctggctgctttagtctatgcccttgcaacattggccacaaggaggatgatgctgaatcttgtacctgtgacccagctggtatgtgtggcatatttgaggatggtgaaggtcatgaaggtgagaaggggtgtggtgaattctgtgctgatgaagatgagcattgtggttcagaatggaacagctctaccatgtggctctcagatgcagccttagaaatagaatgctcttcacctttggttgttgaagatgaagaggaaacaaggattgttaaagttaatgtgaatgatgtggaagataaaatattttgggagatatgcatggcagtagggtatccttga

SEQ ID NO: 3860 - DNA, 561 bp, Glycine max var. Williams 82
atggacggaaacaagctcacctcacatgtggcggatgatagcatttcgtattcattggactcgctctcttttagtggccttgtttgtattcaagaccaccaaccaaagctcccttctcctaaccgggctaaacactaccaggtaagcaagcatgacccagaatttgaatttactagcactaaagcaaatttgaattctgctgtcaatccaatcaagatcactcctgctgaccaactaatttccaatggtcggcttcaaccacaagcactggccatccaaacaaatcagtctctgctcacaaatctacccagttcctcaagctcattactagcaacccgtagcagcagtaagatgccaagtggtagaacagacagcaaaatgaaatatcacgaacaacttaacaaagcaagcaaacatacaaacaagaaaagcacggtgacaaggacagggtttggccagaaaatgaagtcttttctatcaccatgccgtgaatgccaaaccattaagcaaggtgctgttaaagcacaaactgttccaggagaaaatctcaaaatttactga

SEQ ID NO: 3861 - DNA, 2067 bp, Glycine max var. Williams 82
atgatgaagcattaccatgtcttgtacatgtttttatttttcttaccaatttctacgttaagtctccaccacaatgacactcatgcactcacccttttccgtcgccaaagtgacctacatggctaccttctttcaaattggacaggccatgatgcttgcaactccgcctggcgcggcgttctttgctccccgaacggccgcgtcaccgccctctccctcccttccctcaacctgcgtggcccactagaccctctcactcccctcacccaccttcgcctcctcaacctccacgacaaccgcttaaacggcaccgtttcaaccctcttctccaactgcaccaacctccaactcctctacctcagcagcaacgacttctccggcgagatcccgccggagatatcctccctaaaatccctcctccgcctcgacctctccgacaacaaccttcgcggcaaggttgatgtcatatccaacttaacacaactcataacactgagactccagaacaaccttctctccggcgagatccccgacctctcttcctccatgaaaaatctcaaagaactcaacatgacaaacaatgagttctacggtcgcttaccatcccccatgttgaagaaattcagttctacaaccttctccggtaacgaaggattgtgtggtgcatcattgtttccgggttgctccttcaccacaacccctcctaacaataatgatagcaacaacaataatgataataatagtaatgagaaggaaccgtctcagacagtttcttcaaatcctagctccttccctgagaccagcataatcgcccgtccagggagggagcagcagcgcaagggcttgagtcctggtgccattgtggccatcgtgatcgcgaattgcgtggcactgctcgtggtagtgtcgttcgcggtggcgcattgttgtgctagagggaggggttcgagtttggtggggagtggggagagctacgggaagaggaagagtgagagcagctacaatgggagtgatgagaagaaggtgtatggtggtggtgagagtgatggaaccagtgggactgataggagtaggcttgtattttttgatcggaggagtgagtttgagttggaggatttgcttcgagcttcggcggagatgttagggaagggtagtttagggacggtttatagggcggtgcttgatgatgggtgcacggtggcggtgaagaggctcaaggatgcgaacccttgcgcgaggcatgagtttgagcagtacatggatgtgattgggaagcttaagcatcctaatgttgtgagactcaaagcttattactatgccaaggaggaaaagcttcttgtctatgattatctctccaatggaagcttgcatgctcttcttcacgggaaccgtggcccgggaagaattccattggattggactacaagaataagcttggtgttaggagcagcaagaggtcttgcaaagattcatgcagagtacagtgcagccaaagtgcctcacgggaatgtgaaatcctccaacgtgcttctagacaagaacggtgttgcatgcatctccgattttgggttatcactcctattaaacccggttcacgccattgcccgattgggagggtacagggccccggagcaagaacagaacaagaggctatctcagcaggctgatgtgtatagtttcggagtattgttgttagaagttctcacaggaagagctccttcatcgcagtacccttcaccggctcgtccccgaatggaggtagagccggaacaggctgcggtggaccttcccaaatgggttcgctcggtggtgagagaagagtggactgcagaggtttttgatcaggagttgttgcgctacaagaacattgaggaagagcttgtgtccatgttgcatgtggggttgacttgtgtggtggcgcagccagagaagaggccaaccatggaggaagttgtgaagatgattgaggagatcagggtggagcaatcgcctcttggggaggactatgatgtatcatgcaattcgctttcgccttccattcccaccactgaagatggtctagcttag

SEQ ID NO: 3862 - DNA, 357 bp, Glycine max var. Williams 82; identical to SEQ ID NO: 2490

SEQ ID NO: 3863 - DNA, 1422 bp, Glycine max var. Williams 82; identical to SEQ ID NO: 2472

SEQ ID NO: 3864 - DNA, 1128 bp, Glycine max var. Williams 82
atggattcaggtttctacttggtgtcatcactgaaccaccaagaagtagtccaaagccgtttcttcgatccctcttggctacaaatgcaaccccacgttcccatgagctttgtttggcccaaagagtgcttagtggacgcgaacgaggagttccacgctccaatggtggaccttggagggttcctaaggggtgatgatgacgaggccacaagccgagccgttaggctcgtgcgcaaggcgtgctcgagccacgggtgcttccaagtgatcaaccatggtgttgattcccgtctcatcagggaagcatatgatcaaatggacgctttttttaagctttcgattcgtagaaaagtgagtgctcgaaagactccaggttcagtatggggatattctggtgcccatgctgataggttctcctccaaattgccttggaaagagaccctctcttttccctttcatgacaacaatgagttagagccggttgttactaggttctttaacaacaccttaggggaagactttgaacaagctggagtggtattccagaattattgtgaagccatgaagcagttggggatgaagctgttggagcttttggcgattagcttgggagtggataagttgcattataaggacttgtttgaagaaggttgttccgtcatgagatgcaacttttacccatcatgtcagcagccaagtcttgcattagggactggaccacattgtgacccaacatctctcaccattcttcaccaagaccaagttggagggcttgatgtgttcgccgacaacacgtggcagaccgttccacctcgtcccgatgcccttgtagttaacattggtgatactttcacggcattatcaaatgggagatacaagagttgcctgcacagggcagtggttaacaagtacaaagagaggaggtccttggcattctttctgtgccccaaagaggacaaggtggtgagagccccagaggatattgtgcgtagggatgggacaaaacagtatccagatttcacatggtcgagtttgcttgaattcacacaaaagtactacagagccgacgaagctacactgcagaacttcaccaagtggttgctatcctccaaacaacaaaccctttag

SEQ ID NO: 3865 - DNA, 1119 bp, Glycine max var. Williams 82; identical to SEQ ID NO: 2595

SEQ ID NO: 3866 - DNA, 456 bp, Glycine max var. Williams 82
atgatgatcatcatcatcattgctttcatgccctcacctcttctttcatcatattcacaacaacctattcccaaagttcccacactctcatcttcaccagcaacattaacagaccctcctccatctccacatctatcttcactctctcctttccaagagttgtccccagacattgctccactgttgccttctcctggtggtgtgttgccaactcctgctgctggctctgacattcccactattccttccaatccaagccctccaaacccagatgacattattgctccaggacctctttctgctttctcaccatttggatcgccactttcttccaatgcccctacaacaagtctagttgctagcatagccactgctttttttgctggtttagcaaggcccatgattgaactttttaagagtctttttgcatttcaagctttctctttgcgtatatag

SEQ ID NO: 3867 - DNA, 2904 bp, Glycine max var. Williams 82
atggcgaacaggaacctggaaaagatggcatccatcgatgcacagcttaggcaattggctcctgccaaagtgagtgaggatgacaaactgattgagtatgatgctcttctgttggatcggttccttgatattcttcaagatttacatggggaggatctgaaggaaacagtccaagaagtatatgaactttcagctgagtatgaaggaaagcatgaccctaagaaactggaagaacttggaaatttgataaccagtttggatgctggggactctattcttgttgctaagtccttttcccacatgcttaatttggccaacttggctgaagaggtccagatttctcgccgccgaagaaacaagttgaagaaaggggattttgcagatgagaacaacgcaactacagaatcagacattgaagaaactctcaaaaaacttgtatttggcttgaagaagtctcctcaggaagtttttgatgcactgaaaaaccagactgttgatttggttcttactgctcaccctactcaatcaattcgtagatctttgcttcaaaagcatggaaggataaggaattgtttatctcaattgtatgccaaagacatcactcctgatgataagcaggagcttgatgaggctctacaaagggagattcaagctgccttccgtacagatgaaatcaggaggacccctccaacaccacaagatgagatgagagcagggatgagctacttccatgaaacaatttggaatggtgttcccagatttctgcgccgtgtagacacagctttgaacaatatagggattaaagagcgtgttccttataatgctccccttattcaattttcttcttggatgggtggtgatcgggatggtaatccaagagtaactcctgaagtgacaagggatgtttgcttattggctagaatgatggctgctaatttgtattattcccagatagaagatcttatgtttgagctctctatgtggcgctgcaatgatgaactacgcgttcgtgcagaagaacttcacaggtcttccaagaaagatgaagttgcaaagcactatatagaattctggaaaaaggttcccccaaatgaaccatatcgtgtggtacttggtgaagtaagggataggctctatcaaactcgcgagcgttctcgccatttgctttctaatgggtactctgacattccagaggaagccactttcaccaatgttgaggagttcctagaatctcttgaactatgttatagatcactatgtgcttgtggtgatagagcaattgctgatggaagccttcttgatttcatgagacaagtctctacttttggattgtcactagtgaggcttgatatcaggcaagagtcagatcgtcacactgatgtgctggatgccattaccaaacacttggaaattggctcataccaggaatggtctgaagagaaaagacaggaatggttgttgtctgagttaagtggcaaaaggcctctgtttggacctgaccttccccaaaccgaagaaattagagatgttttggacacatttcatgtcatagcagaactaccaccagacaactttggagcctatatcatatcaatggcaactgcaccatctgatgtgcttgcagttgagcttctacaacgtgaatgccacatcaagcatcccttaagagttgtgccattgtttgagaagctagctgatctagaggctgctcctgctgctttggcacggttgttctcgatagactggtatagaaataggatcaatgggaagcaagaagtgatgattggatactcagattcaggaaaagatgctgggaggttctctgcagcatggcagctatataaggctcaggaggaacttataaatgttgccaagaaatttggaattaagctaaccatgttccatggtcgcggtggaactgttggaagaggaggtggacctactcatcttgctattctgtctcaacctccagacacaatccatggatcacttcgtgtgacagtccaaggtgaagtcattgagcaatcatttggagaacaacacttgtgttttagaacactacaacgtttcactgctgccactctagaacatggcatgcaccccccgatttctccaaaaccagaatggcgtgctttgatggatcagatggctgtcattgctactgaggaataccgttccattgtattcaaggaaccacgctttgttgagtatttccgcctggctacaccggagttggagtatggaaggatgaacattggaagtcgaccagcaaagagaaagcctagtggaggcattgaaacactgcgtgcaataccttggatttttgcatggactcagacaaggtttcatcttccagtgtggctaggctttggagcagcatttaaagaagtcattgagaaaaatgttaacaatctcaatatgctgcaagagatgtacaatcaatggcctttctttagggtcacacttgatttggtggaaatggtgtttgccaaaggagatccgaaaattgctggtctgaatgataggctccttgtttcaaaggatctgtggctgtttggggatcaattgaggaacaaatatgaagaaactaagaaactcctacttcaggtggctggacacaaggaaattcttgaaggggacccttacttgaagcaaagactcaggcttcgtcatgctcccattaccaccctcaatattgtccaagcttacacattgaaacgtatccgtgatcctaactacaatgtgaaggtgcgcccccgcatatcaaaggaatctgcagaggcaagcaaatcagctgatgaacttataaaactgaacccaacaagtgaatatgctcctggtttagaagacaccctcattctcactatgaagggtattgctgctggcatgcagaacactggttaa

SEQ ID NO: 3868 - DNA, 774 bp, Glycine max var. Williams 82; identical to SEQ ID NO: 2453

SEQ ID NO: 3869 - DNA, 486 bp, Glycine max var. Williams 82
atgatgtccccatgcaatgtgatcctatccatttttttcttggtgtgtacaagaacaccactactgtccctagcccagaacacccctcaagactttcttgatgtgcacaatcaggctcgtgccgaggttggcgtgggtccactctcatggaaccacacccttcaagcctacgctcaaagttatgccaataagagaatcccagactgcaacctcgaacactccatgggacccttcggcgagaacatctccgaagggtacgccgaaatgaagggttcagatgctgtcaaattctggctcactgagaagccttactatgaccaccactccaacgcttgtgtccatgatgagtgcctgcattatactcagattgtgtggcgtgattctgttcatcttgggtgtgctagagctaagtgtaacaatgattgggtgtttgttatttgcagctattccccaccggggaacattgaaggggaacgaccttattga

SEQ ID NO: 3870 - DNA, 753 bp, Glycine max var. Williams 82
atgacattatcaagatggatttgtgctaataattcaaaaacccagcttctccagattgtccatgctggtggccatgttgaactccatgacagaccagtgactgcagcagagataatgtgccgctatccaagatgccgtgttgcatatccatatgtgttccagcaaccatgggcagttgctgaaccagagacagtgctcatgcttggacaaaagtactatgtaattccaaatagcacaataagaaagcttcaaaggctttctccaagaagctctccttctccttcttctcctgctcatgaaattacaatcagttcttcagttgatgaaattagaaacacaaaatccagcaaagaggaaaatgatggtgtgctctccacttgttgtgtcttcaggaataaaagcagtgcaaagcaatccaatatctacaagcaatactccaaaaataagatcaagaaatctgaaatcagagcagatgtaagaaatttgagtctaaatattaatgataagagtggtggtttatcacatgatagttgtttcgtgagtctgtttaatggaggcaggactaaagcaaatgctagtgatgtggcaaaagaaacaagaacaccatcaagcagtgctcacctttgtgatggcaatacattaaccaggaagaggacaaaagattttacaggaaatgggttaagaagctctcctaagaatgtatggtcttctgagcattggcaaccgagtctagagagtatcactgaagaatga

SEQ ID NO: 3871 - DNA, 411 bp, Glycine max var. Williams 82
atggcagaaaaggaaggaggagttgtgaagaagggtcacgaggaaggcctaaaactcgcggcttcgctgctgcaagaattcgagcttccggaggggcttctccctctggccgatgtcatcgaagtagggtacgtgaagggcacgggatacatgtggatagtgcagaagaagaaggtggagcatgagttcaagttgataagcaagttggtgagctatgacactgagataaaagggtatatttctaagaagaagataaagaagttgaagggtgtgaaggccaaagagctcatgctgtggccaccagtgagtgagatcactgtggatgaccctccaactgggaagattaacttcaagagtcttgctggtatcaccaagactttccctgttgaggcatttgctgctggccagtga

SEQ ID NO: 3872 - DNA, 756 bp, Glycine max var. Williams 82
atggacaaccaacgtagccctcttctaagttgggcttactacttccagggaaagtcaatggaggagctgaggcagtccctgatatacacaactctggagctagaacaaacaagggttgcagtgcaagaagagcttaaaaagagggatgaacaactactcaacctaaaggacctcctgagcaaaaccataagagagagagatgaggcacaagagaaatgccagagacttctcttggagaagctagttttccaacagcagctacaacatgcagctcctgtgtctggaatttcaagcattgaggatgagccgagaagaggaattgactccaacaatggtcattcatcatcagattgtgaagaaagcatcgtttcctctccagtcattgaccatttacctcaacctcaaccacaatcaatgattgaactaacaccagacaaaccattaccagaaaagggtaagcttttgcaagcagtgatgaaagctggtcctctccttcagacccttctccttgcaggacctcttcctcaatggagacaccctcctccaccacttgagtcctttgagattccacctgtcaccattccctcaccaccaccaccaccactacaactactccaccaagacactttttttaacaaaaccaacggtagcagcagtaccacaaccaactgtggaagactcagtagaaaaagggtcttctgtgatggctctgattctcctaccgagaccaagtaccaaaggcttgtacttcactga

SEQ ID NO: 3873 - DNA, 528 bp, Glycine max var. Williams 82
atgaagcattgcatctcaaaacattttctaagttgtttcgctttgtttctgttgctagtcgcaacaacctatgccactgttgtccctaccaccacccaaaagccaccaagaagctttgcaaaccaattcctcatcccccagaacgcggcacgtgcggtgctgaggctgcggccattggtgtgggactccaaattagcacactacgcgcaatggtatgccaaccagaggcgcaacgattgtgccctagagcactccaacggaccttacggtgagaacattttctggggcagtggcacggggtggaagccagcacaagctgttagtgcatgggttgaagagcgccaatggtacaattattggcacaattcttgtgccaatggacagatgtgtggacattacactcagattgtgtggagcaccaccagaaaaattggttgcgctagcgttgtttgctctggtggtaagggcaccttcatgacttgcaactatgatcctcctgggaactactatggagaaagaccttactga

SEQ ID NO: 3874 - DNA, 756 bp, Glycine max var. Williams 82; identical to SEQ ID NO: 2504

SEQ ID NO: 3875 - DNA, 855 bp, Glycine max var. Williams 82
atggatccccaaggaaatacaatggattctgagtcaactatagcaggcaaaaggaaaaatgataaagtgttgaattcttatactgatgaaatgaagatggtatctgctgcttctatcataaatgaagattttagttcagaaatttctaaattttctttggatggaactcaagttcgtagtttaaagaaaagactaattgttcttgatataaatgggttgttagcggatgtagtttctcctcctccaaaggatcacaaagcagatgcaaccattgcgaggagagcaatattcaagaggccctcgtatctcaagtttctggagttttgcttcgataaatttgaagttggcatatggtcttcaagaatgaagaaaaatgttgatggagtcattgattatttgatgggagacatgaaaaacaggttgcttttctgttgggatctttctcattgcactgaaacaagcttcaaaactcttgaaaataagcataagagtgtgacttttaaggatttgaggaaactctgggataaacatgatcttaatcttccatggaagaaaggacatttcaataaaacaaatacattattgttggatgattctccttataaagcattgcttaatcctccaaacacatcggtcttccctcgtacgttcacttataaggatggaagcgacaactccttagctgaaggaggggagctgagagtatacctagatggtttgacaaatgctgaagatatgcataagtatgttgaggaacacccatttggccaagaaggcattagtgaaacaagtgaatgttgggacttctatcgccaggttattgatagtctttctgcaggtcaaagcaacccttaa

SEQ ID NO: 3876 - DNA, 552 bp, Glycine max var. Williams 82; identical to SEQ ID NO: 2454

SEQ ID NO: 3877 - DNA, 897 bp, Glycine max var. Williams 82; identical to SEQ ID NO: 2542

SEQ ID NO: 3878 - DNA, 2100 bp, Glycine max var. Williams 82
atgtgtaaggttcgagggtgttatttttggtgttttatatgcctaaaaatgatgtggaaaatattaaagataaaggtcataacagagtatgtatttgattatagccatagaataagaaaatacatgtttccttattgtgcgtttgtgtgccaggtccgtagtccagtcaatgtgatggatttggacgatataatgtcagagttggaaagtagtgacaatttttgtagcttcgtgaatggtgatggtgacaatgatgttactgaagtgtatccaaatgatgatgatgaccaacatgatgtcagacttgaagatgaggacgaggtggattcggaggtacacaacgacgatggtggagattatgatgatttctggattccaggtttgttgaaagaggaatgcataagtattgatagcatgatagatattagacaatttgacatggaagaaattaccgatgaagttgtccgcaggttggattttggtgatttggagttagcgtatcagttctattgttggtatgctaaaagtaatggtttttctataaggaagagtcatattgttagaaacacatgtatgaaaacactacaacaaacatttgtttgttcatgtgcgggttataggagagtttcaacatcagatagaaggatgcagcgagaaaaaaaagaaagcaggtgtggttgtgaagcaatgttttgtgttcataattttgaccacaatcatttattattggacctaaaattgtcatgtttgttgctaggacataggaagatgttcgcatttgatattatgcaagttgaaaactatagaaaagttgggattagacctccacacatgcatgcaacatttgccaatcaatgtggtggatatgacaaggtgtggtttattaggaaagatatttacaatgaagaagggcgcatgagaaagcaacatacttcagatggaagtggtgcattgaagtatttacatgatttacgcaagaaagatccaatgatgtatgtttcgtacaccgcggatgaagggtcaggactacaacagttgttttgggacgttctggcatttgatgccacttataaggaaaataagtatttgtgcccttttgttgttttcactagtgtgagcaaccataatcagacaatagtttttgctgctgctgttgtaactgatgagacggaagaaacatatgtttggttgttagaacaattgttggtagcaatgaaaggaaaaactcctagttcaataataactgatggctatctagctatgaggaatgctataacaagaatcatgttaggtgtttttcacagattgtgtgcatggcacttattgcgtaatgcattgagccatgttcgagacaaacaagttttgaaatggttgaagaagctaatgcttggtgattttgaagtggtcgaatttgaagaaaaatggaaagagatggttgctacgtttgaattggaagacaatacttggattgctgaactgtatgaaaaaaggatgaagtggtctcccgcccatttgaggggttatttttttgcgggcatacagacaacatctcgttgtgaagccttccatgcacatgttgcaaaatatgttcattcacgcactaatttaaccgatttttcgtatctatgtaggactattaagctaagagtcgtcgattgcaaagagatggtggcattctcaatttacacggttgtcaagtactgtagtggaagtgtttggcttgtgtcctattgcccatcgacggttgactttagtcgtagttgtatgagaatgaaatccattggtcttccatgtgatcacatattagttgtgttggtttctttaaattttatggagttgccaagtagtttggttttgagtaagtggtcaaaagttgccacagaaaatatcaaagacaaatatctggattctgcaatgtattgggattcccaattgatggccaggtatgccactttggttgaagtgtctagacaagtttgtgaagctgcatactgtgatgaagaggagtatgacaaaatgttgcatttcctatccaatgaggctagaaggcttaagtccaagaaaaataggcaaccttgtgttgatgataacaatgactag

SEQ ID NO: 3879 - DNA, 816 bp, Glycine max var. Williams 82
atgtttttgacacgtttgaacttggtcggcaaaggtttatccaaagatgacaaagcacaaaaactagccctgcaacattggcgtgaagctattgacccacgtcatcgttatggacacaatttgcacatgtattatgatattttgctagtttacaaaaaggacggtaggctagtggacactgatgagaaatccaaatggatatttgttcttagcaccacaaggaccttgtatgtggggcgaaaacaaaagggtacgtttcaacactcaagctttctttctggcggtgcaaccacagcagcagctggtagattactggcccatcaaggtgcccttcagaacttcaaagaatttataagctttcttgaggagcacagtgtagacctcaccaatagatgtgctatagatgatgatactccatcacttattgggactaattcatttactgccactaatgaatcacaacaaaatatggaccctactctaaattctcacacaggcccagcaagtgcaatcaatgccaatgatagcaacatgcacaaaaaggatgatgcagcaacatttaacctgtctaagaggttgccttgcaagtggttcactggggctggacctcgtattgggagtgtccgtgactatgctggacacttgcagtcgagagcgttggagcaggtcaatttgtttccaaggcccacttctgcacgcttgagcagctatggcccaattccttcacccaggcccagtccaaaagtgaggatgccccccaggcttgcttacataggcttgcccagtccaagaaacccaattccagctgtaagttaa

SEQ ID NO: 3880 - DNA, 243 bp, Glycine max var. Williams 82
atggaggaaggaatcaaagatggaacaccaagaaaagaaaacctcgttggttcttctcacaaaggtggctccgcaagaatcccaggtctctctaagccagagaaccgtgttgctggtaatggctatgaaaatgtgcttcatcaagcagccaagaacagtaatgttgatgctgctgatagatttaaaaaagctgaagaatctcttagaactgtcatgtacttgagttgctggggtcctaactaa

SEQ ID NO: 3881 - DNA, 207 bp, Glycine max var. Williams 82; identical to SEQ ID NO: 2443

SEQ ID NO: 3882 - DNA, 552 bp, Glycine max var. Williams 82; identical to SEQ ID NO: 2449

SEQ ID NO: 3883 - DNA, 1074 bp, Glycine max var. Williams 82
atggctgatgcttctgtggcaccaccacctccactgaaagatgagcttgacattgtgatccccaccataaggaaccttgactttcttgagatgtggaggccattctttcagccttaccatttgatcattgttcaagatggtgaccccaccaaaaccatcaaggttcctcctggctttgactatgagctctacaaccgcaatgacatcaacaagcttttgggtccaagggcctcttgcatctccttcaaggactccgcgtgtcgctgcttcggctacatggtgtccaagaagaagtacatcttcaccattgatgatgactgctttgttgccaatgatccatctggaaaagcgatcaatgcactcgagcagcatattaaaaaccttttgtgtccatccactcccttgttcttcaataccctttatgaccccttcagagaaggtgcagattttgttcgtggataccctttcagtcttcgtgaaggtgtgccaactgctatctcccatggactttggctcaacatcccagactatgatgctccaacacagcttgtgaagcctctcgagagaaacactaggtatgtggacgctgttctgaccataccaaagggcactttattccccatgtgtggaatgaacttggcattcgaccgtgatctcattggaccagcaatgtactttggtctcatgggagatggtcaaccaattggacgctacgatgatatgtgggctggctggtgctgcaaggtgatcactgatcatttggggctaggagtcaagactggtctgccctatatctatcacagcaaggccagtaacccatttgttaacctgaggaaagagtacaaaggcatattctggcaggaagacatcattccattcttccagaatgttgttcttccaaaagaatgcaccactgttcagaagtgctacattgagctctccaagcaagtcaaggaaaagctctcaaagatagatccttacttcgacaagctggctgatgcaatggtcacttggattgaagcttgggatgagcttaaccctgaaggagcatctcaggccaatggcaaagcataa

SEQ ID NO: 3884 - DNA, 1335 bp, Glycine max var. Williams 82
atggatgcatcttctttgcacatagcaatgtttccatggtttgccatgggacacctaaccccatatcttcacctctccaacaaactagcaaagagaggacacagaatctccttcttcatccccaaaagaacaccacacaagttagagcaattcaacctcttcccacatctcatcaccttcttccctatcaacgttcctcacgttgaaggccttccccatggcgcagaaaccacttccgatgtctctttctccttagctccactcattatgacagccatggatcgcactgagaaagacatagagcttcttctcattgagctaatgccacaaatcgttttctttgacttcacatattggctaccaaacttgactcgccgcttgggaatcaaatctttttatgatcttatgcaaccccctgaagggtaccctgtgtcttccgtcaagcttcatgcacatgaagtcaagtttcttgcttctaaaagggattgggagtttggaagcggtgttctcttctaccaccgtctcaacaagggtttgatcttttcagacgctgttgggttcaaaggttgccgagaaattgaagggccttatgttgagtatcttgcagaacagtttgggaagcctgttttgctttcaggacctttcatacctgagccacccaacactgtttttgagggaaaatggggttcatggcttgaaaggttcaagcttggttctgtggttttctgtgtacttgggactgaatggaagttaccacatgatcaattccaaggactattgttgggtcttgaacttacagggcttccttttttggctgttctaaaagttccaattgggtttgagacaattgaagctgctctaccagaagggttcaaagaaagagttgaagggagaggaattgtccacagtggatggatacaacaacaattgattttggaacacccttcagtaggctgcttcattacgcattgtggtgctggttcattaaccgaggcactagtaaataagtgtcagatagtgttgctgccgcaggtagatgctgatcatatccttaatgcaaggactatggctacaaataaggttggggtggaagtggagaagggtgaagaagacgggttgttcacaaaggagagtgtgtgcaaagctgtgaaaattgtgatggatgatgagaatgagcttgggagagagataaagactaatcatagtaaagtgaggaagttcttactgaaccacaagttggagtctacctgtgttgatagcttttgccagcagcttcgacatttactcatgatttccaagtttcaagaaactcaactgagattatcatatttctag

SEQ ID NO: 3885 - DNA, 1932 bp, Glycine max var. Williams 82; identical to SEQ ID NO: 2538

SEQ ID NO: 3886 - DNA, 384 bp, Glycine max var. Williams 82
atgtggaactgctgcttgagaaacaagcaagtatcatcacaagataagaatgaagaaggtggtaagaaagttgaggagacaaagacaatttctcgtggcatgaagaagaaggtaaggttcaaaaaagaagatggtgaaggaagtcatcatggtgattctacaagtgggcctgtgaggattaggcttgtggtgactaaggaagaattgaagagggtgttgagagataggaatgagaatgatcctcagcacacttcgttggaggagttactaagcgatatggtgttgagagagaaaagggtgtttgaggttgaaaaaaatgctgggggcataaattcttggaggccagctttagaaagcattccggaggatcgctcaatgaaatag

SEQ ID NO: 3887 - DNA, 708 bp, Glycine max var. Williams 82
atggccaaagacaagtacaggtctttcttgcatgatgaacctgataacgttcagtggagacatggtggccctcccacttatgatgctgttaacaagctttttgaagaaggaagaacaaaggagtggacagaaggatcattggaggagatagtgcaaaatgctattaagtcatgggagatggagctctcacacaagacccgtttgcaggacttcaagacaataaaccctgagaagttcaagctctttgtgaatggcagggaaggattatctggagaggatactctaagcctgggaagttataatgctttgttgcaaagttctctgcctgaagacttgaagccttacaaagcagatgaagagacttttgaatcatctcatgaagcgttcaaatcagcttttcctagagggtttgcttgggaagtgatcaaagtttatagtggaccacctgaaattgctttcaagtttaggcactggggcttctttgaaggtccttttaagggacatgcccctaccgggaagatggcccaattctatggcttgggaactgtcaaggtggatgactctttgaaggttgaagaggtggagatttactatgacccggcagagcttcttggaggccttctttcagggaaccacataaatcacccaattgaagaggatggcaccaaaacttcagcaccttcccaaggatgtcccttctccaaataa

SEQ ID NO: 3888 - DNA, 327 bp, Glycine max var. Williams 82
atggagtcttctgataaagtatcaactgctaaacgccgccaaccatcacctggattttccccagaaaagacagaaaacaaaagaatgaagaatagcctcccatacccacctgagaaacattttccatctgaagttcatgatgattcagcaacaaagactggccaaatcattccgttcactggttctggaagacgtttatttgatggcaaactttgtactcgatcagttgaagaaacctcctcttcaatgctaaatcagacaactaagaaggaggaagaaccaaaatttcaagctttcaccggaaagaagtattccttaattaattga

SEQ ID NO: 3889 - DNA, 1116 bp, Glycine max var. Williams 82
atgatggttagatcgtgttggaagcctattgctgatggtgatgaaggagatgggagtgggagagttgatggacttctatggtacaaggatttggggaaccatctttatggggaattctcaatggctgtggttcaggccaatagttcattagaggatcgaggtgaactagagtctggaccattgggttctaatcacttgggtcctcaagggacctttataggtgtttatgatggccatggtggaagtgaggcctcacagtttgttagtgacaatctcttctgcaatctcaaaaggctcgcagctgaacatcaaggtgtgtcagaacatgttatcaaaagggcttactcagcaacagaggagagttttctgtctcttgtgaagaaacagtggctgagtaagccacagattgcatccactggcacttgttgtttggtgggggtaatttgcaatggcatgatatatgttgcaaattctggagactcccgggtggtgctaggaagattagagagagcaacaagggaaacagaagctatacaattatctacagaacacaatgttaaccaagaatcagtgagagatgaacttcggtcaaagcacccctttgattcacaaatcgtggttttgagacaaaacgtttggcgtgtgaaaggcctcatacaggtttcacgatccataggggatgcatatctgaagaaagcagaattcaacagggatcctctaccagccaagtatagactagcagaaacattcttcaggccaattcttagttgtgagccatcaacatcatcccacacactccaccctgatgatcaatttctcatatttgcttctgatggcttatgggagcatcttaccaaccaagaggctgttaacatagtcagcaacaacccacctaacggaattgctagaagacttgtgaaagctgcacttagagaagcagctaagaagtgtgaaatgagactttctgacctccaaaagattgagcaagggatgaggagacacatccatgatgacataacagtgattgtggtgtttctcaatcccaaactcactgagaatacttctctctgtggttctcctctttcaatcaagggaggtgggtctaccaattcctag

SEQ ID NO: 3890 - DNA, 1758 bp, Glycine max var. Williams 82
atggcgttcattggtgcagtcaaattcttgctgcagcacttacttctattatgcctcttcaactatctacctttttctcaaggtaagcagaactggaatgaagggtacccgtttataagaagagcaagttcattgggttataatgggaaaagtggtgggtatgattatataatagtggggggtggaacagcagggtgtccattggctgcaacactgtcaaagaagttcaaagttctggtgcttgagagaggaggagtccctttcaacaaccctaatgtctcatttctgcacaactttcacattacattggcagacacttcaccaacttcggcttctcagtacttcatttcaacagacggagtcctcaatgcaaggggaagggttttgggtggcgccacttccattaacgctggcttctacactagagcagacccaagatttataaggaaggtggggtgggatacaaagctagtgaatgagtcatatccttgggttgagaagcagattgttcaccggccaaagttttcagattggcagagagcagttagggacgggcttctagctgctggtgtgtctcctttcaacggcttcacctatgatcacaagtatggaaccaaagttggaggaaccatttttgacagatttggccgtcgccacacagctgctgaattgcttgcttctgccaaccctcacaaacttactgttttgatccatgccactgtccaaaagattgtttttgatacaaaaggaaaaagaccaaaagctacaggggttattttcaaggatgaaaatgggaagcagcatgaggcatatctaggaaatgacaggcagagtgaggtgattgtgtccagtggggcacttgggactcctcaattgctattgctgagtggaattggcccaaaagcagagcttcagaaattgaacatccctgttgtgcttgataatcaatttgttgggaaaggcatggctgataaccccatgaacacaatttttgttccttccaagagaccagttcagcagtcactcatagaaactgttggtattaccaatttgggtgtctacattgagaccagcagtgggtttggccagtccaaagacagcattcactgccaccatggtatcttgtcagctgagattgggcagttgtccacaattccaccaaagcaaagatcacgagaagctgtaaaagcttatgtgaagagcaagagagacataccagttgaagcattcaggggagggttcatattgtcaaaagttgcgaacccttggtcaacaggtgagctcaagttgataaacaccaacgtagaggacaaccctgctgttaccttcaactacttcagtcacccttatgatcttaagcgctgtgtggagggtatccgcttggcaataaaggttgtccagacagaacacgtcacaaactacactttgtgtgagagagaaaatgcagagaaaatgcttaacctcagtgtgaaggccaatatcaacctcattcccaagcatcccaatgacacaaagtcagtagagcagttttgtagagactctgtgatcactatttggcactaccatggtgggtgccatgtggggaaggttgttaactctgagcataaggttcttggtgttgatagacttcgtgtggttgatggctcaacattttctgagtcgccaggaaccaaccctcaagccactgtgatgatgatgggcaggtacatgggactgaagattttaagggacaggctggggaaattggctggtatttaa

SEQ ID NO: 3891 - DNA, 897 bp, Glycine max var. Williams 82
atgactaccactaaaagtgaaagcccagctcatcaagaaaagaaaggtgaaaaaatgaaaaactcagcagagaacaaaaaagaagaagaagtagaactaaaaccctcaaagaagaaggaacaacactattatccagtttcaaaaccaccttcagccccaacactacaagactcattcaatatctctcacagccaccactctttcagcgaaggggaccttcagatggtggcggctagctactctctttcttcgctcagcgacggcgccattaaggttgttaaggatgaaaagaatgataagagtttggtggtggcagtgatggatgttgaagaagatgctgaagatgctgatggagtgaacaagaaagagggtaagtggtacgttgttcttttggcactaaggattgctgcttttgtgttatgccaaatagctttctctgtgctggctggtgatagaagaaagaaattgcgtcgagggtcatcaacaaacaatttgtatctttcatactatgattcatcatcgtcgtctgaatattctcaaacacattggtatgactacgaggcattcaagtacttcctatcagtaaatataattgggttcgtgtattctggattgcaaatatatgatatagtgaagtacatgattactaaaagacacacaatggaccccaagctgcggggttacttcgactttgctatggatcaggccttagcatatcttctaatgtcagcatcatcatcagctgccaccatagtctgtagttggacaaacagtgttttggctgcagacaagcacgtgcaaatggcgaacgcatgtgttgctttatccttcgttgcatttgtggcctttgcctcttcctctgttgtttctgctttcattttttgtagagtcaactag

SEQ ID NO: 3892 - DNA, 1863 bp, Glycine max var. Williams 82; identical to SEQ ID NO: 2458

SEQ ID NO: 3893 - DNA, 462 bp, Glycine max var. Williams 82
atggtgctcgctggtaaacttagtactgaacttggggtgaaagcatccgctaccaaatggttcaacctcttaaccacgcaacttcaccatgttcagaacctttgtgaaagagtgcatgaaaccaagctgcatgatggtgatgactggcacggtgttggtaattcggttaaacactggacttatgtcatagacggcaaggtacacacatgtcaggagagtattgaagccattgatgaagagaacaaaacaatcaaattcatgctcttcggtggagatattagtcagcactacaagagctttaagctgatctttgaagtgactgataagaacgatggcggtgctgctgttaaatggactcttgaatatgagaagatcaaagagaatattgatcctccacatggctacatggactactttgacaaatccactaaagagatggatgcttatcttgtcaaggcatag

SEQ ID NO: 3894 - DNA, 513 bp, Glycine max var. Williams 82; identical to SEQ ID NO: 2570

SEQ ID NO: 3895 - DNA, 774 bp, Glycine max var. Williams 82
atgggtgtgttcagtacagtgctgctgtgccttatgtccctaatgtggatggtggatgctcgaattccaggcgtatactctggcggcgcttggcaaaatgctcacgctacgttctacggaggatccgatgcttccggcaccatgggtggagcatgtgggtacgggaacctgtacagccaagggtacggagtgaacactgcagcgttgagcacggcactcttcaacagcgggctgagctgcggagcgtgcttcgagatcaaatgcgcaaacgacaagcagtggtgtcactccggcagcccttccatcttcatcaccgccaccaacttctgtccccctaactacgctcttccaaacgacaatggcggctggtgcaaccctcctcgccctcacttcgacctcgccatgcccatgttccttaaaatcgccgaataccgcgccggcatcgtgcctgtcgccttccgcagggtggcatgtaggaagcatggtgggatcaggttcacaataaacggtttccgttactttaacctggttttgatcagcaacgtagcgggtgcaggggatatcgtgcacgcctacgttaagggatcacgaacggggtggatgccaatgagcagaaactggggacagaactggcagtcaaacgccgttttggtgggtcaggctttgtccttcagagtcaccgccagcgaccgtcgctcttccacctcttggaacattgttccatcaaattggcaatttggtcaaactttcactggaaagaacttccgtgtctga

SEQ ID NO: 3896 - DNA, 987 bp, Glycine max var. Williams 82
atgataaaaaaaacaaacacacactacactaagttcagatcacagagagacaaagatatggaacaagagggagaaaaagggagagaggagaaaagacaaattcaacaacagcaacctcctcctcagcagcatcagaaatgtccacgctgcgattccatgaacaccaagttctgctacttcaacaactatagcctctcgcagcctcgtcatttctgcaaagcgtgtaaaaggtactggacactcggtggaaccttcaggaacatacccgttggtggcggttcccgcaaagtgaagcgtggcaaaacaaattctccatcttcttcttcttcttcttcttcttcttgttcaaatttgctctcacagccgcagcagaatctgttgatgaggccttctccaccaccactcactactaatactatggttcagtcaactagtccttattattataatcttggtgttggtggaaatgggtatctctcttttcattcttctctgaacaacaacacaccatcacagccttccgatcagtatctgaaagttggtggtggtgatcatgttgctggttcttctaatatttctcctcttgtgtctggcttcaataacgctgctagttattcgcttccaccgcgattccaccaccagcagcagcaacaatctatgcatcctgcacaacaacaacaacaacgtttgattaacattccatcaaacatggctagtagtagcagtgatgtttctcattctggtgttcgcccgcaaagcttgatcaacaatgtttcaacaagtacagaccataatgtttcaacaagtacaaaccatagggctattactacttctgatgcttctttgtggagtgctgctactatcaacgccacttccatcggtggaaactctgatcagaacaatgtcgtcaaagggagttcttcttcttcttcttctttggtcccaaatctttgggttcatcgccctgggtttggtcctcctcaataa

SEQ ID NO: 3897 - DNA, 2139 bp, Glycine max var. Williams 82; identical to SEQ ID NO: 2524

SEQ ID NO: 3898 - DNA, 1014 bp, Glycine max var. Williams 82
atggcactgaacaagaaccactcctacaacaacaagcttggtaatgaagctctcccacccatcaaaacccaggctggaacactccaacacccaccacaacctgcttcatcagactatgcttttcccatatttgtcattgttgtgctcagcatcttggccactgttctgttgctcctcagctacttcacttttctaaccaaatactgctcaaactggcgccaagttaacccaatgagatggatttccatccttcgagctcggcacgaagaggaccccttcatagcattctctcctgccatgtggaaccgagggcttgatgagtctatcatcagagaaatcccaacttttcagttcataaaaggagaagaaggtgaggaccaaagtgtatatggttgtgtggtttgtttgactgagttcaaggaacaggatgtgctaaaagttcttcccaattgcaaccatgcttttcatttggactgcattgacatttggcttcagaccaattccaattgcccactttgcagatcaagcatttcaggcaacacacactgtccattggaccacatcatagcaccaagttcttctcctcaggattctcagttgctctccaacatgggtagtgatgaagattttgtggttattgaacttgggggagaatctggagcagtgataccaccggtgcaacaagagaggaatgactcaaggggaagcttggcacatagaaaccacactacaaggaagtgccaccatgtttccatcatgggagatgagtgtattgatatcaggaagaaagatgaccagtttctgattcagcctattagaagatctttctcaatggattcagcacatgatagacaaacttacttggatgctcaagtcattatacaacaaaatagacttcagaatgaggctagtgctagtgaggattgtaatagcagatgtcgaagagcattcttcccgttttgctatggaaagggatccaaaaatgcagttcttcctttggagaatgatgtttaa

SEQ ID NO: 3899 - DNA, 858 bp, Glycine max var. Williams 82
atggctttttcaagagttgcattgttaatatgcacggtaattgggtattttgtgattgcctctgcgggcaatttttaccaagattttgatatcacttggggagatgggcgtgctaagatactcaacaatggcgagcttctcactctgtctcttgacaaagcctctggctcgggtttccaatccaagaacgaatacctttttggtaaaattgatatgcaactcaaactagttccaggcaactctgctggcaccgtcacagcctactacttatcttcaaaaggagcaacatgggatgagattgactttgaattcttgggtaatttgagcggtgagccatacatccttcacaccaacgtgttcagccaaggcaagggcaatagggagcaacaattctacctctggtttgacccaactgcagattttcacacctattccatcctctggaacccccaacgtattgtcttctcggtggatggaagtccaattagggagttcaagaacatggagtcaaagggtgttccattccccaagaaccaggcaatgaggatatactcaagtctgtggaatgcagatgattgggccacaaggggaggccttgttaagacagattggactcaagctcctttcacagcttcatacagaaacttcaatgccaatgcctgcactgtgtcctctggaacatcatcttgcggctcaaacaacccttcctcttccaacaatgcttggctctcagaagagttggattcaactaatcaggagaggctcaagtggctgcagaagaattacatgatctacaattactgctctgacactcaaagatttccacagggccttcctccagaatgtaacactgcctaa

SEQ ID NO: 3900 - DNA, 423 bp, Glycine max var. Williams 82; identical to SEQ ID NO: 2593

SEQ ID NO: 3901 - DNA, 1314 bp, Glycine max var. Williams 82
atgctcttggtactttctccttataatttactcatccactgcgaggcaatcattaatatggagaactcaagcgaaaaatgcaattttgaagggaacaaagagttgaatgcttcaaccattactgttggaggaatctatgacatgttgttggacagcatcaaccatgaagacaccagatccgttgttcgtcttggtcgtgtagatcccactgataacccattgtttcggactaccactgtggctgttgatgctattacaagagccgttcattcctttaacttcaactgttaccctcccactgttggcttacctgaggctaagagggctgttgcagaccatctcacctctaatcttccacacaagatcatatcaccagagaacgtttttctcaccattggtggcacacaagccatagatataattttaccttccctagcacgtcctggtgccaacattctccttccaaaaccagggtacccacattatgaacttcgtgccactcgttgtcttcttgaaattcgacactttgatcttttgcctgagagaggatgggaagttgaccttgactctttggaagctttggcagatgagaacactgtggccattgttttcatcagtcctagtagtccatgtggaaatgtgttcacgtacgaacatttgaaaagggttgctgagattgcgagcaaacttggaatctttgtgatttctgatgaagtttatgcccatgttacttttggaagcaaaccgtttgtacccatgagggagttttcgtcaatagtgccagttattaccattggttctttctcaaaacgatggtttattcctggttggagaatcggttggatagccttatgtgatcctcaaggaatttttcaaaaaactgggattgtgacgaaaataatcgacaatctagagatcacttcagatcctacaaccatcgtacaggcatcgatacctggaatccttgagaaaactacagatgatttccattcaaataatcttaatatactgagggaggctgcaaacatattctacgacggatgtaaggagattccttgcttgacatgccctcacaaaccggagggagccatggttgtaatggtggagattaacttttcacaacttgagggcattgttgatgatgtgcaattttgcactaagctggccaaagaggaatctgtaattctttttcctggtgttgctgttggactaaagaattgggttcgggttagtcttgctgttgacctttctgaccttaaagatggccttagcaggataagagaattcagccttcgacatgcaaagatgtcctaa

SEQ ID NO: 3902 - DNA, 279 bp, Glycine max var. Williams 82
ccaacaagcaacgagcagaagctagctcaattttgttttgtagcagttcttacattttctcctaactttgagagcatgggtaacttctattttctggcgggctccccttctgatgctaatacgttaaatgggtttgttgccgatgccagaagaatagaggctccccatgttctcaccgttagcagaaaacggggtgtcatatcacccgttcttatctggataagaccaccaggaaccattatcaagtttgccagcacccccatcacttattcactctag

SEQ ID NO: 3903 - DNA, 1788 bp, Glycine max var. Williams 82
atggagaagtctgaggttgttgatgtgaaagaggaagcagagattgagctggttgatgaaaataaagtggattggaaaggaagacaagctcttaaattcaaatatggggggatgtctgcttctgtgctcatactagctatgattggttttgagaatttgggaacattttcactagctgtgaactcggtgccatacttcagtgggataatgcattatagtataccagatgcagctaacatgctcaccaactacatgggaaccggttacatactcgccattccagtggctgttcttgctgacacatggattggcagatacagatctgttttaatttctggggtattcgagtttttgggacttgcattgcttacagcacaagcacactatcccagcctcaagccacccctttgcaacatttatgatataactgctcactgtgaaacacctagtggtggccaagaagctcttctgttcattgggctatacctgttggcttttggcagtgcaggagtgaaagctgcactaccatcacatggtgcagatcagtttgatgaaaaggaccctcgagaagcgaggctaatgtccaccttcttcaacaccctcttgttggccatttgcttgggtggtgcattcagcttaacgttcattgtgtggatacaaatcaacaagggatgggattggggctttggtattggcaccattgctatatttttaggtattgttctctttgcagctggattgccactatatagatttcgtgttggtcaaggaacaaatgctttcattgagatcattcaggtctacgttgctacaatccgcaatagaaatcttcctcttcctgaagatccaatagaactgtacgagattgaacaggacaaggaagctgctgaggaaatagagttcctacctcatagagacactttaaggttcttagacagagcagccatccaaataaaacaaggtgtgcaatctgagaaaccaccaagcccatggaaactctgtagggtcacccaagtagaaaatgccaaaattgttcttggcatgaccccaatattctgctgcacaattataatgaccctttgcctagctcagctgcaaaccttttcaatccaacaaggctacaccatggacaccactttcaccaagcattttcacatcccacccgcatccctcccaatcatcccaatttctttcctaatcattattatgcccatctatgatttcatttttgtgcctgttatgcgcaaaatcaccggcattccaaccggtgtcacacacttgcagcgcataggagttggtctagtactctcttgcatatcaatggctgtggcttcaattatagaggtgaaaaggaaaagagtggccagagacaacaacatgcttgatgcggtgccaatacttatgccaccattgcccataagtacattttggctttcttttcagtacttcatatttggcatagctgacatgtttacctatgtggggctgcttcagtttttctattcagaggcaccaaaagggcttaagtctacatcaacctgcttcctttggagctctatggcacttgggtattttgctagtaccatagtggtaaaatgcgtgaatggagccaccaagcatatcactagtagtggtggctggttagcagggaacaatattaatagaaaccatctcaatttgttctacttgttcctttccatagtgagcttgatcaacttctttatctatttaatcgtttcaatgaggtacaagtacagatctcaacctggtggcaattcgaagaagtga

SEQ ID NO: 3904 - DNA, 1719 bp, Glycine max var. Williams 82
atggtagtatcaaaatgtctaagtctaacactctatgttcctcctcaccccactactccttttctcaccccagtgacaccaccctccaaaaaaactccaagcttgtcttactcttccagccattttcccttcccaacaaaactgaacaaagcctttcccaccccttacaattgtaccttaaccaaacactttccaatgaaatgttccaactcttcaagctacacagcaccacctgattttgagcttgagtctgatccaacactcaccaatgaagacctcaagccaacagcaccaagtcaaaggacattttctggctttgaaatagcaagtttatgggttggtttagttgttggtgtcccttcttactaccttgctggaagccttgttgaccttggcatggcatggtggcaaggcatagcaactgtggtggcagccaacatggttctcttggttcctttggttctcactggccatgcaggcacacgctatggcatatcattcccagttctagttagatcctcttttggaatcaatggtgctcatattcctacccttataagggcacttattggttgtggttggtatggtattgagtcttggattggtggagaggcaattttccttctcttgccaaaggcaatgaaggaaacttcattgtctcagtctctaccttggcttggcacttccccacttgaatttgcttgttttttggtcttttggtttgctcaattgacctttgtttggaagggaattgatggcattagaaagcttgagaagtactcagctccaatattggttgctcttacttcttgtcttctcatttggtcttgtgtcaaagctggtggcattggtcacatgctctctttgtcttctaggctctctacatcagaattctggtctgttttcttcccttctctcactgccaacataagcttttgggccactgtggctattaacatccctgattttactagatatgctaagagccagaaggatcaagttattggtcaaattgggcttcccatctttatgggggcattcacatttgttggtctagcagttacttcatccacaaaagtgatatttggtcaagttatttctgacccaattcaacttcttggtcaaattggtggcctcacaactaggatcattgcaatccttggtataagcctagcaattatcaccaccaatattgctgccaatgttgtggcaccagcaaatgctcttgttaatctaagtcctaaatggttcacctttagaagaggagcacttttaactgcactccttgggattgcatttcaaccttggaggcttttgaaatcaagtgagagctttgtttatacttggctagttggatattctgctttgatgggtcctattgcagggattgttctagctgattactatattatacaaaaaacatatttgaatattagtgacttatactctaggagtccttatggagcatataggtattcaagagggttcaatgtggcggctattctggcactagttgttggagttttacctgtggttcctggtttcttgcagaaagttggaattgcaacttcagttcctaacacttttgttgtgatctacaacaatgcatggtttataagctttttttctgcagggttcttgtatttggttctatcgaatttgagagggaaacctggtaactctgctgctagagacccccttttgcccactgcaaagtaa

SEQ ID NO: 3905 - DNA, 1815 bp, Glycine max var. Williams 82; identical to SEQ ID NO: 2407

SEQ ID NO: 3906 - DNA, 480 bp, Glycine max var. Williams 82
atgacgcagaagatccttctgcgctctccgccggtcacccgccgcagggagaggcggcgcgtgggggaggttgccggcaacgcgacggcggagtgcgcggcggtgtgctgctgcgtgcccttaaccgtcatggacatggtcgtgctggccacctacaagctccccgcgggccttctcaagaaggccatgcacaagcgcaagggacgccttctgcagaaaaggaagaagaaaaccgaggcgctcttggatcacgggcctgtcaaggccgataattctgggcatgggcttgggcttgggcttgggcttgggtccacacttgaagagcacctggcgaaggaggtcgcggaggagaagttggaggcgtcgaggttggaagacgagatgtgggcccagttcaacgggaccgggttctggagaagcgcttctcagcgccaccaccaacaacaaactgatggggaatcatgccaagaactccaatga

SEQ ID NO: 3907 - DNA, 1527 bp, Glycine max var. Williams 82
atgaaaacgccaaacggctctccggtttctagttcatctccgaaacctcgtcaccaccgaaaccgcgaacccggttcagccacacactccagcgaatgccactccccggtccgacgcaaatcctcgagccccggccggccacacgtcgtcatcacggaggacgccggtcccacgcgccaccaactatggccttccaccgcgaagagaagctccggaacactcgccgatcacataaccgaagacagaatcatagagcgcacttcaaccgcaaataacaacacacccacaacaattggtggctccgcgcgacacgtggcaagattttcaacaccctcagaatctaagaaactaagttataataacaacaacattgctcctggaagattgtcgttggatgaaaacgctaagtccttctcttctcggagacactccagaaactctcttgaattagactctgacgcgggaaaaaaattaacgtcaaaaaaagcagacctggaagttgctaaaagtgatgcaacaacaacgccgagaagggctaggagaggaacttcagattccaacgttgcgaacttgaatggtgattcctcctcctccgttttgaaacggttcacgttgaaaactgctataaggagggcgaattcgctcgctggaacgtacaagagttccaagacttcgtgggctttgtctccggggaggtcggagtcaccggctatgtcggttgagagcatggataaagcggtgtcgttttcgagcttcaaggtcccacccactagtcctacgaaggtgaaaggggtggagaagttactcaacatgggttttgatctcttcaagggtaagaaaagtggtggctttggctctttgtcgcccgttggttttggagttcactcggaggttgttcataggcttcgtttgcttgataatcgcttggttcaatggcggtttgcgaatgctagagcacaagttgtcaatggaaacacttctcacaaggctcagagcaatttgatatgtgtttgggacggtctcacaaagttacagcaatctgttctgaaaaagaagatacagtttgtcagagaaaaacttgaaatgaagatcgcttttgtactgtattctcaaatgaagctactggaagcttggggaggaatggaaaggcaacacttactagcaattactgccatcaaagagtgtttgcattcggttgtttgcagagttcctattttggaaggtgctaaggtgaacatgcaaccaacgtccattgctctacggcatgcatctgatctcacagtttccatcaagtcaattttaactactttttcatcctcagaggttgataagatttcagcaatgctatcagaattagcaaaagttgttgcacgagagaaacagctcttagaggagttctatgatcttttccaggccatatgtgtctttgaggttcaggaaagaagtgtaaagtgcaatctcgttcaacttgaaggttggcaacaaaaatatcaacggcagcaattactaccagagatcacgtcatag

SEQ ID NO: 3908 - DNA, 498 bp, Glycine max var. Williams 82
atggagaaaatgagagtggtactaattactgtattcctatttatagaagacgttgatattggtctctttagcgaagctgaggcttatgagaaccctaaattccaaaggtttgtgacacgttgcacttggcattacgtagagcatgaacatgaagcagttgaatccaaaacaccccaagtgtttcagccatccgtaaatggttttccaataaacttaccaccacccataaagccaccaaacataggtgctacttctcaagtatccccacccgaatctcctaaccctttcctcattcacattatcaaattcctaactgtcttgagaacctgcgctcatgtcactgcacatacttgtttgactgctcctaatcttgctgcatcacttttagcagcttgtctcattccatctcttaatcaatgcgtaaatcccactgcaggtaccccacctattattggcccatctattgtgccattaaatgatctcagacataaagggtaa

SEQ ID NO: 3909 - DNA, 990 bp, Glycine max var. Williams 82; identical to SEQ ID NO: 2451

SEQ ID NO: 3910 - DNA, 2613 bp, Glycine max var. Williams 82; identical to SEQ ID NO: 2423

SEQ ID NO: 3911 - DNA, 1308 bp, Glycine max var. Williams 82; identical to SEQ ID NO: 2520

SEQ ID NO: 3912 - DNA, 417 bp, Glycine max var. Williams 82
atgggaggtttagctaagaagataactcatcatctggtgaccctggtgctggtaatagtattgtgcaccactattgttgaaggcaccaaacatgtaagcatcaagaacagactaggatctgggaggaacatgaccttgcattgccagtccaaagataatgatctgggcaaacaaaacatagcatacggggacgaatttggatgggacttctctgacaatgttgctggaaccacactgtttttctgtgatttgggatgggaaaatgttgaggagttccattttgatgcgtattcctttgccagggacagggtacgatgtggtgatgctggatgttcatggctagtatcgattgaaggcatttatggcttaaatggacaaacggggtactgggaattcatgtaccaatggccaaattga

SEQ ID NO: 3913 - DNA, 1014 bp, Glycine max var. Williams 82
atggagaccttggatcagatgcttgtgtcaagctggtacaatgttcattccttggtgcccccatcctatgtacaattaccggaaaacaggcctagcaaggtggttagttctttgcataaggcaatacccgtgattgattttggaggacatgatcgtgttgataccacaaaacagattttggaagcctccgaggaatatggctttttccaggtgatcaaccatggagtttccaaggatttaatggacgaaacactgaacatttttaaagaattccatgccatggctcccaaagagaaagtcaatgaatgctctaaggacccaaatggaagctgcaagctttatacaagtagtgagaattacaagaaagatgcgattcattattggaaggactcactaacacatccttgtcctccttctggggaatacatggagtattggcctcaaaaaccatccaaataccgggagattgttggaaaatacacaagagaattgaagaaactagcgcttaaaattttggagctgctttgtgaaggattagggcttaacctagggtatttctgtggtggactaagtgaaaatccatcagtgttggttcatcactaccctccttgccctgacccaagtttaacattgggcttagctaagcacagggaccctactattatcaccattttgcttcaagataaggaggtgcagggacttcaagtcctcaaggatggagaatggattggagttgagcccattcccaacgcttttgtggttaacatcggtctactcttgcagatcataactaatggaaggcttgttggcgctgagcaccgagctgtgacgaattcgagcagtgcacgcacaagtgttgcctatttcgtctatccatcatttggaagcatcatagaacccgcacaagctttgatcaatggaagcactccagcaatatacaaatccatgagatttggagagtttcgtagaaatttctttcacaaaggtcccaagattgaagaagaattgcagtaa

SEQ ID NO: 3914 - DNA, 294 bp, Glycine max var. Williams 82
atggggttcagcaaggaggttacagacagaaacttacaagcgggttcaaatattctgtgtgctgaaagcagtgaaagagctctgttgaaccgcttcatgttagaattgcacaagttggatagtgatgttcttgttggacacaatatttctggatttgacctggatgttcttctccacagattccaagttggaattttggcttttcctcaaacaatttcttgtcaatttcttgttaacaaattaatatttaataattttaaaaatatcacatatataattatgcaacaattttga

SEQ ID NO: 3915 - DNA, 1140 bp, Glycine max var. Williams 82
atgcgtctctaccgttattcccaaagacagagacattctccctccaaaagaatcacattctttgttttcttcttcttggccatggcttattcccgttggtgctggttcccactctacttagcagcctcaattgccctcggaatcatcgccatctcctcagcgatacgttccacttccaacaagaacccaccccaagatccacccataccccacgacatctcactcaacgcctccaacgctctccgcaaagcaggcttcatagtaatggcagatcttctccaccactctccctcattcttcaaaccgccgcaaaactcaaccatcttcgccatcaaagactccgccatcaaaaacacctcccaccctctctggttcctcaaaaccctcctcctctaccacaccaccacctccaacgcctattccttcaacgacctcgtcaaaattccccaaggaacgtgcctccccaccctccttcgtgataaaaatgtttctctcactaagcttgaccttgaccatgcaccaaactccgtggagattaatcacgtcttgatatcaaaccctaatatcttcctcggagagcaacttgccgtgcatggcgttcttgcgccgttctctccccttcagccgcaagaccttcttcaacggggttttggttttgctattcgcacacccacttgccgctccaacgacgtcaacgtctccgtttccaagaacggggttgagtggaaccgcgtcgttcacttgctccgtgcaaaagggtatgcttcgttctcgattgcgttgcattctgttcttgatgggataaagagagacttttctgggagtttgggttatgtcacaatcttcgctcctcgcgatttgactttacttggataccctttgactattcttgatagagctgtgaggcttcatattctgcctcaaaggtttgtttacaaagaaatctcttctctgccggttaggagtttgttaaagacgctcatgcctgatgagcatcttgagattgatggggttctggattttgtgccgggcatggttgttaatggtgttgtgattgtggcgcctgacatgatcatttcggagaaatttgtggttcatgggatttctagagcttttaagatggctgaggttactagttga

SEQ ID NO: 3916 - DNA, 981 bp, Glycine max var. Williams 82; identical to SEQ ID NO: 2556

SEQ ID NO: 3917 - DNA, 510 bp, Glycine max var. Williams 82; identical to SEQ ID NO: 2495

SEQ ID NO: 3918 - DNA, 561 bp, Glycine max var. Williams 82
atggcttctagaggcctaaaaatttgcttagccatgtctcttctcttcttgatcattgttgctattgtgattgttgcattgttttttaccatctttagacccaaggatcctaacatcattgtccaccccgttggcttcgaaaactttaacccttccctcttaaccaatgtgaccgcgaatgtgagcctcggcatgcttatcactatcgagaattcaaactatgaaaactttgagtacccaaatgccactggttatatcaaattccatgacaccgttgtgggccaagttccaattgtgggagagttggtcccaccgcgaagccagattaatgtgaacacttcggcaaatttcatggtagcaaagttaatcaatgaccccaattttttgtcagattttctaagtggaattgtgaatttcacatcaacagcttcactgcctgggaaagcgcatatgctaaagattatcaaattcaaggccacagtttatagctcgtgtgacatctctcttaatataacctctaggaatgttgattccaaatgcatatccaagatcaagctttga

SEQ ID NO: 3919 - DNA, 1047 bp, Glycine max var. Williams 82
atgtgcagagaagctgcaaacttgtccaggcaaacaaacatggatgcatcttctatgcacatagcaatgtttccatggtttgccatgggacacctaactccatatcttcacctctcaaacaaattagcaaagaggggacacagaatctccttcttcatccccaaaagaacgcaacacaagttagagcaattcaacctgttcccacatctcatcaccttttaccctatcaatgttcctcatgttgaaggccttccccatggcgcagaaaccacttctgatgtctctttctctttaggtccactcattatgacagccatggatcgcactgagaaagacatagagcttcttctcattgagttaaagccacaaattgttttctttgacttcacatattggctaccaaacttgactcgccgcttgggaatcaaatcttttcaatacatgattgttagcccagcaacagtagcttacaatgcatccccaccaaggatgcaaaacagtgttaacttaactgaagttgatcttatgcaaccccctcttgggtaccctgtctcatccatcaagcttcatgcacatgaagctaagtttcttgcttctaagaggaattgggagtttggtagtggtgttctcttttatgaccgtctttacggcggtttaagcctatctgatgcaattggattcaaaggttgcagggaaattgaagggccttatgttgattaccttgaagaacagtttgggaagtctgttctgctttcaggacctatcatacctgagccacccaacactgttttagagggaaaatggggttcatggcttgaaaggttcaagcctgattcagttattttctgtgctcttggtagtgaatggaaattaccacatgatcaattccaagaatttctgttgggtcttgaactcactggccttccatttttggctgttttaaaaactcctatagggtttgagacactgaagctgctctcccagaagggttcaagaaagggtgaagagagaggaatgtccacggtggatggatacagcaacagctga

SEQ ID NO: 3920 - DNA, 666 bp, Glycine max var. Williams 82
atgaagagcactaggagagaaatggagaagaagtcagagataggtttagtcattgaagagctttctatgatagccatagttaaacctggtgaaaatcatgactctgctcacatccccaccaagcttttcctctcgatttgttacttggttctacaagttcttgataagattgggccaacaatggctgtcttgagacaggacgtgtaccagaatattaagacattggaactgatgcaggaatcaaatccctcattgcactcgaatttggttgagatattgaagtcagaagcaaccgaaggcaattcttggaaagggtcaagctgcagtaaggcccttgtttggctcactaggaccctggatttcacctcgctgttgttacaaacactagcaaatgatcctgaaaagagaatggaacaaatagttgaagaggcttatgatgtaactttaaaaccgtggcatggatggatttcatcaactgctttcagagtggctctaaaactggtacctgaaagtaaaacattcgtgaatattcttaaaactgaagatgaaaactatgacaccctaaaggagaaaatgcagatgctggtttctctgtttgtgccttttcttgaggatatgcattgtattctgagattgtacaacttggacaagctaaagtcaacctga

SEQ ID NO: 3921 - DNA, 1368 bp, Glycine max var. Williams 82
atgaggaaagaactcactggtgtcaaagacaacaacgaacacataaatatgaataaaaatggcgagatgaaaaatgaacgcaatgccacaaagctacagcaaatgttgatggtactagtagacgatgctggtggagcttatccacgcattgatcactccccgtggaatggatgtacattggctgatttcgttatgcccttctttcttttcattgttggggttgcaatagccctggcactaaagagaatccccaaggttaagtatgctgtgaagaagataatccttaggacattgaagcttctcttttggggcatacttttgcaaggtggatactctcatgcccctgatgatctatcatatggagttgacatgagatttatccgatggtgtggcattctccagagaatagcccttgtatactgtgttgtagctctaatagagacatacaccaccaagcttagaccctctaccttgaagccaggacacctgtccattttcactgcctatcgatggcaatggttggggggctttgtggcatttgtcatttacatggtcacaatcttcagcctctacgttccagattggagtttcgtggattataacagcgacaaacctaagagatacacggtggaatgtgggatgcgaggacacctaggtcctgcatgtaacgctgttggatatgttgatagacaagtttggggcgttaatcatctttattcccaacctgtttggacacgcttgaaggcatgcacactcagttctccagctgaaggccctcttcgtaaaaatgctccagcttggtgtcgcgctccctttgaacctgaaggctttttgagttccgtattagctatcctctctggcaccattggcatccactatgggcatgtcttgattcacttcaagggtcactttgaaaggctcaagcaatggctctcaatggggtttgtgttattgaccctaggcctcatccttcattttacagatgctatcccgattaacaagcaactctacagcttcagctatgtttgtttcacagctggggcagctggaattgtcttctctgtgttctacctactgatcgatgtttgggggcttcgtactccattcttattcttggaatggataggaatgaatgcaatgctagtgtttgttatggcagcacagggcatcttcgcagcatttgtaaatggatggtattacaaagacccagataactcactagtatactggattcagaatcatgtgtttaccaatgtttggcactcagagaggttgggaactctgttatatgtcatctttgcagaaatcaccttctggggtgttgttgctggcatcttgcacaaattaggaatatactggaaactataa

SEQ ID NO: 3922 - DNA, 819 bp, Glycine max var. Williams 82
atggctccctcatcaaactacatttctttccttttcctcaccacccttttgtttgctcttcaaatcagtgcaagagacagccagttcttcagcaaagtcacccattttgacaaaaacagtgtcaaagagacagaacttcccaacaaagaagcaccagaagtgaacaagccagagcaacaaccacctttcattccggagactgaaaacagctatggcctatatggtcatcatgatgagtataaccaagtcccttccaccaccaccaaccccacttcttaccacccctacaagaccgagtttgagaactccaacaacaagtattacaacaatgatgcctataacacaaggttctccgaaaccggttacaacaacaacaaggattcttatgagggtaaccaatatgagttaagtgacacaaagtacacagaagaagaatacaacaacaacaacaacaacaagtatcacaactcctatcagaacaacaaccagaagtactacaacaacgatgctgccaatggcatatactcctacaacaacaacaacaattacaatgctaacaataacaggtacaatacttacaacaacaacaatgccgttaacgggtacaatggtgagaggcaaggaatgagtgacacaaggtttttggagggtggaaaatactttcatgacgttgccgccgagaagtacaatccaacaaactatggtgactcatcaagggaagtgaacactaacaactggtacaacaacagaggtggcaactacaacgggaaccagaaccagcaggagtttgaagatgaacatgagaacttcgagccatga

SEQ ID NO: 3923 - DNA, 624 bp, Glycine max var. Williams 82
atgggagggcaagtagttaaacgcagacgtgtatactccgtggaatcaaaccaaatagtgcaacctatatttactaggaattatttgaaccatttggttccagcgttggtgaagataaaggaaaagggttctataaaagaagatagcagcagccattgtaatgataatattaacaatgctgtcaagtatgaagtggacatggcaatggtattgtcagcacaaggttttgcatggagtaacggccttaaagtcaagcttcaaagcgatgacgttcatgtcaatgcagctaaaagcactaggtttcttgaaaatgaggctagtgaaggttcatcgaagaataatgtttatgacaaaaatgaagttgtcccaatggaatatttctcttcaaaccctagctcaaggtctaagtgcaaggacatgtcagaaatgaaaagggatttagccagagaagatgataaggaagctgaggacatcaacaaccagtggaagaggctgagaaggatgatacctggaggagaagagatgtgtgatgatgaacaaatggtttcagagcttgagagttacataaactgtttgcaaatgcaggtgaacgctcttcagtttctgctgccacacacgcgctga

SEQ ID NO: 3924 - DNA, 882 bp, Glycine max var. Williams 82; identical to SEQ ID NO: 2408

SEQ ID NO: 3925 - DNA, 1200 bp, Glycine max var. Williams 82
atgcttgaagcttggctttctctcaagaagacccttcaatgcaaaccacaaccaaatcaagttcatgatccaaagactactaggcagcaaaagggtaatcagagaacaaagttaagtaatcttgagagttcaaataccaaagatttcatccaaggaagcaaggggcacttaaaaaaatcactgagttatagaggggacattgacatcactagtcccataactaatgaaattgttcttgatagctcaaacaatggaacctctcgatgttgtccttgtcctcaaagcaatagcggcaacaaagcttcggaaggttctcatagaacacgaaggtcagctacatcttcaaagataacaatgacatatcatgttgattacaatgaagcaaatgtctcctccaatacaagtacgctggttcagatggattctgatggttgttcaacattgacatgccataaatgtggcaagaaattgaaaaatctcgatgctgtagaagcacatcatatttccgagcattcagtcactgaacttgaagaagattcatctagacagattatagaaacaatatgtggaagtggaacaagctctattaataattccgaaaacatggtggggcagattgattgcattttaaaggttctgaatgtaccaaaaaccttagcttgctttgaggaatacagagcaaaggtgaaggataacgctgagaagctacagaagaagcatccacgttgtgtggctgatggaaatgagcttttaaggttccatggcacaactatttcatgttctcttggcacaaacagttctagcctgtgcactttagactattgtggtatatgccaaatcctgagaaatggcttcttcaccaataaggaattccatggtgcatcgggggtttacaccacttccacaagtaggaaagcctttgaatccatttccattatgacatcccatgagaggccatttgcaagaaagtctgtcatagtgtgcagagtaatagctgggagaatttatagtcctcttgaagaaattgaagaagaaagggctgattcagagtttgattcattgtcagaaaatacaaatggtcattcagatgctgaggaactctacgtgttaaatcccaaagcccttcttccttgctttgtgataatctacaaacagcaaacagacaaggctaggagattaggaggttcagctcaagcttaa

SEQ ID NO: 3926 - DNA, 366 bp, Glycine max var. Williams 82; identical to SEQ ID NO: 2433

SEQ ID NO: 3927 - DNA, 1053 bp, Glycine max var. Williams 82; identical to SEQ ID NO: 2465

SEQ ID NO: 3928 - DNA, 1407 bp, Glycine max var. Williams 82
atggataccgcaaatgcagctcctttgcacatagcaatatttccatggtttgctatgggccatctaaccccatctcttcacctctccaacaagcttgcacagagaggccacagaatctccttcataggccccaaaaaaacacaaaccaaactacaacacctcaatcttcaccctcatctaatcacctttgttcccatcaaagttcctcatgtcaatggtcttcctcacgatgctgaaactacttcagatgtgcccttctctttattcccacttattgccgaggctatggatcgcactgagaaggacatcgaaattctcctaagggaactgaagccacaaattgttttcttcgatttccaacattggctaccaaacttgactagaagactaggcatcaagagtgttatgtatgtcattattaatccgttatcaacagcgtacttcgcaaacggaccaaggaaaagcaaaggaagagagttaactgaacttgatctaatggtgccccctcaggggttccctgattcatgcatcaagtttcagccacatgagcttcggttcctcgttggagtaaggaaactcgagtttggaagtggggttcttctctatgatcggtaccacactgcagcgagcatggcagatgcaataggattcaaaggttgcaaagaaattgatggaccatatgctgagtatcttgaaactgtgtatgggaaacctgttttactttcagggcctcttttacctgagcctccgaacactactttagagggaaaatgggtttcatggcttgggagattcaaccctggttctgttgttttctgtgcttatggaagtgaaagccggttaccgcaaaatcaacttcaagagttgttgcttggtcttgagctaacaggttttccatttcttgcagcacttaagccccctaatggttttgagtctattgaagaagcacttccagaagggttcagagaaagggttcaaggaagagggattgtagatgaaggttgggtgcaacaacaattgattttaggacacccttctgtcgggtgcttcataacacactgtggagctgcttctttgacagaggcgcttgtgaataagtgtaggttggttttcttaccgcatctgggtgctgatcaactcataaattgccgaatgtttagtagaaagttaagggttggtgtggaaattgagaaaggtgaagaagatgggttgttcacaaaagaaagtgtatgcaaagctgtgaaaattgtgatggatgatgggaatgaggttggaagagaagtgagagaaaatcatagcaaactgaggaacttcttactaagcgacaacgtagagtcagaatgtgttgatggtttctgcaaaggacttcatgatttacttaatttgaaaagactcgtcatgtgttga

SEQ ID NO: 3929 - DNA, 1050 bp, Glycine max var. Williams 82
atggagggagatcaacagggttctaattactcttttccacctggcttcagattccacccttctgatgaagaactcatagttcattacttgcaaaacaagatcagttcacgtccacttccagcttccattatagctgaaattaatctctataagtataacccgtgggagctaccgaataagtccttgtttggagaggaagagtggtatttctttagcccgagagacaggaagtatccaaatggattgaggccaaacagggctgcagcctcaggatactggaaggcaactggaactgacaagccaattctttcttcttgcggatcaaagcgcataggagtgaagaaagctctggtgttttattcaggtcggcctccaaagggagctaagacggattggatcatgaatgagtatagattggttgacacaatcaccacatcctccaggctaaaaggctccatgaggttggatgactgggtactatgccgggttcgacataaaggctactctccgaagaattcatgtgaaaatcaagagagtcctaatgaactaaacttgtctgcaaaactaccaaggagtgaagaatacccaacaaacatgaactgtcgggctgacatgatccctgattatcaatacaaagactatcaaatcatagcctctattcttgttggtggacctattcctcccactgaaagcatgccaaaccttagctttaagggctgcaaaggcaacaatgtagtttcagtttatgaagatgatttcactaaagtgaattctcaagcgacaattccttctttggaaagttatttcaacccactgacaagaaaatccagtgaagatgaacagtatggaaatctcatttcttttaacaggaagttcaacactgagaacagaatggatggatccactagcaaagtgttgaccagtagagaattgaattgctataaccaaaaccagtctcaagatgacattttcaatgtgaacccaccagatcctagcatcaattttcaagagctaaacgaattagacttttcgggaaggtaccatcagtga

SEQ ID NO: 3930 - DNA, 960 bp, Glycine max var. Williams 82
atgaacatgttaggccttagagacctagttttcatagctccaactccttctcaacttcaccaccatcaacaacaccaacccatttcagcagaacaccattcaaacctccctttgccttcacaagcctctctcagtgttggtcttggcattttccctctcctaacagtgccacacaccaatgatgttcaagttcaggttcaagactgtgccaacaacaacaacaacaccaacaccaactattggaacctgaagatgtgtggtgccactgaagtgaattccacaagaaaaggtgttatgaacatggaggatgagggaagcaataagcaaatgatggagagtgaggaaggtgggggtgagtttagggtgtgccaggattgtggcaatagagccaagagagattgcagcttcagaaggtgcaggacttgctgcaagggacgtggctttgattgcagcactcacgtgaagagcacgtgggtccccgcgtctatgagacggggtggtggtggtgatagtagtggtggtgatggcaacagcgatgctggtgcttctaagaggctaagaactttggggtcatcaaagaatgttgctgctagtgctacctctcatagttccacttccaatgctaccccaacaaagagctttgataccagttcttgtcaacaagatgctggtttcaaacagtctttgccacggcacgtgcgtgcacctgcggtttttaggtgccatagagtgtctgctattgggagtggtgaagatgagattgtttacatggccacagttcatattagtggccatgtttttaaggggtttctgtatgatcatggtgctgatgccagaaatgatgtgcctagtgtctcagaactgcaattgggaaacaatggaagtggaaagaataataatagggaatgctcttctgcaattggggttccaactagtgcttaccctgcttctgtttgctga

SEQ ID NO: 3931 - DNA, 309 bp, Glycine max var. Williams 82; identical to SEQ ID NO: 2483

SEQ ID NO: 3932 - DNA, 909 bp, Glycine max var. Williams 82
atggccgcaaaagagaacgaggtaacccacaagtttcgctttttccgcgtttacaaagacggcacagtggagctttacaaacccaccatccaaaaggttgcccctttcgatgacccaatcaccggcgttcgctccaaagacgcggtcgtttcaacccacccacccgtttccgttcggatctttttacctccaatatccgacccgacccgaaaattcccgatctttttctatatccacggcggcgggtactgcatgcaatccgctttctccccagactaccacagtctcgtcgccaccactgccgccgaagcaaacgtcattgcagtctccgtggaatacgggttgttcccgacccgacccatacccgcttgctacgaggattcctggaccgcgctcaagtgggtcgcggcgcacgcaactggaaacggatccgagcaatggctcaacaaccacgccgatccagaccgtgttttcatctccggcgacagcgccggcggcaacataacccacacactgctaactcgggtcgggaagttcgggttaccgggcgccagggttgtcggggcggttctggtgcacccgtatttcgcgggcgtgacaaaggacgatgagatgtggatgtacatgtgtccggggaacgagggttcggaggatcctaggatgaaaccgggcgcagaggatctggctcggcttgggtgtgagaaagtgttggtttttgcggctgagaaggacgaattgttccaatgtgggaggaactacgctgaggagcttaagaagagtgggtgggatggaagcgttgaccttgttgagaattggggtttgggacactgctttcatgttttcaagccccaacatgagaaggcaaaggagatgttgcaaaagattgttaccttcatccaacaagactag

SEQ ID NO: 3933 - DNA, 1305 bp, Glycine max var. Williams 82
atgaaaaataggagtggatctgcacataagatgttactggaatttattgctggcattttaacaacaatggttggggccttactctattgcctcttctggagaaaggtcattccatttcttaagcaacgaaagactttgaaaggaaaggaacatgataaaatatcattaaggtattttgattttaaggaactagagagagcaaccaaaaattttagccaagattgcttgctaggttctggtgcatttggaaatgtctacaaaggaacctttgacttagaaggaacactagccattaagagagctcattctgaatcattctcaagtgtggaagaattcagaaatgaagttaggctcctctcagctgtaaggcacaggaatcttattggtttgattggatattgtgaagaaccagaacgacatggagccaaaatcctagtctatgaatatgttccaaacggttcactgcttgagtacatcatgggaaacgaaacgagcttaacttggaagcaaagactaaacatagcaataggagcagcaagaggcatagcttatttgcatgaaggggtgaaaccaagcattattcaccgtgacatcaaaccaagtaacatcctattagcggaaggttttgaggctaaggtctcagattttgggctagtaagatcagggccaactggtgatcagtcacatgtcagcagccagattaaagggacaccagggtaccttgaccctgcctattgtttaagctttcatttgaccaaattcagcgacgtttatagcttcggtatcatacttttgcaacttgtttcagctagacctgtggtggattccactgtaaaccaaagtaatcaacatattattgactgggcaaggccaagcttagagaagtgtagtgttgaagaaatcatagatgcaaatctactatgtcaaagtgagccatgcaacatggaagttatgctaaagatggggcaacttggtttaagatgtgtggttgaagaaccaaaacatcgcccaacaatgagccaggtgtgtcaagaactagagcaagccctctactcagctaatgatagcttcaataacaagaaatcttcaaagggattccttacaccaattggctcatcccaacaatcaacaaagtcggagactcggcgatcagttgaatcatacgattgttcacaaagctttgttagtattgacagtgttggattacagaaatttcatgttgatatggatagtttctcctttaagagcacagacttaaggtgcttagaaaataatagtattagtattgacatggatagagtataa

SEQ ID NO: 3934 - DNA, 4443 bp, Glycine max var. Williams 82
atggcaaaagaagagggtggcggagaagaaattgtagggtcaatgagtgaaggaaggagtttttcatcccccagaagaagttgggccacagaaagctttcatgaggcagtgagtggagagagtgatgcgtttcacacatgtgaaaaggagatagatgaagaggaagagctgaagtgggaagctttgaggaggcttccaacatatgataggatgaggaaagggattttgaaacaagttttggagaatggaaacgttaactatgaagaggttgacatcaccaagcttggagtgcaggaaaagaagcatctccttgagagcatactgaggactgctgaagaggacaatgagagtttcctcaatagaatgagggagaggattgatagggtggcgattgagattcccaagattgaagttaggtttgagaatttatcagttgaaggggatgcatatgttggaaccagggcgctgccaacactgctcaattctaccctgaatgtaatagagggagctctcggctatatcaagcttttgccacacaataaaagggttgtcaagattctccaagatatcagtggaattgtgaaaccatcaagaatgactctgcttttgggacctccggggtcaggaaaaactacactcctgcaggcacttgctgggaaaacggacaaggatttaatggcatcaggaagagtcacttactgtggtcacgagttgtcagagttttttcctcaaagaacatgtgcttatattagtcagcatgatcttcaccatggagagatgacagtgagagagacactggacttctctggacgctgccggggagttggaacaaggtataatttgctggcagagttatcaagacgggaactagcagccggcattaaaccagatcctcagatagatgctttcatgaaagccacagcaatggaaggtcaagaaacaagtattgttactgattacattctaaagattcttggattggaaatatgtgctgatactttggtgggagatgagatgaaaaggggcatatctggtggacaaaagaagcgtttaactactggtgagatgctggtaggccctgcaaaagcattcttcatggatgaaatttcaactggtttagatagttccacaaccttccaaattgtcaggtttatgaggcagatggtccatatcatggatgttacaatgataatctctcttctgcaacctgcaccagaaacatatgacctttttgatgacatcatattactttcagaaggtaagattgtctatcaaggtccccgtgagagtgttctgcattttttcagaagtgtaggctttaaatgcccagaaaggaaaggagttgcagactttttacaagaggtaacttccaaaaaggaccaagaacaatactggttcagaagggacataccttaccaatatgtcactgtgcctgagtttgtagcccatttcaacaattacagcattggtcagcaactttctgaaaagattcaagttccatatgatcctaatgaaagccatcgggctgctttagtgaaggaaaagtatggtctctccaaatgggaactcttcaaggcatgcttttcaagagagtggcttttaatgaagcgcaactattttgtatacatattcaagacttgtcagatcactatattagctataattaccatgacagtattttttagaacagaaatgaagcatggtcaacttgaaggtgcaggaaaatattacggtgcactatttttcagtctcattaatgtaatgttcaatggagtggctgagcttgcaatgaccattaatagacttcccgttttttacaagcaaagagatttcctgttttatccagcatgggctttcgcattgcccatctgggtcctcagagttcctctctctctattggagtcaggattatggatcatcctcacttattatactattggctttgctcctgcagccagtaggttttttcgtcaattactagcattcttctgtgtgaatcaaatggctctatccctattccgcttcattgctgcagttggaagaataaaagttgtggcaagcacacttggttccttcacacttttagttgttttcgtcctaagtggatttactgtttcaagaaatgatattgaaccatggatgatatggtgctattatggttcaccgatgatgtatggtcagaatgccatagccatcaatgagttcctagacaaaagatggagtgctcacaatattgatccaaggattcctgagcccacagttggaaaggcttttcttagggccagaggcatattcacgaaagactattggtactggatatctgtcggtgcccttataggattttctcttcttttcaacatttgtttcattctggctctaacttacttgaatccatttggaaactccaaatctattatagtggaagaggaagaccaaaagaaaagcacatttggttcatcctcagtggataaaatggcaacagaagcaacgacagagaagagttcaacttcaattgctaattcgtttgaaggtattgatatggaagtaagaaacacagcacatggctcaaatcctaaagctgaagaaaatacaaaatccaagaagggaatggtgcttccttttcagcctctgtcacttgtgtttcaagatgtgaattattacatcaatatgccacatgaaatgaagaaacaaggaattgaagagaatagactccaactactaagagacataagtggagctttcaggcctgggattttaacagcattagttggtgtaagtggtgctggaaaaactaccttgatggatgtacttgcaggaagaaaaactggtggttatattgagggaagcatcagcatatctggttatccaaaaaaacaggcaacttttcctaggatcagtggttattgtgaacaaaatgatatccattccccaaatgttacagtctacgaatctctggtgttttctgcttggctgcgtctcagtaatgatgttaataaggaaacacaaaagatgttcattgaagaaattttagagctggtagagctccacccagtgaggcattttatagtaggccttcctggaataagtggcttatcaacagagcagagaaagaggcttaccatagctgttgaattggttgcaaatccttccattatttttatggatgagccaacaactggtcttgatgctagagctgcagcagttgttatgcgtactgttagaaatacagtagatactggtcgaactgttgtctgcacaattcatcaaccaagcatcgatatatttgaaaattttgatgagctgctattgatgaagagaggtggacaagtgatatatggtggtcctcttggtcgaaattctcagaatcttattgagtactttgaggctattgcaggagttcctaagattaaagatggatgtaatccagccacatggatgctggagatctcttctcctgttgttgagtctcagcttaacgtagactttgcagaattatatactaagtcagacctttatcaaaagaaccaggaagttattaaggaactctgcacaccagtaccaggaacaaaggaccttcactttccgtctaaatactcacagtcatttgttactcaatgtaaagcttgcttctggaaacagaactgctcctattggaggaatccacagtataatgccatcagattcttcaccacaatagttattggtatcatttttggactaatctattgggacaaaggaaaaaagacgcaaaaggaacaagacctgttgaatctccttggagccatgtatgcagctgtttttttccttggagcctccaatactaacagtgttcaacctgttgttgcaatagaaagaacagttctctatcgtgaaagagctgctggaatgtactcagaattgccttacgcaattggtcaggtagccattgaagtaatttatgttgcaatccaaagtctagcctataccattctcctctactggatgattgggtttgaaccacgggttgaaaatttcttgtggttctactacttcatattcatgtgctttatgtacttcacactgtatggaatgatgactgtagctctgaccccaaactatcaaattgctgcacttgttatgtcattcttcatcaacttctggaacctgttttctggttttgttatcccaagaacgcaaattccaatatggtggaggtggtattattgggggtcccctgtggcttggactatatatggactggtaacatcccaagtcggtgacaaaaatagtccaatagaagttcctggctttagaaccatgacagtaaaagattaccttgagaggcagttcggctttcagcatgagttccttggagttgttgcactaactcatgttgccttttgcctcctcttccttcttgtatttgcatatggcatcaagttcctaaacttccagaggagataa

SEQ ID NO: 3935 - DNA, 1854 bp, Glycine max var. Williams 82
atgcagaacacaagagattttgctgtgtttctaaggaggctagttttctttgctatcattttctttatcatagactgtacaagaggtaagtcatcagaatctgagtctttcttaaatttcttaagggcccttgatcccagaaacgagcttaacattacctggaatgggtcaccatcgcatccatgcttggtcaagttgaatggtgtaagatgtaactcaaatgctaccaatgttgtacatataaggcttgagaacttgaaccttagtggcacaatcgatgcagattccctatgcaggctccaaaagttaagagtggtaagcttggctaacaacaacattagaggaaccataccacagtcaattttgcattgtacaaggttgacacatttaaatgtaaccagcaaccaattgagtgggaggttgccaaatgccttaacaaaattgaaacatcttaggaacttagacatttccaataacaatttttctggtatgatccctagtaaacaacaatattataggcacctccttaggtattatgtgactccaagtaacaagttggaaagcaatagtaccaaagagaggctaaaggaaagtgacacaaacacaatactgcaagagcaggcaacaccaccaggtgctttaagtaacagcacacctaataatgggaaggattcatcgtcttggagggtggaaaccttgggggtgttccttttgggtgctggattgcttttgtcaagcatttactttattgtaaagaagtcagcaaagttaagtgcagagaaagaggttgctgtagttaaagaccatcgtcgtgtgtctccaataataaaggctacaactcatgaagttcaagaggtgaagctaaaggaaggagattctgagcttgttttctttgttgaagatcgtgaaaggttcacactcgaggaccttcttcgagccactgctgacttgaggagtgaaggcttctgcagcagcctttacaaggtgaaattggaacacaatgtttactatgctgtcaaaagattgaagaatttgcaggtatccttggaagaatttggtgaaacattaaggaagataagtaacttgaagcatcagaatattctcccccttgttggttatcgttccaccagtgaagaaaaattcatcatttacaaatatcaaagcaatggaagcctgcttaatctgttaaacgattatatagcaggtagaaaagatttcccatggaaactgcgtctgaatatagcatgtgggattgcaaggggtttggccttcatatataggaagttggatggagaggaggaggtcgttcctcatggaaatctcaagccctcaaacatccttctagatgagaacaatgagccactaataagtgagcatggcttatcaaaatttatggacccaaatagaggtttcttgttttcctctcagggatacactgctcctgaaaagagcctaacagaaaagggtgatgtgtatagctttggagtgattctcttggaactactaacaggaaagagcatagaggtgagtagaatagaccttgctagatgggtgaggtccatggtgagggaggaatggacaggagaggtatttgacaaagaggttagggaaaatgatcatcaatgggcatttcctcttcttaatatagccctcttgtgtgtgtcatgtttccaagaaaataggccaaccactgtggagattttggagaagattgaagaggtcatggatcaacatgagcaacatcaggaacgttatgcttccaaatgctgttccaatggatccaaccgcgatgaatgctgttcacttcacaaaatcatacctgaaacctgggattctccaggatcaaattattga

SEQ ID NO: 3936 - DNA, 765 bp, Glycine max var. Williams 82
atgtcccagtccaacattttgctaaaaatttgctcagccccagcagacaacatgggaaagagaggaacaaggttaccaggcttctgcctcaacagaattaggcctcatgctagggtgcgttcgccaccagcacaagccaacaacaagcatgacaccaccaccacaagtgctaccaaaattgatcagaaaactgaaaattcttgcaatgcatgtgaggagaagttcgatgacggggcaaaacccgggtctgtgattgctaggaagatcatgattgtggttgattctagccttgaggccaagagtgctgtgcaatgggcactcactcacacagttcaggaccatgacactatagttcttcttcatgtcatgaagccttctaataaacaagccactgatgaacaatccagcaaggaaatagctccaagggcttatgaacttgcttcctccttcaagaacatgtgtcatgggaaaaggcctgaggtgcaaattgagattgcagtaatagagggaaaggaaaagggtccaaaaatagtggaggaggcaaaaaaacaaggtgtggcacttctagttttggggcagaagaagaggtccacaacatggcgtcttctgatgatgtgggcagggcatagagtcacaggtggggtggtagagtactgcattcagaatgcacattgcatggcaattgctgtgagaagaaaaagcaagaagagtggagggtacatgattaccactaagcgtcacaaagatttctggctcttggcttaa

SEQ ID NO: 3937 - DNA, 786 bp, Glycine max var. Williams 82
atgggttcagaaaattgtatagataagaagcactttgtgctggtgcatggggcatgccatggagcatggtgttggtataagctcaagccacgcttggaatctgctggccacaaggtcacagtgcttgaccttgcagcttctggagccaacatgaagaaaattgaagatgttgacactttttcacagtatactgagcctttgttgtttctattggacacaattccctcaaatgaaaaggtagttctagttggtcacagctttggagggctgaacatagcacttgccatggagaaatttccagaaaaggtagcagttggtgttttcctaacagcttttgctccagacgttgaacaccacccatcttatgtcttggaaaagtacagcgagaggaccccgttagctgcatggttagacactgaatttgctccaagtggaaacaaaacaacaatgttctttggccccaacttcttgtccgacaagctctaccaactatccccaattgaggattttgaattggccaagactttaataaggccatcatcactcttcatggaagacttgactaaacaaaagaacttctccaaagagggatatgggtcagtgccacgtgcctttattgtttgcactgaggaccttgcaattccattggaatatcagctcttcatgatccaaaatgttgggttcaatgaagttgtagagatcaaaggcacagaccatatggctatgctttgcaagccacaagaactatttgattccctccagcagatagcgactaaatatgcatga

SEQ ID NO: 3938 - DNA, 660 bp, Glycine max var. Williams 82
atggacgctgcatcggaggctgcggcggcggtggcggctccacaggcagagggatcaccggctgcggcggcagcgccgagccgctacgagtcgcagaaacggcgcgactggaacacgttcttgcagtacctgcggaaccacaagccgccattgacgctggcgaggtgcagtggcgcccacgtgatcgagttcttgaagtacctcgaccagttcgggaaaaccaaggtgcacatcgcggggtgtccgtacttcggacacccaaatccacctgccccatgcgcctgccctcttaagcaggcctggggcagcctggacgctctaatcggacgactcagggcggccttcgaagaaaacggaggtcgtcctgagtccaatccgtttgcgactcgggctgtccgaatttacctcaaagaggtaagagaaggtcaggctaaggccagaggaatcccctatgagaagaagaagcgcaagagaactgctgtaactacctctgtcacctctgccgccaccgttatgtctaccttaactggtagtagtcctaataatactattacaaacggtgctggcagtaccaccggtaacactaccaacggagctggtgttagtgtaccttctgttgctgctactgctacacctaatgttactgctactgccgtatag

SEQ ID NO: 3939 - DNA, 951 bp, Glycine max var. Williams 82
atggcacttccatacccattttcctatctcctcttcctccttctaattctcttatcttctctcccaaacatttcccaagccacctctcgtgccccaaatcgcatgttagccttggttcaaaaccaaccgcttgtactaaaataccacaagggtcctcttctaaagggcaacatcaccctccatttgctatggtacggtacatttacccccacgcaacgatcaatagtcatcgatttccttgaatccctaacctccacgtcagcacctggagccccttcagtttccacgtggtggcaaaccaccgagagctacaggggaggcccctgcaccctcgtcgtagggaaccaaatcctcgatgaaacctactccctcggaaaatcactaaaaaacgaccacctcgtagctctggcgtcgaatcctaaactaaattcggcgcccggggatcgtgtcatccacgtcatcctcaccgcagctgacgtggcggtggaggatttctgcatgaaccagtgcgggacccacgggaggggcaagaacggaaattcagaaaagatcgcgtatgcgtgggtggggaattctgttacgcagtgtccggggcagtgcgcgtggccgttccatcaaccgctatacggtccccagacggcaccgttagtggcgcctaacggcgacgttggggttgacggaatggtgataaatttagcgacggttttggctggggcggttacgaatccgtttgaggacggttactatcagggtccggcgagtgcgccgctggaggcggtgtcggcgtgcaccgggattttcgggaagggggcgtacccgggttacgccgggaacgttctggcggagaacgcgacgggggcaagctacaacgccgtcggggtgcgcggccggaagttcttgctgccggcgatgtgggacccactcacctccacctgcaagacactggtgtga

SEQ ID NO: 3940 - DNA, 642 bp, Glycine max var. Williams 82; identical to SEQ ID NO: 705

SEQ ID NO: 3941 - DNA, 297 bp, Glycine max var. Williams 82
atgggttcaaagacgaagatagcaagggttatcctaggaatgttggccgtgatccttcttatctcctcagaggtggcagccagggatttaaaagagggtgaggttgtcaaagagactaatgaagagaatgatgccaaattagttggtggtggggatgacatctatgaaaatatcaattgtgagcgttacaaatttgtggatttaaacccgaccattggttgcccctgtggctgttgtaagttgtatatagtactgcagttagtttgcgtacattgctgcccaaaaactcggaattga

SEQ ID NO: 3942 - DNA, 153 bp, Glycine max var. Williams 82
atggtggtctttatttgcaaggaagaatatggtgttcccttgagcaatggctgggctgcaacacatgaatttggccacaagttttgcatctcaaatgaaggtgatgatgacgatgatgataatggcgtcatcgatgtggccccagctgcatag

SEQ ID NO: 3943 - DNA, 1380 bp, Glycine max var. Williams 82
atggacacatcactagtgtttactgtgaggaggagtgaggcagagctgatagctccggcgaagcccacccctcgtgaagtgaagctactctcagacatagatgaccaagatgggttacgtttccaaattccggtgatacagttctatcgccacgacccatcaatggcagggaaagaccctgtcgatgtgataagaaaggctgtggccaaaacgcttgtgttttactatccttttgcaggtaggcttagggaaggacttggtcggaaactgatggtggattgtactggggaaggtgttttgttcattgaggctgatgcagatgtcactcttaagcaatttggtgatgctcttcaacctcctttcccgtgctgggaggaactcctttatgatgtacctggttctcaaggagtgcttaacactccccttctgcttattcaggtaacgcggctcaagtgcgggggtttcatattagctgtccggctgaaccacacgatgagcgacgcagccggtctggttcagttcatgagcgcgctgggagaaatagctcgtgggaggcaggagccgtcgatcccaccggtgtggcgcagagagctcctgaacgcgcgggacccacctcgagtcacatgcacccaccgcgaatacgaacatgtccctgacaccaaaggcaccatcatccccttagaccacatggcccatcgctctttcttcttcggccccagtgaagtcgccgccatccgctccctcatcccccaaactgatcaacgctgctccaacttcgaggtcctcaccgcatgcctctggcgctgccgcaccattgcgctgcagcccgacaaagacgaggaggttcgcatcctctgcatagtcaacgctcgctccaagtttgaccctcctctgcctagcggttactacggcaacgcttttgccttccccgttgctgtcaccactgcggggaagctgtgcgataaccctttgggatacgctctcgagttggtgaggaaagccaaagcggatgtgactgaggaatacatgcactcggtggctgatttaatggtcaccaagggccggcctcacttcactgttgtgagatcgtatctcgtgtcggatgtgactcgtgctgggtttggaaacattgagtttgggtgggggaaggctgtttatggaggacccgccaagggaggggttggagccatacctggtgttgctagcttttacataccctttaagaatgctaaaggagaggaagggttggttataccggtttgtttgccttctgaagccatggagaggtttcagaaggagttggactgtgtgcttaaccaccacatcgtccaacctagtgccattgctccaaactctaggttcattgtttcttccttgtag

SEQ ID NO: 3944 - DNA, 1443 bp, Glycine max var. Williams 82
atgagtagttgtgaacatcatcctctacacattttcttcttccccttctttggccatggtcatatgataccaaccgttgacatggccaaattgtttgctgaaaagggtgtgaaagccactatagtcaccacacccctcaatgcacctttcttctccaaagccattggaaactccaaaactaatggcaacaaaatccacatcgaaaccatcgagtttccttgtgctgaggctggtttacctgttggctgcgaaaacgttgactccatcccttcaccaaatttgtttcaagccttcataatggccaccggtttactacaagagccgcttgagcaactattgctcaagcaacgtcctgattgcattgtcgctgattttttcttcccatggacaactgattctgccgccaaatttggaattcctaggcttgtgttccatgggaccggtttcttctcctcgtgcgctaccacgtgtatgggactctacgagccttacaacgatgtttcttctgattccgaatcattcgtcattcctaatcttcccggtgagattaaaatgacaaggatgcagctgccaccttttttcaagggtaaggagaaaacaggcctggccaaattgttggtggaagcaagggaatcagagtcgaggtgctatggggttgttgttaatagcttctacgaacttgagaaggtctatgcagatcatttcaggaacgtgcttggaagaaaagcatggcacattggtcccttatttctttgcaacaaagataccgaagagaaagtgcatagaggtaaggaagcatcaattgatgagcatgagtgtctaaaatggcttgacaacaagaaacctggttcagttgtttacgtatgcttcggaagcgtagcaaagttctcggattcacaacttagagaaattgcaataggtctagaggcttcagggcaacaattcatctgggtcgttaagaaaagcagagaagaaaagggagagaaatggttacctgatggatttgagaaaagaatggaaggtaagggactaatcataagagggtgggcgcctcaagtgttgattcttgaacacgaagcaattggcgcgtttgtgacgcattgtgggtggaattcaaccttggaggcagtgactgcaggggttcccatggtcacttggcctattgctgcagaacaatttttcaatgagaagttgttgagtgaggtccttaaaattggtgtacctgttggtgctaaaaaatggttacgattggagggggatagtatcacatgggatgctgtggagaaggctgtgaagaggataatgattgaggaagaagcaattgaaatgaggaacagaacaaaggtgctttcgcagttagctaagcaggccgtggaaggaggaggatcatccgattctgatttgaaagctttaattgaggagttaagttcattgagtcactaa

SEQ ID NO: 3945 - DNA, 1008 bp, Glycine max var. Williams 82; identical to SEQ ID NO: 672

SEQ ID NO: 3946 - DNA, 834 bp, Glycine max var. Williams 82
atgaccttgttgaccgtggaagatcaaagtttgcatgatatgaacttcttgtgggaaaatcattcatgggatccctccaattctgataattcgggtgaaagtaaagaaaacatgaaatcacttgatcaggtagaagaaaaagatgaagctctcatgaataagaaacgaaatcgagaccaaggcaatattactagtggtgaagggaaaggtgaaaaatgtcgtgaatctgatcatgaaatgcatatatggaccgagagagaaaggaggaagaaaatgaggaacatgtttgccagtcttcatgctttgcttccacatcttccttccaaggctgataaatcaaccgttgtggatgaagcagtggcatacattaaaaatcttgagaaaaccctggaaaagctagagaaacagaaacaagaaagggtccaatgtgtctccacttttgggtgtgaaccatccatgtttgtgactggtcagggatcttctaataacaacatttccaatgcaataattggaactacttcaaatgcactttcattccctgtagcttttgacaagacttgggcttctgcaaatttggtcttgaacatttttggagatgaagcccaattctccatttgcacagcccataagccaggcctcatgactaccattggttttgtgctggagaagtacaagattgaggtcataactgccaacatttcgtgcattggttatggaaatgcttgcatgattcaagcccatggaaaacgagtttcacatcagttcctagatgcaaattcagtagaggaaatttacaagcaagcggcaggagagattatgctatggatcggttaa

SEQ ID NO: 3947 - DNA, 1629 bp, Glycine max var. Williams 82
atggttgtggaggctctagttcctcttcttgagagcaacatgcaagctatgaatgaagactattcagcttcatttaccagtaaaatgaagaaggaggggaatcacaaaacctattcttccaccagagatagtaacaataacatgcagcagggtggggaactttggactaatggacttatttgtgcttttgaattcatgaggggaaatggacctaccaagaagaaggattattgcttagggagaattggaaacagtttgaatgaatcagattcacatggagatgattttcatttgtattgcaaagaggatcttccaaggagatactggagaccaattggttgggatagaatttctgaacttgttcaggcagtgcatagtggtgatgcacagccgtttgatttcacggatgatgagagtgatgttcctgttgcagatgtagcgactccttactgggaacgcccggtggggcccacgtggtggtgtcatttggatgctgctgatccttttgttactgcctggtttggtagttctcgctggttgcatcctgccatcagcatcgctttgcaagaagaaagtagattaataagtgatagaatgaaacaccttctgtacgaggttccagttcgagttgctggaggattattatttgaacttctagggcagtctgctggtgatccatttgctgaggaagatgacattcccgttgtcttacgggcatggcaggcacaaaactttttggtgactgctttgcatgttaagggctctgcttcaaatatcaatgtgttaggtattttagaagttcaggaactgctggctgcaggaggtgctaaaaatccatgcagcattcatgaggttgtagcacacctagctagccgacttgcacgatgggatgataggttgtttcgtaaacacatctttggggctgcagatgaagttgaattgatgtttatgaacaggaggagccatgaggatctgcatctgttcactataatactgaaccaagaaattagaagattatcaacccaggttataagagtgaaatggtcactccatgcaagagaggaaattgtttttgaacttcttaaacagttgagaggaaatgcagcaagagcattgctggaaggagtaatgaagagtacaaggcaaatgattggggagcaagaagcagttcgaggtcgcttattcataatccaggatgtgacgcaaagcacagtccgggcatggttgcaggacagaagcctcacagttacccataacttgggaatattcgggggttgtggccttgttctttccatcataactggactatttggcataaatgtggatggaatacctggatcttcaggaactccttatgcctttcttctattcaccatgatcctctttgtgctaggggtcgtgctaattggaattggattgctttaccttggcctgaaaaaacccatcattgaagaaaatgttgcactgagaaagcaagagcttcaagagctagtcaggatgtttcaacatgaagcagaaactcatgcacaagtacggaaaacggtgcctcacaaggctcaaactgcagcagttcggccaccaaatggtgcaaatcatcgtttcataatgtcaaagttgtgcagtcactag

SEQ ID NO: 3948 - DNA, 876 bp, Glycine max var. Williams 82
atgttatggagtttcattctcttgctcgtggacatggatgtttgccgaaatgtatcagtttcttcaagtgagtgtcagcaagagcttcccacccttgatgaccttttctctcatcagaacacggaagtggattttggcctggaatggttatcagtgtttgtggaagactgtttctctagtaggccaagctgcctcttggcacctggtggtgttcaaaccacaagcactagcacaagcaccaagccttcttcaggcactatattgcaaagaccccaacaattaagtcatcactgtcctttgcagaattttgctgtgccagggaaagcaaggagcaagagaaagagaaagaggctttcagcccctagaacaacaaaacacaccctaagcacatggtcgcaacatttcagcacacagaatgatggggtgagttctgaccctcctcttttgaaacaagcttattggttggctgatagtgaactcattgtgcctaagaagaaggatgttgagcaagaagaggaggagggggttgttgtggttgtgaagaaggagaaattgggggattattgtgatcatgatgagggtgatgaaattaacaataataatagtaataatgatgataatgtgcagcacccaattccaagaaggtgcacacattgtctggctcagaggaccccacagtggagggcaggaccattgggtccaaagacactatgcaatgcatgtggggtgaggttcaagtctggaaggttgttgccagagtataggccagccaagagccctacttttgtaagctatttgcattccaattcacacaagaaagtcatggagatgagaatgggtgttgttggtgttttttctacagacaacaacaagtag

SEQ ID NO: 3949 - DNA, 1764 bp, Glycine max var. Williams 82
atgggaaacaactgtgttggatcgagaacctcttcttctaaagacggaacaaatggctcttctaattcaagttcattctggtggtcacgtggacacaagaaagatgcttctcatgcacacaaaagtggcaaaaagagtgcaaaagccgcagaaactgttcaaaacaagcctccggagatggtgaaaatcgagagggaggatgtgaagcctcctcatcaatccaaagagactaaaccgccttcggaagaaacaaaggagcagccaacaaaaccaaagaggccacacaatgtgaagaggctagcaagtgcaggcctcaaaacagattctgttttgcaacgaaaaaccggtaaccttaaggagttttacaatttgggaccaaagcttggacaaggccagtttggaaccactttcctttgtgtggagaagatcactgggaaagagtatgcatgcaaatcaatattgaagaggaagcttttgacagatgaggatgtggaggatgtaaggagggagattcagataatgcaccacttggctgggagtcctaacgtgatctccatcaaggaggctttcgaggacgctgtcgcggttcatgttgttatggagctctgtgcagggggtgagttgtttgataggattgtggaaagggggcattacactgaaagaaaggctgctaagcttgcaaggactatagttggtgtgattgagtcttgccactcccttggagtgatgcatagggatcttaagcctgagaattttctctttgttaatcagcaagaagaatcccctcttaaggcaatagattttggactgtctgcttttttcaaaccaggtgaaatttttggtgatgtagtaggaagtccttattatgtagcacctgaagttctacgtaagcgttatggccccgaagcagatgtatggagtgctggtgtcataatctacattctcttaagtggggtgcctccattttggggtgaatcggagcaagacatattcgaggcgattttgcattctgatcttgatttctcatcggatccttggcctgctatatctgaaagtgcaaaagacttggttaggaaggtgcttgtcagagatcctactaaaaggataacagcttatgaagttcttcgtcacccctggattcaagttgatggagctgctccagacaaacctctggattctgcagttttgagtcgcctgaagcagttttatgcaatgaataaactcaagaaaatggctctcagagttatagcacagaatctttctgaagaagaaattgcagggttgaaagaaatgtttaaaatgatagacacagacaacagtggtcaaattacatttgaagaactcaaggttggactgaaaatgtttggtgctaatctcaatgaatctgaaatttacgaccttatgcaagcagctgacgttgataacagtggcacaattgaatatggagaattcatagctgcaacattgcatctaaacaaggttgacagggaagatcatttagttgcggctttcgcttattttgataaagatggaagtggatacatcactcaagatgagcttcaacaagcttgtgaagaatttggcgttggagatgtccgcttggaggaaatgatccgagaagctgatcaagataatgatggaagaatagactacaatgaatttgtggctatgatgcagaaaggccatgcagatttgggtaagaggggtcgaaagggtaacactagttttagagttggatttagggaagcaccacctgtacgttaa

SEQ ID NO: 3950 - DNA, 696 bp, Glycine max var. Williams 82; identical to SEQ ID NO: 626

SEQ ID NO: 3951 - DNA, 753 bp, Glycine max var. Williams 82
atggctcaaatttgtttgctcttggtggggcttctctcaatgttctcctctgcctatggctacggatatggtggtggctgggttaatgcacatgccaccttctatggaggaagtgatgcctcaggaacaatgggtggggcatgtggatatggaaacctctacagccaaggttatggaacaaatactgctgctttgagcactgctttgttcaacaatggtcttagttgtggctcatgctatgagataaggtgtgtgaatgaccataggtggtgcctccctggctccattatggtcactgccaccaatttctgtcctccaaacaatgctttaccaaacaatgcaggagggtggtgcaaccctccaatgcaccattttgacctctctcaacctgttttccttcgcattgcacaatacagagcaggaattgtgcctgtttcctacagaagggtaccctgcaggagaaggggaggcataaggttcacaatcaatggccactcctacttcaacttggtcctcataacaaacgtaggaggtgctggggatgttcatggtgtggccatcaaggggtcaagaacagggtggatgccaatgtccagaaactggggtcaaaattggcaaagcaacaactatctcaatggccaaagcctctcattcaaggtcacaaccagtgatggccgtacagctgtgtcctacaatgttgcccctgctggttggtcctttggccaaacctacactggtgctcaattccgctag

SEQ ID NO: 3952 - DNA, 1068 bp, Glycine max var. Williams 82
atgtccatagcaggccttatagacccagaaatgaatcacaacaagtccttccaccggcgaaataactccggcgagctcgatgtgtttgaggcagcaaggtacttctcaggatacagtgaagttcttggctccaccaccaccacctacactcagaagatcaatatgagagaagaaaggcaccatcatcatcatcatcatggacatagagctgccagaatcagcttagacatgccaatgagaagcttgctcccacagcaattccatggcatggagaagcaaatcatcatgaaggagaagaagcacaagcagcctagctctcctggtggaaggcttgcaagcttcttgaactctctcttcagccaatcagcatcaaagaagaagaagtcaaataagtcaagctcacagtccatgaaagatgaagatgagagccctggtggaaggaggagaagaaggagcagcattagccatttcagaagctcaagcactgcagattcaaagtccttgtactcctccttgagttcagggtttagaactcctccttatgtacaaacaccaacaaagagctgcaaggaattcagaaccttctcttcagaaaacaagcatgcactgtccttttcagcaaagtacaacaataacaagaacaacaatggacaacatgtaagatcatcaacagcaaccaccactttgcaaaatgagtttttgtgggatgagaagaaaaagagggaaccaacaacaacaacaaccttgttggatgataatagcaaccacaaacacttatcagagaaacaaaagaacaacaacaacaagggaagtcatgagttattacttgagaaagataggatgttagtggacaacaagtactcatcagaagagaaggaaaccaccactcaattcaagaacttcaatgaggttgttgttgatgatggtgcagaaagtgattcaagttctgatctgtttgaattgcaaaactatgacttgagatactattcaagtggcctacctgtctatgaaactaccaacatggatagcatcaagagaggagcaccaatttccaatggccctctgtga

SEQ ID NO: 3953 - DNA, 759 bp, Glycine max var. Williams 82; identical to SEQ ID NO: 712

SEQ ID NO: 3954 - DNA, 1071 bp, Glycine max var. Williams 82; identical to SEQ ID NO: 740

SEQ ID NO: 3955 - DNA, 654 bp, Glycine max var. Williams 82
atgttcgagtttggaacttctgtacttgtgccttctgttcaggaacttgcaaagcaagccatcatcaatgttccagagaaatatcttcgtccaaatcaagactctcatgttatagtagactcaaccttaacacttccactcattgaccttagcaaattactatctgaagatgtaaccgagctagagaagctaaacaatgcatgcaaggaatggggtttcttccaggtgattaatcatggagtcatcccttcactggtggaaaatgtgaagagagacgttcaagagttcttaaatcttccaatggaaaagaagaagcaattttggcaaaccccagatgaaattgagggttttggccagttgtttgttgcatctgaggatcaaaagctagaatgggcagatatgttcttggttcacactcttccaataaacgcaaggaatcctcgcttatttcctaactttccccaaccattgagagataatttagagaactattctttggaactgaaaaagctttgcctcacaatcattgagcgaatgacaatagctcttaagattgaaccaaatgaactgctagactacatagttgaagatttatttcaatcaatgaggtggaactactaccctccatgcccccaaccagaaaatgtcatttga

SEQ ID NO: 3956 - DNA, 705 bp, Glycine max var. Williams 82
atgatcatgaatagcatccttttggttttactactcatggaaattcttaactgtgaagcacaatatttcgatgccagcccgtacgactatttagaactagccttaaggtggccaaactcctactgcttaacacatgaagatggttgcagggaaatagtgccccaatatttcactattagctactttcgtcccaggaaattgggagggcctgatctacaatattgtcccacgccaatcactctgtcaaataacattattgaaacgaacaaatatgacctacttagattctggcctgatctgagaactgataattttatagagagcaagtcattatggagggaccaatggaaaaaatttggatcctgctgttttatgatgccagatgactattttgtttatgcactcaacaacagaaagagatacgacctaaagagaatcttgacaagtgcaggtaaatgtattgttgccaatggaaattcatatccaacgtataggatactacaaattttcaagaaaactctaggtttgaatgtgagcatagtttgtgagtcagatagaagtggcaatgtttatcttgcagaggtgcatcaatgtgttgacatctctggaacaatgccgataagttgtgacaataaagcaaaaggatgtgacgatgaccccatctttccctatatgggatttcaaccagataaagatcccaaataa

SEQ ID NO: 3957 - DNA, 2256 bp, Glycine max var. Williams 82; identical to SEQ ID NO: 676

SEQ ID NO: 3958 - DNA, 288 bp, Glycine max var. Williams 82
atgggttcgaagatggcaatagtgatcgtagccttgttcgccgtgctccttttcatctcccaagaggtggcatgcagggatttcaaagaggagctaggtgaggttgtcaaagagactaatgaggagagtgatgccagattagccggtagtggtggtggtgaccttgattattgtccgggttacgacaccattagaaagtggataggacgttgccgttgtggctgttgtcagtggaccacagagccggaagtttgcatagattgctgtacagtaatgcaccacaattga

SEQ ID NO: 3959 - DNA, 993 bp, Glycine max var. Williams 82
atgggttctcatctccaattatctttccttgtgcttgttatggtcactttggcaacatttatgatccctacctttgctcagctcactcctaattattatgacaaagtttgccctaaggcgttgccaatcataaagtcaattgttaagcaggcaattattcgtgaaaaacgcattggagcatccttgctgcgtttgcattttcatgactgctttgttaatggctgtgatggatcagtgctgctagatgacacaccttccttcttgggggagaagactgcacttccaaatcttaattcaattagaggatttgaggtggttgatgaaatcaaagtagcagttgacaaagcttgcaatcgtcctgtagtatcatgtgcagatatcttagctgttgcagctcgtgactctgtagctatattggggggtgcacaatattggtaccaagtgttactaggcagaagagatgcaatatatgcaagcaaggatgcggcaaatgccaatctccctcccccattcttcaacttcccacagcttcttgctagtttccaatctcatggccttgacctcaaggatctagtggtcctctctggtggccacacaattggactagcaaagtgcattaccttcagggacaggatcttcaatgacacccacatagaccccaacttcgcagccactttgcgcgattcatgccctcgaagaagcggtgatggagacactaacctaacaccattggatgcctcctctccttcacaatttgacaacacatactacaaggctttgttgcacaaaaagggtctcctccattctgatcaagagctattcaagggtggtgatgatggtggtgaaagtgatagattggtgcagctatacagctatgacccttatgcttttgctagagattttggtgtctccatgattaagatgggtaacttgaagcctcttactgggtatgagggagagatcaggtacaattgcagaaaagtcaactactag

SEQ ID NO: 3960 - DNA, 2124 bp, Glycine max var. Williams 82
atgtctttcgctctcatcgaagcctgcaagaagcgtaaacggttgccgaagtttttcaggttcaactcgttcggcgaccctggtgttgttccaattgcacgttcgggtcccttccgcgataacgttcgcgttttccttcaagaagctggcgatctcgaagactacactgtctccgggaaccccctctggtgcattcttctcatccacgacaactcgtacgctatggctcctctttacaccatcgaagaacacgtcgaccactcttcgcaccccttctgcgatcactgccgctgcgtaggttggagtggacattttgtatcaaagagaaggtatcattttataatccccatggacaatgggtggcataaacccttagatgaagattcaatagacaatgagaagcatctgctgcatggagtgattcattgcaatgggtatggtcatttgctttgtgtcaatggcattgaagaaggctccaaggttcttagtggcagagagatcatggatctttgggataggatatgcacaaacctccgagtgaggaagattgcagtggaagatgtttcttgtaagaggtctatggatcttcgcttacttcatggagttgcttatggacactcctggtttggtaggtggggttataggttttgccgtggaagctttggagtgacagagcgagaatacaatgaagcaatgacaacgcttggttccttggggcttgacgtgattgtaaaagatttgagcaagacaaagacaaagtacaaggcagaaatcaagcaaattattcggtgctatagagatatgagtgagactcatattatctcactcagggatcttctaaggtttatgctcactgtcaagtcttctcgtgctcctgtgcctaagataacagacacttattctgctgctgctgattctacttcttcagcattaacctcaagaaattcaaccaaacacacacttccaaacagatcaaattccatgaaggataaatctgtgaggtacaagaagttcagcaatgcagtgactagcatagatagcaggtggcccacaaggagactagagtttgcagctcaagtgattgtggatgcactgaaagagaacaaggctgtgaaaccaggctcaggtgggatgacaaggcaagatgtgagagatgcagctaggatacacattggtgacacaggcttactcgattatgtgcttaaatcactcaacaatgtgattgttggaaactatgttgttcgtcgcatggtgaatccaacaactagaatcttagagtacactattcatgatcttggcaaggggttaaaagcccctgaagtggagactgaagtgatggctcatgtagatcaacaagtagaagagtcatcttggaagcctggtaatgatgtatactgtgatgcattgtttttgtacaagaatgtgctattgagttaccctgattcagaagcagtggacacagcagttcagacaattctagacagcagatactttgtgaaggagtggccagtaagggatgaaataaaggagcaggtattgacattcatttgccgcttgcaaccaaattttgtggacaaaaaacatgagctgaaaggtgtagcatgtggtgagattgtagtggttccactgcatgcaacagttggtgacttgaagagagcttcagaggctgctctgagggacacttactgcattgcagagagtcttatagtgacagacatcaaagaactcatggatgtgagtgatgaggaagtattgtttggattaatccagtctggtgtggaactttgtgtgaggggaattgcaattgatttgttgacccctttgaagtatgagggtggatctgaatctgacaactggaaggtgaggtgtgagtgtggagctcaagatgatgatggggagagaatggtggcttgtgacatttgtgaagtatggcagcacactcggtgctgtggcattgatgattctgagacagtgccaccactgtttgtgtgcactggttgctgtgactcagtactagtaccttcttcaaggactgaatcaacagtctttggtgtggattctgccgattcttttctcatttcagaagactctacccttttactaggatacgagtatggatactaa

SEQ ID NO: 3961 - DNA, 1227 bp, Glycine max var. Williams 82
atggtctcagcttcttcttctccccctcgcaatgccaaatggtggtactcaacttttcacactgtgacggccatgattggtgcaggtgttctcagccttccctatgccatggcatatctaggatgggtgccagggaccttgtttttgttgatatcttggtgcctgaccttaaactcaatgtggcaaatgatccagctccatgagtgtgttccaggaaccaggtttgatcgttacattgatcttggaaaacatgcttttggaccaaagttagggccatggattgtgctgccccaacaactgattgtccaatgcctgaagaagttcatggagattgcttgcaccaattgcacacaaatcaaacagtcctattggattctcatttttggtggcatccatttctttctttcgcagcttcccaatttcaattctgttactggggtttctgtagcagctgctgtgatgtcactaagctattcaactatagcctgggtggcttgtttggctagaggtcgtgttgagaatgttagctatgcatacaagaaaaccacttctactgacttaatgttcagaattttcaatgcaattggtcaaatttcatttgcatttgctagccatgcagtggccctagaaatccaggccataattccatccacccatgagaagccctcaaagataccaatgtggaaaggtataatcggtgcctatatcatcaatgctatatgctatttccccgttgcacttgtaggatattgggcctttggaagagatgttgaggacaatgtgcttatggaatttgaaagaccttcatggctcattgcctcagctaacttgatggtgttcattcatgttgttggtagctaccaggtttatgctatgcctatttttgacttgattgagaaggtgatggtcaaaagatttaagttccctccaggagtagcacttagacttgttgttagatctacttatgtagcttttacattattatttggggtcacatttcctttctttggtgatcttcttgggttgtttggtggatttggttttgctcctactgcattctttcttcctagtataatgtggctgataatcaagaagccaaaaagattcagcacctactggttcatcaattgggcttcaatatacgttggagtgtgcattatgttggcatctacaattggtggcttaaggaatattattactgatgcttctactaagttttacacctaa

SEQ ID NO: 3962 - DNA, 1629 bp, Glycine max var. Williams 82; identical to SEQ ID NO: 725

SEQ ID NO: 3963 - DNA, 1428 bp, Glycine max var. Williams 82; identical to SEQ ID NO: 654

SEQ ID NO: 3964 - DNA, 309 bp, Glycine max var. Williams 82
atggatagagtaagagagttggcatcaaagaaggcagcagttatattcaccaagagttcatgttacatgtgccacagcatcacgcaactgttctatgagcttggagcaagccctgcagtgcatgagctagacaaagatggctatgggagggaaatggagtgggctttgaggagcatggggtgcaacccttcagtgccagcagtgttcattggtggaaaatttgtggggtcttcaaaggatgtcatatccctccatgttgatggctctctcaaacaaatgctcatggctgcaaaggccatatggttctag

SEQ ID NO: 3965 - DNA, 171 bp, Glycine max var. Williams 82; identical to SEQ ID NO: 685

SEQ ID NO: 3966 - DNA, 963 bp, Glycine max var. Williams 82; identical to SEQ ID NO: 623

SEQ ID NO: 3967 - DNA, 351 bp, Glycine max var. Williams 82
atgaaaccgtacctacgtccaatattcctattattccttatccttctcgaccaatccatttcggcgagtgctgctataaatattaatggtctgagaaacaaaattagagaagttctaaacaagcacccgagcatcaatcttccggcagataaactgaagaaggtgaagagaccactgaaggcactggattatctgcttggcgaatgtaaggacaggccgcctcaagaatttcaagaattttgcccgaaatttaagaacgattatcaacaaaattgcccgaatgccgcgtatgaagcagtttgcccgttactgaagcaagcgattcaaatatgttgccagaaacacgcataa

SEQ ID NO: 3968 - DNA, 1377 bp, Glycine max var. Williams 82; identical to SEQ ID NO: 707

SEQ ID NO: 3969 - DNA, 1830 bp, Glycine max var. Williams 82
atggatgtatgtgagtcagagcaagcattaaggaaacacaaaactagaacaagacaacccttggttcctgctgagaaaaacaatgcattcacggccagacgctctgggacaagggaaattacttcacggtataggtcgccttcgcctactccggcaaccccagctggtcctcctcgtcgatgtccctctccaagcctcacaagggcaacaacacctgcatcatccaaattgttacccaaaagagctcaatcagcagagaggaagaggcccgcaactccaccttccccacctagtccttctacacctgtccaagactcatcagtagatgtgcatttatcatccagaaggctgtctggtagcagaatgccagaggccctttggccttccaggatgcgaagtttgagtgtttcttttcagtcggatactatttccatacctgttatcaagaaggagaagccagtgactagtgcttctgatcgtacactgcggtccaattcaaacgtggctcacaagcaggctgaaacaccaaatgtaagaaagggtacgccagagagaaaaaggagtcctctcaaagggaagaatgcctctgatcatcagactgagaattcgaaacctgttgatggtttacattctcgactgatagatcagcatagatggccaagcagaataggtgggaaggtatgttctagtgcatcaaatagaggtattgatcatgctgataagacaaccagaatgtcaaactcttctgttccgggaactggtgtgtcttcgctgagaagattgtctttaccgggtgaagcaagtaggcccttgcagaaagcttctagtgatggtgcaaggctaatgttgcttgttgaaagtggtagaatagtaagcgaggtgaaaccggttgatgacagttttcaagtactaagacctcacaaatttgttcctgcaactacattggataaaacgggattagcagttgctggagtcagatctcagtccttttcaagtcccggatcacgactcccttcacctagtaagacctcggttataccctcttgtagttcaagaggtgttagtccatctcggtcaaggccttcaactcctcctagaggggttagtccatctcgaataaggccagccaattcatccaaccaaaatacaacttcagtgctcagctttattgctgattttaaaaaagggaaaaagggtgcagccctcgtagaagatgttcaccaactacgacttctctacaacaggtacttgcaatggagatttgtcaatgcgcaagcagaggatgtattttacatccaaaatgtaactgcggagaaatcactgtacaatgtatggcacactactttgtctatatgggaatcaattattaggaagaggatcaatctccagcaactgcagcttgagctgaagctgaattctattttgaatgatcaaatggcctaccttgatgactgggctgtacttcaaagtgatcatattgatgccttatccggggctgtagaagacttggaggcaagtactcttcgtcttcctctaactggaggggcaaaggcagatattgaacatttgaagcatgctatctattcagctgttgatgccatgcaagcaatgggatctgctatctgccctttgctgtcacgggtggagggcatgaatagtttaatgtctgaagttgctgttgtatcagctagggaaaaagccatgcttgatgaatgtgaagcgctactgaattttgcgacagctaagcaggttgaggaatatagccttcggacgcatctcatgcagatcaagcaaataagtaaccaatctcggaaattcaaacacgcatga

SEQ ID NO: 3970 - DNA, 1812 bp, Glycine max var. Williams 82
atgggcacttctccgagccgcgagggcctcgaagtcaccgactcagattccgactacgaacacgaagaagaagaaacagagcactacgaacacgccaaaacccactccaccgagctcgatgacttggatgcgaaactcaaagccttaaaactcaaataccaaacgccctcttcctcctcctcaaaatcacttccccaaaacgctgttaagctctacctccacatcggcgccaccactcccaacgctaagtggatcctctccgacaaacgcacctcctacgcctttctcaaagactcagacgacgaaaacgacgccgtttggttcctcactgtaggttccaaggtccgcgctagggtttcctccgaaatgcaattgaagatgttcggcgaccagcgccgcgttgatttcgtagccgacggcgtctgggccctcaaattcccctccgacgacacctaccgccgattcgtcactgaatttcaaaactgcgtcttcgagaacgtgtatggaatcgaatgcacggaagaaaacaaggtcaaaatcttcggtaaagagttcatcggctgggtgaagccggaagccgccgacgattccgtctgggaggacgccttcgccgcagatccgtcgccttcgcggcggagagacgacctaatggaggaattcgaagaggccgcgaacggtggggtccaaaccctaaccctaggcgcgttggataatagtttcatggtgaacgacgccggcgtccacgtgtaccgcaacttcaaccgcgggatccacggcaagggcgtcgccgtgaagttcgccggcggtgacgccacgccgaacaaggctttgttgatgcgtgcggaaacgaacatgatgctgatgagtcccttaaaagacggaaagccccacgcttcgaagcttcaccagctcgacattgaaacggggaagattgttacggagtggaagtttggaaaagacggagttgacttaacaatgagggatatcaccaatgacaccaaagggtcgcagttggacccttcggagtcaacgtttttggggctggatgataaccggttgtgtcaatgggacatgagggatagaaagggaattgttcagaacattgccacggcgagttcttcgcctgttttgcattggagccagggacatcagttttccgcagggtctaactttcagtcctttgcgaccaccggtgatgggtccattgtcgtggggtctcttgatgggaagataaggttgtactcgaagacctcgatgaggatggcgaagacggcgtttcccggtctctgttcgccgattactagtgttgatgttacctatgatggcaagtgggtgcttggtaccacggatacttacttggtgctcatttgcaccttgtttacggataaagatgggatgacgaagaccgggtttagtgggagaatggggaacaggatacctgctccgaggctcttgaagctgactcctctggattcgcatttggctggtgcgaacaataagtttcacagtggccatttttcgtgggtcactgagaatggtaaacaagaacgccacctcgttgcgactgtgggcaagtttagtgtgatatgggattttcagcgggtgaagaacagtgcacatgaatgttacaggaatcaagaagggctgaagagctgttactgttataagatagtgttgaaggatgagtcaattgtagaatcacggtttatgcacgacaaatttgcggttagtgattctccagaagctccgttggtggtggctactcctatgaaagtcagctccatcagcctgtctggaaagcgacatggttaa

SEQ ID NO: 3971 - DNA, 183 bp, Glycine max var. Williams 82
atgattgtggcagtgatggcaaaagtacttctcaataattttcagaaattacagccagaacttggagcatcttccaaagattctggagcaaagactgtgactcctcttcatacaatgaatatgattaaatcttgctatggccctccattgaagtacatgcatgtctctggcattttcacctaa

SEQ ID NO: 3972 - DNA, 513 bp, Glycine max var. Williams 82; identical to SEQ ID NO: 657

SEQ ID NO: 3973 - DNA, 294 bp, Glycine max var. Williams 82; identical to SEQ ID NO: 741

SEQ ID NO: 3974 - DNA, 606 bp, Glycine max var. Williams 82; identical to SEQ ID NO: 711

SEQ ID NO: 3975 - DNA, 666 bp, Glycine max var. Williams 82
atgtcaaagggtgacaaggttgaggttttggacttttgggctagcccattttgtgcaagagtgaaagttgctttggaagagaagggggtgaattatgtagccagtgaagaggatttgtttggaggcaagagtgagcttctccttaagtcaaatcctattcatcaaaaagttcctgtgctcttgcacaatgacaagcctctagccgagtcttctatcattgttagctacattgatgaagtctggtcttccaacccactgcttccaactcttgcttatgatcgtgcacaagccagattctggactgattacattgacaaaaaggtatttgaaaccgggaggagtatctggggaagcaatggagaagagagagaagtgggcactagggacttcattgaagttttaaagcatcttgaggaagctctaggggagaaggactactttggaggtgatgcctttggttatgttgacatcatagccattggtcattcagcttggtttttggcctatgagaagcttggtggcttcaaagttgaagaccactcgccaaaaatctcagcttggattaagaggagcttgcaaagggaatctgttgccaaagttctgccagaccctgagaaggtctaccagtttgtccttcatttcaggaagatgttaggacttgaataa

SEQ ID NO: 3976 - DNA, 2481 bp, Glycine max var. Williams 82
atggcacaagctaccaagtcacgcaacagcaggaggccatcatcatcttcctcttacacatcaaccctaacaaccctaatcttcatcgcactatgcgttttgggcttatggatgctaacctccaacaccgtagtcacacccaaaacacgcactgccattgatgataatatctccgaaaccaccaacaccgacctcacccaagacaccaccgccacaaccacaacaacaaacaacatccccgatgattttgctgaatccatcacaaccatctcccaagacctgccacgtgagaccgccacaaatataccacatgaaatccacaccaaaattcaagaccaaaaggacgctacggtgttcggcgacaaccccggaaacctccccgacgatgccataaagaatgatctcaagaaagaaacttccattattgcgaacgaagctactggttccgacagcgatcagaaagcgaacgagagcgagaaagaatcgcaaaacaacatcatcatagctcaagatgaaaaagaaaacctaaactcaaaacaaaacacagaacctgagattgcaaatgtgagtgagaatattcaagaagagggcacaggaggaggaggtaagagcaacaacaacgacgatgacgcgaacgtgcagcaactgagagaagacaaaggtgaggcagtggcggagagagagcaaaaggaaaaagaggagaatgagaagaggaagaagaacaatagaaagaaatcaaacaagggtttgaagaaggaggggtcatcaacagaatcgaatgatgatgagtcgacacagcggggtgagaaaaagggatcatcaactgaatcgaatgatgatgagtcgacacagcagggtgagaaaaagggatcatcatcacagaatgatgaggaatcatcatcatcagaagtgatgcaattgcaggataatttgaagtggagtttgtgcaatgtcacggctggtatggattacataccgtgtttggataatgacaagtatttgaaaacttcgcgcagaaagcactacgagcatagagagaggcactgccccgaggatgctcctacgtgcctggtgccacttcccaaaggttacaaaacaccaatacagtggcccagcagcagagataagatatggtaccacaacataccacacactttgctagcagacgtgaagggacaccagaactgggtgaagttaacgggtgaattcttgacattcccgggaggtggcacccagttcattcatggcgctctccactacattgattttcttcaacaggctgaaccaggtattgcatggggaaagcacactagggtgattttggatgttgggtgtggggtaggtagtttaggaggttacctatttgaaagagatgttattgctatgtcttttgcacccaaagatgagcatgaagcacaagtgcaatttgccctagagagagggataccagccatatctgctgtcatgggtactcaaaggttgcaattccccagcgaggtctttgatcttattcattgtgctcgctgtcgtgtaccttggcatgaagatggtggcttgttgcttttggaattgaatcgcctccttagaccagggggttattttgtgtggtgtgctacacctgtgtaccagacaattgaagaagatgctgagatatggaagcaaatgaaggcattaaccaagtccatgtgttgggaactcgtgaccataaaaaaggatgcattgaatcaagttggtgctgccttctaccgcaaacccacttccaacgaatgctacgagcaaagggagcaaaaccaacctccaatgtgcaaaactgatgatgatccaaatgcagcatggtatgttcctctacaggcgtgcatgcacaagttgccgactgacaaggacgagagaggaactagatggcctgaaccttggcctcgtagactggaaaaagccccatattggttaaacaacttgcagggtggaaaacaagcttctcatgattttgcaacagacaatgaacgttggaaaaacgttgtagatgagttgagtaacgttggggtttcttggtctaacgttagaaatatcatggacatgcgagctacttatggaggatttgcagcagctctgaaggatcttcctgtttgggtattcaatgtggtgaacacagatgctcctgacacacttgctgtcatatatgaacggggtctcattggaatataccatgattggtgtgaatcctttagtacctatccacgaacttatgatctactacatgctgatcatcttttctcaattctaaagaataggtgcaatcttgttcctgttgtaacagagattgatagaatagtaagaccaggaggtaatttgatagtccgtgatgaatctagtgtcattggagaggtggaggctttgttgaaatctctgcattgggaaataacctccacaaatctagagggattgctctgtggcaagaaagggatgtggcgacctagctcttga

SEQ ID NO: 3977 - DNA, 3204 bp, Glycine max var. Williams 82
atggctaccaacaagtttgctaccatgttgcatagaaacaccaacagaatggttgtgattctagtctatgcagtgcttgaatggcttttgatagcactccttcttctaaactctttgttcagttacctcatcacaatatttgccaaatgtgttggcctccaaccaccgtgtctttggtgttcaagggttgatcacgtattgcagaaagacattgccacgcatttgcacaaggatctcgtgtgtgaggctcacgcagcagagatttccaagctcggttactgctcaaatcatcagagactcgcggagacacacagcatgtgtgaggattgtttggcctctcggccaaaccatcccgagaactcgttcggaatgaggcaaagaatcgctttcatctcgtgggtgagtagtcatggcaaacatgaaaatggagatgatgacataatgggattgagaaggtgctcttgctgcaatgagagcttgagctgcagcagcagcagcagccagctttactctccttatttgctgttgaagccttcttggggccatgagaattacaatagcaaagggtcttcttttattgtggaagaggcaatagatgatgaaaaagaagatgataaggaccttgagtttgattttgagtttgagagaaacaatggagaagaagaggtggcagatgagcatcagatactttctgatatcgagagttttatcctcatagaggcggccgaggatcgtttgagttctgtttccaacttgcattcggatgaaaaggatgcggaaaaagatgagaaggaagatgatgatgatcttatcatcatcactgagctggatccaagtggtgatcacaattttgtttgtcaattcacttccactatgcagggttcactgtatggagatcaatcacttgaagtcatcaatgtgcattttgagaatcatatggcttgtgatagccaccgtttggtgcctgtcaagttaattgactctattacctctttgaatcttgaaacatacaaattggatgagtcaccaattgaagcacaatcaagtatcttagaaaggggaggattactcacagtggatgagagtgcagagaaaacaagtgtgagagaacttgaaagcttggaaaattgtataaatttggaacttgaagggttaaaacagaattcagttgatgaggtacatccacaggggactactgctggagaagctcagactttgctgaatgatgacaacagtgttgaagcagctactgaagaactagatgatacacaagttgatttgcctcaatctcaaaaaccagaaagctctaatgaatgcacagaagaagatgaatcttcatcaagtgatgatgatgttggagtccaaaatgcctttgataagttcattgctcagaataatctaagtaagtctcaaagtttatctaatggtgacaacagtatggaagcagagatgcaagaaccagaaaatccacaagctaatctgcctccatctgaagaaccagcctgctcttgtcaatgcatatcagaagatgaatcttcatcaagtgatgatgatgctgaagttcaaaatgcctttgatgaatttattgctcagaatcgtctaagtcagtctcaaagtttatccaatgatgataaaagtataaaatcagatacggaagaaccagagaataaacaagataaccattctccatctgaagaacctgcttgcttatctaacatacaagaagatcaatcttccacaagtgaagatgatactgaagctccaaatgcctttgatgaattcattacccagaataatctctgtccagataaaacaggtgcaaatgacaccgagtatgctaagaacattgagaaaacaatagcagttgagaaaaatcatgaagaaacaagccatgaatcatccaagtgcccagagccatacgaagtagaagaagagaaacttcctgagactcctagatctgtagatggcctgcattacctgcataaaagagaatcagtagcaaatgactctgtggatggcagtgttgcaagtgaggcagaatgtggcgacccggtattaacaatcgaccggctaaaaacagctttacaaactgaaagaagggctctaagtgttgtatatcaagaactagaagaagagagaagtgcatcagcagtagctgccaaccagacaatggcaatgattacaagactacaggaagaaaaggcagcaatgcagatggaagcattgcaataccagaggatgatggaagaacaatcagagtatgaccaggaagctttgcagcttttgaatgagttgatgatgaaaagggagaaagagaagcaagaacttgagaaggagttggaagagtatagacagaaggtaatggaatatgaagcaaaagagaaactaagggtgttgcaaagaatgaaagatggaagtgtaagaagtagaggatcctcttcttcttgcagcaacatgaactacactgatgagctatccattgatcttaaccgcgaggtgcatgacgaagataatgtcttgttcaaccatgaggagatcagccacaataatgcaactgatgacacagtttctaatatggaggagatggcactagactgtgtaaagcatgtaagtgctcttgatgatacattggctgaatttgaggaagagagggcttccattctagaacagctcaaagcattagaggaaaagattatttcacttgcagataatgaggaatttcttgatgacatcaaattgattgagcattcatcaatgtatggtgacaaagacttgaatgaaaactgcaactttagcagtgttgaagaggagaatggatattctaatgggttttcagatgataaacactctccaataggttccttggccaagaagctacttccatatttagatgcagctgagaatgagactgaggaaacatacacacttgagggacaattggaatctgaatcatctgacatgcaaaactcagttcctatacttgaaatggatagcatgaagacatgcattgaagaggaggttgatcgtgtttacgagaggttacaagctcttgaaacagataaggagtttctacaacactgcatgggttccatacagaatggtggagagaaaggagtggatctgcttcaagaaatcttgcaacatcttcgtgatcttaaggatgtggaaattcgcctgaagaccttgggaaatgatccactatag

SEQ ID NO: 3978 - DNA, 1428 bp, Glycine max var. Williams 82; identical to SEQ ID NO: 675

SEQ ID NO: 3979 - DNA, 2298 bp, Glycine max var. Williams 82
atgcttggacaagagaattgtgtccttagatcaccattcttgcaatgtatcttcattggcttcttgatgcattctgttgtgggagctgagattccattgggttccaaactttccgtggttgagaatgattgttgggtttcctccaatggtgattttgcatttggattctacaacatttcagatcaacctaaccagtttagtgttggcattagattcaattccaagtctataccatataaccaacaaactgtggtttgggttgctggtggtgatgtcaaagtaggtaacaagtcctactttgaactcactcaggaaggggaactggtcctgtttgattccttaggcgaggtttctgtttggaccgtcaaaacgggaaaccgatctgtagcttcagcttcacttcttgacaatggaaatcttgttctaatggacaaggagcaaagaatcatttggcaaagttttgatactccatctgatacacttctcccaggacaaagtttatttgctaatgaaatgcttcgggctgctaccgcaagcaagaatagcaaggccagttactatactctccacatgaatgcttcaggtcatttggagctacattgggaaagtggtgttatctactggacaagtgaaaacccttctgcttcaaatctcagtgctttccttacagccggtggagctctagagcttcgagaccgaagcttgaaacctgtttggtctgcatttggggatgatcacaatgattctgtgaagtacagatatcttcgactcgatgtggatggcaatcttaggttatattcatgggttgaaagtttggaatcatggagatcggtctggcaagctgttgagaatcagtgcaaggtctttgcaacttgtggtcaaattggtgtatgtgtgttcaacgcctcaggttctgctgaatgcaaatgcccgtttgaggtaactgggggtaacaaatgtttggtaccatatgaaggggagtgtgaatctgggtccaatatgatagcatataagaacacatatctatatgcattctaccctcctgataattcttttaccacaactagtatgcagcattgtgaacagttgtgcctgaatgacactcaatgtacagttgcaaccttttccaatgatggaactccacaatgctcaataaagaaaactgggtatgtcactggttattcagatccatctgtaagctccatatcatttgttaagagatgttcaggtccatttgctgtaaatccaggtatcaccaagtctcctcctccttctgaaccgcctcctcggctctgtgttccttgcgtaataggagcttcgactggcacatttttcacccttgttatactccagttgggaatagggctcttcatctacagaagaaaaaacactaccaggaaaaagtccactttagctttcacaggcacaaactcgaagggtttaattgtgttgtccttctcagaaatcaagagcctcacaggggatttcaagaatcaaattgggccaaaggtgttcaagggtttgctacccaacaatcatctgattgcagttaaagacctgaatgcgtccatagaggaaaggaagttccgaagtgctgttatgaagatgggttgcatccaccacaagaaccttgtgaaactggagggttattgttgtgagtttgatcacaggtgtttggtgtatgaatattgcaaaaagggttcagtggacaagtacatagatgatgatgctcttggcaggatgctgacatggagaaagagagttgagatatgctcaagtgttgcaaaggccatatgctatttgcactccgggtgcagggagttcataagccatggaaacttgaaatgcaaaaatgttatgttggatgaaaacttagtggccaaggtgactgaatttgggtttgctattgcagatggcaaggcaacatattgtggcttttcagctgagaaggatatagaggactttggcaagttagttctaaccttgttaacggggtgttgcgatcacgatcatgttaagctttgtaagtgggcgtataaagaatggatggaagagagggtagccaatgtggttgataaaagaatggaagggggttacaattcagaggaactggagcgcacattaagaattgcattttggtgccttcaaatggacgaacgtcggagaccttccatgggtgaggtagtaagagtacttgatggttcattgagtgtcgatccaccgccatctccttttgtctttcagaggcccttgcaggtagattattcagaagaaaatgtttcagaattagaaggatag

SEQ ID NO: 3980 - DNA, 654 bp, Glycine max var. Williams 82
atggcgttcaaagtggaccatgaatacgattacctcttcaaggtcgtattgattggggactccggggttggaaaatctaacatcctttccagatttacgagaaatgagttctgcttggaatctaagtctaccattggggttgaattcgcaaccagaacattgcaggtggaggggaagactgtgaaggcacaaatatgggacactgcagggcaagagaggtacagagccatcaccagtgcctactacagaggagctgttggtgccttgttggtctatgacataaccaagaggcaaacatttgacaatgtgcagaggtggcttcgggaactacgggaccacgcagactccaacattgttatcatgatggctggaaacaaatctgacctgaatcatctgagagcagtgtctactgaggatgctcaaagtttggctgagagggaaggtttgtcctttctagagacttcagcattggaggcatacaatgttgataaggcatttcaaaccattttgtttgatatatatcacattataagtaaaaaggcactggcagcacaagaggctacttcctctactggccttccacaaggaactaccataaatgtctcgaatatggctggtaatgccggcggcaatagaagttgttgctctaactaa

SEQ ID NO: 3981 - DNA, 822 bp, Glycine max var. Williams 82
atgctcacactaattgcagtcatgcaccaggttattactcctatgggttacaaaagcagtgtggacagcaggttaatgtttggagctaaccagaagatgattgaggcacaagctgcaaggaagaaggaagagtatcttaacaatccggagcttgctcagatttctgaactatacaaatcagaaaaggttggatttaagatagaaacaattacagggtcatcactaaagacagttgcattgaaatcagccatgaagctaaaggcaaactggctcatactggacaggaaaatgaagaatgatgaggagtatttcctccggaagctttcttgtggtatcttaagagtaaggcgtttcaataaaattctacgtttaagagaaccactacacctcccccaagaaacacaacccggtagcacccatgaaacatacactgacagtataccactaccagacacttcaactgaacatgatctttacgtcttcagcgctgagacttcccctaatagtcaaggaggagataatcagatgaaccaggaacaaggacataccctaaagagcctccatgatgaggaagggttcttaactcctgatcaactgaacatggaagaaaaagacaatagtattaagcatatggaaagtcaaacacaaagaagccaacactggcaagatgaacaaaaagaaaacagaaacaatgggaatgagagggacccaaaaccgaaacagaagttagaagaaaaaaattgtgacataacttgtagtggaagcaaaagagaaacagaacagaaaatcttctgcaccaagttgattgagtatgatgtgtga

SEQ ID NO: 3982 - DNA, 1557 bp, Glycine max var. Williams 82
atgaacgatattcaagggtacgtgccaatactccttgtttggctagcctcaataatattgctccaagccatattcaaaacctcaaaatttcgccttcctcctagtccatttgccttgccaattattgggcacttccacttactaaaactaccccttcacagatcttttcagaagctctcaaatcgctatggacccttgattcacatctacattggctctacactcactgttgttgtttcctcttcagaaatagccaaagagatcttcaaaacccatgacctttccttctccaatagaccagcaaatgttgctattaactacctcacttacaactcatctgatttcggatttgctccttatggaccctactggaagttcatgaagaaactttgcatgtcagagctcctcaatgggaagatgttggatcaactactacccgttaggcaagaggagatacacaggtttttgctgatgatgaaattgaaaggtgaagcatgcgaggtcgtgaatgttggagatgagtttttgaagctaacaaacagcatagtgatgagaatggcaataggaaaaagctgtttcagaaatgatgatgaggctcacaaggtgacagaaaggatcaaggagtcttccaaggtgagtggaatgtttaacctagaagattatttttggttctgtagggggttggatctgcagggaattgggaagaagctgaaggtggttcatgagaggtttgacaccatgatggagtgtatcattcgggaacatgaagaggcaagaaataaatcgactgaaaaggatgctccaaaagatgttcttgatgctcttttgagtatttctgaagatcaaaactcagaggtgaagataaccagagacaacattaaagccttcttggtggatatgttcacaggaggcacagacacaactgcagttactctagaatggtcactggcagaactaattaaccatccgacagtcatggagaaagcaaggaaggagattgactctatcattggcaaagacagaatggtaatggagatagatatagataatcttccttatctccaagccatagtgaaggagacactgaggcttcaccctccatctccatttgtattgagagagtcaactaggaattgcaccattgctggatatgacattccagcaaagactcaggttttcactaatgtgtgggctattggtagggatccaaagcactgggatgaccctcttgagtttagacctgaaaggtttcttagcaatgaaaatgagagtggaaaaatgggtcaagttggggtcaggggacagcattatcaacttctgccttttgggagtggaagaagagggtgtcctggaacttcactagcgctaaaggttgctcacaccacccttgctgctatgattcaatgctttgaattgaaggctgaagaaaaaggagggtattgtggttgtgttgacatggaagagggaccttcatttattctttcaagagctgaacccctgatttgtgtcccaaaatcaagactcatgccattccctttgtgtcatgctaaatactag

SEQ ID NO: 3983 - DNA, 1431 bp, Glycine max var. Williams 82
atggaagattcagaggaagaagagcttctgaatcttactctttcagttgatgccggtagggagaggagaattaagaaaggaaggacaagggataataataataacactaattctgttattattcctatgaagtccaatgacgggtatgaagggaagatcttcaggctcctccaaatgagggagctgatgctaagacaagaccacagaagaaaaggagtgctacttgaagatgtgaacaacaacaacaacaatggccttcctttgattcatttgcttctctcaacagccactgctgttgatgatgatcaaagaaactattgtgccgctcttgagaatctcattgacttataccaaacagtttccctaacaggtgactcggtccaacgtgttgtggcctatttcgctgatggtttggctgcaaggcttctcacaaaaaagtcacctttctatgacatgctcatggaggaaccaacaagtgaggaagagtttcttgcattcactgatctctatagagtctcaccctattaccaatttgctcacttcacagcaaaccaggccattttggaggcctatgaggaggaggaagagaggaacaacaaagcacttcatgtcattgactttgatatttcctatggcttccaatggccttctctcattcaatcactttcacaaaaggcaacaagtggcaagagaattttcctcaggataacaggttttgggaacaacctgaaagaacttcaagaaactgaggcaaggttggttagtttctcaaaggggtttggtaatcaccttgtgtttgaattccaagggattttaagaggttcatcaagggccttcaaccttaggaaaaggaaaaatgaaattgtggcagtgaaccttgtttcttatttgaacactttgagtagtttcatgaaggtgtctcacacattgggatttgttcattctcttagcccctccattgtggtgttggtgaaacaagaaggtagctgcaggagtctcaagaccttcttgtcaaggttcactgagtctttgcactattttgcagccatgtttgattcactggatgattgcttgccacttgagagcactgagaggttgaggattgagaagcagcttttggggaaagagatcaagagcatgcttaactatgacatggatgatggtgtggaatattattgccccaaatatgagaggatggaaacatggaaagggagaatggagaatcatgggtttgttgggagaaaaataagctcaaagtgtgtgatccaagcaaagctgcttctgaagatgaggacacattattatccactacagtttgaggaagagggtggtgggggattcagagtttctgaaagggatgaagggagagttatctctttggggtggcaaaataggtttcttctcactgtctcagcatggcaaccagtttga

SEQ ID NO: 3984 - DNA, 999 bp, Glycine max var. Williams 82
atgatttgtagacttttcaccatctacttcactttcttcttatgtttgctttttaccttcttcgttccttatgttcatagcaataaccagcttgataccaatttctatgatggatcatgccccaatttggccacgattgttagatatggtgtttggtcagccattaaaaatgacaacagaatggctgcgtccctccttcggttgcactttcacgattgcatagtaaatggttgtgatgcttctgtgcttcttgatgataccccatatttcacgggcgaaaagaatgcttctcctaatcgcaattcacttcgggggatggaagtgattgataatataaaagaacaagttgaaaggcaatgtccatcaacagtttcttgcgctgatatcttatccttagcagttagggaagctattgatctggttggaggaccttcttggcctgttgcattaggccgaagagatgcaacaaaagccaatcggatggaagctaatcaacaaattccttcaccgttcgagcctctagataacatcattgcaaagtttacttcaaagggtcttaacttgagagatgttgtagccctttcaggggcacatacaattggttatgcccgatgcttgaccttcaaaaggagactttttgattttcaaggctctggcagacctgatcctgtgcttgcctcttcacttctctcaaaattgcaaagcacgtgtccaaatggagacacttcaaacagctacattgcacctcttgattctaatactactttgaccttcgacaatgagtattatagaaatctcttatacaacaaagggcttctagaatctgacatggcactactttcggatcgaaggacttcttctatggcttatttttacagcaccgaccaatattccttctataatgattttgctgcatccatggtgaagcttagtaatgttggagtacttacaggaatacaagggcaaattagaaggaaatgtggctctgtaaactattaa

SEQ ID NO: 3985 - DNA, 276 bp, Glycine max var. Williams 82
atgtgtttcaaggtgttgtgcaggaggtgtgagaaatacacctggggtggatgtggcaatcacttgaccaatgtttataatagcatacaggagggaaatcattgtatgtgtcgttcatggcctggcgttgtcataccaagacctactcagcaaccaacacaatcaagaactccacctcaaggtataactatcttgtttgattgttggagatatgctggaaaagtaattaagagcatgtttggtcatgcgttgggaggaagagggaagagcacataa

SEQ ID NO: 3986 - DNA, 696 bp, Glycine max var. Williams 82
atgaagagcgagttcctttttgttttcctattcttgggaattcttaactgtgaagcacaatatttcaatgctaacccatacgactatttacaactagccttaaggtggcctaattcctattgcttgacacatgaaggtggttgcagggaaatagtaccacaatatttcactattagctaccttcatcccatgagaagaggaggcccggatctgcaaaattgcccctcaccatttaatatgccaaatagcactatggagacaaacaaaaatgacctactcaaatactggcctgatctgagaactgataattttatagagagtaagtcattatggagggaccaatggagaaagtttggttcatgctacagtatgatgccagatgactatattgtttatgcactcaacagcagaaagagaaatgacctcaagaaaatcttgacaagtgcaggtattgttgcaagtggaaatccatatccaacccgtaggatactgcaagctttcaggaaagctctaggtgtgaatgttgacatagtttgtgagccagatagaagtggaaatgtttatcttgcagaggtacatcaatgtgttgatgctgctggaacaacggctatagattgcgacaataaggcaagaggatgtgatgatgaccccatctttccctacatgggattccaaccagataaagatcccaagtaa

SEQ ID NO: 3987 - DNA, 2007 bp, Glycine max var. Williams 82
atgcacctcccttggttagtcaaatatcaattagcatcaaccatcttcattatcattacccttaccaaagttacctgcttttatttcaatttccctaccttccaaaaagacaatgaatctgagttattgctgagcaagaattcacaaatatacttcgatgccatccaagtgaccccagatattcgtggtcctatacaagattattctggacgcgctttctacaaaaagccatacaaactttggaataaaaagaagaaccaaattgcttccttcaacaccacttttgtgctcaacatcaagcctgaaacaacccctggcggagaaggcttggcttttatcttaacttcagataccactctcccacaaaacagttcaggagagtggcttggtattgtaaatgctacttccaatggaacctcacaagctggaattctagcagtggagtttgacacaagaaagagtttctcacaagatggccctgacaaccatgttggcgtcaacataaacagcatcaactccatccaacaggttccactaatcaacacaggggtcaatgtttcatcaggtataaatgtaacattcaaaattcagtacttgaatgacacaataacggtttttggttcgatgactggtttcgaagaatctatggagacccttttggtatctccacctcttaatctatcttcctatctccatgaagtggtttaccttggtttctcagcctcaacaagtaactacacggagctgaactgtgtgagatcatgggaattcagtggtgttgacattgcagatgatgataataaaagtctcttgtgggtttacatcactgttccaatagtgatagttattgttatcataggagggatggtgatctttttattgtgttggcaaaggaagcgccatatggagaggccagaagatgcatatccaaggatagaggatcagattcagtattcctctatggctccaaagaagtttaagctaagggaaataacaaaagcaaccggtggattcagccctcaaaacaagcttggagagggtgggtttggaactgtgtataagggcctattggaaaacaaggaggtggctgtgaagagagtctccaagaactcacgccaagggaagcaagaatttgtggcagaagtgacaacaattggaagccttcaccacaggaatttggtgaaactcactggctggtgctatgagaaaagagagcttctccttgtgtatgagttcatgccaaagggaagcctagacaagtacctctttggtgacaaaaattttggtaataacacccttgaagaggggtattctttaacactgaattgggaaacaaggcacagtgtgattcatggtgtggctcaagcattagactatctccacaatgggtgtgaaaagagggtgcttcatagagacatcaaggccagcaacataatgttggactcagattacaatgccaagttgggagactttggcttggccagaaccattcagcagagaaatgaaacacaccactctacaaaggagattgcaggcacaccagggtacatggctccagagacctttctcacaggaagagcaacagtggaaacagatgtgtatgcatttggggttcttgttttggaggttgtgtgtggaaggaggccagggagtgtgtacgcacaagatgactacaagaacagcattgtgtattgggtgtgggacttatatgggaaggggaaagtagttggtgctgtggatgcaaagttgaagaaggaggagattaaggaggaagaagtggagtgtgttcttgttctgggcttggcatgttgccatccaaacccacaccatagaccatccatgagaactgttcttcaggttctgaatggggaagcaaccccacctgaggtgcctaaggaaagaccagttttcatgtggcctgctatgcctccatctttcaaagaagctgaagattcttccctcgtccagggaacactcgccccgttcactgaaatcactggcagatga

SEQ ID NO: 3988 - DNA, 1353 bp, Glycine max var. Williams 82
atggtttccaatggagatgaagaatcaggcacacaagtccaactacctgaaaccacaacaaaaaattcaccttcaccctttttcaggtacaactcaccactagttcaagtgattctcattggtgtgatctgcttttgttgccccggcatgttcaacgccctctcaggaatgggtggtggaggccaagtggaccacactgcctccaacaactccctcactgccctctacaccaccttcgccatattcggcatcctcggcggcggcatctacaacatcctcggaccccacctcacccttctcgcaggttgttcctcctatgtcctctacacatcctccttcctctactacaatcaccaccaccaccaagccttcgtcattctcgccggcgctctcctcggcgtaggagcaggcctcttgtgggctgcacaaggtgcaataatgacatcttaccctccaaccaatagaaaaggcacttacatatctattttttggagtatcttcaacatgggtggagtcattggtggtttgattcctttcatcttgaactaccatcgtagtgaggctgcttcagtcaacgatggaacctacataggcttcatgtgcttcatgtcactggggacccttttgtcattagccatcttgcctgcatgcaaggttgttcgtgatgatggtagcaggtgcaccaacatgttttacaccgatgtttccaccgagtgtgtggaggttctcaagttgttttccaattggaaggtgcttcttatggttccagcagcttggtccagcaattgtttttacccttaccagttcaatgatgtgaatggggctctgttcaatttgaggactagagggttgaacagtgtgttctactggggggctcagatgctaggctcggttgggattggttatattatggattttagttttaagaggagaagagttaggggaatggttggggttatagtggttggtgttcttgggactgtgatttgggggggtggacttgttaatcagcttaggtattcttccaatgatttgcctgaaaaattggattttgagcagtcagggtctcactttgctgggccttttgtcttgtactttagttttgggttgctagatgccatgttccaaagcttggtctattgggttattggagccctggctgatgattctcagattcttagcaggtacagtgggttctttaaaggaatacaaagtgctggtgctgcggttgcttggcaagtagatgaacacaaggtgtctttcatgtcccaattgattgtgaattgggtgctcacaacaataagctatccattactgtttgttttggtcatgttggctgtgaaagatcaatga

SEQ ID NO: 3989 - DNA, 1680 bp, Glycine max var. Williams 82
atgctcttcctctactactcacaagtcaatgcattagctgattgcaatatggaacatccacaaattaacaaggttcataagcttcttctcacagcatttgttttgttcttccttgcaagtttgggtttgtctttccctttagagcctccaggaaataataggcaatggcacatgacttcagatgttaagcaagtggcaggaaaatcttatgactatattatagtcgggggaggcacttgtggttgtccattagctgctacactatcacaagatttctctgtgctactcatagaaagaggtagttcaccatatgggaatcccttggtgatagataggaggtactatggttttccattaattaagaccgataagtacatgtcagtggcacaaagtttcacatcagaggatggagttggcaatgtgagaggaagagttcttggaggatcatcagctataaatggagggttttacagtagagcaagtgaggaatttgtttgcaaagctggttgggacaaggaactagtcaaagaagcttatgaatgggtggaatccaaggttgtctttcctcctttttatctttcaccatggcaatctgttgctgaattcagcattcttgaagcgggagttttaccatacaatggcttcagcttggaacatatcaaaggaaccaagatttctgggagtgtgtttgatgagtttggaaagagacacacctcagctgaccttctgaatgcagggaatccaaataacctcacagtccttctaaatgccacagtcaagagtatcatctttcatcacagtagtaacaggaatgaaactagagctaagggtataaggttcatccagagtaatggcaccttggatgaaacctatgaagcatacataaacaaagccaagaattcaagttcaaagggtgatgtcattttggcagcaggtgcattaggtagccctcaacttatgatgctaagtggcatagggccaaaagaacagctgagaaggttcaacatttcaatagtgcatgaaatgaaaggggttgggcaaggaatgcaagacaacccttgcatagcagttttggtggactcaaagccacagaataggctccctgatccaccccaaattgctggcataacagatgacttcaagatcatagttgaagcatcaatacttcccctaacttccaactcatcaagggttaatgttgctgccaagatagcaatgcctacttcaaaagggatgcttgaactgaacaacactgaccctaggttgaacccttctgtgaggttcaactatctagcaagtgatgatgacatggaagaatgtgtcaagatgacaaagctacttgagagaattgcaaggtcgaagtctattgcatttttccttggagaatcaaagcaagaaaaactgacatctactgatattgatctaagaaacttctgcaagaaaaatgtgagaacaatctatcactatcatgggggttgcacggttggatcagtggttgatgagcactacaaggtttatggaataaagggattgagaatattggatggctcaactttttcagagtcaccaggcacaaacccaatggccagccttctgatgctaggaaggtatcaaggactcaagattctaagagaaaggaatgcagaatctggcttaaatgccaaagagcaccgaaaatga

SEQ ID NO: 3990 - DNA, 1440 bp, Glycine max var. Williams 82
atggagctgataaacttgctgttctcattgatcctttccttgttagtgttatcagttctcttgttgttgtatctaactcgttctcctaaagcattggaaggaatccctggcagccttggttggccaattgtgggagagagtttctcattcttctctgacttttctagtccctctggaatatctaacttcatgagcaagaggcaaaaaagatatggaaaggttttcaagacatttatactggggaggttcactgtcttcatgactgggagagaagcaagtaagatattgttaactggcaaggatggaattgtgactttgaatctgttttacactggccagcaagttctgggccccaccagtttgctgcaaaccactggagaggcacacaaaaggctaagaaggctgattggtgaacctttatcaattgatggcctgaaaaaatatttccattttatcaatactcaggcaatggaaacattggatcaatgggaacgaaggaaagtcctggttcttgaggaggcttccacatttactctaaaagtgattggacatatgatcatgagtttagacccttctggggaagaacaagaaaagttcaggtcaaattttaagattatttcttcatcattttcctcatttccattaaaacttccggggacagctttccatcacggtatcaaggctcgggataggatgtatgagatgttagattctacaatttcgagaaggagaagtggccaagaatttcaacaggatttcttaggatccttagttatgaaacaccgaaaagaagatggagaagaagatgaaaataaactcacagatcaacaattgaaggataatatactaactctactggttgcaggccatgataccacaactgctgctcttacttggctcatcaaatttctggatgaaaatccaattgttttggaaaaattgagagaggaacacagacgaattattgaaaacagaaagagtggaacaaatcttacatggtctgaagttaataacatgtcttacacagccaaagtgattagtgaaactcttcgtagagccacaatactaccttggttttcaagaaaggcatcccaggattttgaaattgatggttataaagttagaaaaggttggtccatcaacctagatgttgtttctatccaccatgacccagaagttttctcagatcctgaaaagtttgatccctctagatttgatgaacccttgaggcctttcagctttcttggatttggtagtggaccacgtatgtgtcctggaatgaaccttgccaagcttgaaatcagtgtcttcatccatcaccttatcaacaaatacacgtggaggactctggaggaagaaaattctgttcaaccaacagttgtaaggatgccaaagaacaagtatcctattatagttgaggcactaaagagcaatgagtaa

SEQ ID NO: 3991 - DNA, 330 bp, Glycine max var. Williams 82; identical to SEQ ID NO: 750

SEQ ID NO: 3992 - DNA, 540 bp, Glycine max var. Williams 82
atgaaggggaaggtctcaattggcttgttgatgaaagcacttgagagagctttcttgagaccacaaggaacggtctccattttaacacgtcttgttactgttgcaatactatgcgtgcagcatggaatgccacttgtggttacagtttctctcaagtaccagactgataaggtagttccaaaccaagatgcagttcttaatgatttatcagcttgtacgacaatggggttggtaactgtcatctgtattgatgtatcagatgagctcatatgtaagccaatggaggttagtagagtatggatgagggagaaagatatcagcatggttgagggatcaaaaatagataaaactgcgcttgacatgcttaaacaaggaattggtttatcagttcttgcaccagagatttctctttcctctttgtctgtttcacttgtttcttgggcagaaacaacatgggcagtgaacatgagatctttcacagaagagaaatttgacattcttaagcacagcaatctgaattctggcaaagaaggaaggtga

SEQ ID NO: 3993 - DNA, 789 bp, Glycine max var. Williams 82; identical to SEQ ID NO: 653

SEQ ID NO: 3994 - DNA, 2547 bp, Glycine max var. Williams 82; identical to SEQ ID NO: 627

SEQ ID NO: 3995 - DNA, 2247 bp, Glycine max var. Williams 82
atggctggagtagtcgacaatcatcagcacgactcagaacttgacatacctgatgaaagtgatgaggtggatgactctcctattgagcaagtgaggctgacagttccaacaacggacgaccctacacaggcagcactgacattcagaacatggactctggggttggcctcatgcatcatcctctcttttgtgaaccaattcttcggctacagaaccaaccctctctccatttcctccgtctctgcacagattgtgtctctcccagttgggaaactcatggcagcaacacttcccaccaaaccaatacgtgtaccgttgaccaagtggtctttctccttgaaccctggccccttcaatgtcaaggaacatgcactcatcaccatctttgccagcgctggatccagtggtgtttatgccatcaacattatcactattgttaaggctttctaccacaggaatatccatccacttgccgcttttctcttggcactttccacccagatgcttggttatggatgggctgggattttcaggagattccttgtggattccccgtacatgtggtggccttcaaaccttgtccaagtgtctctattcagggcatttcatgaaaaggagaaaaggcctaaaggaggaaacacaaggctgcaattctttttcctggtgtttgtatcaagctttgcctattacgttattccagcttactttttccaagcaataacaacaatctcctttgtttgcttgatttggaaaaactccatcactgctcaacaaattggttcgggcatgagaggccttggcattggttcatttggcttggactggaacactgtggctggcttcttggggagtcctttggctgttcctggctttgccatcatcaacattctggttggatttgtgctgttcatgtatgttctggttcccatctcctattggaacaacttgtatgatgccaagaagttccccatcatcagttctcacacatttgattcctccggtgcaacatataacgtcactcgtgttttgaatgctaaaacttttgacattgatatggatagttataaaaattacagcaagctctatctcagtatcacatttgcatacgactatggattgagctttgcaactctgactgctactattgcgcatgttgcactcttccatggaaaaatgattcttcagctgtggaagaagacaagatcagcactaaaaggacaagaagctggagatgtgcacacgagaattatgaagagaaactatgaacaagtaccagaatggtggtttgtcagcattttgcttctaatgattgttgtagccttgataacttgtgaaggctttggcaagcagctccaattgccatggtggggagtcctaatgtctctagtaattgcgttagttttcactttgccaattggtgtcattcaagcaacaacaaacatgcaagtcggactcaacgtgattacagagttaataattgggtacatttacccaggaaggccacttgcaaatgtagccttcaagacctacgggtacatcagcatgtcacaggcactcgggttccttcaagacttcaaattaggccactatatgaaaattcctccaaaatctatgttcgcggtgcagttggtaggcaccatagttgcttcaggtgtgtactttggcacagcatggtggcttctgacgactattccagacatatgtgatgatgcaaacttgccagcaggtagtccatggacatgtcctggtgacgaagtgttttacaatgcttcaataatatggggaatagtaggaccacaaagaatgtttaccaaggatgggatttaccctgggatgaattggtttttcctcattggtctacttgctcctgttccagtttggatgctttctcgcaaattccccaatcacaagtggattgagctcataaacatgcccttaataatagctggtagtggtggcatcccaccagccagatccgtcaactacattacttggggaatggtgggaatcttgttcaatttctacgtttacaataagttcaaggcatggtgggctagacacaattacatcctctcagctgctttagatgctggtgttgctttcatgggtgtcattctctattttgcccttcaatattatgatatttttggtccaacatggtggggtcaagatgctgatgaccactgtcctttggccaaatgccccacagctccgggcataatttctcatggatgtcctgttctctga

SEQ ID NO: 3996 - DNA, 3375 bp, Glycine max var. Williams 82
atgtcatccattaataggcaatcttcgaagaaatctggacgtaattcaggaggatcaacatctcaagggtcacaaagctctggcgggccaagtgttaagtttgcgagaagaacttcaagtgggagatatgtgagtctttcaagggatgaaattgatgtgtcttcagacttatcaggggattacatgaactacactgttcatattcctcctaccccagacaatcaacccatggactcatctgttgcaatgaaagctgaagaacaatatgtttctaattctttatttaccggtggattcaacagcgtgactagagcgcatctaatggataaggtcattgattctgaagtcactcatcctcaaatggcaggctccaaaggctctctatgttcaatttgtgatggcagggtcatgagggatgagaggggacgtgatgtcactccctgtgagtgtaggtacaagatttgtagagattgctttatagatgcacaaaaagaatctggtatgtgtcccggttgcaaggagccatataaagtgggggaatatgaggaagacctcacagatcagtattccaacaatggggcattgccattgccagccccaaatggttccaaacgcaatccaaacaacatgtcagttatgaagagaaatcaaaatggagaatttgatcataacaagtggttgtttgagactcaaggtacctacggagttggtaatgcatattggcctcaagatgacatgtatggtgatgatgccctaaaggcaggaatgctggatccagagaagccgtggaagcctttgagccgggtaacaccaattccatcaggcatcataagtccttacaggttacttatcttggtgagatttgtggtattgatcttttttttacattggagagtggtaaatccaaataaagatgcagtttggttgtggattatgtcaattacatgtgagatatggtttggcttctcatggattctagatcaagttccaaagctttgccctgtgaatcgttccactgaccttgcagtccttcacgaaaaatttgatagtccatccccatcaaatcccacagggcgatctgatctacccggtatggacctctttgtgtccactgctgatcctgagaaggagccacctctaaccactgccaataccattctttccatattagcagttgattaccctgttgaaaagcttgcgtgttacatttctgatgatggaggtgctctcttgactttcgaagccatggctgaggctgcaagttttgctgatttatgggttcccttttgccgaaagcacaacatcgagccgaggaatccagaatcgtattttagcttaaaagttgatcctaccaagaacaaaagcaggacagattttgtcaaggacagaaggagggttaagagggagtatgatgagttcaaggtacgcataaatggcctaccagattccataaggagaagatctgatgcatttaatgcgagagaggaaatgaagatgatgaagcatatgaaggagagtggggctgacccttctgagcctgtcaaagtgttaaagtccacatggatggctgatggcacccactggcctggtacttgggctactccttctagtgaacatgctaagggtgatcatgctggaatacttcaggtgatgttgaagccaccaagtcccgatccgttatttggaagtgccgatgatgacaagattctagacttcaccgaggttgatacacggttgccaatgtttgtatatgtttctcgggagaaacgaccaggttatgatcacaacaagaaagccggtgccatgaatgcattagttcgagcatctgcaattttgtcgaatggcccattcattctcaaccttgattgtgatcattacatctacaattgcaaggcagtacgagaaggcatgtgcttcatgatggacagaggtggcgaggacatatgctacatccaattcccacaaagattcgaaggcattgacccttcagatcgttatgccaatcacaacactgtgttctttgatggaaacatgcgagcccttgatggtcttcaaggtccaatgtacgtgggaactggatgcatgtttcgacgatttgctttatacggattcgaccctcccttcgcggacaaggacagtgacaataaagatggtaaaaagattgaagggtctgaaacaccggccatgaatgctagcgagtttgatccaaatcttgacgtgaacttactgcccaagcgctttggaaattcaaccatgttggctgagagcatacccgtcgctgagttccagggacgtcctttagcagatcaccccgccatcaagtttggacgcccacttggtgttcttagggctcctcgcgagccactcgatgctactaccgtagctgaagccgtatctgtcatttcttgttggtatgaagacaagactgaatggggagatagagtgggatggatttatgggtctgtgactgaagatgtggttacaggataccgcatgcataaccggggatggcgatcggtgtattgcataacgaagcgagatgcatttcgcggatcagcaccaatcaacctaactgatagactgcaccaggtgctgagatgggccacaggctcagtcgaaatattcttctcaaagaacaacgcattcctcgccagcaagcgcctcaagattctccaacgtctctcttacctcaacgttggaatctaccctttcacctccctcttcctagtcgtgtactgcttcctccctgcactctctctattctctggttccttcattgtcgaaaccctcagcatcgccttcttaatctacttgctcatcatcaccgtatgcctggtgatgctggccattctggaggtgaagtggtctggtgtggagttagagcaatggtggagaaacgaacaattttggctgatttctggaaccagtgctcacttggctgctgtggtgcaaggactcctgaaggtgatggctggcattgagatatctttcactctaacgtcgaaatcagcgggtgaagacgaggacgacatgtttgcagatttgtatatagtaaagtggagctcactcatggttccgccgattgttattgctatgaccaacatcattgccattgcggttgcgttttcaaggactatttacagtgccaacccacaatggagcaagtttattggaggtgcattcttcagtttttgggtgcttgctcatttgtacccgtttgccaaaggtttgatggggaggagaggcaagacaccaactattgtgtttgtgtggtcaggtctcattgcgattacactttctttgctttgggtttccattagcccaccacaaggtgctgacggacaaggtgtagggggagattttcaatttccatga

SEQ ID NO: 3997 - DNA, 1596 bp, Glycine max var. Williams 82
atggcagcagctgcaccaccacccaagccggaagagcttcagccacaccctgtgaaagatcaacttccaaatgtttcatactgcatcactagtcctcctccatggccggaggcgatactacttggtttccaacattacttggtgatgcttggcacaactgttctaataccaaccactcttgttactcagatgggaggaggaaatgaagagaaagcaaaaatggtccagactctgctgtttgttgctggcataaacacatttttccaaacactatttgggactcgtctacctgcagttattggaggatcctgcacctttgtgccaactaccatttctatcatttttgctggtcgctacagtgacattgtgaatcctcaggagaggtttgagaggataatgcgtggaacacagggtgcgcttattgttgcttcgaccttgcaaattgttgttggcttcagtggcctttggcgcaatgtagtgaggttcttaagccctctctctgctgttcccttggttgctctgtcaggctttggactttatgagttgggctttcctgtgcttgcaaaatgtgtggagattgggctgccggaaatcgtattcttactagtattttcacagtacattcctcatgtgatgaaaggagaaaagcgtatctttgatcgatttgcagttatattctcagtgacaattgtgtggatttatgctcatcttctcactgtgggtggagcatataaaaatgtaccacagacaactcaagagacttgcagaactgatcgtgctggaattataagtggtgcaccttggattagaatcccatatcctttccagtggggagctcctacatttgatgctggagaagcttttgcaacgatggctgcttcatttgttgcactagtagagtcaacaggtgcttttattgctgtttcaaggtatgcaagtgcaactccaatgccaccttcagttcttagccgtggtatcggttggcagggggtaggaattttgttatcagggatctttgggacagggaatggatcatcagtttctgtagagaatgctggactcttagctttaacgcaagttggtagccgcagggttgttcaaatatcagcaggattcatgatctttttctccatacttggaaaattcggagctgtgtttgcttcaatcccagcaccaatagttgcagctttatattgccttttctttgcctatgtgggttctgcaggcctcggtttccttcagttttgcaatttaaacagctttagaactaaactcatcttggggttctctattttcatgggcttctctataccacaatacttcaatgagtacactgcatttaagaactatggtcctgtgcacactcacgctagatggttcaatgacatgatcaatgtcccattctcatcaaaagcatttgttgctggctccttggcactgttcttggataccacattgcacaacaaagacagtcaaacacgtaaggacagaggcatgcactggtgggacagattcagttcattcaagacagatacaaggagtgaggagttttactctctacctttcaatctaaacaagttctttccctctgtatga

SEQ ID NO: 3998 - DNA, 3039 bp, Glycine max var. Williams 82
atgggaaacttagctgcagagtctctctgtgctttattgttgctttatttctatggcacacttttagttagtgctaaatacataaagtataatactggggctggtgttgtgccaggaaaattgaatgttcacttggttccacactcccatgacgatgttggttggctgaaaaccgttgatcagtactatgttgggtcaaacaatagtattcagggggcatgtgttgagaatgtgctggactcggtggttgtgtctcttcagaaagacccaaatagaaagtttgtgtttgtcgaaatggcatttttccatcgatggtgggtagaacaaagtccagaaacacaagaacaagtgaaaaagcttgtggatgaggggcagctagaattcataaatggtggatggtgcatgcacgatgaagctgcgacacactacattgacatgattgatcaaaccactttgggccatcgtttcatcaaggatcggtttaacaagactcctactgttggatggcagattgatccatttggacactctgctgtgcaggcttacctgctaggagctgagcttggttttgattctatacatttcgcaagaattgattaccaagacagagctaagcgcaaagctgataagtctcttgaagttgtttggcgtggctccaaaacatttggttcttcatctcagatttttgccaatactttccccgttcattatagtgctccaaatggcttcaactttgaagtcaataatcctgatgttgatgttgttcccgtgcaggatgatcctcttattttcgattacaacgtggaacagcgtgtccaagactttattgatgctgctactacccaagcaaatgtgacgaggacaaatcatataatgtggacaatgggtgatgatttccagtaccaatatgcagagtcttggttcaagcaaatggataaattaattcactatgttaataaggatggtagagtaaatgctttgtattccactccatctatttacaccaatgccaagaatgctgctaatcaaacttggccactgaaaacagatgattacttcccgtatgccgatagtcgaaatgcttattggacgggctatttcaccagtcgcccggccttaaagcgatacgttaggatgctaagtggatactatttgacagcacgtcaacttgaattcttggttggaaagaaatcaactaaatacaatacttatgaccttggagatgctctaggaattgcacaacatcatgatgctgtcagtggaactgcaaagcagcatacaaccaatgactatgccaaacgattggctattggagcctctgaggctgaagcggttgttagttcttctttggcttgtcttactagaaaacaatcaggtgataagtgttcagcacctgcatcggcatttgcccagtgtcaattgttaaatattagttactgccctccagcagaagacaacattccagaggctaagagtttggtagtagtggtgtataacccacttgggtggaatcgtactgatattgtcaaaataccagttaatgatgctaatcttgttgtcaaagattcatcgggcaataaccttgaagtacaatatgtggatgtggatgatgttacgacaaatttaagaaaattctatgtgaaggcatacttgggggtttctccaaaacaagccccaaagtactggcttttgtttcaggtgtccgtacctccacttggatggagtacttacttcatttctaaagcaactagaaaagggaccaggagaaaagatctatctcaccccaacagtcagaaaggtgacactataaatgtaggatcgggaaatttaaagatgtccttttcctcaacctctggacaactcaaaaggatgtatgattccaaaactggagttgatatacctattcagcaaagctacctttggtatggatctagtgagggcgatagtgatcctcaggcttctggtgcatatatattccggcctaatggatcgcctccaaatatcgtttcaagatcagtgcctaccaaggtaattcgtggaccactagtagatgaagttcatcagaaatttagctcctggatttaccaggttactaggctttacaaagacaaagaccatgcagaaatcgaattcactattggtccaattcctactgatgatggagttggaaaagaggtgatcacacgaatgacagcaaatatggccacaaacaaggagttttatacggattccaatggaagagattttctaaaacgagttcgagatcatagggaagattggcctctgcaagtaactcaaccagtagcaggaaactattatccaattaatcttggaatttatactaaggataagaaatctgagttctcagtcttagttgatcgtgccactggtggagccagcatcaaagatggtgaggtggaattgatgcttcataggcgtattctccatgatgatagtcgaggagttggggaaccacttgatgaacaagtttgcgtgaacaacaataatacatgtgaaggactaacagtcagaggaaattattatatcagcatccacaagcttggagctggttcacgctggcgtcgtacaactggtcaggaaatttattctccattcttagtggctttcacacatgagaactcggaaaactggaagtcctctcatttgacaaaaggaactatcatggatccaaattacagcttgcctcccaatattgctctgataactcttgaggagttggatggtggaattgtgcttctccgtttggcacatctatacgagccaagtgaagatgctgagtattcaactcttaccaaagttgaactaaagaagttgtttgccatgaaaacgataaaggagttgaaggaggtaagtttgtcatctaaccaagagaagtcagaaatgaagaggatgacatggaaggttgaaggggacaaaggacaagaacctctggcaattaggggtggccctgtcagctatcacaatttggttgttgagcttggccccatggaaatacgaactttccttttgaaattttaa

SEQ ID NO: 3999 - DNA, 201 bp, Glycine max var. Williams 82
atgccaccacatattttcactcttgcatcgtcagaaagtcgtggtttttattttcttgggttgagtcatcgttttcgcacttccatatgctcccacaaagccaagttacgcaaacaaacattatatgcccatataattatgtggcttgaccgaagcattgttgatttggcaaaagaacaaaataaaataaagagaacttag

SEQ ID NO: 4000 - DNA, 1152 bp, Glycine max var. Williams 82
atggtattgaaggagttcaaaatccgaagctatgagtgtcaattcgatagagctcaggtagaagatcttgagagaagatgcaaggtagggccatcagaaagcgtgttagacactatgggtgaccccatgtgtaggattcgaaactgtcccatgtacataatgctggtggcagagatggacaacgaattggttggtgtcattcaaggctcaataaaaacggtcacacttcataatcatcatcctaataaggatatggcaaaggtagggtacgtcttaggcctaagagtttctccacataatagaaaaaaaggcattggctcaagcctagtgcaaaagctagaagaatggttcacttccaatgatgtggactatgcatacatggccacagagaaagaaaaccatgcatcaatcaatctcttcatgaacaagtttggctacatcaagtttaggactccatctatactcataaacccagtgaatcatcacccttttggaatctcatccaacatagagatagccaggatcaaggttgaaaaagctgaatccctctatagagggttcatgggagcatccactgagttcttccctagtgacatagagaatatactaaccaacaacctaagcttgggaacatgggtggcttatttcaaaggggatagtggttttggtaatttagaaggaaaagtccccaatagttgggctatgcttagtgtatggaattgtggggaaatcttcaagctaaggctagggaaaacacctttgtcttgcatgctattcacaaagagtttgagcttgatgaatagaatcttcccttgcttgaaattgcccaccttgcctaatttctttagtccttttggattctacttcatctatggggtgtaccaagaagggcctttctctgggaagctggtgagggccttgtgcaagtttgtgcacaacatggcttctaagactgagcattgcaagatcattgtgacagaagttggagaaacagatcatgagcttattcatcatgttccacattggaaattgttctcatgtccagacttgtggtgtataaaggctttgaagaaaaatggaagaacaaacaggtttcatgaattaaccaacaccccaccaagaggtctctttgtagacccgcgagaagtctaa

SEQ ID NO: 4001 - DNA, 774 bp, Glycine max var. Williams 82
atgccttctctcatcgccattgtgaccctcatagccgttgttctgacttccaccgaggcgaggatcccgggcgcctacagcggcggcgcgtgggagaccgcgcacgccacgttctacggcggcagcgacgcgtcggggacaatgggcggcgcgtgcgggtacgggaacctgtacagccagggctacggcgtgaacacggcggcgctgagcacggcgctgttcaacaacgggctgagctgcggtgcctgcttcgagataaagtgcgccaacgaccccagctggtgccacgctggcagcccctccatcttcgtaaccgccacaaacttctgccccccaaactacgctcttccgaacgacaatggaggatggtgcaaccctcctcggcctcacttcgacctggccatgcccatgttcctcaaaatcgctcagtaccgcgccggcatcgtccccgtctcttaccgcagggtgccttgccgtaagcagggagggatgaggttcacgatcaacggtttccgttacttcaacttggttttgatcaccaacgtcgcgggtgcaggggatatcgtgaagacgagcgtgaaagggtcgaagactgggtggatgagcatgagccgcaactggggtcagaactggcaatcaaacgctgttctggttggtcagtcactctccttcagggtcacagccagtgaccgacgcacctccacctcctggaacctcgtacccgccaattggcaatttggtcaaacattcaccggcaaaaatttcaaagtctaa

SEQ ID NO: 4002 - DNA, 447 bp, Glycine max var. Williams 82
atggtatgcagtagcaacgccggcgacatagtggtttactggggccagggcgagagcgagggcacattgaaggaaacatgcaactctggactatacaaaatagtgaacatagcctttctggcaaaatttggcgcttggtggcggcgaagccttctacgctgtgctgcaccacagtgtcccttccctgatcaacaccagaatggagcagtgtcaacggggctctttgactttgtttgggttcagttttacaacaatggtccatgccagtttgagtctacagaccccaccaagttccagaaatcgtggaaccaatgggtcttatccatcaggtctaggaaaatttatgttggactccctgcatctccatcaccagctacgcctgttagtgggtttgtgccaacacgaacgcttataacacaagtatgggggagtaatgctctgggatag

SEQ ID NO: 4003 - DNA, 1629 bp, Glycine max var. Williams 82
atggagtcggcaacttctgaggctgtggatacaggttgcagcctcaaaattcaactttcacctttattgaatgattcaagaagtgaagagggagactgggatgaaatccttcataacaagtgctgtggagcagcattcgatgcttacatctatgcactcggttggcgggcaaatcaaactggaaagatttacttagattctactgagcaaagaaattgtctgtctagaatgaaaagtttgaatgatgatgtttttggttgtggaattgagaacctaacaagtggtgctggtgggtgttctgacttgttggtttctgatgttaggagtagattaggaaatgagcttagaagtttagatgaaaactgtcaacagtcatgttctttgtgcctgaagacctggaatacaataggagggacagattccagaaagaccaatgccaaaactgaaaaaattgaagctgatctctgtagaattgcagttcttgtgacattgataagcagcaaaattgaaaatgtgatgtatgtcaaaacagttctgagatgccttggagcacaacatatttattcaggtatatggattgtgactggagcaatcataggggttatattgataatacttatcactgcatgcttcatgtctcgtagatacttcagatcagccccaccaaaaaaagaagtaacatttggagacatgttaaggaaaactgcctgtcctagagttcctattaaggaagtgtatgcggccacaaaccatctgaatgaaatgaatatcattgggaaaggaacttcaggtaaggtctataagggtacaatgacaaataatctgaatgttgcaataaagcacataatcaatgatgatggaaatgtgaacacttttgtcagagaaattacaagcttatctcatgtcagacaccctaatattgttgctttgttgagttactgtgttgagggagatgaacgttttctggtttatgaactatgtcccaatgggagcctttcagaatggctatttggcaagaacaaggtgctatcctggatacaaaggctagaaatcgcaattgattgtgctagaggtctttggttcttacatacttaccaaggaggatgcattgttcaccgtgatatcaagccaacaaatattcttctggggtccaaatttgaggcaaagctatcagactttggactgtctaaagttattgaggtgggcgaaacgtatgtaagctctgaagtgagaggaacatttggatatgttgaccccgagtaccaaagtaaccaccatgtgaattcatcaggtgacgtttacagctttggaatggtacttctacaaatcctctcgggaaagaaggttataaatttgaaactgaagaaaccaatgccactgaacaaagtggcaaaagcattcaccagggatgggaggataacaggatttgctgaccctaaacttcaaggagagtactctgaagaagcatttgattttgcacttaagttagcactatcatgtacagccctcaaccaacaacgtccatccatggagcaggttgtcaaaagactagaagaggctctgttcatttcaaaagggaggaaggcttctactccagaaactccagctgacaatatttctaatccataa

SEQ ID NO: 4004 - DNA, 765 bp, Glycine max var. Williams 82
atggaaaatatgccaccaggttatcgtttctaccccacagaagaggagctgatttcgttctatcttcacaacaagcttgaaggagaaagggaagacatgaatcgagttattccagtcgttgatatatacgactacaacccatctgaactcccacaaatttcaggagaggcaagtatgagagacacggagcaatggttttttttcattccgaggcaagagagtgaagcgagaggagggagaccaaagcgtctcacaactacagggtactggaaggcaacagggtctcctaatcatgtttattcttcggataatcgcatcatcggaattaaaaggactatggttttctatagtggaagagctccaaacggaaccaaaaccgattggaagatgaatgagtacactgccatcaaaacatcatcctctagtcccacgctaaggaaggaattcaatttatgcagagtgtacaaaaaatcaaagtgtttgacagcatttgatagacgaccaccgccaaggagggacacagaaagctattcgggtgctcaaaatgtagaagagcaacaaaagggttcaacatcatatgatgattatcatcataaaatggtggagagaagtgcaacgtgttcaccagcagagagctcttcctccggagaccatgaccaaccccctcttcacggtgaggaagctactcaaatggatgttgacaacaacgatgacccttttttggattgggagaaagtggatatgttcttgggatcagaaccatga

SEQ ID NO: 4005 - DNA, 168 bp, Glycine max var. Williams 82; identical to SEQ ID NO: 3370

SEQ ID NO: 4006 - DNA, 2955 bp, Glycine max var. Williams 82
atggcgaccaagtttttagctttagcttgtttacgtaacaatgaggggtcggggtacctatcgccacgacctcactacccgtcgatgccgaaatatccaaagggagtgacagaagaagaaggaagcagtaacgtatcgtccaaggcacttttctccgtcgtcggaatgacttgctccgcctgtgctgcctccgtcgagaaagccgtcaagcgtcttcccggaattcgccaagccgtcgttgatgttctcaacaaccgtgcccaagtcctcttctatccatcctttgttaacgaagagaccattcgtgaggtcattgaagatgctggattccaagccacattcatcagagatgataacgagacatctgttcagatatgccgcatacgtatccaaggcatgacatgcacgtcgtgttcctccaccgtcgaatccgctctacaatcaatccaaggagtggtgaaagcccaagtggctcttgcaactgaggaagctgaagttcactacactccaaacgttgttacctacaaccaaatcttggaagctgttgaagacacgggctttcaggccacgcttataagcacaggcgaagacatgagcagaatagacattcaagttgaaggcataagaactggtcgttccatgagactcattgaaaattctcttcaggccctccctggggtccaaggtgtagaaacacaccctgagttcaacaaagtatctctttcttataaaccagacttgacaggaccgagaaatttcatcaatgtgatcgaagaaacgggatctaggcgtttcaaggctaagattttccctgaagaaggaggaagaaggaatagtcataggagggaggaaataaggcaatactatagatctttcttgtggagtttggtgcttactattcctgtgtttctaacctctatggtgcttatgtatatccctggaattaagcatggagtagatgctaaagttgtgaacatgcttacagtgggcgagattataagatgggtgcttgctacaccagtgcagttcattatagggaagaggttttactctggtgcttacaaagcattacgccttggctctcccaacatggatgttttgattgccttggggacaaatgcagcatacttttactcagtgtattctgtgctgagagctgctacatctcagggtttcaagggtactgatttctttgagactagtgctatgcttatttcgtttattttgctagggaagtaccttgaggttttggccaagggcaagacgtccaatgcaattgccaagctcatgaacttgacacctgacactgctatactgttgaccctggacagtgaaggaaatgttgttggtgaagaggaaattgatagcaggctgattcagaagaatgatgtgattaaagttattcctggtgcaaaggtggctgcggatggatttgttatttggggtcagagccacgtgaatgagagcatgattacaggtgaggcacgtcctgtggctaagaggaaaggtgaaactgttattggaggaactgtgaatgagaatggagtgttgcatgttaaggctacctgggttggatcagagagtgctctttctcagattgttagacttgttgagtcagcacagatggccaaggctcctgtgcagaagtttgctgaccgcatttctaaatactttgtgcctctggttattttaatctcattttcaacttggcttgcatggtttttagctggaagatttcatgcttaccccaagtcttggataccatcttccatggatagctttcagcttgctttgcagtttgggatttctgtcatggtcatagcttgtccatgtgctttaggtttagcaacgccaactgctgttatggttggcactggagtaggtgcatctcagggaatacttatcaaaggaggtcaagcattagaaaatacacataaggtgaactgtgttgtatttgacaaaacaggtactctcacaatcgggaagcctgtggtagtaaatacaaagttgttgacaaatatggtactccgggaattctatgaacttgtggctgcagctgaggtgaatagtgagcatccactggctaaggccatagttgagtatgccaaaaaactgagagatgatgagaaccccatttggccagaggcacgggattttgtgtccattgctggacatggagttaaggccatggttagaaacaaggaaatacttgtgggtaacaagagcttgatggaagaccacaatgttgcacttcccatcgatgctgaagagatgcttgcagaagcagaagcaatggctcaaactggaattatagtgtctattaatagggaagtagttggggttttagcagtatctgatccattgaaaccagctgcacaagaagtcatttccattctcaagtctatgaaaattaggagcatcatggtgactggggacaattggggaactgccaattctatagcaagggaagttggaattgaaacagttattgctgaggccaaaccagatcagaaagcagagaaagtcaaggacttgcaggcttctgggtgcagggtggctatggtgggggatggtatcaatgactcaccagcacttgtggcagcagatgtaggaatggcaattggtgctggtacagacattgctattgaggctgctgatattgtcctaatgaagagcaacttggaggatgtcataactgccattgatctttccagaaaaacgttttctcgtatccgcctcaactacatatgggctttgggctataatctacttggcattccaattgctgctggagctctttttccttctacacaatttcggttgccaccatggattgctggggctgccatggctgcatcttctgtcagtgttgtgtgctgctctctaatgttgaagtattataggagacccaagaagctggacaaccttgagatacgaggcataagcattgagtga

SEQ ID NO: 4007 - DNA, 1260 bp, Glycine max var. Williams 82
atggcaaggaagagaaaggttgttgaagtggtggaagagggagaactatgtgagggaaccttgggttgggatgagatgatgaaacaagctgcagcacttggaggggtgcaaagagcaaggaagaggtttgttggtgtaaggcaaaggccatcaggtagatgggtggctgagatcaaagacaccattcagaagataagagtgtggttgggaacttttgacactgctgaggaagctgcaagagcctatgatgaggctgcttgcttgcttcgcggtgccaacacgaggactaacttctggccttgctctcaatcctccacaagtccagctctttcctcaaagataaccaatctcctccttcaaaggcttaaagaaagaaacaacaacaacaacaacaacgcttgttcctcgtcctcgtcctcgtccacctcacttctcatcaaccaccaacaaatgcaacaccaccaacaagttgatgcatatggagaaggttcaacacaattctcaattgaccaattcactgatttcctcaatgaccctgaagattatagcacaagcaacaatgacttcatcaacaacactgcacaaattgactacattactagtagctttgagtcatgcttaactaaaaaagatggtgggacaaaaatggatatgcaattgcaatacaaatcaagcaatgtgacaccacagacttcaagcaatgacagcaattcaggagtggaggacagtgaagaagaaggaaatgatttgggtgtgcaaagtactaatttggatgtccatgattttaggtttctggacaacattgctccacctagttactattctccctttgagatggctgaagagatggaggaggagcctgtggagcctgagaatgagaactacgatgatgagccttcaatgcttagagctgtgatgaagagaatgacttatgagaggaagttctcagcttctctctatgccttcaatggaatacctgaatgcttgaagttgaaacttgaatccggaaacatgaagggaagaggactagctgatcaattaacaagccttcaaatggcttgtagcaaaaacaagcttgagaagaataaggaggagaaagagttcatggcaacaatggataggaaaaaggaacaagaacaccaacatacatcacctgacatggattcttcaagtgttgatggggaactgttactttggaattcacttgatcttcctcctatttgctttgttaacttacttgaaaatggttcattcaattaa

SEQ ID NO: 4008 - DNA, 4293 bp, Glycine max var. Williams 82
atggaggacgggggtagtgtcaaagcaggtagtactactaatactatgagtagtttcaggattgggagtagatcagtttggagcaacagtggtgtggaaatctttgccaactctttccaccaggaagatgatgaagaggctcttaaatgggctgccattcagaaacttcctactttcgcacgtttgaggacgggattgatgacttcacctgaaggggttgccaatgaggtcaatgttcatcaacttgggttgcaagaaaggagaggtttgcttgagaggctggtcagagttgccgaagaggacaatgagaagttcatgctcaagctcagggaccgcattgatagagttggaatcaccattcctacaatagaggtccgatttgagaacatgaacattggagcagaagttcatgtaggtagtagagctttgcccactttcactaactacatggttaataaagtggaggggctattgaacttccttcatgtactcccaagtagaaaacaacgtataaacattctccagaatgttagtggaatcataaggcctgccagaatgacattgcttttgggtcctccaagttctgggaagaccacactcctgttggctctggctggaagacttgattcaaaattaaagttcactggaaaggtgacttataatggtcatgggatgaatgagtttgtaccccaacgaactgctgcttatgtcagtcaaaatgatcttcatattggagaaatgacagttagagaaaccttggccttctccgcacgggtccaaggagttggagctcgttatgatttgctagcagaggtgtccagaagagagaaagaagcaaatattaaacctgacccagatatagatgtctatatgaaggctgtagcaactgaaggccagaaagcaaattttatcacagattatattctaaggattttgggattggaggtttgtgctgatactattgtgggaaatgcaatgttaagaggtatatctggtggacaaagaaaacgtgttacaacaggggagatgctggttggaccagctaaagctgtattcatggatgaaatatccactggtttggatagttcaacaacttttcaagttgtgaattcactcaagcactttatccactctctcaaaggaactgctgtcgtctcactcctacaaccagcaccagagacctacaatctttttgatgacattattctactctctgatggccaaattgtgtatcagggtccccgcgaacatgttcttgaattctttgcttctgtgggtttcaaatgtcccgagaggaaaggtgttgcagactttctgcaagaagtgacgtcaaggaaagatcaggaacaatattgggtacacagagatcagccttacagatttgtcacaaccgaagagtttgtagaggcatttcaatcatttcatgttgggagaagccttgctgatgaacttgctactcaatttgacaagtctaaaagccaccctgcagctttggcaaccaaaatgtatggattaggaaaatgggaactgttgaaggcttgcttgtcaagagaatatttactcatgaagcgtaattcatttgtccacatcttccaactttgccaacttgctatagtggcctttatagccatgaccgttttcttccggactgagatgcacccagattctgtgaccagtggtggtatatatgcgggtgcattgttctatggccttcttgtaattttgttggatggatttgctgaccttaccatgacagtttcgaagcttcctgttttttacaagcaaagggactttctcttcttcccttcatgggtatatgctcttcctgcatggatcctaaaaatccccatgacttttgcgcaagtgggaatctgggtgttcctcacctactatgttattggttttgatccatatgttggaagattcttcaggcaattccttcttctgttatttgttaaccagatggcttctgccttattccggtttattggagcacttggtagggaactgacggttgctttcacaattgggtcatttgtattggccatccttattgccatgagtggtttcatcctgtcaaaaggcaatatgaaaaaatggtggttatggggcttttggtcatcacctatgatgtatggactgaatgccatgataaacaatgaattccaagggaagagatggagacatgttctacccaactcaactacaccgctaggagttcaagttctaaaatctcgtgggttcttcacccagtcaaagtggtattggataggtgttggggcactgattggatatacgatagtgttcaatattgcttacatccttgctctcacttatttgaacccaattgtgcagcatcaagctgttaaatcagagaaatctcaaagcaatgagcaggatggtggaagcacttctgctaggtcttcatccagaaggaaagaagctgacagaagaagaggaatggctcttccctttgaaccacattccatcaccttcgatgatgtaacatattctgttgacatgccacaggaaatgaagaatcagggagttctcgaggataggttgaaccttttgaagggtgtcagtggcacttttaggcctggtgttctcacagctctaatgggttccactggtgctggcaaaacaactctgatggatgtactagctggaagaaagactgggggatatattggtgggaacatcacaatttctggctatccaaagaagcaagaaacctttgcaagaatttctggatactgtgaacagaatgatatccactctccttatgttacagtatatgaatccttgctctattcagcatggcttcgattatcagcagaaatcaattctgagaccaggaagatgttcattgaggaagtcattgaacttgtggagctgaaccctctaaagcatacaattgttggattgccaggtgttaacggactatctacagagcagcgcaaaaggttgactatttctgttgagctagtggctaatccttctatcatattcatggatgagccaacttctgggctagatgcaagagctgctgctgttgttatgagggctattaggaaaatagtggacactggaagaacagttgtctgcaccatccatcagcctagcattgatatatttgaatcttttgacgagctttttctaatgaaacgaggaggacaagagatatatgtggggccacttggacatcattcttatcatttaatcagttactttgagggaattaaaggtgtccgtacaattgaggatggctacaatccagcaacctggatgttggaagtcacaacttcagcaaaagaaatggaattggggattgatttcgctgagctgtataaaaattcagacttatacaggagaaacaaggaacttattgaagaattgagtactccagccccgggttcaaaggacctttatttttcttcaaagtactctaggtcctttattacccaatgcatggcttgcttatggaaacaacattggtcttactggcgcaataatgaatacaccgccctaagatttctctttacaattgctgttgccttgttgtttgggagcatatattggaaccttggctccaaaatcaaaaagcaacaagatcttttcaatgccatgggatccatgtatgctgctgttcttcttcttggtattaagaattctaattcagcacaaccgttggtggcagttgaaagaacagtgttttatagggaaaaagctgctggaatgtattcagctttggcatatgcttttgctcaggttgtagtcgaactacctcatgttcttctacaaactgtggtctatagtgctatagtgtacgcaatgattggttttgagtggtctgtcactaaatttttctggtatctcttcttcatgtacttcaccttcctctactttacctattatggcatgatgtctgctgccatgaccccaaacccatccttagcggttataatttcttctggattctatgaagtatggaatctcttctcagggttcataatcccacgaccaaggatgcctgtctggtggagatggtattattgggcaaatccagtagcttggactttgtatgggctggtgacatcacagtttggagatatacaagaccatattgagtttaatggtagaagtacgacagttgaagactttttgagaaattactttggttttaagcatgattttttgggagtagttgcagctgtacttataggatttgcagtaacttttgcattgatctttgccattgccataaagatgttaaatttccaaagacgttaa

SEQ ID NO: 4009 - DNA, 1275 bp, Glycine max var. Williams 82
atggagaacttgttgcgcctagtagaccacgaagacttcttctctcgtcgttgcatttgggtgaatggccctataatcataggggcaggaccctcagggctagccacagcagcatgccttagagaacaaggggtacccttcatggttctcgaacgtgcagattgcatagcctcactgtggcaaaaacgaacctacgacagactcaaacttcaccttccaaaacaattctgccagctcccgaaactacccttccctgaagacttccctgaataccccacaaagaaacagttcattgagtacttagaatcatatgctaagcacttcgagatcaatcctcagttcaacgagtgtgtgcagtccgcaaggtacgatgagacaagcggcttgtggcgggttaagaccgtttcttcgagtggcgccgccgcccgcggcgagattgagtacatttgcaggtggctcgtggtggccaccggggagaatgcggagtgtgttatgcccgatattgaagggttgagtgagttcaaaggtgatgtgatccatgcttgtgattacaagtcaggggagagcttcaggggaaagaaggttcttgttgttggttgtggcaattccggcatggaactctcacttgacctttgcaaccaccatgcctctccatccatggttgttcgtagctcggttcacgtgttgcctagagaagtgtttgggatatcaacttttgaattggcagttatgttgctgcaatggctgcccctttggcttgttgacaagattctcttgatcttggcatggtttgttttggggaacattgagaagttggggctcaaaaggccttcaatgggtcctttggagcttaagaacacaaaggggaagaccccagttttggatattggtgccttggagaagattagatccggtgacatagaagttgtgccaggaatcaagaggttcaacaatggggaagttgagtttgttaatggtgaaaagcttgatattgatgcaatagtgcttgcaaccggttaccgcagcaatgtcccttcttggcttcaggaaggtgaatttttctcaaagaatggatacccaaagatgccattccctcacagttggaagggaaatgctgggctttatgctgtggggttcacaaagagagggctctctggtgcttcttctgatgctgtgaaaattgctcaagatattggccaagtttggaaaaatgagactaagcaaaagaaacagcgcactaccgcttgtcatagacgttgcatttcacagttctaa

SEQ ID NO: 4010 - DNA, 1071 bp, Glycine max var. Williams 82
atgggtcgtgcaagaataaccttgaaactcatctcaaatgagagatctcgtaggttaactttcaagtccagaagggaaatacttatcaagaaaacctctgaattttccaccttgtgtggagttgaagcctgcttgattgtgtacgataatggcaatggagatgttgcaccagtaacttggccaaaagaacctgtattggtacaccccatccttcaaaagtatgagtctcagaagaatgagagacctcccaagacctttggtattgaagactttttggagaataggaagaacatggttgaagctgacatttccaaagtgcataaacagatcagtaacatcaagtatccaacttgggatccaagtttcacaaacatggaagagaagcaattgaaggctttcattactcaggtgaatgctaagattatggcttgtgatcatgtgttgcaaaacaagcatcaaagtaaagccaacaacatcatgcaaaacatggcttggggaagtgcttcctcctcccatattccaagccaaatcaccccaactcctaacaataatgggagggtgtatgttacaaatccaataaatcagtttgatggagctagtaatcatggaatgaacatgcaacaagttgatgcttgctatggttacattcccacaatggctcaagaaagtactaattctacctcctcatatccaaggcaattcaattgcttgcaaaacatccctcaaagccaacccatatttgaagatttaaagccacttgattataagaatgagatggtagattttagttatcaagttgatgtgccactagattcaactaatcaacttggtgtgtatgcggactggactaataatcaattcggtgactttgaggactggattaatcgacctattgatgggtctaatcaaccagttaatggtgatcttgtgggtttggacaataaacctaatgaatctatcttgcaaaatattcctgttcaatatcagaataagcaacaaggaggagctttgcatgtcttgccaccaccattgaatggatttcaaacagattgctataatgtgaatttctga

SEQ ID NO: 4011 - DNA, 999 bp, Glycine max var. Williams 82
atgactggtagccacataaaagtattgtgcatgtgtttgccagagggagaaagaggcatggcactagaagcagtagtatatccccaacctcaagacccgtttggctacggaatcaaagacccttcttacaactacaacaacttgttagaaggtggtggaggcaactggggctttgaaaaagaagagcaaggttttgtcacttttctggagaaccaaacagagaattatccttatggagaatggaactgttctccttctccaccatccatgttgcctcacttgaatgcatcaaatcctcagtcttcagaaaccagcaacatacataacaacttagatagttcaatttccacccctgctcgtcccaaaaggcgcagaaccaaaagcaggaagaataaggaagagattgagaaccagagaatgactcacattgctgtagagcgcaacagaaggaagcaaatgaacgagtatctctctgttcttcgctctctaatgcctgaatcttacgtccaaaggggtgatcaagcatctataattgggggtgctatcaactttgttaaggagctggagcagaggctgcaatttcttggtggtcagaaagagaaagaggagaaatctgatgtgcccttttctgagttcttctcctttccacagtactcaacaagtgccggtgggggctgcgacaattctacagccatgagtgagcaaaagtgtgaggctcagtctggcattgctgacatagaagtgacaatggtagagagccatgcaaatctcaaaataagatccaagaaacggccaaagcagctcttgaaaatagtctctagtttgcatggcatgcgtctcacaatcttgcacctaaatgttaccaccacaggggaaattgtcctctattctcttagtgttaaggtggaagaagattgcaagctgggatcagtggatgagatagctgcagcagtgtaccaaatgctggataggattcaacaagagtcaatcttgaattaa

SEQ ID NO: 4012 - DNA, 1236 bp, Glycine max var. Williams 82
atgaaggacgaggtggattcccctgttggtgttcttgaggactatttcaagagctcggaatcagaaactagttcttccaaagaacccagtactattgtggattctgataagtcaaaacccggttctaggtggcttgcgtttcttcaattgttgagggacacatcgaagaagccaatagccacattgcatcctcttagtgtcctcaagctttcgagaagaatgagcagtagcatgagggagactataatagatgcagattcgtccttgcatagaccaccctggaagatctttactcaccatgagatacaaattgcaaccaattgcttcacccaaggtatgcaatgtgcttcagaaaattttattggaaagggtggttatgctgaggtttacaaaggctgtttgccaaatggtcagctggtagcgattaaacggctgacacatggaacagaaaatgaaactataggggacttcttatcagaacttggcataatggctcatgtaaaccaccccaatactgctaagttagttggctatggggtggagggaggaatgcatttagtgcttgagttgtctgaaaaagggtgcttagcttcagtgcttaatggtttcaaggagaaactaccatggtctataaggcagaaaatagcattaggaacagctaagggtataatgtatcttcatgaaggttgtcaaagaagaattatccatagagatataacagcagcaaatatcttgcttaccgaggactttgagccgcagatttgtgatttcgggctagcaaaatggctaccagagaattggacccatcacactgtttcaaaaattgaagggacttttggttatcttgctcctgaatacttgcttcatgggatagtggatgagaaaacagatgtatttgcctttggtgtagtgctattagaattagtcacagggagacgagcacttgatcattcacaacaaagccttgttttgtgggcaaaacctttgctgaaaaagaattctattagggagctgattgatccttcattagccgatgattttgactgtcgtcagattaaaattatgctctgggcggcttctttatgcattcaacaatcttctattcatcgtccctttatgaaacaggttgtacaacttttgaatggtaaccttagctgctttaagttcacgaagaaatctcaacatccattcttccgaaaagtctttcaagaagagcttcttgacgattctgattaa

SEQ ID NO: 4013 - DNA, 1080 bp, Glycine max var. Williams 82
atgagttctgtgaataatcttggaacattgttggctcgtcttacctctatgctgaacacacgttcacctctgattccatgttttcacactcttagaacggttcccgtttcccccaaaagagaatggccaaagctattttcttctgtcaattccactctccccttctcgtctgcgcccaacttcgacttcaaggcctacatgctcgacaagatcaacaccgttaacagagcattggacgcagccgttgcgctaagagaaccacggaagctccacgaagccatgcgctacaccctcctcgccggcggaaagaggatccgcccggtgctctgcctcgccgcctgctctctcgtcggcggcagcgaggccaccgcaatccccgccgcgtgcgccgtcgagatgatccacaccatgtcgctcatccacgacgacctgccctgcatggacaacgacgacctccgccgtggaaagccgacaagccacaagatcttcggcgaacacgtggccgtcctcgccggcgacgcgctcctcgcgctcgcgttcgagcacgtggcggcgtcgacggagggcgcgtatgcggcgcgcgtggtgcgcgcgatcggggagttggcgaaatgcatcggcgcggaaggcgtcatggcgggacaggtggtggacgtgaattcggaagggttgacgttgtcgatgtcggatgaagtggcagttttggagaggttggagtttattcacgtgcacaaaacggcggtggttgaaggtgcggttgtgatgggggcgatactggggggtgggtcggacgaggaaattgagaggttaaggatgtttggtaggtgcattgggttgttgggtcaggttgtggatgatgttctggatgttactaaatcgtccgaggaattgggaaagacggcgaagaaggacttggtggctgataaactcacgtaccccaaggttttggggatacatgagtcgaaggagtttgctcataaattggtgcatgatgcaaacaaaatgttggctgggtttcatcctccaaaggctgctcccctatttgctttaaccaattacattgcttacaggcaaaattaa

SEQ ID NO: 4014 - DNA, 2184 bp, Glycine max var. Williams 82; identical to SEQ ID NO: 3438

SEQ ID NO: 4015 - DNA, 600 bp, Glycine max var. Williams 82
atgggaaaccaaatagctagagatgcaactgggaaaatcgtttactgggatggttcggttcaagaattcgacgagccactgacagtggcagagctcatgttggagcacccgcaacaagtagtgcttgatttccattccgctgtgaaggagaaaaggccaacgccactaccagccgacgaaaagctagagatgaagaaaacctatgtgatggttccggtgaagcgagggaagcctgtgttgttgagcagcgaagatagtcgccgcattctcttgattgttaattcctctctgcattccaagtatttcgtttcttcttcggggtttcttccttggctttcacggttgttccactctgagggagaggttgtttcagtgttgcagagaaaggaagaggtggaggtggagaacacggtagagaggtatggtttttctgagtttttgccagaaatgatagaagggtcgaggccagagtatatgagtagacagttatcggggaaggggtggaagcctagcttggacaccattaaggagaagaaagttaagacaaaactatctcgctggttattgttcctcaaaggtttttctgctgcaaagatttaa

SEQ ID NO: 4016 - DNA, 468 bp, Glycine max var. Williams 82
atggcttctgcagctcgcttggccttctttgccgtttccatggttctgctttcctcagtggctatggcaactgatttcactgttggtgatgggactggctggactgttgactttaactacactgcgtgggcagagggcaaagttttccgtgttggtgacaccctttggttcaactatgagaacacgaagcacaacgtggtgaaggtgaatgggacacaattccaggagtgcagcttcacgtcaaacaacgaggtattgtcgagcggaaaggacagcataacgctgaaagcggaagggaagaagtggtacgtttgtggagtggcaaaccactgcgctgctcgtcaaatgaagcttgtcatcaacgttgaaaccgcagctcctgctcctgctcccacttcctccgctcattctctgctttcttctgtgtttggggtcctcatcgttgccatcgctcccatctttgcgtga

SEQ ID NO: 4017 - DNA, 954 bp, Glycine max var. Williams 82
atgggtagtgtgagttatagcaatctgaagaacgccatgatagcattcttggtccctctaccctccatcctattctacctctcattccaatcggccattagtactccttcttcttggtcttctctgtggacatggtgctatcaccaccctctgctattggccaatgtccttttcttcttcaatgtcaatttcctcttctggctcatcggcctaatccaatccagccactggatgattgacccgtattggacagtgatacctgtgatgcttgttcattactattcaactcaccctttggcacagtatcagtggtggaggtcgaggatcgtaacgttgttgacttgggcgtggagtgttaggctgatccacaactacttcaggcgagaaaagtggcagtggggtgccagggaggattggcgtttcactgatttgagccatcgctatggaaggcattggtggtgggcttctttcttcgccatctacgtccctcagcaggtgtttctgattggattgtctcttccgttctatgtcatccactcggtgaaccagcctctgagcatgtgggacttggtagccatagttgtgtgtgtatctggcattgtcacggcatacattgctgatactcagctttacaactttgtgagtagaaagaacaaggaggtccctattcttgacaaagggttgtggtattattctcggcatccaaattactttggagagcaggtgtggtggtggggaatggctgtgtttgcttggaacctgggacatggatgggctttcataggggcattagccaataccatgtgtttggcttatgtcactaagcttgtggaggaccgaatgttgaaacaagatagcagagcagaggcgtttaggctctatcagaagactacttccctatggattccttggttcaagtcatctcctttaggactcaaatctaaggatgcttga

SEQ ID NO: 4018 - DNA, 1584 bp, Glycine max var. Williams 82; identical to SEQ ID NO: 3427

SEQ ID NO: 4019 - DNA, 1143 bp, Glycine max var. Williams 82
atggctccagccttggaagaaggaggagaaagagaaactagtgtggcacagaacaactccttgaacagtgttgtcaatgatgccacacacagatccaaagtcactgttattggaagtggcaactggggcagtgttgcagctaagctcattgcctccaataccctcaggcttagctccttccacgatgaagtgaggatgtgggtatatgaggagacactactaagtggtgagaagctcacagatgtcatcaatcgaaccaatgaaaatgtcaaatatctccctggaatcaagcttggcaaaaatgttgttgcagatccagaccttgaaagtgccgtgaaggattccaacatgttagtgtttgtgactccacatcaatttatggaaggaatatgcaaaaggcttgttgggaaaataagggaagatgctgaagctatttcccttgttaaagggatggaggtcaaaatggaaggcccatgcatgatctctagtctcatttctcagcaactgggaatcaactgttctgttttaatgggtgccaacatagcaaatgagatagctgtggagaagtttagtgaagcaactgttggatacaggctcaatagagaagttgctgagagatgggttcagttgttttatacacactatttcattgtgacagctgttcaggatgttgaaggagtcgaactgtgtggaactttgaaaaatgttgtggccatagcggcaggttttgtggatggcctggagatgggaaataatacaaaagctgcaatcatgagacttggtcttagagaaatgaaggcattttcaaagttgttgtttccatctgttaaggacagcaccttttttgagagctgtggtgtagctgaccttatcacaacatgcttgggtggaagaaataggaaagttgctgaggcttatgcaaggaatggagggaagaggtcttttgatgagcttgaagcagaaatgctacaaggccagaaattgcagggtgtctcaactgcgagtgaggtttatgaggttctaagccatcgtgggtggctagagttgttccctctcttctcaacagtgcatgagataagcactggcctacttccaccatcggccatagttgaatacagtgagaagctacccaggtccttctaa

SEQ ID NO: 4020 - DNA, 1323 bp, Glycine max var. Williams 82
atgacacggtcgagaatattcgtgcggagatccgttgggggtgatttgtttcgtgtgcaagcgataaatagcgcaacccaatcatcccttaaatctcaccaccatcgcaacacgcacaattcaatccctgcaccttacccacaaccctctttctctctctctctctctctctcccaaatggctctcaaggccgtccatgtcaccgacgtcccttccctcgacctcgtcccggagaatgcctctctcgccctctgctcctcccgcttccccaacgggttggagatgtgtcggagtgggttagagatcccaaagttcgtcgtgatcggacacagaggtaacggcatgaacgttctgcagtcttccgatcgaagaatgagagccatcaaggaaaatacaatcatgtccttcaacgccgccgccactttccctctcgatttcatcgaatttgacgttcaggtgacgagagatgactgcccagtcattttccacgacgacttgatcctcacagaagagaatggtactgtgtttgggaagagaataacggagctgagtctgtctgagtttctttcttatgggcctcagagagaagatgaaaaggagggaaatgttttgcttagaaaaaaagatgggaagataatgcaatgggacgttgaacaagatgatccgctatgcactcttcaagaggcttttgtcaaggtggaacccactttgggttttaacattgagttgaaattcgatgaccacattgtttatgagcaagattatctcgtccatgttcttcagaccatcttaaaggttgtgtttgattatgccaaggacaggcctattatcttctcaacattccagccagatgcagcaatgctaatccggaaattgcaaaccaactaccctgtgttctttttgacaaatggaggatgtgaaatctacgaagatgtgaggaggaactcattggaggaggccatgaagctctgtttggagaatggattggaaggaattgtctctgagattaaaggaatattcagaaatcctggagcagtaacccagatcaaggagtccaagctttctctcctttcttatggaaaattaaacaatgttccagaggcagtttacatgcaacatctaatgggaatcaatggggtaattgtggatttggtccaagaaataaccgaggcagttgcggatatgataaagccaacaaagggtggtgaaggagagggtttggctgagggttgtgggaaggtgcagggaaactcaaagcctcaattttcacagcaggagttgtcttttcttttcaagctcattccacagttactacaaatttga

SEQ ID NO: 4021 - DNA, 2316 bp, Glycine max var. Williams 82
atgtcttccagcttctcaccccttgccatcttcctcctcctccttctggtccggtacacgtgcgaggcacgtgagccgttcgcgtgcgacccaaaaaatggcggcacgaagaagatggcgttttgcaaggtttcgctggcgatagcggagagggtgaaggatctgattggaaggttgacgctggaagagaaggtaaggcttctagtgaacaatgccgcggcagttccgaggcttgggatgaaagggtacgagtggtggtctgaggcactccatggtgtttcaaatctgggtcccgccgttaagtttaacgcacagtttcctgccgctactagcttccctcaagtcatcaccaccgctgcttccttcaatgcttctctctgggaggcaatcggacaggtagtgtcggatgaggccagggccatgtacaacggtggaacagcagggctcacgtattggagcccaaacgttaacattttcagggaccctaggtggggccgtggacaggaaactcccggtgaggaccctgtgttggccggtacttatgctgctacttatgtcagggggctacagggaacccacgctaaccggttgaaggttgctgcttgttgcaaacatttcactgcttatgatcttgataattggaacggcatggatcgattccactttaatgcacaggtgagtaagcaggacatagaggatacattcgacgtgccattcaagatgtgtgtgagcgaaggcaaagtagccagtgtcatgtgttcttataatcaagtcaatggggtccctacctgtgctgaccccaacctcctcaagaaaactgttcgtggcctgtggcaacttgacgggtacattgtatcagactgtgattctgttggggtgttttatgataaccaacattacacaccaacgccagaagaagctgctgccgatgccattaaagcaggtttggatttagactgtgggcctttcctagctgtgcacacgcagaatgcggtcaaaaaaggcttgctaagcgaagctgatgtcaatggtgctttggtgaatacactgacggtccaaatgaggttagggatgtttgatggagagcccacggcccatccatatggtcacttgggcccaaaagatgtgtgcaaaccggcccaccaagaactggctcttgaagctgccagacaaggaattgtacttcttaagaacactggtcctgttttgccactctcctcacagcttcatcgcaccgtggctgtcatcgggcccaattctaaagctactattacaatgattggaaattatgctggtgttgcttgtggatacaccaaccccttacaagggataggaagatatgcacggactgttcatcagttgggttgtcaaaatgtagcctgtaaaaatgacaagctgtttggacctgctataaatgcggcccgtcaagcagatgcaacggttttggttatgggcttggaccagtccattgaagctgaaacggtggacaggacaggcttgcttttgcctggtcgtcaaccagaccttgtttcaaaggtggcagctgcctcaaagggaccaactattttggtcttaatgtctggtggtcccgtggatataacttttgcaaagaataaccctcgaattgtgggtattctgtgggctggttatccgggccaagctggtggtgctgccattgcagatatcttgtttggaacagctaacccagggggaaagctgccagtaacatggtacccagaagagtacctaacaaagttaccaatgacaaacatggcaatgcgagcgaccaaatcagcagggtatccaggaagaacgtatcggttctacaatggtccagtggtgtatccatttggacacgggttgacatacacacactttgttcatacactagcaagtgctcccacagtggtgtcagttcccttgaatggtcatcgccgtgccaatgtcaccaatatttcaaacagggcaattagagtgacacatgcgcggtgtgacaagctctccatcaccctccaggtagacattaaaaatgtagggtccagagatggcacgcacacgttgttagttttctctgctccccctgcaggttttggtcattgggcactagagaagcaactagtggcctttgagaaggtccatgttcctgccaagggtcaacatagagttggagttaatattcatgtgtgcaagctcctaagtgtagtggataggtctgggattaggagaatcccgttgggggaacacagttttaacattggtgatgttaaacactccgtgtcacttcaagctgcagcacttgggattatcaagtcctga

SEQ ID NO: 4022 - DNA, 1161 bp, Glycine max var. Williams 82
atgtctactatgtctgaagggtattataattccaagaagagtggtgatatatatggccagcagggaactcgcgcagcattgagcatgtcaaggcttcgttgcattctgcgagggttgaatttcaagacctatatgtttttgtttcttgttgttccaatgggaatcttcagtctgtattttcatgggctgaaaatctcatactttctgagacccctgtgggaatctcctccaaagcccttccatgaaatccctcattattatcatgagaatgtgtcaatggagaccttgtgcagacttcatggttggagaattcgcgaatcgccaagacgagtctttgatgctgtcttgtttagcaatgaagttgacatcctcaccattcgctggaaagaaatgtatccatatgtgacacattatgtgatcctcgaatcaaactcaacatttacaggattgcccaagccgtcgattttcgcaagcaatagggacaattttaggtttgttgagtctcggttaacgtatgggatgattggaggaagatttaagaaaggtgagaatccttttgttgaagaggcataccaaagagtagccttggaccggcttttaaagatagcaggaatagaagatgacgatctcttgataatgtctgatgttgatgagattccttgtgctcacacaattaacctcttgaggtggtgcaatggtatccctcctgttcttcaccttcaaatgaggaattacttgtactcgttcgagttctttctagacaaccaaagttggagagcgtcaatacatagataccagactggcaagacacgttatgcacactataggcaggctgatgtcttgttggcagatgctggatggcattgtagcttctgtttccgccgtataagtgaattcgtattcaagatgaaagcttacagccataacgatcgggtgaggttcgcgcattacttgaactgtaacaggattcaggatgtgatatgcaaaggggatgacctatttgacatgctccctgaagagtacacatttaaggatattattgggaagttgggacctattcctcattcttattcagcggttcatcttccatcatatttgttgaataatgcagagaaatacaagttcttgttgcctggtaactgcagaagagaaagtggctga

SEQ ID NO: 4023 - DNA, 717 bp, Glycine max var. Williams 82; identical to SEQ ID NO: 3415

SEQ ID NO: 4024 - DNA, 1488 bp, Glycine max var. Williams 82
atggaaatggaagaggagctaaaggagacgcttatgcatcatccaaacaacacttctttggagagtgttgaaaaggaagagtcattgaggaaaagggcatgggaagaaagcaagaagatgtgggtggtagcaggccccgccatattcacaaggttttcaacgtttggaatcatggtggttagtcaatccttcattgggcatattggctcaactgaactagctgcctatgccattgttatgactgtcctagtcaggtttgcaaatggtgtattgattggaatggcaagtgcattggatactctttgtgggcaagcatatggggccaaaaaatatgacatgctaggagtgtatcttcaaagatcatggatagtgttgttcatgacctcaatactccttcttcctatttacatctttaccactcctttgttagaggctctaggccaagataaaaccattgctcaagttgctggaagcatttctctgtggtcaataggtataatatttgctttctctgtctcattcaccagccaaatgttcctacaatcacagagcaagaacaagatcattgcctaccttgcagcagtttcaatttcaattcatgttttgttgtcatgggttttaactgttcagttcaagtttgggctcaacggtgcaatgacatcaacacttttagcatattggattcctaacattggccagcttgtgtttataatgactaagtgccctgacacatggaaaggtttctcattcttggccttcaaagatcttttgcctgttatcaagctttccctctcttctggagctatgttatgtcttgagatctggtacaacactgttttgattcttcttacaggcaacatgaaaaatgctgaagtgtctattgatgctctggccatatgcctcaacattagtgggtgggaaatgatgatagcccttggtttctttgctgcagcaagcgtccgagtggcaaatgagcttggaagagggaattcaaaggctacaaaattttccattctgataacagtcctcacatcattttccattggattcgtgttattcttggtgttcctatttctgaggggaaaacttgcttacattttcactccagaccctgaggttgctaaagctgttggcgatttatcaccattgctctcattttccttcttgttgaacagtgtccaacctgtgctttctggagtttctgtgggtgctgggtggcaaagcgttgtagcatatgtaaacataggctgctattatcttattggtattcctgttggagtgctgcttgataatcttttccatttggaagttaagggtatttggattggaatgttgtttggaacatttgttcaaaccgtaatgcttattacaatcacatttaaaactgattgggacaagcaggtagagatagctcgaaatcgtgttaacaaatgggcagtgacgacggagaacgaagaatcaaacagtagatcaagcatatctagctag

SEQ ID NO: 4025 - DNA, 1074 bp, Glycine max var. Williams 82
atggctgatgcttctgtggcaccaccacctccactgaaagatgagcttgacattgtgattccaaccataaggaaccttgactttcttgagatgtggaggccattctttcagccttaccatttgatcattgttcaagatggtgaccccaccaaaaccatcaaggttcctcctggctttgactatgagctctacaaccgcaatgacatcaacaagcttttgggtccaagggcctcttgcatctccttcaaggactccgcgtgccgctgttttggctacatggtgtccaagaagaagtacatctacaccattgatgatgactgctttgttgccaatgatccatcaggaaaagcgatcaatgcacttgagcagcatattaaaaatcttttgtgtccatccactcccttgttcttcaataccctttatgaccccttcagagaaggtgcagattatgttcgtggataccctttcagtcttcgtgaaggtgtgccaactgctatttctcatggactttggctcaacatcccagactatgatgctcctacacagcttgtgaagcctcttgagaggaacactaggtatgtggatgctgttctgagcataccaaagggcactttattccccatgtgtggaatgaacttggcattcgatcgtgatctcattggaccagccatgtactttggtcttatgggagatggtcaaccaatcggacgctatgatgacatgtgggctggatggtgctgcaaggtgatcactgatcatttggggctaggagtcaagactggtctgccctatatctatcacagcaaggccagtaacccatttgttaacctcaggaaagagtacaaaggcatattctggcaggaagacattattccattcttccagaatgttgttcttccaaaagaatgcaccactgttcaaaagtgctacattgagctctccaagcaagtcaaggaaaagctatcaaagatagatccttacttcgacaagctcgccgatgccatggtcacttggattgaagcttgggatgagctaaaccctgaaggagcatctaaggctaatgacaaagcataa

SEQ ID NO: 4026 - DNA, 723 bp, Glycine max var. Williams 82
atggttgctttgttttctcctccagtgttctcaaccaagggatggcttttagaagaggagccattaagctatgatgtgtcttcggagtactcatttccctatcaattttattcaccacagacacagattgaggttgaaatagaaagctcaactgcaccatcccctgatgaccctgccatggtcaagaagcttagccacaacgctagtgaacgtgatcgccgcaagaagatcaataacttggtttcttcacttcgttcacttcttccggtggctgatcaaacgaaaaaaatgagcattccggctacagtttcgcgagtcataaaatacatacctgagttacaacagcaagtgcaatcactgactaagaaaaaagaggtgcttctttggagaatctctcggcaattgcaaggagatgcagtgaacaaagaatctcaaaggaaaatttcccaacacaactctgaatttgttgtttcaacaagtaggctcaacgactgtgaagttgttgttcacatttcttatgaggctcaaaaggctccactatccgagatcttgcactgtttagaaaataatggtctttatttgctaaatggttcttcctctgaaacctttggaggaagggctttccacaacttgcattttcaggtggaaaaaactcagagattagagtccgagattctaactgagaaccttttgtcgatatatcagaaccaaaggattttataa

SEQ ID NO: 4027 - DNA, 1014 bp, Glycine max var. Williams 82; identical to SEQ ID NO: 3425

SEQ ID NO: 4028 - DNA, 369 bp, Glycine max var. Williams 82
atgagcttggggtattgcaccataaggtctacgccacgcaagtttgggatctcattcactgtgccagaccgtgtcactgcagagatcaatgacaagaagagagtcatagggaagcaccctttgaggatcactagaattccctcaggaggaccaagtgagtttcataggatcatgcaagaggttgagaaagggccatcatccactttgactctgaagaagagaaaaaattatgatgatgatgacacaaaggaggagtatttggttagtcacaaaagggcctaccatagaagccgcttcaatgattggtatgtccaagtgttttattttgagaattgtggtcagaaccaaccctcagaacctaacacatga

SEQ ID NO: 4029 - DNA, 1278 bp, Glycine max var. Williams 82
atgaagttccaagatattgagcttctatttgggaagataaccccaaaacaaatgctcccaaaagtgactttacttgtactcttatccatacttatatttgttgtcaccccaatgtgttatcctttgtttagttactcttcactcttgaagatcaataaatataacaagcacccagaaagcttgccttcaacatctgtgaagaagtgtaacattttcagtggtgaatgggtgtcaaatccagaggcaccatattacacaaacaacacatgttgggcaattcatgagcaccaaaattgcatgaagtatgggagacctgacactgatttcatgaagtggagatggaagccaaatgagtgtgaactccccatattcaacccctttcagttcctagaaattatgaagggaaaatctatggcttttgttggagactcagtgggaagaaatcatatgcagtctttgatttgtcttctttcaagggtggaatggcctatagatgtttcacccacaacaaatgactatttcagacaatggaagtacccaagttataacttcaccgtagcagctttttggacaccctatttggtgaaatctaaaatggtagattcaattggaccaagtcacaatggcctgtttaacctttaccttgatcaagttgatgagacatgggcaacccaaattgaggagtttgactatatcatcatcaatgctggacattggttctttcgttcaatgatattttatgagaaacaaaatattgttggatgttgtgactgtctcttaaaaaatgtcactgacttaactacgtactatggctacagacaagtttttaggactgcatttaaagccatcaatagtttacaaaacttcaagggagtaacatttcttagaacatttgcaccatctcattttgagaatgggacatggaataaaggtggacattgtgtgagatctaagccatttaagaacaatgacatacgtttagaaagtactaatttggagttatatatgatccagttggaagagttagaaattgcaaagaaggaaggtagaaagaagggtttggaatttaggttgtttgacactacacaagcaatgttattaagaccagatggtcacccaagtagatatgggcattggccacatgaaaaagtcacactttataatgattgtgtgcactggtgcttgcctggacccatagacacgtggaatgattttctactagaaatgttaaagatggaggacatgaaattttctagtggtgaaagacttcatgtgtaa

SEQ ID NO: 4030 - DNA, 1152 bp, Glycine max var. Williams 82
atggctggtaataaacaaaaactctttaacagactgaagccattcataggtgtagtgttcttacagtttggatatgctggcatggatgttctatccaaagctgcactgaacaagggaatgagtaactatgtatttgtcgtgtaccgtcatgtttttgcctttgttgtcacggccccttttgcactgatcttggagaagaaagtaaggccgaagatgacattttcaattttcatgaagataatgattctcagcttgctagagcctgttattgaccaaaatttatattttttgggaatgaagtacaccacagcaacctttgctgtttccatgtacaatgtcctccctgccattacctttgtcatggcttggatttttaggcttgagaaggtaaaactaaaaagtatacgcagtcaagcaaaggtggtggggactttagcaactgttgcaggtgccatggtcatgacactgataaagggcccagtacttgatctttttggaacacacacaagcaatacccacaaccagcaaaatggtggggtgaatcttcaacatgcaataaagggatcggtcatgatcacaattggctgctttagttgcgcttgtttcatgattctccaagctattaccattgaagcctaccctgctgagctctctcttacagcatggatatgcctattgggaacagttgaaggtggtgtagtggcactggttatggaaaggaagaatctttctgcttggtctctgcaatgggatacaaaactgctggctgctgtctacagtggcatagtttgctcaggaatggcttattacatccaaggagcagtgatgaaagataggggaccggtctttgttacaacttttaaccctctctgcatggtcattgtggctatcatgggctccttctttctggctgaaataatgtacctcgggagggcggttggagctattgtaattattttagggctgtatcttgtggtgtggggtaaaagccaagactacgagtcatcaagtccaattactaaagagcatatattggcatccaagcaaacagtagaggagaacaacggcaaagaggaggatcattctaatcatggggtcatcactctcagtaacttaggcgcgggaaacatagcacgagatgaacaagtatga

SEQ ID NO: 4031 - DNA, 4515 bp, Glycine max var. Williams 82
atgtcattggcatcatcttcaacctggttaacatccctctcatgtgcattccctgagaaacaaacctcagggtacacgtttgtctcaactctgcttcaatggtttgagtttattttcctctcaccttgtcctcagagagctatattgtctttcattgatgtcgtcctcctcttctttctctttgtctttgctgtcaccaagttctggaaaaggtccaccaacctcaacgaaccactcatcagaaataacaataacatatccattttcttgactacgtggtttaagctaaccttaactgtggcgattctgttgactctagtttacacggttgctagtgttcttgctttcagcagttcctctgaggtgccgtggaaccaagttgatgaggtgttttggttagtccagaccataacacacgcggtgcttgtcgtcttgatcattcacgagaaaagatttgaagccgttaaacaccctctgttggtgagactttattggattgcgaatttctttgttatttctctgttcgctgtttctgcggttatacgtttggtctccgtggacgtggatggaaccataaactttaaggtgaatgacgtggtgtctttcatttcactccctctgtccttgtttcttctttttgttgcggttaaaggatccactggcattgttattccgacagaagaaacacgaccacttcttgaggaggaaactaagttatacgatggtggtgatgagacagaatccgaggttactggcttcgcttcagcttctatattatccaaggcattttggagttggataaaccccttgttgcgtaaagggtacaagtccgcgctgaagattgatgagattccaacgctttctccagagcatagagctgagagaatgtcatctatttttgaatcgaagtggcctaaatcaaacgagaggtcgaagcatccggttagaatcactttgcttcggtgcttttggaaggagttagccttcaatgctttccttgcaattattaggctctgcgtcatgtttgtggggccggttctcatacaaagttttgttgatttcacatcagggaagagaagctctgaatacgaaggatattacctcgtgttgattcttctcgtttctaagttcattgaagtcttggctactcatcatttaaacttccaagctcagaagctagggacgcttttacggtcaactcttatcccttctttgtataaaaaggggttaatgctatcattctctgctcggcaggatcatgggatagggactattgtgaattacatggctgttgatacccagcaactctcggacatgatgcttcagttcaatgctgtgtggatcatgccgtttcaagttgccattggcatgtttctgctttacaattgtctaggtgcctcatccgtcaccgcgtttctcggtcttcttggtgtttttgtgtttgctgtgattggtacccgtaggaacaaccacttccaatacaatgtcatgaggaaccgtgattctagaatgaaggctgtgaatgagatgcttaattacatgcgtgtgatcaagttccaggcctgggaggaacatttcagccagagaatcatgggattccgtgagaccgagtatgggtggctctccaagttgatgttcacaatttgtggcaatattgttgtgatgtggagcacgccgctgttggtgtcaactatcacatttggtacagctattttgctgggagttcaacttgacgcggccacggtgttcaccacaacaactgtgttcaagatattgcaggagcctattaggacattcccacagtctatgatatctctctcacaagcatttatatcactggagaggttagacaggttcatgttgagcagagaattgttgggtgattcagttgagagagaggaaggctgtggtggaaaaacagcagtggaaatcatagatgggacttttagttgggatgatgataacatgcagcaggacttgaaaaatgttaatctggagatcaaaaagggagagcttactgcaattgttgggactgtagggtcaggaaagtcctctctcctcgcatcaattcttggagagatgcgtaagatttctggaaaggtccgggtttgtgggaatgttgcctatgttgcacaaacatcttggattcagaatggaactattgaagagaacattctctttggtttaccaatggacagacggaggtacaatgaagttatcagggtgtgttgtttggagaaagatttggaaatgatggattatggggatcaaacagaaattggagagcgtggtatcaaccttagtggaggccagaagcagcgtatacaacttgccagggctgtatatcaagactgtgatatatatcttcttgatgatgtctttagtgctgttgatgctcataccggttctgaaatatttaaggaatgcgtgaggggagctctaaaaggcaagaccattattcttgtaacgcaccaagtagatttcctacataatgtggatcaaatattggtgacgagggacggtatgatagttcaatcagggaaatacgatgaattattagattctggaatggattttaaagctctggtagttgcacatgagacctccatggctctagtagagcagggtcagggtgtggtcatgcctggtgaaaatttgaataaaccaatgaaatctcctgaggcaagaaattctggtgaaagcaattctcttgaccggcctgtgtcaagcaagaaaagttctaaactcatcaaagaagaggagagagaaaccggcaaagtgagcttacatatctataaactctactgcactgaggcttttgggtggtggggcattacagtagtattgattttttctttgttatggcaagcgtctatgatggcaagtgattattggctggcatatgaaacctcggaagaacgtgctaaaatgtttaacccttctctgttcatttccatctatgcaattattactgctgtttcaattattttggtagtgataagatcctacatctttacactcttggggctaaagacagcacaaattttcttcacacaaattcttcgtagcatcttgcgtgcgcccatgtccttctttgacactacgccatctgggagaattctaagtagggcatccactgatcagaccaatgttgatgtccttctccccttgttcacgggaattgttattgctatgtacattacagtgctcagcatcttgatcatcacctgtcaaaattcttggccaacatcgtttttgataattcctcttatttggttgaatatttggtaccggggttactatcttgcaacatctcgcgaattaactcgcttagattcaattaccaaagcaccagttattcatcacttctctgaaagcattgcaggggtcatgacaattcgctcattcagaaagcaaaagaatttttgtgaagaaaatctcaaacgggtgaatgataatttgcgtatggatttccacaactatagttctaatgtgtggttgggagtacgcttagagttgcttggaagctttgtcttttgcatttctgcaatgttcatgatcatcttacccagcagtatcattaagccagaaaatgttggtttatctctctcttatgggttgtccttaaatgctagcttgttctgggccgtattcatgagctgtttcatcgaaaacaagatggtatctgttgagaggataaagcaatttacaaatattccatcagaaccagcatggaatatcaaggatcgtatgcctccttcaaattggccaagtcaaggcaatgtagatatcaaagacttgcaggtcagatatcgtctaaacactcctctggttcttaaaggcattactttaagcattagtggaggtgaaaaggttggtgttgttggtcgaactgggagcggaaagtcaactttaattcaagtattctttaggctggtggaaccttcacgagggaaaataataattgatggtattgacatatccgctttggggcttcatgatcttagatcacggtttggtatcattcctcaggagccggtgctttttgaaggaactatcagaagcaacattgatcccattggacagtatacagatgaagaaatatggaagagcttggaacggtgtcaactaaaagaggttgttgctactaagcctgaaaagcttgactctttagtggtggataatggagagaactggagtgttgggcagagacagttgctttgtctagggagggtcatgcttaagagaagtcgactcttgtttatggatgaggcaactgcttctgttgattctcaaaccgatggtgtggttcagaagatcattagagaggactttgcagcatgtaccatcattagcattgctcacagaatacccacagtcatggactgtgacagagttttagtagtagatgcagggcgagccaaagaatttgataagccctccaacttgcttcagaggcaatctctctttggggcattagttcaagagtatgccaatcgctccactgaactataa

SEQ ID NO: 4032 - DNA, 660 bp, Glycine max var. Williams 82; identical to SEQ ID NO: 3337

SEQ ID NO: 4033 - DNA, 900 bp, Glycine max var. Williams 82
atgtcatcgatacaccactactcaccggaaacaacactatactggaccagcgaccaccagcaacaacaacaacaacaacaacaacaacaacaacaagctgccacgtggcttagtaattcccacactccccgtttcaacctgaacgaagacgacgacgaggaagacgacgttgtcgtttcggacaaggctactaataatttggcgcaagaacaggagaaagaagcgatgttcgagaagccgttgacgccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctcctactctgcgctcccagcttatcctacgcaccatcatcatcacctccccttcccataccaacctcactctcttcacgcaccaggtggagggtcccaaggacagaacgaaacgacaccaggagggaacagttcaagtggcagggtgctgaggctgtttggggtgaacatggaatgccaacctgataatgataatgattcccaaaactccacacatgaatgctcctacacccacttataccaccatcaaacctcttcttatccttcttcaaaccctcaccatcacatgctacctcaacaaccataa

SEQ ID NO: 4034 - DNA, 1668 bp, Glycine max var. Williams 82
atggcagccaaaacatctaccaacggcactcattattctcgctctcgccccgagtacattccaaaccgcatccccgacccgcattatgtccgcatcctggacaccacgcttcgcgacggcgagcaagcccccggagcctccatggtttccagccagaagcttgctcgccagctcgcgaagcttggcgtcgatgtcatcgaaggaggctttccttcagcgtcgcaggaagacttcaatgctgtcaagatgatagcacaagaagttggcaacaactgtgatgctgatggctatgttcccgtcattgccgccctctgtaggtgcaatgagaaggacattgccacagcgtgggaggctctgaaatacgccaagaggccgaggcttatgcctttcatagcagtgagccccattcacatggagtacaagctcaataagactaaagaagaggtgcttcaaatagctaaagatatgatcaaatttgcacgcagtttaggttgcagtgacatccagttctgttccgaagatgcagccagatcggatagagagtttctttatcaaattttggaagaagttatcaaagctggggcaacaactttgggcataggtgacactgtgggcataacaatgccattcgagattagacaattgattgctgatataaaagccaatgtccctggagcagaaaatgttattatttctatgcactgtcataatgatcttggacatgctactgcaaacgcaatagaggctgctcaagctggtgcaatgcaattagaagtaacaattaatgggattggtgaaagggctggtaatgcctcattagaagaggttgtgatggccctaaaatgcaggggagatcaagtcttaggtggtttgtatactggaattaatacaaggcacttattgaagacaagcaagatggtcgaagagttttctggtatgtatttacaaccacacaaagctgttgtaggtgataatgcctttctccatgaaagtggcgttcaccaggctggattgttaaagcatagagctacatatgaaataatgtctcccgaagatattggtcatgaaaagtccagtggagttaatatggtactagggaagctaagtggacgccaagctttgaaaagtcgtctcaaagagcttggctatgaacttagggatgaagaagttgagagtgtgtttaggaacttcaaagcaatagccgagaaaaaaaagagagttaccgatgttgacctcaaagcattggtgtcaaatcaagtttctcatgatgaacctatttggaagcttgatggtttgcaggtgacttgtggaactatgggttcttcaacagcaactatcaaacttgtcactagtgatggtatcacacatgttgcttgttctgttggtgtaggaccagtagattcagcttacaaggctatcaatctcatcgtgaaggaaactgtaaaagtacttgagtactcactaagtacagttacagaaggcactgatgcaattgcaactacacgtgttgtaattcgtagagagaataagcaatcaccaactcctgctttgaatggaaacgtaatttatccaacatttagtggaaccggagaaggggtggatgttgttacttcaagtgtagaggcttatcttactgcactaaacaaaatgctcgatttaaaggaatga

SEQ ID NO: 4035 - DNA, 798 bp, Glycine max var. Williams 82
atgccggagatggagatgagcatatgtgtgaatggagaatcccaagtccctccaggcttccggtttcatccaaccgaagaggaactgttgcagtactatttgaggaagaagatgtccaacgagaagatcgacctcgacgtgattcgcgatgttgatctcaacaggctcgaaccatgggacatacaagagatgtgcaaaataggaagcagcccacaaaacgattggtacttgttcagccacaagtacaagaagtaccccacgggaagccgcacaaaccgcgccaccagtgttgggttctggaaggccacggggcgcgacaaggtcatatatagcaacgggaagataattggaatgagaaaaacattggttttctacaaagggcgtgcccccaatggccaaaagtctgattggatcatgcatgaatacaggctagacgacattaataacaccaatgagatggaacacgggtgggtggtctgtagagttttcaagaagaagaacgtccctctcaaaacactagatagcccaaaatccatgaccatgaatatggtcacagaaagcgactactgtggtggcttcactagctgggaatcccttgatcagcttgtggcatcacaactgaatggacaaactgagacatattgcagtgatttgcaattccccgcatttctatcatcctcatacattgctacaacaacaacaacaacaacacacattgctcccacaatacaggattaccccagctacgacattgacctgtggaaccactgtgcttcgtgtccaacactccaaatgtaa

SEQ ID NO: 4036 - DNA, 390 bp, Glycine max var. Williams 82
atgaggcatagagagggagaagtgttggaatttagaaccccacaacacccatctttgggaacaaacaattggggtggttcatctcctttgctagcaaggaacgtacccaaggaatcacttgatcaaaagtattcaagactcaacacagttcggaccaaagatgagatctttccagctgatgatgactactatgttgtgaacccttccaatgagtcaggtgcaagtgtaagtagtgccaagagatggaacaaaggtagaggagttctgtttaagttaatatttgtgaggaaagagaacaaaaccacagttaaattgggttcacgtttaaggaagagaagatggataccgagaatggatcctacgactaggtggccacaaggttggtgttga

SEQ ID NO: 4037 - DNA, 978 bp, Glycine max var. Williams 82
atgtcctcctcaagtgtctgccaagggttgcaatcttgtctcgaaccccgcgtgatggagccacgtgtactcaggctcaaactcgcactacaacaaggttccaattttcctcaaccctctccctctcccactaccaacacattttcactttcacccctctctgactccgaagaaaacccacctaccaactgccaatgtgacaaaaatgacacaaaatccggcgagcctagtggctggagtttccttcaaactctctcacaggacaaaacagaggaccaagtctatgtccaccccacagttaaacgttcctcctcaattctcagtgaaaaaagcttagaaatgtgcaccgaaagcctcggcagcgagaccggtagcaatgccagtgaaaatggtgatgacatgtccttgttttcctttgacaccaacactcgttccaccgaacatactactactactactgctactcatgcaaattatgagtctaaaagagtgaaccgcacttgcaacttgccaccaccactgaccacaatcactgattttggcggtgttcatgttcgacctcatcgcgaaggtggaaggctagtattggaagctgtagcttctccttcccctcgtccatattttcacatagagcgcggcgatggaaggcttaggctgtgtttgcttgagagcttttcggcctcggatagtgatgatgaagtttgtgatgctgaggaaggtgttgatgaacaacaggaagaagaaaatgaaagtgagaagaacagaggagaagaagaagaaaaggagtgtggtgaagaggatattgctactggggcagaggaggaggaggaggaagagtgtgttgagaacgtggaggatgggatgggagtgaaaaagttggcgagaccaagcaggtgcaaggaaagtgggaaaagagatatttttggtgatgccttggctaatttgagcttccctcgttttctctctgtctccgaatag

SEQ ID NO: 4038 - DNA, 1764 bp, Glycine max var. Williams 82
atgaaaatctgcaccaccttttgtgtgtcactggccacggttttggtgatgatgagcaacatcgtcatggcagtggctgagactcacattcccaccaccctggatggcccatttgacccggtgacccgacggttcgacccgtcactgcgacggggcagtgatgacttgcctatgactcatccaaggctcagaaagaatgtcacttcaaacttccctgaacagattgctcttgcaatttcttcaccaacttccatgtgggtttcttgggttactggggatgcacagattggcctcaacgtgaccccagtagatcctgcatctgttggaagtgaggtgtggtatgggaaaaagagtggcaagtacacaagtgttgggaaaggtgattctgttgtttacagtcagttgtatcccttcgaaggcctatggaattacacctctggcatcattcaccatgtgaaactcaaaggtcttgaacctggaaccagatattattacaaatgtggggatagttctattccagccatgagccaagagcattattttgagacttttccaaaacctagtccaaataattatccagctcgaatagcagttattggagatttaggtctcacaagcaattctacatcaactattgatcatctaaattacaatgatccttcaatgattctaatggttggagatttaacatatgcgaatcagtatcttacaactggtggaaagggagcttcatgttattcatgtgcatttccagatgctcctattagagagacatatcaaccccgatgggatgggtggggaaggtttatggagcctttgacctcagaaattcctatgatggttattgaagggaatcatgagatagaacctcaagctggtggaatcacattcaaatcatacctgacacgatttgcagttcctgctgaagaaagtggctctaaaagtaacttctactactcttttgatgctgggggcatacactttatcatgttgggagcatatgttgattacaatagcactggtgcacagtttgcttggctgaagaaagatctgcaaagtgtagaccgtagtgtaaccccttggttagtagctgcatggcattctccttggtataacagttatgcttcacactatcaagaatttgagtgtatgagattggaaatggaagaacttctctttcgatacagggttgacattgtttttgatggccatgttcatgcttatgagagaatgaatagagtttttaattacacgttggatccttgtggacctgtttacataactgttggagatggtggaaatattgagaaagtagatgttgatcatgcagatgatcctggaaagtgtccttctgctggtgataacataccagaatttggaggtgtttgcaaatcaaatttttccactggtcctgccaaaggaaacttttgttggaacaaacaacctgagtggagtgcatttagagaaagcagttttggacatgggatacttgaggttgtgaattcaacatatgcattatggacttggcaccgaaatcaagacaattacaaagaaaatgcagttggtgaccaaatatacattgtgcgacaacctgaattgtgcatgaaagatttgaaggatccacatcaatcacttccatacaattcatccactaaatcctcttctgctataaaccatctctctcaggatgtttctataatcatatcacaaatccttggggttctctttatatatggtctactttctcaggtggagtggagctag

SEQ ID NO: 4039 - DNA, 1653 bp, Glycine max var. Williams 82; identical to SEQ ID NO: 3354

SEQ ID NO: 4040 - DNA, 414 bp, Glycine max var. Williams 82
atggcgagaaaactaagcattgttgtactctgccttgttcaaatgctgcttcttctcgtggaaaaccatgccgagattgttgtgtccaccgttgaggcttcagctccgcagcctcacaagaacaccacccacaccctgtcccacgctccagctccgcagcctcacaaaaacaccaagtcccctgttcccaatttgcagcatggcatcaccgaaggcagtcttaaaccacaagaatgtgggccacgttgcaccgctagatgctcaaacacacaatacaagaaaccgtgcctgttcttctgccaaaagtgctgtgccaagtgcttatgtgtgcctcctggaacttatggcaacaagcaagtttgcccttgctacaacaactggaagaccaaaaggggagggccaaaatgcccctga

SEQ ID NO: 4041 - DNA, 969 bp, Glycine max var. Williams 82
atggcagaagatgcttcaattattccaacacacacaaaagcttggtactactctgaacatggtagtccaggtgatgttctcaaattagatcctaattggcccttaccccaacaactcaaagatgaccaagtgctcatcaaggtcatcgctgcatccattaatcccgttgattacaagaggatgcacggcgagttcaaggacactgaccctcatctgcctattgtgccgggttatgatgttgctggcatagtagtgaaagtgggaggagaagtaaaaaaatttaaggttggagatgaagtatatggtgatatcaacgagcaaggcttgtcgaaccttaagattcatggcactttgtcagagtatactattgcagaagagagactattggctcataaaccatccaatctaagcttcattgaagctgctagcattcctttagcacttgagactgctaacgaaggttttgaacatgctcacttctctgctggcaaatctatccttgttttgggaggagctggtggagttggaaactatgttattcagctagctaaacaagtttataaggcgtctaagatagcagcaactgctagcaccggcaaacttgaacttttaagggagttgggcgttgacttgcctattgattacacaaaggagaactttgaagaccttccagaaaaatacgatctagtgtatgatgtagtagggcaaggtgatagagcatttaaggccgttaaggaagatgggaaagttgtgacaatagtaccacctggacatccaccagctatgtttttcgtgctcacctcaaagggatctatcttagagaatttaagaccttactttgagagtggtaagttgaagcctatactcgatgccaagactccagtgccattttctcaggttattgaagccatttcctacttagaaacttcaagagccacaggaaaagtggtcgtttatcccataccctaa

SEQ ID NO: 4042 - DNA, 1305 bp, Glycine max var. Williams 82
atggggagacactcttgctgctacaagcagaagcttcgtaaaggcctctggtctcctgaggaagacgagaagcttttgaattacatcaccaaacatggccatggatgttggagctccgttccaaaactagctggtcttcagaggtgtggcaagagctgcagattaagatggataaattatctcaggcctgatttgaagagaggagcattctcacagcaggaagagaactccatcattgaacttcatgcagtccttggcaacaggtggtcacagattgcagctcagttaccaggaagaactgataatgagataaagaatctatggaactcctgtctgaagaagaagcttaggcaaagaggcattgacccaaacacacaccagcccctctcagaggttgagaatgacaaggacaagcctcttacagctgacaaaagcaaccagaaagcctccaatgaggtgagtcttattgagccaccaaaaccaaagccaatatctactacttctatgcccatggatagatatccccttgaagtttcttcaactttcaagatcagcggtggcaacaacaacaataacaacagcaacagcaccctagacaggtttgacagctccatcactagttctgatatgatgggaatgggatatttcccttttcagcacttgaactatggatcaaacatgggactcactactacacccaacaacactccactttgcttcatgccaagttccacttcttctcaaatgatgtcagagctgaattccaccatgctccattctatgttcccaacacatgtaaaacccactgttagcctccactctaacaacaacaacaacccttcttccatatcctctgatggggttcagaactgggaaacaagtaccttcagtaataacaacaatgcaagcaaaagcaatgggagtagtagctgcagcatccaattacaaagcggcagcactaactttcttgatcatagcagcacaataacatgggggctgcaagcagaatctgccaccaaggcagataaagatgctcatgttgttgtacctttgcaatcatcggaacaagaagacattaaatggtctgaatatctcaacaacacccctttctctctgggaaccatgtcagtgcagcatcaaactacaaactctctctacagtagtgatgaggtgaagccagaaacaacaggcttcatagcagacgaatcaagtaccagttggcaccacagccagcattttcaaccttcggaaatatataccaaagatctgcagagattttcagtggcttttggacaaaccctgtag

SEQ ID NO: 4043 - DNA, 1014 bp, Glycine max var. Williams 82
atggagaccttggatcagatgcttgtgtctagttggtacaatgttcattcctcggtgcccccatcctttgtgcaattaccagaaaacaggcctggcagggtggttagttctttgcataaggcaataccggtgattgattttggaggacatgaccttggtgataccacaaaacaagttttggaagcctccgaggaatatggctttttccaggttatcaaccatggagtttccaaggatttaatggacgaaacaatgaacatttttaaagaattccatgccatgcctcccaaagagaaggtaaatgaatgctccaaggacccaaatggaagctgcaagctttatacaagtagtgagaattacaagaaagatgcgattcattattggaaggactcactaacacatccttgtcctccttctggggaatacatggagtattggccacaaaaaccatccaaataccgagatgttgttggaaaatacacaagagaattgaagaaactagcccttaaaattttggagctgctttgtgaagggttagggctaaacctaggatatttctgtggtggactaagtgaaaatccatcagtgttggttcatcactaccctccttgccctgacccaagtttaacactaggcttagctaagcacagggaccctaccattatcaccattttgcttcaagataaggaggttcaaggacttcaagtcctgaaggatggagaatggattggagttgagcctattcccaacgcttttgtggttaacattggtctactcttgcagatcataactaatggaaggcttgttggtgctgaacaccgagctgtgacgaattcgagcagtgcacgcacaagtgttgcctatttcgtctatccatcatttgaaagcatcatagaacctgcacaagctttgatcaatgaaagcactccagcaatatacaaatccatgacattcggagagtttcgtagaaatttctttcaaaagggtcccaagattgaagaagaactgcaatag

SEQ ID NO: 4044 - DNA, 3090 bp, Glycine max var. Williams 82
atgtcaatgcccttgctcacaaacttgcaacacattgagacactcctcaatgcaccaaaccccaccgttagtgcatccattaaaagatggcactctgcattcatggccatctattgttcccgagctattatgtcacactccactctcaagaaaccaaacaaaaccaaagcaaaagcctcaccttcaccaacaccaacaccaacaccatctttcacagttgttgatttgaaccctcaccattcctttgatatagaccaaacagccctcaccgatattgtcaaagaaaaagagcttgagaaccttgatagatttggtggggttgaaggggtggctaaagcccttcaaacccacgttgagtatggtatcaaaggtggtgatgatgatgctgaagacatcacacgtagaagacaagtgtttggttccaacacttaccacaaaccaccttccaaaggcttctttcactttgtggtggaagcctttaaggatgtcactattctaatcctcatggtttgtgctgctctttcccttggctttggaatcaaggagcatggaattaaagaaggttggtacgatggtggaagcatctttgtcgcggtgttcattgttatttccttgtcagcagtgagcaacttcagacagaatagacagtttgacaagctgtctcaagtgagcaatgacatacaaattgatgtggttagaagtgggaggcgccaaaatgtttcaatcttcgaaatcgtagttggcgatgttatttgcttgaagattggagatcaagtgccagcagatgggttgttcatagaaggacattcacttaaagtcgatgaagcaagcatgacaggagagagtgatcatgttgagattagtagacaaaaccacccttttctgttctcaggtaccaaagtggctgatggatatgctaagatgcttgttacttcagttggaatgaacacaacatggggccaaatgatgagttcaataagccaagatattgatgaggaaactcctttgcaagagagattaaacaagctgacatcatccattgggaaggttggtttggctgtggcttttcttgtccttgttgttttgttggttaggtacttcacaggtaacacaaaggatgagactgggatcaaagagttcaatggaagcaggaccaagtttgatgatatcatgaatgctgttgtggggattgttgctgatgcagttacaattgttgttgttgcaatccctgagggtcttcctctggctgtgactctaactctggcttattcaatgaagaaaatgatggctgaccaagcaatggtgagaaagctctctgcatgtgagacaatgggttctgctaccacaatttgtactgataagacaggaactctcacacttaacgagatgaaggtgactaaggtttggcttggcctagaaccggtgctagaaagtgcctacacaaaggttgctccatttgttcttcaattgatccaagaaggagtggctctaaacactactggaagtgtgcacaagtccaataaatcaggttctgaatttgagttttcaggtagtcccacagagaaagcaatcctatcttgggctgtcttggaattgaacatggagatggagaacttgacaagaagttgttccatcattcatgttgagaccttcaactcaaagaagaaaagaagtggagttttgttgagaaggaaggtagacaacacagttaatgcacattggaaaggagcagctgagatggtactaaagatgtgttcaagatactatgatgcttctggcattgtgaaagatcttgacaatgataggatgttgaagtttgagcacattattcaaggtatggcttctagtagtcttcgttgcattgcttttgcacatgtagaagtagctgaggaggagcttgtagatgaagaagggaatgcaatggcgaaagtgaaagaaaatggtttaacattgttggggcttgtgggtattaaggatccatgtcgtcaaggggtgaagaatgccgtggaagcatgccaaaatgctggtgtgaatatcaaaatgatcacaggtgacaatgttttcactgcaaaggccatagcaaccgaatgcggcatacttcggcctaatcaagacacagatggagcagtgattgaaggagaggaattccgcaactacacgcatgaagagaggttggagaaggtggaaaaaatctgtgtgatggcaagatcttctccttttgacaaacttctaatggttcaatgcctaaaacaaaaaggccatgtagttgctgtcactggggatggaacaaacgatgcaccggctctcaaagaagctgatattggactctctatgggaattcaaggtactgaagtggcgaaagagagctcagatattgttatattggatgacaattttgcatctgtggtcactgtcttaaggtggggaaggtgtgtttacaacaacatccagaagttcattcagtttcaattgacagtgaatgtggcagcacttgcaatcaactttgtggcagcagtgtcagctgggaaagtgccactaacagcagtgcaattattatgggtgaacttgatcatggacacattaggtgctttggctcttgcaacagaaaaacctacaatggaattgatgcacaaaccaccagtgggtagaacaaaacctctcatcaccaatgtcatgtggaggaacctattggctcaagctttgtaccaaatagcaattttgctgacccttcaatttaaaggtgagtctatctttggtgtgacatcaggagtaaatgacacattgattttcaacacatttgttctttgtcaagtgttcaatgaattcaatgcaaggaagatggagaagaggaatgtcttcaaaggcatacacaggagcaagttgtttttaggcattattggcataacaataatccttcaggtggtgatggttgagtttctcaagaaatttgctgacacagagaggctaaattggggacaatggggtatctgcattggtttagccgcagtttcctggccaattggttgggttgtgaagttaatacctgtcccagataaaccattcctcagttttttgagtaagaagaaatga

SEQ ID NO: 4045 - DNA, 2658 bp, Glycine max var. Williams 82
atggctactaccacattctgtacatacctattccttctctctgtgtacctttcaatcttcattaatcttagttcatcttcttcagaaggtaatattcttctctccttcaaggcctccattgaagattctaagagggccttgtctagctggtccaacacttcctcaaaccaccactgtaactggactggaatcacttgctccaccacaccttcactttcagtaacttctatcaaccttcaaagcttaaacctttctggagatatctcatcttcaatatgtgaccttccaaatctgtcttatcttaaccttgctgataacatcttcaaccaacccatccctcttcatctctctcagtgcagttccttggagactttgaatctcagtaccaacctcatatggggcactatcccgtctcagatttctcagtttggttcattgagagtgcttgatttgagcagaaaccacatagagggaaacattcctgaaagcataggctccttgaagaacctccaagttctcaacttgggaagcaacttgctttcaggtagtgtacctgctgtctttggaaatctaactaaacttgaagtccttgatttgtctcagaatccttacttggtgagtgagattcctgaggacattggtgagcttggaaatctaaagcaacttctgttgcaaagctcttcttttcaaggtggaattccagattctctggtgggcattgtcagcttgacccatttggatctctctgagaacaacctaacaggtggggttccaaaggctctaccgtcttctctcaagaacctggtttcattagatgtttcacaaaacaagcttttgggggaatttccaagtggcatatgcaagggacaaggccttattaacctcggtctccacacaaatgccttcactggttcaatacccacctccattggtgaatgtaagagtcttgagagattccaagtccagaacaatggtttctctggagatttcccccttggattgtggtcattacctaaaattaagctcatcagagctgaaaacaacagattctcagggcagatacctgagtcagtttcaggagctgttcagttggagcaagttcagcttgacaacaacagctttgctggtaaaattcctcaaggtcttggccttgtcaagagcttatacagattttctgcttctctcaaccgtttctatggtgaacttcctccaaacttttgtgactctcctgttatgagcatagtaaatctctcccacaattctctttctggtgaaatcccagagctcaaaaaatgcaggaaactagtttcattgtctttggctgacaacagtctaacaggagacataccctcttcccttgctgagctacctgtgcttacttaccttgatctttcacataacaatctcactggttcaatcccacaagggcttcaaaacttgaagcttgctcttttcaatgtgtccttcaatcagctatcaggtaaagtaccatactccttgatttcaggtctccctgcctcatttttggaaggaaaccctggtctttgtggccctggattgcctaactcttgctctgatgacatgccaaaacaccacattggtagcatcacaaccttagcatgtgccctcatctctttagcctttgttgctggaactgccattgttgttggtgggtttattttgaataggagatcttgcaagagtgatcaagtaggggtttggcgctcggtgttcttctatccactcagaattactgagcatgatctgcttacagggatgaatgagaagagttcaatgggaaatggtgggatttttggtaaagtttatgttttgaatttgcctagtggtgaactagtagctgtgaagaagttggttaattttggaaaccagtcctcaaaaagtttgaaggctgaggtcaagactttggcaaaaatcaggcataagaatgttgttaaaattcttgggttctgccactctgatgagtcagtgtttctcatttatgaatacttgcatggagggagcttagaggatttgatttctagtccgaattttcagttgcagtggggaattcgattaagaattgccattggagttgctcaaggactggcatatcttcacaaggattatgtccctcacttgcttcacagaaatgtcaagtcaagtaacattttgttggatgcaaactttgagccaaaactcacagattttgctcttgatcgagttgtgggagaagctgcttttcaatcagttttgaactctgaagcagcatcttcatgttacattgcaccagaaaatggctacactaagaaagcaactgaacaattggatgtctacagctttggtgtggtattgctagagctagtgagtggcaggcaagcagagcaaacagagtcaaatgactcacttgacattgtgaagtgggtcagaaggaaagtgaatatcactaatggggtgcaacaagttcttgaccctaaaatatcacacacttgtcaccaagaaatgattggagctttagacatagcgcttcattgcacttctgtggtgcctgagaaaaggccatccatggtagaagttctaagaggccttcactccttggagtcaagaacttgcattgcaaatttgcatgaaccaaatgaggaaccctccattccagtctga

SEQ ID NO: 4046 - DNA, 678 bp, Glycine max var. Williams 82
atgggattgttgtccaagtccaagactatgcctaagagagaaagccacttcctaaaactagtacaccctggtggctttgtagagctacatgctaacccaatcttggcttctgaagtcatgagcaagaatcctaggcactgtgttacacgacccgacttcttccaatatccttggattgtggttagaccagaatccattctcacacccggcaacgttttctacatcgtaccttgtcacaccatccgtcataagttgaagtccacaaatttcactgctaacacccttcttcctaatcaatcttctcttgattctcacagagaagctaaaacctctaactccaacaaaattcgatgcttccaaaaacaatcctcatgcgtgaaattacccagagaggggaacaaacacagcaaaggaggtaactgggatcaatcttatgtcagagacaggcctgtttattattctagcgactacacttcacgttactcgggaaaagtaaaggcacgaagccctagtgggagattcaaccactctgagcagatccctaagctgaagccgtgcctgaagaatgataagacccacagtgctagatcgcgacgtaatcttaaagtaagatttcagtgcagtgacgacaacgccaacagcgccaatttcacaacaaaattctaccgttactcctaa

SEQ ID NO: 4047 - DNA, 354 bp, Glycine max var. Williams 82; identical to SEQ ID NO: 3390

SEQ ID NO: 4048 - DNA, 924 bp, Glycine max var. Williams 82
atgagaagcatagcatcttgttacaacgaacatgcaattagagtgtccgattcatattgttcaagaccttcgaaccaggcgtatctctgtccagaactcaacccttccaccagagattccgttacctgcatgtacaaactctccctcatcaaaacgcaaaaacaactcttcatcacaataacttgggccaagaaactcttgggccaaggcttcaccataaccatctccaattctgaacattctctttctccctctaataataaatccaacgcaaggcaattgagaaagaacaaaggcaacgaaacattccaatcccaaaattttcaagtccaagtcttgtgggatctctccgatgcaaagtacgaggaaggaccagaaccggttggtggcttttacgtcgacgttttggtggactccgaactgggcctacgcctcggcgacaaaaattcctcaatggaagaattgttaccaaactttgacgcaaaggaagcgactttctcgatggtttcacggagcgagacgttttccggcacagcggtttacgcgacgaaggcgaaattctcgcagacgggaagttctcacgatatattgattaggtgcggcgcggaggcggagcgaggagagccgaagggtcacgtgttgtccgtgtgcgtggacaagaagacaatgttccaggttaagaggctgaggtggaactttcgtgggaaccaaacaatttttgtcgatggtttggtcgttgatatgatgtgggacgtgcacgattggctttttaattcgaattctgcttcatctgcagtgttcatgttcaggacaaggagtggcctcgatagtaggctatggttggagaagagtttgcacgcgcacaaggaacaggacaaaattgggttctctttgttgatttgtgcctgtaagaacaatgactga

SEQ ID NO: 4049 - DNA, 1596 bp, Glycine max var. Williams 82
atgctctttgcatctttactcatcatggccgcagcaggagcagcctacatgttcggcatgtactctaacgaggtcaaaacctctttagggtacgaccaaaccactcttaacttgttcagcttcttcaaagacgttggtgccaccgttggaatcatatcagggttagtcaacgagataactccaccttgggtagttctgtcaattggggtcatcatgaacttctttggctacttcatgatatttcttgctgtcactggccgcattgccaaaccccaagtttggcaaatgtgtctctacatttgcattggctcaaattctcaaacttttgctaacacaggtggtactgtcacgtgtgtgaaaaacttccctggaagccgtggcaatgttttaggcctactcaaaggttacgttggtctaagtggtgccatcattgcacagctctaccatgccttctacggtgatcataaccctcaggctcttattttactcattgcgtggcttcctgctgctgtttcctttcttttccttccaacaattcggatattcaacacagttcaccacccaaatgagaacaaagttttctaccaccttctatatatatcactagtccttgccgggtttctcatggttcttatcatcatgcaaaacaagctcaggtttacaaggcctgaatacatagccgatggggttgtggttttcttctttctccttctcccacttgttgtggtgtttagagaagaaataaaccaattgaaagccaaaacgcaaggtttgaccgattcagtaaaagtagtcactgaagttattccacctccaaatgtggtggaaggagaagactacaccatcttgcaagcacttttcagcattgacatgctgattctgttcatagcaacaacatttggtgctggcggagcattaacagccatagacaatttaggacagattggacgctcattagggtacccaagaaaaagcattacaacatgcgtgtccttattgagcatatggaactacttgggaagagtagttgcaggttacgcctctgaaatattcttaaccaaatacaaactccctcgtccctacatgctcactctagttttgcttctctcttgtgttggccacattctgatagccattggtgccccaaactctctctacttggcttcagtgattatagggttctgtttgggagctcagtggccactaatgtttgcaatcatatcagaaatatttggcctcaaatactactccacgttgttcaactttggagccgtagcaagccctgttgggtcttacattctgaacgtgaaagtggctggtgttttgtatgataaagaggctttgaaacagttgaaggccaaaggactcacgagagaagaagggaaggacctaacttgcgtgggagtgcaatgctataaaatggcttttatcataatcacggcttcaacgctgtttgcatgcattgtttcgtttgttttggtggtgaggactagaaaattttacaaaggggatatctatagaaagttcagagtggaacatgaaacaggagagaatgaaatggggatcactaaaactcgtaatagtccttctggttga

SEQ ID NO: 4050 - DNA, 828 bp, Glycine max var. Williams 82
atgaccctccccaccaatctcaacttcttctatgtgttcctcccaatgctcattctctattcctcttccttccttgcatcagcttctgattctaaagctgaagatgaaaaatttacctacgctataggaagtagcacaggaccagagaattggtggcatgtcaaccaaaaatggaaaacatgtggggatggaaaactacaatctcccattgatctgcttgaccaaagggttcaagagcttcctcaattgggtaaacttaagaaagcttacaaatcagctcctgctgtcctaaagaatagtggtcatgacatcgtgctggaatggaaaggagatgcaggccatcttaacataaatgaaacttactacaatctgattcaatgtcattggcatacaccttcagagcacacgttgaatggaacaaagtttgacttggaactgcatgcagtccataaatcctctaagggagagtttgctgttattggaatattgtataaaattggttctccagatccctttttttcaaagctgctcaatgacataaaatcaagtgtggacaaggatatagatgtaggagtaatcaacccaagagagatcaagtttaaaagcagaccgtactacagatatgttggttctcttacaactccaccatgcactgaaggtgttgtttggacaattgtgaagaaggtcaggacagtctcaagcgagcaattaagtgccttgaaaggagctgttcatcatggatatgaggaaaatgcaaggccaacgcaggaacttggtggaagacaagtttggttatatggacctatggagaatgaaaagcctacttaa

SEQ ID NO: 4051 - DNA, 1911 bp, Glycine max var. Williams 82
atggcggttcatccgtcggtcgccgccgctccggcgtcgctctatgtcggcgacctccaccccgacgtctccgacagccacctcgtcgacgcattctccgagttcaagagcctcgcgtctgttcgcgtctgcaaagactcctccacggggaaatccctctgttacggttacctcaacttcgtttcccctcaagacgcaattcgtgcaatcgagctgaaaaataactccacgcttaatgggaaagcgatgagggtgatgtggtcgcgtcgtgatcctgatgcgaggaaaagcgctatagggaacttgtttgttaagaacttacccgaatcgatagataatgctggactgcaagatatcttcaaaaaatacgggaatattttgtccagcaaagttgtcacgtctgaggatgggaagagcaaaggatacggctttgttcaatttgaatcagaagaatcttcgaaagttgctatcgagaagctgaatggctatactgttgctgataaggagttatatgttgggaagtttgtcaaaaaaagtgatcgcattttgcctggccctgatgctagatatacaaatttgtacatgaagaatttggacctggatgtttcagaagcaacactgcaggagaagttttcctctttcgggaaaattgttagcttggttattgcaaaggacaacaatggaatgtccaagggctttggctttgtgaactatgataacccagatgatgctaaaaaggcaatggaagcaatgaatggatcacaattaggttctaagattctgtatgtagccagagcacaaaagaaggctgaacgtgagcagatcttgcaccaccaatttgaggagaagcagaaggaacaaatcttgaaatacaagggatcgaacatttatgtgaagaacattgatgaccatgtaagtgatgaagaactgagggatcattttagtgcatgtggcactataacttctgcaaaaattatgcgagatgacaaagggataagtaaagggtttggctttgtctgcttctccactcctgaggaggccaataaagctgtgaacacatttcatggattcatgtatcatggaaaaccactatatgttgctcttgctcagaggaaagaggataggaaagcacaattgcagctccagtacgcacaacaactggcacgactatctggaccttcgactgccattatccctagtggatatcctccttactactatgcagctagtggcgttatttcacacgtgcctcctcgagctgggctgatgtatcaacatctggcattgagaccgggatggggggctaatggctttgcaccccctgctagatcatttcaacaatcaccagttcctgcagtttctaacaatactaggcagcataggcaaaacaggggcaagttgaatgggaattcaatagcacagggaaatactcactctggtacttatttaccacaagcccagcagatttctcagccagtgatctcttcaagagattcaagtactcagcagagaaccggacaggctaggtacatacctagtggacgccagcgtgatgtggaaaaaggatctggatcctcatctgttggttcaaactctggcagaggaggatcccaggggtcagaaatgctgcatagcttgcttgctggtgctgctcctgagcagcagaaagagattctcggggagcatctttacatgcttgttcataaactaaagcctaccctagcagcaaaaataacagggatgcttctggagatggacaatggagaattactgcttctcctggaatcgccagagtctctttctgccaaggtggaagaagctgtccaagtgcttaagaactctaagaccaaagtttctggccaggacgtacttcattcaaatttcctttcagctgaggttgcagttaactga

SEQ ID NO: 4052 - DNA, 786 bp, Glycine max var. Williams 82
atggcaaagctatttttgaaacaggcaaagcaatacgcagatgcaagaccaagctatcctccacaactcttccaattcattgcttccaagactccctctcacaacctcgcttgggacgtcggcactgggagcggccaagctgccaaatctttagctgcaatatacaagaatgtgatagccacagatgctagtgacaaacaacttgaatttgcagccaagctcccaaatgtgagataccaacacaccccttcaaccatgtcgacggccgagcttgaacaaatggtggcatctaagggaaccatagaccttgtgaccatagcacaagccctgcattggtttgaccgcccaaccttctacgaacaagtgaagtgggttctcaagaaacctcatggaatcattgctgcttggtgttactatttgccaagagttagtgatgcatttgacactgtctttgaccaattctattccactaatgtaagcccttattgggacccagctcgtaaatgggttgatgacaattatagaagcattgattttccatttgagcccgtggatggagctgatcacacaggaccctttgagtttgtgacggaaacaatgatggatttggatgatttcttgacctacataagatcatggtcagcatatcagacggctaaggagaaaggagtggagcttctcgcggaggatgtggttgaaaaattcaagcttgcttggggtgaagatgctaaaaaagttgtcaagtttccaatttatttgagaattggaagaacaggggattcctaa

SEQ ID NO: 4053 - DNA, 1419 bp, Glycine max var. Williams 82
atggagaaaacaaggtacatagcagttattcctggtgtaggattcagccatttagcccccattcttcagttctcaaagcaacttgttgagctgcatccacattttcatgtcacatgcatcgttccctcacttggttctctcccaagtgcctcaaaagccatcctagaaactcttccaccaaattacatcaacaccattttgcttccaccggtgaaccctaatgaccaattatcacaagaagacattcccgtactagtcaaaattcatctcacaatgagtcactccatgccatctatacacaaagccttgaagtccttaacttctaaggctacccttgtggccatggtagttgattctttcgcctttgaagcactagactttgctcaagagttcaacatgttgtcctatgtttattttccagcagcagctacaacactgtcaacactcttgcatttgcccaagttggacgaggaaatatcctgtgagtatagagatttctcagatcctatcaaagtaccaggttgtgtaccatttcgtggtggagatttctatggtccagctcaagatagaactagtccagtttacaaattcttgcttcaacgtgttaaccgaatccgtcatgttgatgggatcttcattaatagcttcttggaaatggaaacaagtcctataagagcattgaaagatgaggataaagggtaccctcctgtgtaccctgttggaccaattgtccaaagtggtgatgatgatgcaaaagggttggacttggagtgtttaacatggttggacaaacaacaagttggttcagttttgtatgtttcttttgggagtggtggaacactttcgcaagagcaaataactgagcttgcttttggtttggaattgagtaatcacaagttcttatgggttttgagagcaccgaataatgcaacatctgatgctgcttatcttggtgcacaaaatgatgttgaccctttgaaattcttgcctagtgggtttttggagagaaccaaagagaaaggtatggttgttccttcatgggcaccccaaattcaagtccttagtcacagttcggttggtggattcttgacccactgtggttggaattcaatccttgagagtgtgctaaagggtgtgccgttcatcacatggccactatttgcggagcagaaaatgaatgcggttttgctaagtgagggtctcaaagtgggagtgaggccaagagttagtgaaaatggcttggtggaaagggtggaaattgttgacgtgataaagtgtctaatggaaggggaagaaggtgcgaaaatgcgtgaaagaatgaatgaattaaaagaagatgctactaatgcactcaaagaagatggatcttctacaaaggccctttctcagttgccattatattggaaaattttggcatga

SEQ ID NO: 4054 - DNA, 861 bp, Glycine max var. Williams 82
atgaagctatcagccaaacccatttcgagtccgggtcgcacagacaagttccctcccccactcatgaggtttctcagaagcaatgctgccagcagaagcaccagaaggtccaaatcaagcccaatgttcgtaaggaaaaaaaacaccaccgccatcgaaacccaaacccaggaaccctcttcccccaaggtcacgtgcatgggccaggtccgagtcaaacaagccgccaccacctcacgtgacttagctcccccgcgctgccgctgccgctgctactgctgttggatccgaagccccaacaaccacccctgccgctgcaaacccctctggcccaactggcccagcttcttccgtcgaaagcccaccacgctcaaacatcactccgagcccgagcgcaattttcacgaccaagaatcagaattaccgttccatgagagagtgaatgtcgataaggatagtgattttgcttccaattcaagcacgcccccgagaaacgctttgcttttaactcgctgtagatccgcgccgtacagatcttcctctttggctagtaggttctggagttctcccgttaaggaccaagaaacggagtttccaattccgaacacgacggaacaacaacacacttccgaggaaccccaaacggaacccgaattaggttttctcagagaaaaaattgcttcactcaccgaaccggaaaaggttgaggaagttgaaacagaaacagagtctgcatcatcacgtcctactgtactcactaggtgcaaatcggaaccggcgagaaccggacacagacttcttgaccctctggtaaataatactagtaatttgttgaataaaagaaggttggaatttgattaa

SEQ ID NO: 4055 - DNA, 534 bp, Glycine max var. Williams 82; identical to SEQ ID NO: 897

SEQ ID NO: 4056 - DNA, 1749 bp, Glycine max var. Williams 82
atgatgaggaaatcacgtgatgctgaccatgatgcaaaagaagaacaaaggcccctcaaccaatggagaagaagcaaagggggattcatggcttccatgttcatttttgtcttgtcagcattggacaacatgggctttgtggcaaacatggtaagcatagtcctatacttttatggagtgatgcactttgatctagccagttcagccaacacactcacaaacttcatgggctcaacctacttgctttcccttgttggtggcttcatctcagatacttacttgaacagattcaccacatgcttgcttttcggatcactcgaggttctggctttggcaatgctcacagtccaagctgcttcaaaacatttacaccctgaagcatgtggcaagtcaagctgtgtgaaaggtggcatagcagtgatgttctacacatcactgtgcttgttggcattgggaatgggaggggtgagaggatccatgactgcatttggagctgaccaatttgatgagaaggatccaactgaggcaaaagcccttgcaagttttttcaattggcttttgctcagttcaactgtgggagcaatcacaggagtcactggtgttgtgtgggttagcacacaaaaggcatggcattggggttttttcatcataaccatagcttcctccgttggctttgtgacccttgctcttggtaaacaattctaccgcatcaaaactccaggagatagccccactttgagaattgctcaggttattgttgtgtcttttaagaaccgaaagttgtcattgccggagtcacatggagaactatatgaaatcagtgataaagatgctacagctgagaagattgctcacaccaaccagatgaggttcctagacaaagctgccatcatacaagaaagctcaaaaccccaggcatggaaaatttgcactgtgacacaagttgaagaagtgaagatcctaacaagaatgttacccatagtagctagcaccatcatactgaacacatgtatggcacaactccaaacattctcagttcaacaagggaatgtgatggacctaaaacttggctctctaacagtgccagcaccatccattcctgttatcccacttgtttttataagtgtcctagttcccttgtatgaactattttttgtgccatttgcaagaaaaatcactaaccacccttcaggcataacacaactacaaagggtgggtgtagggttagtactctcggcaatatcaatggcagtggcagggattgtggaagtgaaaagaagggaccaagggagaaaagacccttctaagcctataagcctattttggctttcattccaatatggcatatttggaattgcagatatgttcacccttgtgggactattggagtttttctatagggaatcacctgctagcatgaaatcactttcaacctctctcacgtggttgtcaacatctcttggttacttcttgagcacagtctttgtcaatgttatcaatgctgttaccaaaaggatcacacgaagcaaacaagggtggttgcatgggttcgacttgaaccaaaataaccttaacttgttctattggttcctagccacccttagttgccttaacttctttaactacctttattgggcctcaaggtaccaatacaaacgtgaagactcaggcccaggttttaagcctttaggtgaaatgcctctcaaaagggttgagagaaaacaagattgtgaagttagccgagagtga

SEQ ID NO: 4057 - DNA, 3171 bp, Glycine max var. Williams 82; identical to SEQ ID NO: 888

SEQ ID NO: 4058 - DNA, 147 bp, Glycine max var. Williams 82
atgagggactcaaatggtcgggtgttgttttcttatgctgctaacataggatctggttcagttgttatagctgaactttgggcaattttgcttcgaaataaaatttcttggagattggagccgagggtacaagcatttttgtgttga

SEQ ID NO: 4059 - DNA, 573 bp, Glycine max var. Williams 82; identical to SEQ ID NO: 875

SEQ ID NO: 4060 - DNA, 1218 bp, Glycine max var. Williams 82; identical to SEQ ID NO: 842

SEQ ID NO: 4061 - DNA, 1407 bp, Glycine max var. Williams 82
atggagaaaacggttcacatagcagtagttcctggtcctggcttcagccacttagtcccaattcttcaattctcaaagagacttgttcatctccatcaaaactttcatgtcacatgcataattccctcagtagggtctccctcatgtgcctcaaaatccatccttgaaactcttccaccaaatataacctctatttttcttcaaccagtgaaacctgaaaacctaccacaagaggttgctatagaagcccaaattcagttcacagtgaccttctctctgccatctatacatcaaaccctcaagaccttaacttcaaggactcactttgtggccttggtggctgattcttttgcctttgaggcattagattttgctaaagaactcaacatgttgtcatatatttacttccctacatcagcaacaacactctcttggtacttgtatgtgcccaaattggacaaggaaacatcatgtgagtatagagattttcctgagccaattcaaataccaggttgtgtaccaattcacggcagggatctcaataaccaagctcaagatcgatcgagtcaagcttacaaactcttcgtccaacgcgctcagcgactccctttggttgatgggattttcatgaataccttcttggaaatggaaacaagtcctataagaacattgaaagaggagggaagagggtcccctcttgtgtatgatgttggaccaattgtccaaggtggtgatgatgatgctaaagggttggacttggagtgtttaacgtggttggacaaacaacaagtcggttctgttttgtttgtttcttttgggagtggtggaacactctcacaagagcaaataactgagcttgcttgtggtttggacttgagtaatcataagttcttatgggttgtgagagcaccaagtagtttagccagtgatgcatatctcagtgcacaaaatgattttgatccttcgaaattcctgccatgtgggtttttggagagaaccaaagagaaaggtatggttgttccttcatgggcaccccaaattcaagtccttagccacagttcagttggtggattcttgactcactgtggttggaattcaatcctcgagagtgtgctaaagggtgttccattcatcacatggccactgtttgctgagcagagaatgaatacggttttgctatgtgagggtctcaaagttggagtgaggccaagagttggtgaaaatggtttggtggaaagggttgaaattgtgaaggtgataaagtgtctaatggaagaggaagaaggtgagaaaatgcgtgaaagaatgaatgagttaaaagaagctgctattaatgctatcaaagaagatgggtcttctacaaggaccctttctcagttagcactgaagtggaagagtttggcataa

SEQ ID NO: 4062 - DNA, 390 bp, Glycine max var. Williams 82
atgaggcagagagacgtagaagtgttggaatttagaaccccacaacacccatctttgggaacaaataattggggtggttcatctcctttgctagcaaggaacgtacccaaggaatcacttgaacaaaagtattcaagactcaactcagttcggaccaaagatgagatctttccagctgattatgagtactatgttgtgaacccttcgaatgagaccggtgcaagtgcaagtagtgccaagagatggaacaaagttagaggagttctgttgaagctaatatttgtgaggaaagagaacaaaacaacagttacattaggttcacgtttaaggaagagaagatggataccgagaatggatcctacaactaggtggccacaaggttggtgttga

SEQ ID NO: 4063 - DNA, 2673 bp, Glycine max var. Williams 82
aatgatgttgagctacttcaagaaatcatcaatcttgtgctgatgacgttaagaaagcatacagtagattcaaaagggctggttggcattgacaaacaagttgcacatttagaatctttgttaaaacaagagtcaaaagatgtctgtgttatcggaatttggggtgtgggcggtattggtaagacaaccattgcacaggaagtgtttagcaaattatatctggaatatgaaagttgttgtttttttgcaaatgtaaaggaagaaataagaagacttggagtaatttctttaaaagaaaaactatttgcttcaatattacaaaaatatgtgaatattaaaacacaaaaaggattgtccagttctattaagaaaatgattggccaaaagaaggtgcttattgttcttgatgatgtgaatgattcagagcagctggaagaattatttggaactccagactggtatgggtcaggtagtagaattattataacaactagagatataaaagttcttatagccaacaaagttcctgaaatataccatgttggtggattgagttcctgtgaagcatttcagctttttaagttgaatgcctttaaccaaggtgatcttgaaatggagttttacgagctatcaaagagggtggttgattatgccaagggcattccattagttcttaaaatattggctcatcttctttgtggaaaagataaggaggtatggaaaagtcaactagaaaagcttaaaggaatcaagagtaacaatgttcatgattttgtgaaacttagttttgacgatctacaccatgaagaacaagagattcttttagatcttgcatgtttctgccgtagagcaaatatgacagagaattttaatatgaaagtggattctataaacatattattgggagattgtggaagtcataatgcagtggttgttgggttagaaaggctgaaagaaaaatctcttataactatttctgaagataatgttgtatctatgcatgatactgtacaagaaatggcatgggagattgtttgccaagaatctaatgaccttggaaatcgcagtcgattatgggatcctattgagatctatgatgttttgaaaaatgacaaggggactaaggcaattagaagcataacaacacctttgtcaacattgaagaatctgaagttacgtcctgatgcatttgttaggatgagcaatctacaatttttggattttggtaataattctccttctcttccacaagggcttcaatctttgccaaatgagttaagatatcttcattggatgcattaccctttgacatgcttgccagagcaattttctgctgagaagcttgttatattagacttgtcatgtagcagagtggaaaaattatggcatgaagtgaaaaatctggtgaatttaaagaatgttaaactccgttggtgtgtattgctgaatgagcttccagacttctcaaaatccacaaatctcaaggtactggatgttagttgttccagtgggttgactagtgtgcatccatctattttctctctacacaagcttgagaaattggaccttagtggatgcagttccctcatcaaattttcaagtgatgatggtcatttaagctccctactttatctcaacctcagtgactgtgaagaactaagggaattctcagtgacagccgagaatgtggttgaactagatttaaccggcattctcatcagttcattgcccttgtcttttggaagtctacgaaagttagaaatgctacatctaatacgtagtgacattgaaagcttgccaacatgcatcaataatcttacaagactgcgatatcttgacttgagttgttgcagcaatctctgcattctaccgaagcttcccccatcccttgaaactctacatgctgatgagtgtgaatcactggagactgtattgttcccttccacggcagttgaacaatttgaggaaaacaggaaacgagttgagttttggaattacttaaagttggatgaattttctctgatggctattgagttaaatgcgcaaatcaatgtaatgaaatttgcataccaacatttatcagcaccaatacttgatcatgtggaaaattacaatgattacaaggatctccatgattcttatcaagcagtgtacatgtatccaggaagcaatgttccagagtggttggcatataagactagaaaggattatgtaattattgatctctcttctgctccacctgctcatttgggtttcattttctgcttcattctggacaaggacacggaggagtttttggatcctgcattgcaatttagcatctctatcagtaatggtgagaatgaatgtaaaagggacagtgttgaaatacaaacttctgggccatattctatgatttattcggaccatgtttgtgtgttgtatgacaaacgatgttcttgctacctgaacaacagacttaaaagtctggcaaagtttaaaatcaaagtatcatggcttacagatggtgaacggtgggaggtgttaaaagggtttggggtcagcccaataaacacctcagtatatcacaattttgttcaacaaatggaactgtgcgaccaaggttttaggccggtgttgaagcgaactccaaagaaaaggaaaagggtgatcagagaacatgataacctctag

SEQ ID NO: 4064 - DNA, 1848 bp, Glycine max var. Williams 82
atgagtgcaaagactgcaaaggacgagttgcagaaatcaatagcagatatggagatagagaagagcgaggtggcggtgaaagaagagacacggaaacgccagcatcgtcgtggaggaatccgaacattgcctttcatccttgcaaatgaattctgtgatagatttgcagtagctggttttaatggcaacttgataagttaccttacccaagtgctgaacatgccattggtatctgcctccaacattctcacaatctttgttggaacgggtagcttcacccctcttcttggtgctctcattgctgagtcctttgctggccgcttttggaccattactattgcttctcttatctatcaactgggattgataagtttaacagtatcagctatactaccccattttcgccccccaccatgtccaacacaagagaattgccaagaagccacatcctcacagctgagcatgctctacatctctctcctcctcacatctcttggatccggtggcattaggccttgtgttgtgccctttctgggggaccaatttgacatgacaaaaaatggtgtggcatctaggaaatggaacctcttcaattggtactttttcagccttggattggcttctcttagtgccttgaccattgtggtttacattcaagacaacactggctggggttggggctttggcataccaactattgtcatgcttgtatccatcatagcctttgtgttgggctcaccactttataagactgagaaaccagaagggagccctttggttcgtttggcccaagtgattgtggcagctataaagaagaggaatgagactttaccaagtgatcccaagtttttgtaccaagatagggacctcgatgctgctatttgtttggaaggaaggctcttacacacggatcaatttaaatggttagacaaggcagcaattgtcacaggggaggatgccagagacccaaatgcaccaccaaacttgtggaaattggccacagtgcacagagttgaggagctaaaatccatcatcagaatccttccaatttcctcatcaggaattttactcatagctgcatcatcacaccttcccagctttgtgattcaacaagctcgaacgatggaccgacacctctctcactcattccaaatttccccagccagcatgtccattttcagtgtactaaccatgatgacaggagtcattgtatacgaacgccttttcgttccgttcattcgcagattcaccaagaacccttcagcaatcacctgcatacaaagaatggcaataggctttgtgatcaacactatagccacattggtttcagcaccagttgaaatcaagagaaaagctgttgctgaaaagtaccacttattggatagtccaagtgcaactattccaataagtgtgttctggttggtacctcagtattgtcttcatggtttggctgatgtttttatgtctgttggactctttgagtttctctatgatcaatcacctgaaagcatgagaagcagtgctactgctttgtattgtatagtgatagcacttgggagctatgctggtacatttgttgtgacacttgtgcataagtatagtggcagtaaggagaggaattggttgcctgataggaacctcaataggggtagattggagtactattacttgcttgtaagtgggattcaagtgttgaatctggtttattttggaatttgtatttggtgttacacttacaagcccttggaagagattgctgaagtgagcatggaaaaggatttggagttggaacaggccaattcaaaggtctcatgtgtcaattcgaaagatggtggagatgctgaataa

SEQ ID NO: 4065 - DNA, 228 bp, Glycine max var. Williams 82; identical to SEQ ID NO: 908

SEQ ID NO: 4066 - DNA, 558 bp, Glycine max var. Williams 82; identical to SEQ ID NO: 787

SEQ ID NO: 4067 - DNA, 1623 bp, Glycine max var. Williams 82
atggaatttctgggagagattgatcctcttcctactgaggatggaaaaggagccaaattgttcaatgatcaagatcagaaacagctacaagaacccaaaattgataacttcatgttagaagaggttaactttaaccctgatatgcaaatgcaaccaacacaactatttcaggaaaccacaggactaatgaaacatgttagggtaaattcagaactagttgaatacaataagcaggtgccaccaacaccatcattagcatccttagagctcctgagaaattacggaagcaggttcaagaggctaagcgagcaaaacataagcaccttaagcaatattgaaacttcctttgatcgccagaagatgtcaactgaagaaataataagagtggctggagcaaggtatctccaatattctgcacattggaatgatagtttttacatccctatgcatccatacgggttagatctagttggtttctctgaggaggaaaacagagacatagaacttgctcaatttctccttgctgcagccgagagggtaggttgccaacaatttgaacgtgcaaacgggttacttctccattgtgaatggagttcatctggcagtgcaagccctgttcaaagagttatctttcatttcgctcgagcacttcgagagagaatatacaaagaaacaggaaggatgacagttaagggatcagggaaaaatgaagaaagggagttaattcagaagatggacactaacatttccattaaatgccatctaaaaattcctttcaatcaagtaatgcaattcgctggggtacaagctatagtggaacatgtagcatctgagaccaaaatccatcttatagatcttgaaataagaagtggtgtgcaatgcacagctttgatgcaagcactgtctgaacgccgggattgcatagtgcaacttttgaagataactgccattggacttaactcattgaaaatcaagatagaagagactggcaaaagtttaactagttttgctgaatccttgaacttacccttttcatataatgcagtttttgtggccgacattgccgaaataaggaaagatcatttcgaaattggagaggatgaagctgtggctgtttactctccatattttctaaggagcatggtatcaaggcctgattgcatggagaacttgatgaggattataagaaatatcaaaccagttataatgatagtccttgaagtagaagcaaaccataactcaccctccttggtgaaccgtttcattgaagcattgttcttctactcagcatattttgattgccttgaaacatgcataaaacatgagattgagtgcaaaatgacaatagaagcagtattatctgaagggataagagacattgttgcaatggaaggaagggaaaggactgtcagaaatgtgaagatagatgtttggagaaggttctttgcaaggtatagaatggtggaaaccgggtttagtgagtcatctctgtaccatgctcacttggttgccaaagggtttgcttttgggaaattctgcactatagaaaaaaatggcaagggtcttgtagttggatggaaggggaccccaatgcattcaatctcagcttggaggtttctttga

SEQ ID NO: 4068 - DNA, 486 bp, Glycine max var. Williams 82; identical to SEQ ID NO: 886

SEQ ID NO: 4069 - DNA, 1335 bp, Glycine max var. Williams 82; identical to SEQ ID NO: 822

SEQ ID NO: 4070 - DNA, 975 bp, Glycine max var. Williams 82
atgtctctcttgaatttgccatatcccatattggattgcattctaaagcttctttcaccaatggatctcactaggatgtctgaagtgtgtacttttttaagggatagatgtcgaagtgatcctttgtgggaactccacatgaagcaaaaatggggtggagtcattggtgatgttgcttacaaggagtggctatggcacatcacaacaccaaaggagaaaggaattaaccaattgaatcaacacaacaatcaaaatggatcaatgggacctttcagtggtacttggcctatgttatacctcaggtcatatcttgaagattgtagttatcttaattcctcatcattggcaaatagcttcatgatggctttgtatttctctctagagaatggcaatttctggtttccagctcaaatctacaggggattgtattttcgtgacgccttagttagatatgattccaaaactgataactttcaagcaagacaacaaaatgcaggctggaaaataatggggaacaacatccaatgggataagctgagagctcccccagttgatacccttccatctgttagatacgtctctgattgcttacaagacttaaaaccaggagatcatattgagctccaatggaagtcaagtagagatattccttatgattggtggtatgctgttattggtcacatggaatcatgtaatgaaaacgaaaacttctgccgctgtcgttactctgagacactgatcgtggagttcgagcaataccctcttggatctagaatgagacgagtaaagctgctaaaaaatggggatcaatgtgaagaatcaactggatgctatggaggaattagaaagctttatagtgaggaggagattcaaagatgggagaatatcttgtcacggggcatggccggaacaagaaacacgtcttatatatgtcggagtggagccatgccacgaccaccaagggggggagtctga

SEQ ID NO: 4071 - DNA, 624 bp, Glycine max var. Williams 82
atggcagattataagcaacaccacggaagaagctgcggctgctgctgcctctttggaatcttgtggaagattgtggttgcactcattgtcctcgttggtcttgtattcctcatattttggctggttgttcaaccccgctacttcaagttccacgtcacggaagcggacctaactcaatttgagtactatccaaacaacaacacccttcactacaacatggtcctcaatttcactgcacgcaaccccaacaagaagctcagcatatactacgacaaagttgaggcattagcattctacgaggatgccaggttcgccaattacgatgtcataactcacatgaactccttccgccagtacaagaagagcaccagtcccatgagcgccgttttctcggggcagaaggtgttgatgctcaacaacgaacaagtctctcagttcaaccaagacaagagtgttggagcttatgatatctatgtgaagctcaacttcaggattcggttcaggctcggggactcgatttcccgtcacttgaagcccaaggtcaaatgtgatctcaaggttcccttgaacaaaagtggcacctttactctgtttcagaccaccaagtgccatgtcaatgtctag

SEQ ID NO: 4072 - DNA, 774 bp, Glycine max var. Williams 82; identical to SEQ ID NO: 874

SEQ ID NO: 4073 - DNA, 852 bp, Glycine max var. Williams 82
atgtctctcttgaatttgccagaacccatattggattgcattctaaagctcctttcaccaatggaactcgttagcatgtctgaagtgtgtacttgtttgagggatagatgtcgaagtgatcctttgtgggaagtccacataaagaagaaatggggtggagtcattggtgatgttgcttacaaggagtggcattggcatatcacaacaactaaggagaaaggaattaaccaactgcatcaacagcacaatattcagaatggatcattagggcctttcagtggtacttggcctatgttatatctcaggtcttatttagaagattgtagccatcttaatacctcattggcaaatagttttatgatggctttgtatttctctctagagaatggcaagttctggtttccagctcaaatctacaggggactactggttcgagatgccttagtaagatatgattccaaaacagataagtttcaagcaagacaacaaaatggaggttggcaagtaatgggaaataacatccaatgggatatcctgagagctccaccagtagatacccctccatggaatctacacgtgtctgattgcttacaagacttaaaaccagaggatcatattgagatccaacgtaagccaagaagagaaagtacaccatatgagacattaatcgtggagtttaagcaatattctcatggatcaagcatgagacgagtaaagttacccagaaatggagaacaatttgaagaaccaacacgatgctatggaggaattagaaagcttcacagtgacgaggagatacaaagatgggagaagctcttgccaccacatcaaactcctgtatatatagcttga

SEQ ID NO: 4074 - DNA, 1347 bp, Glycine max var. Williams 82
atggggcatttgggtcagaatattttgaattatgaacttgaaaatggagtcaatatgtgttgtgatgaagactgttctaagaatgagatcaatacaactcttattcagtatgctgtgaaagacctattgacgggtcttggggaagacatcaacagggaaggcattataaagacacctcttcgtgttgccaaggcactttgtgatggaaccagaggttatagtcaaagtgcgaaggaaattgtggaaggtgcactattccctgaagctggcgtagacaacacaaaagttggtcatgcaggtggagtaggtgggcttgtgattgtgagagaccttgaattttattcctattgtgagtcttgcatgctaccattttattttaagtgtcatgtgggttatgtcccttctggccaaagagttttgggtttaagcaagctctctcgtgtgaccaatgtgtttgcaaaacgactccaagagcctcagcgtcttgcagatgaggtgtgttttgctttgcatcaaggaatagaaccagcaggtgttgctgtcgttcttcaatgcacacacatcaacattccagacacagtttttgacacaaatcacaaagggttggtggagacactagtttcttcagggtctggtgtttttgaaaacaaagatgcagacatgtggggtgatgtttttggtcttcttaagtttagaggaattgataaggataaagtacatgttaagggatcattagaccaatattggtgcccttctttgtcatccaagattggagaaatcaaccctattatggtcactgcagtatcttcaattctcaagtctttaggtgaggatccaacaagaaaggagttagtagggactccaagtagatatgtgaaatggctgatgaacttccaatattgcagtgacattgatgggaagctgaagctgaatggttccccttggagtggggaggtaaactttgatgagaaagaggtacactcagagctaaacttgcccttttggtcacaatgtgagcatcatctacttccatttcatggtgttgttcacataggatatttcatttccaaagggtgtcaccccattgaaaaatctcttttacagtcaatagtgcttttttatggttttaagcttcaagttcaggagaggctcaccaagcagatagcagaaactatttctccactgataggtggaaatgtgatagtagtagtggaagcaagtcacacatgtatggtttctagggggattgagaagtttggaagcaacacagctaccattgctgtattgggacgcttttcaattgaccttgctgcaaaaaccgcgtttttggagagtattccaaaatga

SEQ ID NO: 4075 - DNA, 417 bp, Glycine max var. Williams 82
atggcgagaaaactaagcattgttgtactttgcattgttcaaatgctgcttcttcttgtggaaaacgatgctgagattgttgtgtccaccgtggaggctccagctccgcagcctcacaagaacaccacccacaccctgtccagcgctccagctccgctgcctcacacaaacaccaccaagtcccatgttcccaatttgcagcatggcatcaccgaaggcagtcttaaaccacaagaatgtgggccacgttgcaccgctagatgctcaaacacacaatacaagaaaccgtgcctattcttctgccaaaagtgctgtgccaagtgcttgtgtgtgcctcctggaacttttggcaacaagcaagtttgcccttgctacaacaactggaagacaaaaagaggaggaccaaaatgcccctga

SEQ ID NO: 4076 - DNA, 441 bp, Glycine max var. Williams 82; identical to SEQ ID NO: 795

SEQ ID NO: 4077 - DNA, 939 bp, Glycine max var. Williams 82
atgatgatgatgaacaatactattattccatggtcaaccattggcgttgtgattgcatggtacacttccaacataggggttcttcttctgaacaagtacttgctaagcaactacggctttaggttccccgtgttcctcaccacgtgtcacatgctggtgtgctcgctcttcagctacgttattgtttccgttacggaagctgttccgctgcagcgcgtgcggtccaggagccagttttggaggatcgtggcgctcggcgtcgttttctgcttctccgtcgtttgcgggaacgtgtcgctcaggtacattccggtgtcgtttaatcaggccatcggcgccaccacgccgttcttcaccgccgttttcgcttatgctgtcagcgccaagagggaggcttgggttacgtacgccacgctcttgcccgttgttgcgggcgtcgtcatagctagtgggggtgaaccaagttttcatctgtttggatttataatctgtgtttcatcgactggtgccagagcatttaaatcagtgcttcaagatattttgttgtcctcagagggagaaaagttgaattctatgaacctgctgctttatatggctccaatagcagtgatggtcttacttcctacaatattgttgatggagggaaatgtgattcagatcactatggatcttgccagaaaggatataagaattttttggtatctgcttctcagttcttctcttgcatattttgtgaacctcactaattttttggtgaccaaacatacaagtgcacttacccttcaggttttaggaaatgcaaagggggcagttgctgtggtggtctcaattttgatattcaaaaaccccatttcaatgataggaatgcttggctatgcactcactatcattggagttatcttgtacagtgaaaccaagaagaggtatagcaaaaattag

SEQ ID NO: 4078 - DNA, 2580 bp, Glycine max var. Williams 82
atgggacacaacaacacttgtcatcatcatgtcaaaggtttccacgcagacccttttagccatagcctctcttctgcttcaaatggtggtgataggaggagaaaatgtgggaacaatgaaaaaagtggtggtagtggtttcattttcttacccttttttctgtttcttttgatttccacttccaccattcagcatgtttcaggccacttgtgggatggggtggttgtgactcaggctgattttcaagcccttagggctattaagaatgagatcattgacatcagaggggtgttgaaaagctggaatgacagtggtgtaggtgcttgttcagggggttgggctggaatcaagtgcgtgaatggtgaggttattgcaattcagcttccttggagagggttgggtggcagaatctctgagaaaattggccaacttcagtctcttaggaagctcagtctccatgacaatgctcttggtggttcagttcctttcacccttggtttgcttcctaaccttagaggagtttatctcttcaacaacaagctttcaggttctatccctccttccctgggaaactgtccaatgcttcagtccctggatattagcaacaattccctcagtggtaaaatccctcctagtttagcaagatcttctaggatattcaggatcaatttgagcttcaactcactttccggatccattcctagtagtctcactatgtctccttctctaaccattcttgcacttcaacacaacaatctctctggttttatcccagattcttggggtggaactggaaagaagaaagcttcccagcttcaagttttgacccttgatcacaatcttatttctggaaccattcctgtttctctagggaagcttgctttgcttgaaaatgtttctttgagtcataaccagattgtaggggctattccaagtgagctaggtgcactttccaggcttcagattcttgatttatcaaacaatgccattaatggaagccttcctgctagcttctctaacctctcctctcttgtttcattgaatctagaaagcaatcaacttgcaaaccatattccagattctatggacaggttgcacaacctttccgtgcttaacctgaagaacaataagcttgatggccaaatcccaccatcacttgggaacatctcaagcattatccaaattgatttctctgagaataaattagttggagaaatcccagattcccttaccaaacttgcaaaactcacttcattcaatgtctcttacaacaacctatctggtactgtcccatctctactttccaaaagattcaatgctacctcttttgaagggaatcttgagctatgtggattcatcagttcaaaaccatgctcttcacccgctcctcataatcttccagctcaatcaccacatgctcctccgaagccgcatcaccgcaaactaagcaccaaagacataatcctcatagttgcaggtattctcttgttgattctgttagtactgtgctgcttcttgctgtgttgtttgatcagaagaagagctgcttcaagcagaaagagtagcaagactgctaaggctgcagcatctgccaggggtgttgagaaaggtgcctcagctggtggtgaagttgaatcaggaggtgaagctggtgggaaactagttcactttgatggcccttttgtgtttactgctgatgatcttttgtgtgcaactgcggagataatgggaaaaagtgcatttgggacagcatacaaagcaacactagaagatggtaaccaagttgctgtgaagaggttgagggaaaagaccactaaagggcagaaggagtttgaaactgaggttgctgcacttggcaaaatcagacacccaaatctcttggcacttagagcctactatttaggaccaaaaggagagaagcttcttgtgtttgattacatgaccaaaggaagcctagcatcattccttcatgctcgagggcctgaaattgttattgaatggccaacaaggatgaagatagcaatcggagtcactcacggcttgagctacctccacagccaagagaacatcatacacgggaacctcacatcaagcaacatactattggatgagcaaacagaagctcacataacagattttggcctctcaaggctgatgacaacttctgccaacaccaacatcattgccaccgcaggaagtcttggctacaacgcaccagagctttcaaagaccaagaagcctaccacaaagactgatgtgtacagccttggtgtcatcatgctggagctcctgaccgggaaaccgcccggggagccaaccaatggcatggacttgccacaatgggtggcatccatagtgaaggaagagtggactaatgaagtgtttgatttggagctcatgagggatgcaccagccataggagatgaattgcttaacacattgaagttagcattgcattgtgtggatccttctcctgctgctaggcctgaagttcatcaagttcttcagcaattggaggagattaaaccagacttagcttcaggggatgatgatggagctaaggcccaagaaactgagtaa

SEQ ID NO: 4079 - DNA, 1719 bp, Glycine max var. Williams 82
atggctacaccaccgccaaataacagccttcagaccatgttgcgggctgcagtgcaatctgttcagtggacttacagcctcttctggcaactttgtcctcataaagggattctaacatggggtgatggatactacaatggagcaattaagacacgaaagacagttcaagcaatggaagttagcaccgaagaagcgtctctgcaaagaagcgagcaacttagggagttatatgaatcgttgtctggtggggagacaaacgcaaaaacacgaagaccatgtgcttctttgtcgccggaggatctaacggaaaccgaatggttctatttgttgtgtgtctctttctcctttcatcctggtctcgggttgcccggaacagcatatgctagaaggcagcatttatggctcagtggagcgaacgaagtagacagcaaaacattttcaagagctattcttgccaagacagtggtgtgcattccagtgttggagggcgtcgttgagttgggcacaaccgataagatggaggaagacctaaatttcatccaacacataaagagcttcttcatagatcagcagcatcctgctctcacggcaaagcctgcactatcagaacagtactccacttccaagcccacttcttcttcttcttcataccctcttgtcactgccaataatactattccaatccaaaacattgttgatagaggagaagctataatattgaataataataccaaagaagcagaattagcagtccctaacagtagtttcataccgagcgagctaatggaactggatgccaccttggaggaattcagggttggatcatctggagatggctccaaccacttggattcattccccactgagaaatctatggcactgtgttcagcagggttggagctccttcaacttcaacttccaccagctccagcacatcctcccacagaaaacctagcacaaggcggcacagacacacactactctcaaacagtgtccagcatccttcaaaagaactccaggaggtggccggaatcaccctctctcaacctcctcactgactccttccaatcagctttcaacaaatggaactccggcgctgacgactaccagcaccatttccacgtgtcggtggccagcgtcacctcccagtggctcctcaagtacattttgttcagcgtcccttacttgcacaccaactggctcaagggcaagggcacttcaccatacgagaccagtcacgtgatggcggagcgtcaccgaagggagaagttgaatgagaggtttctcattctgcgttcgatggtgccttccgtgacaagaatggacaaggcgtctatcctgggagacaccatcgaatacatcaaacagttgagagataagattgagagccttgaggcgcgtaagcgcctcacgggaaagagaaggatgaggcaggtggaggtttcaatcatagagagcgaggcgctgttggaggtggagtgcgtgcatagggaagggttgttgttggatctgatgacaaagttgagggagttaggggtggaagtgatgatggtgcagtcttgggttaaggatgatggagtgtttgtggcggagatgagagccatggtgagggaaaatggtaacgggataaaggctagtgttattgaagtgaaaaatgcccttaatcagatcataccccgtcatgaaccatacacacttgcttccagtgatcatttttag

SEQ ID NO: 4080 - DNA, 999 bp, Glycine max var. Williams 82
atgggatcccaaacacagtctcaagaacttcatgtggtggacttcaccgacgaaaacacgaagaagcccggcaccgatgcatggctctcagcgtgcagtgtagtgaggactgcactcgaggacaacggttttttcatggcacgctatgataaagttggcaaagagctttgtgactcagttgtatctgcggtggaagagctatttgatctccctgtggagacaaaagcgcaaaagactagtgagaaacttttccatggctacttagggcaagtctcgtggcttcctttgtatgaatctgtgggcattgatgatccgttgaccttgctagggtgtcaaaaatttggccacataatgtggccggaggggaatcatcgtttctgctcatggcagaggtttaattttccatatagtgaaagcatcaatgagtattctaagttgttgggagagttggaccatatggcgaagagaatggtgtttgagagctatggtgtggacatgcaacgatgcgattctttcatagaatcaaacgattatctacttcgatgcatgatgtataggacaccccagacgggtgaaattgatttgggactgcaacctcactcggacttgaccatcacttccattgtacatcagctgaataatctgaatggcttggaaatcaaactgaaggatggggaatggaaagggattgatgcttcaccctcttcgtttgtagttatggcaggtgacgcattcaatgtgtggagtaatggcagaatacggccatgtgaacacagagttacaatgaatgcaaagaaaaccagatactctatgggactgttttcttttggtggtaataaggtgatgcgtatacctgaggagctagttaataagcaacatcccttgcgttataaaccactattcgaccattatgaataccttcgtttctatgacaaagagaaaatcaaagagccttactctcgaatccaagcccattgtggaatctctaccctacagtag

SEQ ID NO: 4081 - DNA, 2187 bp, Glycine max var. Williams 82
atgaatgcaaagggacataaatttgtgaggtttgaggactggaaatcagagtcatcttttagtccagagcaagaaaattctattaacaatgggaatcacaaaagaagacctagtgtgggtgcggttttgaagagtataggaagaaggctggagagtgtgtcagagaagatgaagaacttgacaagagcttcagctgtccatcctgtaagtgatggaaagaaaaagcttcctcctaggaagaaaattcttgatccacagggtccaatccttcagaaatggaacaaaatctttgtaataacgtgtgtgatggcagtctctgtggatcctctcttcttttacattccggtgataaataatgctagaaaacgtgttgatttggatggagtattgcagatcactgccagtgttcttcgcaccttctttgatctattctacattcttcgcataatcttccagtttaagacaggattcattgccccttcttctcgtgtttttggaaggggtgagctcattgatgatcctatggctataatgaaaagatacttaacttcacacttcatcattgatgttctatcaattattccacttccacaggtgattcttttagccataaatcgaaacctgaaaacatcagatccatttgtagcaaaggatttgttgaagtattcagtattaatccagtatgtgccaaggcttttgcggatctatccactattcaaagaagtaactagaacttctggcatattgaccgagacagcatgggctggagctgcttctaatctttttctctatatgctggcaagtcatgtggttggagctaactggtatatgctttcggtagagtcagaggtgcggtgctggcgagagttaaagaatgcttcactctgtcatcgagaatacatgagttgtggagaccgcaatcaaaaaaactttacacttctcaatcttcttaatcagacactattgaatcaaacagttcttaatcaaacttgttctttggttgaccctgatacaatcaaagacccaaaaaccttcaattttggaatattttctgatgctctagattcacatgtggtagaatcaacaacagattttcctcagaagttcttctactgcttttggtggggtttgcgcaatttaagttctcttggacaaaatctcaagactagtactgatgtctcagaaatagcctttgcaatcttcattgccatctttggattggtcttattctcgttacttattggaaacatgcagaaatatctgcaatctacaactgttagagtggaggagatgagagtgaagagacaggacgcggaacagtggatgtcccaccgtatgctacctgagaacttgaaggaaagaattagaaagtacgaacagtaccaatggcaagaaaataagggtgttgaggaggaggcattaattcgtaaccttcctaaagatctccgaagggacataaagcgtcacctttgcttagctttagttaaaaaagtgccaatgtttgagaaaatggatgagcagttgttggatgcaatgtgcgatagactgaagccagtcctttacactgagaagagctacattgttcgtgaagaagatccagttgatgagatgcttttcattatgcgtggaaaggtttctactatgacaacaaatggtggaagaactggtttcttcaactccatgttcctcatggctggtgacttttgtggagaggaacttctgacatgggccttggatcccaactcctcctcaaatctacccatttcaactaggacagtagaaactatatcagaagttgaagcctttgctctcatggccgatgacttgaagtttgttgcttcccaatttcgacgccttcacagcaaacagctccaacacgctttcaggttctattcctcacagtggaagacatgggctgctactttcatacaagcagcttggcgtcgatactggaaaaagaagattgagaggtcattgtgcaaagcagaagcagacctacaagatgctttggcaaatgaggaagggtctagtctaagccttggtgcaaccatatatgcatcaaggtttgctgtcaatgcactgcgaaacttgagagaaaatagcagacacaatacaatgcagcagagactactatctctgttacctccaaagccagctgagccagatttcactgctcagaaacactaa

SEQ ID NO: 4082 - DNA, 912 bp, Glycine max var. Williams 82
atgggcaataaaacagcaaaagtttcaattttgtttctgttgaattttctcgggttggtttgcagtagcaatggcggagacatagtggtttactggggccaagacgagagcgagggcacattgagcgaaacatgcaactctggactatacaaaatagtgaacataggctttctggcaaaatttggcggtgggcgggaacccgaaataaacctagcaggacactgcgaccctgcatcaaacggttgcaaaagtttgagcaaagacataaagaattgccagaagaggggcataaaggtgattctctcaattggaggtggcgagacaggttactccttgtcgtccgctaatgatgctacaaaggtggcagattacatatggaacaacttcttgggaggaaaatcatcaaagacaagaccattgggtgatgctgtgttggatggcgtggattttgacattgaagttggtggcggtgaaagcttctacgctgtgcttgcgaggagactctctcagcacagcaaaggagggggcagaaaagtgtacttaacagctgcaccacagtgtccattccctgatgaacaccagaatggagcactgtcaacagggctctttgactttgtttgggttcagttttacaacaatggtccatgtcagtttgagtctagtgaccccaccaagttccagaaatcgtggaaccagtggatctcgtccatcagggctaggaaaatttatgttggacttcctgcatctccatcgccagctacggctggtagtggctttgtgccaacacgaacgctcataacacaagtgttgccttttgtcaaaagatcgcccaagtatgggggagtaatgctctgggatagggctgctgataagcaaaccggatattccaccaacatcaagcccagtgtttga

SEQ ID NO: 4083 - DNA, 1668 bp, Glycine max var. Williams 82
atggcaaccaaaacatccaccaacggcacccatcattctctacccgagtacattccaaaccgcattcctgacccacattatgtccgcatcctggacaccacgcttcgcgatggcgagcaagcccctggagctgccatgacgtccgatcagaagctccaaattgctcgccagctcgcgaagcttggtgtggatgtcatcgaagggggtttcccttcagcgtcacaggaagacttcaatgctgtcaagatgatagcgcaagaagttggcaacaactgtgacgctgatggttatgttcctgtcattgcggccctatgtaggtgcaatgagagggacataacgagagcctgggaggctctcaagtatgccaagaggccaaggcttatgcctttcatagcggtgagtccgattcacatggagtataagctcaataagactaaagaagaggtgcttcaaatagccactgatatgatcaaatttgcacggggtttagggtgtactgacatccaattctgttctgaagatgcagccagatcggatagagagttcctttaccaaattttggaagaagttatcaaagctggggcaacaactctgggcataggtgacactgtgggcataacaatgccattcgagattagagaattggttgctggtataaaagccaatgtccctggagctgaaaatgttattatttctattcactgtcataatgatcttggacatgccactgcaaacacaatagaggctgctcgtgctggtgcaatgcaattagaagtaacaattaatgggattggtgaaagggctggtaatgcctcattagaagaggttgtgatggccctaaaatgcaggggagatcatgtcttaggtggtttgtatactggaattaatacaaggcacttattgaagacaagcaagatggttgaagagttctctggtatgtatttacaaccacacaaagctgttgtaggtgataatgcctttctccatgaaagtggcgttcaccaggctggattattaaagcatagaggtacatatgaaatattgtctcccgaagatattggccatgaaaagtccaatggagttaatatggtactagggaagctaagtggacgccaagctttgaaaagtcgactcaaagagcttggctatgaacttagggatgaagaagttgaaagtgtgtttaggaacttcaaagcaatagctgagaaaaagaagagagttaccgatgttgatctcaaagcattggtatcagatcaagcttctcatgctgagcctatttggaagcttggtggtttgcaggtgacttgtggaactatgggttcttcaacagcaactatcaaacttgttactagtgatggtagcacacatgttgcttgttctgttggtgtaggaccagtagattcagcttacaaggctattaatctcatagtgaaggaaaccgtaaaagtacttgaatactcaccaagtacagttacaggaggcaccgatgcaattgctactacacgtgttgtaattcgtagagagaataagcagtcacctactcctgctttgaatggaaacgttatttatccaacatttagtggtaccggagaaggagtggatattgttacttcaagtgtagaggcttatattactgcactaaacaaaatgctcgattcaaaggaatga

SEQ ID NO: 4084 - DNA, 2094 bp, Glycine max var. Williams 82
atggcttacactgcagttgccatgcctacctctccagcagctacctcggcaactgtagacattgcaaaagagcataacggtcttcgccgctcgcaatccagcaaagaactacacacacgtgccgttatgcggaggtcttattctgacaaccacctatgttgctccatcaatcgcgtacaagccacatcagtgccaccaaaacttaagagcaatcaaccaatggggatttcaccatttcaattttcaggctccattcttccaaattcactgcgctccttcttgtttgacccagaaacaagcaatgatctagttgtggaggagaaggtggtaagcattgaggaaaacatggtagaaagcagcaaggaagagatagtgaatagagccaactgggtagagaggcttatggaaatcaagaaacattggagaaacagactgcccaaagaaagcatgaatacagatgcgatatgcaacgacaatacgtatgatgaatgtgaatgtgatggggatggagatgacaatgtttgtgtggtgggtgaagatgaagatgagcaggaagtgacatatgatcgtgactcattctcaagctttctggttcaagtgccatggtctgataccaaactatactctcaacttgctttcctctgcaacatggcctatgtaataccccaaatcaaggctaaggacttgcgaagatactacagccttcaatttataacatcttctttagagaagaaagctgaagtggccaagttaaaagtgcaacttaatcaggactccacttgcgttcctgtagatgactcggtagcctctcaagatgtatcaaagaaagacaaagataatacaaagaagcctcaaatcaaactagcttatgatattgctgcctcagcagcctcttatgtccaattacgagctaaggatcttttgcaccgtgctgctaagtcacaagacacacaacagactgaaaatgaagattctaatgaaagagaagacttgccggggcgagaagagctagaaggcacttcgcgaggttacaaatcagaggttgcagcttatgttgcagcgtccacaatgacagcagtggttgcagcaggggagaaggaaaaacaagaaacagcaaatgacctccagtcacttcattcctcaccttgtgaatggtttgtttgtgatgatcccggcaattacactcgatgctttgtaattcagggctcagactccctggcatcttggcaagcaaacctcttctttgagcccactaaattcgagggcacagacgtacttgttcacagaggaatttatgaggccgcaaaaggaatatacaagcaattcatgccagaaataatggagcatttgaagagacatggggatcgtgcaaagcttcagttcactgggcactcccttgggggtagtctctctcttctggttcatttgatgctattgactaacaaggttgtgagtccctccactcttggaccaatagtgacttttggctcaccgtttgtattctgtggagggcaacaaataatcgatgagctaggcctggatgagagccaaatccactgtgtgatgatgcatagagatattgttcccagggccttctcctgcaattacccaaaccatgtagctctagtccttaagcgcttacacacctcatttcggtcacatccatgtctgctcaaaaataagctgttgtactcaccactgggtaaaatattcattctccaacccgatgagaagacatctcctccgcatcctttactccctcgaggaagtgccttctatgccctggacaatactaaatgtccaagtgttcttcgaaccttcctgaatcaaccacaccctattgatacactaagtgatccaacggcatatggttcagaaggcacaatcctaagagaccacgactccagcaactacctcaaagccatcaatggagtgttgaggaaacattcaaagattatcgtcggcagagtgaggaagcaaaggattaatcagttgtggcctctgttgacatcaccatctccacactctaggagccatgaacagaactcggagagatgcagcttgaggacaaaggagatagttacaggggtttaa

SEQ ID NO: 4085 - DNA, 840 bp, Glycine max var. Williams 82; identical to SEQ ID NO: 891

SEQ ID NO: 4086 - DNA, 1125 bp, Glycine max var. Williams 82
atggggaaggccagcaaatggatcagaaacttcctactagggaaaaaagaagataaaataaagaagatcgatgcattctgcagcgaggataagagtggcaacacagggagtctgattgtgagtcccaaagtgaagcgcagatggagcttcggaaaactaacaggagcagggcataaattttccagatcatttgactcagctgactctgcaaaacttcaaatacaagccttgttggaaaccaagactccaaggcgtcttccaaaaccattagcaaagccttctaaagataaaaacaaagccgctacaaagattcaggctagctttcgctcttatttggcaaggagagcattgcatgctttaaggggattagtcaagttacaggcactagtgaggggtcaccttgtaaggaaacaaacaactgctacactgcgtggaatgcatgcgttgatggccatacaagttagagcccgaattcacagagttcagatggcagaggaagcaaacctcctccgacaacaatcgcctccgcaacatagacaagttccatactccactgatctcataacagaagaaaataaagattcaaaccatatgagtgtggaagaaatgttggaggttttgaaaagcagaagtggcccactagatggttcatatgttaagggcagagagcgtgattccatgacatactattccaagcatgtgccggttgtttctaaacgagaaaaccaatacaagaaaactctaatcatagaaccaaacagcctagaaaactaccgatccatgtctgaatttaacccaacgacaattgccttgtcaacttctcagcgccattcagtgcctcacggccaatcactgtcaccaaattacatgaacaagacagaatcttcaagggctaaagcaaggtcgcagagtgaaccaagacaacgaccaatacggggaacaaggcacaaaggcaagtctgtggaatcaccattgaatggtccaagacaaaatctgttctcaaactcgttacgcttcgatcatggaagcatggaccattgggttatcaattttcatgggtcaacgaacgacagcaggcgcaattcctttggcagcagctcggttactactgattcctattattga

SEQ ID NO: 4087 - DNA, 2637 bp, Glycine max var. Williams 82
atggctgtggtgagtcctatgcctgcaactccaccacaggtcaatcctgtgaacttgcttcgtaatactggggttcctggaatcatgactagtaggagagaaattgtaaatgaacctagtccaagtatggttaatgagacaatctatgttgccgtggcaaaagatgtgaaagatagcaaattaaatctgatatgggcaatacagaactctggaggaaggagaatttgcatccttcatgttcacgtgccagcacctatgatccccttggccttgatgggtgccaaatttcctgcaagtgcgctgagagaggagggagttcaagattaccacgaaagagaaagactaaaaatgcacaagactctggatgcttacctttttatctgtcaaaggatgggggttcgtgcaaggaaactactacacattgaaatggattgcatagaaaaaggaattgttgaactcatctcccggtatggcatacagaaacttgtaatgggagcagcatctgataagtaccattcaaggaggatgacatccctcagatctaagaaagctatatatgtatgtgaacaagctccagcttcttgtcatatacagtttatctgcaacggctacctcatacatacaagggattgcagtttgaatagagggaatgtagaggttgaatttcctttgttgcagcaaatggcaaactctgaagttggacattcacctaacttgagtttccaatcaattttgcaagggcaaaaccatgggataaaattaactaatccagctcaagagttatttcgtagagtaaggtctgttaatgatggacatatgagaagccttgaatctgtttcttcttcagaagggtttttaactccaccaagcaagttcagtaaaaacataagttctattgaaccaggattgaccccaaatttgattaatgatggaagtgagaatgcattagacttgattttgaattacccttctctgattaacaaggatcttcatcattcatcatctcctagtgtactgcaggatgaaggaatggatgatgctctctattatcaacttgaacaagtaatggctgaggcttcgaatgctaggcgtgatgcatatcaagaaactgttaggcgcagtaaagctgaaaaagatgctattgatgctattcacagggctaaagccactgaaaacttgtacaaagaagagctgaaactaaggaaagaacaagaagaagcagtagaaaaagcaaatgaaaaacttaacaatatgaagagccagacagacaaagttaatgaggaactccgacttgccttagatcagaactcatcactagagaatcaaattgcatcaactgaacttatggtaaaggagttgaagcaaaagattatatctgccttggacctgttacaaaactacaaggatgagctagatgatttgcaaatacagcgtgataatgcagtgggagaggctgaggagtttaggagcaaacaaggggaagcctcatcaagcgcacaggagcttcactgcttctcagatttttcctttcaagagattaaagaagcaacaagtaacttcaatccatccaagaagattggagaaggtggatatggaagtatatttaaaggtgtcttgcgtcacactgaggtggctataaaaatgttgaatcctgacagcacgcaaggacctttggagtttcaacaggaggttgaagtattgagcaagttaaggcatcccaatcttatcacacttataggagcctgcgcagaatcttggactcttgtctatgagtatttacctaatggaagccttgaagatcgtctcaaccgcaaggataacacacctccactatcatggcaaactcgaatttgcattgctgcagaactttgttctgctctcaattttcttcactccaataaacctcacagcatagcgcatggcgacttaaaacccgccaacattctcctcgatgcaaaccttgttagcaagctcagtgactttggaatctgccgtatattatcttgtcaagacagttccagtaatagtactacacagttttggaggactgttccaaagggaacttttgtgtatgtggatcctgaattccttgcttctggtgaacttacaccaaagtcagatgtttattcatttggaatcattttattgagattgatgactgggaaaccagccctgggaataataaaggaagtgcaatatgcattagatgctggaaagttgaaatccatcttggatcctttggctggagaatggccatttatgctggctgaagagctgattcgcttggctttgaggtgttgcgagatgaatcggaagaaccggccagaactttattcagatgtttggaggatactggaaccaatgagggcttcttcagtagtcacaaacacctctcaactgggttctcaaaggctatgccaacctcctccttattttatttgtccaatctttctggaagtcatgcaagatccacatgtagcttcggatggttttacttatgaagctgaggctatacgcgaatggctggaaagtggtcgtgacacttcaccaaggacaaattccaagcttgctcatcgcaaccttgttcccaaccacgctcttcgccatgcgatccagaactggcttcaaagtcactga

SEQ ID NO: 4088 - DNA, 1884 bp, Glycine max var. Williams 82
atggagattttggaagattcaaaactacgggaagatgcaatgagagaactctatgaagtatcattaaatggatgcgtgagtaccttaaacacactgatccaaaaagaccctcttattctgagcagaatttcactctacccctacactgaaaccccattacacatagcctctttgcttggacatttggacttctgtgaggttcttcttcagaatagtcccagtttagcgactgaattgaactcagaaggacgttgccctcttcatttagcttcagctaatgggcacacagtggttgtgaaagcgcttttgaggacaaaccctgaaatgtgtttggttggtgacaaagatgagatgcttcctctccactttgctgcaatgagagggcgcgttggagccatcgaggagttgatcaaagccaagccagactccattcgagagatgacaaagactgatgatggttcagttctgcacttgtgcgttcgctataaccatcttgaagccttgaaattgttagtggaatcattgagaagtgaacatcaattcctatattcactcaaagacaaagaggataatactttgctacgtttagcagtgaaacgcagacaaatcaagatcgttaaatacttgctatcactatccgaaatgagtacagaaataaatactttgaacaaggagggtttaatatctatggacacattggggcagtgtccaagagaattcatcagccaacacattttaactgaaggagttgaaaagtctgaaaatgaagttataacacaagaagcagtttcctcaacaaccctagtcagcaatcatcaaacgactctgtcaacatctagacaagaaccaacttcctcacaaagcagcataactattgtaattgtacaaccggatctttcactagcatcatcaccctcacaaaccaacaatgatcctcctccacaaacatcatcatcatcctcatcagagtcatcaccaaccaacaatgatcctgaaccagcacaagtttctcttcaaccgacacaaccatatagacaacaacaatcctcacaaacacaaagcgtaactattgaacttgtacaactagatcctcctccacaaccctcacctcaacaaattccatcaccatcacaaaccaatattaatcctgaacaaggacaaccctcaactcaacaaacaccaacaaacaatagtaatagtattccaccagcaacaccgagcaatggtcaagtccaaccactaacatcagaaaacatcatcacaagtgaaaaccaaggacatcctaatagatggaacaggttcgagaggttctgcagaacgtatctgctagacgacggtaactggatgatggacataaagacaagggagcaactaatggtagcagccactgtgatggcaaccatgacatttcagtcggcgataagcccaccgggcggtgtatggcaaggtgatacaacacaagatgggtttgcttgccctgactatggtttctgtcaagcagggaccgcggttgtgggctatgcttggtcacctgattttctcaaattcatttttctcaactcttcttctttcttcgcgtctctttgcgtgatgctggtgctcatgagcgggttgccgctggagaacaaggtcgtgatgaggatcttgacattttttatgatcgttgcggcttcgtgcatgctcctcacgtacatgtgggcgttggggatggttagtccgaatcatatttattatacaactaagaaactggggtatcttttggttggtatgtgggctttcttgcttgcgcttgttattttgcttcatgcaagccgattagtgttctggtttaggtcaccacgcacaccctcctccacaaatattgctccgccgagcctcccttaa

SEQ ID NO: 4089 - DNA, 369 bp, Glycine max var. Williams 82; identical to SEQ ID NO: 794

SEQ ID NO: 4090 - DNA, 972 bp, Glycine max var. Williams 82
atggtgggtgttatttcgttggtaacaggaatggctggtccaagtgggtttggatcagcttcaactgcagaacaggttactgaaggagttgatgccagcaacctcactgcaattatcacaggaggagcaagtggtataggattggagacagcacgagtgttggctcttcgaaaggtccatgtcatcattgcagtacgaaacatggtgtctgcaaaagaggctaaacaacaaatactagaggagaatgagtctgcacgagtggacataatgaagctcgacctttgctcagtgaattctattagatcatttgtggacaacttcatagctcttgatcttcctctcaacattttaataaacaatgctggagtgatgttctgcccattcaagctctcagaggatggcattgagatgcaatttgcaacaaaccatattggtcatttccacttatcaaacctacttcttgacaaaatgaaacaaactgcaaaagccactggaatagagggcaggatcataaatctgtcatcaattgcccataactacacttacagaaaggggattagatttaataagatcaatgaacggaaaggttacggtaacaagaaggcgtatggacagtccaagttagcaaacatattacatacaaatgagctttctcgtcgcctgcaggaagagggtgtgaacattacagcaaactcagtccacccaggagtgataatgactcctcttatgagacactcttcttaccttatgcacttcctcaaggtctttaccttttacatatggaagaacgtcccccagggagcagccacgacatgttatgttgctctccacccaagcgtgaaaggtgtaactgggaagtactttgtggattgcaatcaatgcaaaccaagttcacatgccaaaaacaaacagcttgcaaagaaactctgggatttcagtaacgatttgatcaaatcaatctcaaaagcttga

SEQ ID NO: 4091 - DNA, 285 bp, Glycine max var. Williams 82
atgttatttaagttacgtacatgctcttctcatttttccaatccacttgcttttaaatatgcaacacacaagtcttctccaagctttaagtgtgcaaacactccatttgggtggtgttctatatatctttttgtggttcaggaagtgtgttgcaatgtttcttttcttcttttaagcgtagtagctcacatatatgcacctgcagagatagtggaattgagccgaacatgcataaactgtctggattggaagtctacaaaggaaaaagtgaagctgccagcatga

SEQ ID NO: 4092 - DNA, 2025 bp, Glycine max var. Williams 82; identical to SEQ ID NO: 868

SEQ ID NO: 4093 - DNA, 390 bp, Glycine max var. Williams 82
atggctggggttcctccagaagcacatgtttcacttgatcagcttaagcagataatggatgagtttgcaaaggagagggattgggagcagtttcatagcccaaggaacctccttttggctttggtgggtgaagtgggagaattgtctgagatatttcagtggaaaggggaggttccaaagggtcttctagattggaaagaggaggaaaaggttcatcttggtgaagagctttcagatgtgttgctttatcttgtgaggctctccgacatgtgtggtgtagatcttggcaaagctgctttaagaaaggttcaactcaatgccgtaaaatacccaaaaaaggtttatgaagacccttcaagcagcactgtcagccccaacaacaccaattga

SEQ ID NO: 4094 - DNA, 2163 bp, Glycine max var. Williams 82
atgagcgccaagaacctcaatttcgacgcagacacagctctggcgaaggatttcctttccaactttgcagatgccaatggcgaagccaaatacatgaacatcctgcaagatgttgcaaaccacaaaactcgagcagtccagatcgaccttgaggatttatttaattacaaagatctggacgaggaatttctgagccgtgttactgataacactcggaggtatattgggattttttccaatgcaattgatgaactcatgccggagcccacggaggacttcacagatgatgatcatgacatattgatgactcagagatctgatgaaggagtagaaggcaccgacggttccgatccacgtcagaagatgcctcctgaaatcaagcgttactatgaactttatattaaagcatcttcaaaaggacgaccctctacaattagggaggttaaagcttcgaacattggtcagcttgtaagaatttctggtattgtgatacgttgttcagatgttaaaccattgatgaaagtggctgtatacacatgcgaggattgtggatttgaaatttaccaggaagtaactgctcgggtcttcatgcccttgtttgaatgcccatcaaagcgctgtgatacaaacagaagaaaggggaatgttatccttcaactaagagcatcaaaatttttgagatttcaagaggccaaaattcaagaattagctgaacatgtccccaaaggccatattccaagaacaatgactgtgcatctaagaggagaactcacaagaaaggtggctcccggggatgtggttgaattttctgggatttttcttcctataccttacactggttttcgagcaatgcgtgcgggcttagttgctgacacttacttagaggccatgtctgtaatgcatttcaagaaaaaatatgaagaatatgagtttagaggagatgaggaagagcagattgcacgattagcagaggatggtgacatctacaataaattggcacgatcacttgctcctgaaatatttggacatgacgacattaaaaaagcactgcttcttctccttgttggtgctccccatcgtacgttgaaagatggaatgaagattagaggagatttacatatatgtttgatgggtgatcctggtgttgccaagagtcagctccttaaacacataatcaatgtagcacccagaggggtgtacactactggcagaggaagtagtggagttggtctaactgctgctgttcagaaagatccagtgacaaatgagatggttcttgaaggtggagcattggtgttagcagatatgggcatatgtgccattgatgaatttgacaagatggacgaatccgatcgtacggctatacatgaagttatggaacaacagactgttagcattgccaaggctgggatcactacatcgctgaatgcaaggactgccgtccttgctgctgctaatccagcatggggaagatatgatctaagaagaactccagctgaaaatattaatcttcctcatgccctgctatcaagatttgatcttctgtggttaatccttgatcgagctgatatggataatgatcttgaaatggctaggcatgtcctatatgttcaccaaaataaggagtctcctgctcttggattcactcctcttgaaccatctgttctacgtgcatacatatcagctgcaagaagattgtctcctagtgtccccagggaactggaagagtatattgctactgcatactccagcattcgtcaagaagaagcaaggtccaatgctccgcattcctacactactgtaaggacattgctcagtattctccgcatatcagctgcactagcaagactccgtttttctgagactgttgctcagagtgacgtggacgaggcactgaggttaatgcagatgtcaaaattctctttgtattctgaagatcgtcaaaaatctggtctggatgccatatctgatatctattccatactgcgggatgaagcagctagaggtaaccgaatggacgtcagctatgcccatgcactgaactggatatctaggaaggggtacagcgaagcccagttgaaagagtgcttggaggagtatgcagcacttaatgtatggcagatacatcctcacacctttgacattagatttatagacgcttga

SEQ ID NO: 4095 - DNA, 1530 bp, Glycine max var. Williams 82
atggcaattggctttcagttcataataatcacactcttctctctattttcggctccctcactcacttttgcttttgtccctatccttcccagatttccttcttcagcagttagtgcagagctgaagcaacgctctcattcttcccaaaatgggctttacagaacaaaattcttcacccaaatactcgaccacttcaattttaatccccaaagcaatcacacttttcaacaaaggtatctcatcaacgataccttttggggtggtgccaagaacaatgctccaatctttgtctacactggcaatgaagggaacatagaatggttcacgcagaacacaggctttatgttcgaaaatgctccttcttttcaagcccttttggttttcatcgagcatagattttatggaaaatcaataccatttgggggaaacaagacggttgcatatgcaaatactagcacacttgggtatttgagctcaacacaggcattagctgattatgctactctcatcattgatttgaagaagaatttgtcagcaactgattctcctgttgtggttttcggaggatcctatggaggaatgttggctgcttggttcaggatgaagtatccacacgttgcaattggagctctagcatcctcagctccaattctccatttcatgggtttggtttcgccagatatcttcaacaacatcatcacacaagacttcaggagcgagagtgagaattgttacaaagtgataaaagggtcttgggatctgatagacgacacggccaataaacccggaggaatggaactgctgcggaaaacattcagaatatgcaagagcgatgattttgggcctggttctttggaaggttggcttcgggcggcgtggatttatacagccatgacagattacccgacaccatccaatttcctgaatcccttgccagcatatccggtgaaaaagatgtgcgaggccattgacagctcagtaacgggaaataatagattagccaagttgcatgcagcagccagtgtctactacaactatacaggcaaagcaagatgtttcgatttggatgacaattctgatcctcatgatcttggaggatggcaatggcaggcttgtacggagatgataatgcccgtaggtggaagcaacaaggagagcatatttccagaatatgagtggtcatacgaagccagagcctcttggtgtgactttttctacaacgtacagccaagaccacactggattacaactgagtttggcggccatgctgtagagagagttctgaaaaggtctgccagcaacattatattttttaatggtttaagagatccttggagtggtggaggggtgttgaagactatatcaaaaacattagttgctatagttgcaaaaaaaggagctcatcatgtagacttaaggttctcaagtaaggaagatccacagtggcttaaagatgtaaggaaactagaggtaaatatcatagcaagttggatctcacaataccatcaagacctacaatccaatagctaa

SEQ ID NO: 4096 - DNA, 1149 bp, Glycine max var. Williams 82
atgctagttcctcatcatccttcaatgctaattgcacctcaaaacacatccgcagaaaatcatgacaacatggaaggacagaaacaactacaccactttgatgaatctttgatgccaaaccagtccaacataccctcccagttcatatggcctgatcatgaaaaaccatgcttaacaccaccagaactccatattccacccattgacttgaaggcttttctctcaggagatccacaagctgtgtcagcaatttgtgcagaagccaatgaggcatgcaagaagcatggcttcttccttgttgtcaaccatggtgttgatagaaagctcatagctcaagctcataagctcatagatgatttcttctgcatgcagctgtcacagaagcagaaggctcagagaaagattggagaacattgtggctatgctaatagcttcattggaagattctcctccaaacttccttggaaggaaacactttctttccattattctgctgataaatccagcaaaagtgtggaggattatttcctaaatgtcatgggggaggatttcaggaaatttgggagtgtgttccaagaatactgtgaagccatgagcaaactctctcttgggatcatggagcttctggggatgaccctaggagttggcagggaatgtttcagagatttcttcgaaggaaatgagtcggttatgaggttgaattactacccaccatgccaaaaacctgagttagctttaggaacaggacctcattgtgaccctacatccctaaccattctccaccaagatcaagtcgagggcctccaagtcttcgttgatggaagatggtactctgtcgctcctaaagaagatgctttcgttgtcaatattggcgatacatttatggctctatcgaatgggttgttcaagagttgcatgcatagagcagttgtaaacaacaaaattgtgagaaaatcacttgctttcttcctatgtccaaatagagacaaagtggtcacccctccaaaagatctaatcagcaacgagaatccaagaacatacccagatttcacatggccaagccttcttgaattcacacagaaacactacaggtctgacacagaaacacttgatgctttctcgaggtggctactagagaaaaacaactga

SEQ ID NO: 4097 - DNA, 348 bp, Glycine max var. Williams 82
atgatgatggcttcaaattaccctagaaagggactaaccctaacttcttcaaaggccatagctgatgcagcttcatggtactgtgcctttgttctcgtggcactcgtgctccttagcatgttcaaaggaagctccatcatgatgcttccaagtcatgccaacaaccaactcttgtcacggccgtgcgaggaaatctatgttgttggagaaggtgagacgcttcacacaatcagtgacaagtgtggtgacccttttatagttgagaacaaccctcatatccatgaccctgatgatgtcttccctggccttgttatcgaggttacacccttacttctacctagaaattaa

SEQ ID NO: 4098 - DNA, 531 bp, Glycine max var. Williams 82
atgccattttatgactacatctatggtaccatggataaggcttcagatcaattacatgattcagcaataaaacaagaggaagaaatcccagatgttgtgcacctagcacatctcacaactcctgaatggtggctttgtttgatgcggccagtaacagcttggtccatgatcctcacatgggtttatggtcaaacatttatcgtagaaggaaatcgttttgacaaactcaagctgcaaactagagcaatacccaaatacagtttccaagttactacaatccacaacaaggatgattatatttggttagttggggacgaattgactgaagaagaacaattaaaggtaccgaaaggagcattttttattccattctcgcaattcccaccaaggaaataccgtaaggattgctcctaccaatacaccccagcaatgctagttccaagtattcttgaaaatgttcattcttgtgaggtttgttcaaataatcttttctttgttcagttgattcagtttatatgtggttgtatgtga

SEQ ID NO: 4099 - DNA, 297 bp, Glycine max var. Williams 82
atgaaggttttagaatttattttggcactgattctggttcttgctgtggttcatgttcagccaaacctagctgttagggtattgaacatgaaggaacaactgaaccttatgtctctagacaagggtcctgtgaccccctcagggccttctacctgcacttacattcccggaaccggtggcaaaaactgcccccctttggaggaaatgaatgtcgcaggaaattacgttcagcaccacagtgatgaaacttatcctcgtctagttgttccatttggtgttgcaaccaatcaacattga

SEQ ID NO: 4100 - DNA, 561 bp, Glycine max var. Williams 82
atgaaggctagtgcagttgagtctagtgaaatttcaaaaggagcaccacccagaaaggggttgattagagggctctcgataatggactttattttgagaattgttgcagccattgccacactcggaagtgcattgggtatgggaacaactaggcaaacacttccattttccacccagtttgtaaaattcagagctgtatttagtgatcttcccacatttgtgttttttgtgacctccaattctattgtatgtggctacctagttctttcacttgttctgtcattcttccacatagtaaggagtgctgcagtgaaaagcaaggttctccaggtctttcttgacacggttatgtatggtcttctcacaactggagcctcagcagcaacagcaatagtctatgaagcacactatggcaactcaaataccaattggtttccattctgcagacaatacaaccgcttctgtaaacaaatttctggttcactcattggctcttttattgcagtagttctcttcatcatacttattctcatgtcagcaatatcaataagcaagcattaa

SEQ ID NO: 4101 - DNA, 297 bp, Glycine max var. Williams 82
atgaaggttctaaactttattttggcactgattctacttgttgctgtggttcatgttcagccaaacctagctggtagggttttgaacatgaaggaacaactgaaccttatgtctctagacaagggtcctgtgactccctcggggccttctacctgcacttatataccccgaaccggtggcagaaactgcccccctgtggaagaaatgaataatgtcgcaggaaacgctcagcaccacggtggtgaaacttatcctcgtcttgttgttccatttggtgttgcaaccaatcaacattga

SEQ ID NO: 4102 - DNA, 318 bp, Glycine max var. Williams 82
atgattatatatttttcgaattgtagttgcgtgactcagctagtcaacttaaagcaaatggaacagtggtggctaatgccgcacttggtcctccctctcctccccccaccctttccttcttttgccacccacctcccctctctgttgcatatcttgaaaattcttgtagaaatactagatctccttgtgaaaatccaacaaaatactccaataatagatcttaagaatcaaatcttgaacctaagatctacttgcaagaacctttattggagattacctagggtttactttgcctttttattttatttttgggcttga

SEQ ID NO: 4103 - DNA, 2442 bp, Glycine max var. Williams 82
atgacaatgcctcttactctaaggaataagctcaagactctttgtacttgtggtgatggctggtcttatgctattttctggcgctttcatccacgaaattctttgttgctgactgtggaagaagcatactatgaagagcatctgggagaagagattgccaacatgcatccacaggtccacttgctgggtgaaggaattgtaggtgaagctgctttcacgggcaagcacagttgggtgcactcagatggtctaactcatgattggaatttgactggccaaaatacttgtgaggatgattctgaattgcagcaacagttctcctcagggataaagactattgtggtcgtacctgtcaaagcatggggagtggtacagtttggatccagaaagaagatcttagagaaagtggaatttttggagcaaacacaaagcgtactcacagagatggatgatgatatgggtatgtttgacatgccgggaaatgcagttttaccactggattgtgaaaataatgatttaaatgggttcttggattccatttcttctgcaagtcccaacaattccttcccttcccaatataacacttatgaagaatcagtggctacattgcaaggagattcttcttatcttggtgaccaattgaaaggtaccatggaagctctagttgtattatcagatagggatagtgctgatgtgcttttgaagcctaactcttctacgaacaatttaattgccgaaaacccatattttggcgtatgtggtaacgaattatcttcttttgatttgttggagcaacaattggtatcctgtgtaagtgcacaagaagatgcagatgtgtgttttacaaatgaaaatgcatttgctaccagcgaacttctaggtcaggatttggcattgacctcattgtgcagtatggacagagggtcatttcaaggcaaattacaaaattcactcgataaccaatattcaactcagtccagtgttgtgacagatgttgatttttcctcgagtttaaatgcattgcatggactctctgagaacttagagcgagttgatatgtcagaagaaattttgaaattcagctccatggaagatctttgccagtggtttggtccttctcccaaggatagtatctgcaaagcagtaattgcattggataataccttttctgaatcaacagaatttaatcccacttcctttgatctggttggatctagttctttaaatgatatttcagtgacatgcctaactggacagaattccaactcagaggggaaagaaacatctgtagttatgcatagcactgaaaacgctctcttggataacctgaaacttgattttagctatgaccaagctgatgaatggtgggggaatatgcttacaccagtggtgagtggtgttactgatactggcttctctgaatgcatttcagagttgaatactgatatcccaactggcacccgaaagagattattctcagagttaggaattgatgagcttttgaggggtgaagcaaattacaatccttttaatagttcagaacttgagcatgagttattattacccaataagaggcagacagtagaatcttcatcagtgaatagaaattcaatacctttcaccaaccttcattggcctggtgtggctagagcagacttgacgcagacattttgtgacttagacagcgcaaacaatcttccgacaaagaaagataaattcccaaaattacaaacaggcatgtggaatgatgatagtcatagcattaatattgggaaggctgttccagtacaccctcaaaagccagaggaacccgcaaagccacccaagaagagggctagggcgggggagagtactcgaccacggccaaaagatcgtcagcagatccaagactgtattaaagagttgagaagactcattcccaatgatggaaagtgtagcattgattctttgttagaccgcaccatcagatacatgcttttcttacaaagtgtcgtcaagtattcagacaagctacaggaaccaaatgagcctaagcttattgaacaggcaaataaagtggttctaaaagacagtggtgcagcggatggcaaaaactgtggcattacatgggcatatgaagtagcacaccaaccaatgctatgcccaattatagttgaggacatgagtctacctggccaaatgcttatagagatgctttgtgaggagcaaggtttcttccttgagataattgacattattcggcatttcgggctgaatatcttgaaagccaagatggaaagaaggaggaacaaactatgggcacgctttattgttgaggcaaacaacagacacgtgacaaggatagatgtgtttttgtccctaatccgttttctacagcaaacaaacacctctggcattgattcttctaataagaattgcgacgttattgatgccaatatttag

SEQ ID NO: 4104 - DNA, 507 bp, Glycine max var. Williams 82; identical to SEQ ID NO: 3536

SEQ ID NO: 4105 - DNA, 771 bp, Glycine max var. Williams 82
atggttaccgcagatattgcgcgaacagtagtcggtatcataggaaacatcatctcgggctgcctcttcttgtctcccgtgccaacttttgtccgaatatggaagaaaggatcagtggagcagtactcagcagtgccatacctagccacattgatgaattgcatggtatggaccctttatggcctccccatggtgcaccctcacagcttgctggtggtgaccatcaacggtgcagggtgtgtcattgagatcatctatgtcaccctcttcttgctctactccgaccgtaccaagaggctcaaggtcttcctttggctcttcttagaactcgtcttcatcgccgttctaaccttcgtcacattcactctcatccattccgtcaagaagcgctctgccgtcgtcggaaccatttgcatgctcttcaatgttgccatgtatgcttcacccttgtcagtcatgaaactagtcatcacgaccaaaagtgttgaatacatgccgtttttcctctctctagcatcctttgggaatggcgtgtcttggactacttatgctctcatcccttttgatccattcattgctataccaaacgggattgggacaacattttctgtggctcaactaattctgtatgcaacctattacaagtctacgaagaagcaaatagcagcaaggaatgcaaaagaggtgaatctctcagaggtggttgttggtaacagtactgtccaagatcccaacaataacaagatcagtgctgctcccaatggtctttaa

SEQ ID NO: 4106 - DNA, 228 bp, Glycine max var. Williams 82
atggaacaacaggcccaaaggcaccacaacttatctgctctccagcaacattgtgctttttttgatcaagatcacaatggaatcatttacccttgggaaacttacatggggctgcgtgctattggatttaatgtcgttgcatctgttattttagctgttgttatcaatgctggattgagttatcccactcagcctgttaagtcatttttatttctcttttttccttaa

SEQ ID NO: 4107 - DNA, 2028 bp, Glycine max var. Williams 82; identical to SEQ ID NO: 3517

SEQ ID NO: 4108 - DNA, 1539 bp, Glycine max var. Williams 82
atggcactttcaacctttccaacggtgaacaagtgtacctctattggtagggaaaagcacacggtggttgcggacatggatggaactttactcataggtcgaagttctttcccttattttgctctcgtggcctttgaggctggtggaattcttaggcttttgttctatgtcttggcttcccctattgctgccttgctttattacttcatctctgagtccgcaggcattcaggttctcatctttgcctcaatggctggcatgaaagtgtcgagcatagagtcagtggcacgtgcggttcttccgaagttctacgctggtgatgttcaccccgagtcgtggcgcgtgttctcatcatgtgggaagcgttgtgtgctcacggccaatccgagggtgatggtggaacctttcttgaaggaatttttgggtgcagacatggttttgggcactgagattgcgagctataagggaagggcaactgggttgatttgcaagccggggatacttgttgggaagaagaaagccgatgctctaaagaaggcttttggagaggagaagccagatattgggcttggagatagacaaacagatgctcccttcatggctttatgcaaggagggttacatagtcccacccaaacccgaggtgaaatcagtgtcaacagacaagctgccaaagcccataatcttccacgatggaagacttgtccagaagccaacacctctcattgccctcctcacaattctctggatgcccatagcctttcccttagcatgccttcgcatggccgcaggttccctcctccccatgcacttggtctactatgccttttgggcccttggcgtccgtgtcataattaagggcaacccacccccaaaagtcacaaaatctaaccctaaccctaaccctaacaacaacaacgattctggggttctctttatatgctcccaccgcaccctgcttgaccccatcttcctctctgccgccctcggccgccccatccccgccgtcacctactccgtctctcgcctctctgagatcatctcccccatcaagaccgttcgcctcaatcgcgaccgtgcaattgacgccgccatgatcaagaaactcctccaagaaggcgacctagcaatatgccctgaagggacaacttgtagagaaccatttcttcttagattctcagctttgttcgccgaactcaccgatgaactagtccctgtggccatggtgaaccgcatgagcatgttccatggaacaactgcacgagggtggaaagggatggacccattttacttcttcatgaaccctagtcctgcttatgaggtcacttttttgaacaagttgcccaaagagttgacttgtggggcaggaaagtcaagccatgacgtggccaactacattcaacgggttattgccgcgactttgtcgtacgagtgcactgggtttacgaggaaggacaagtacagggcacttgctgggaatgatggggttgtggttgagaagggccatattttgaaggccaacaaagttatgggttgctga

SEQ ID NO: 4109 - DNA, 297 bp, Glycine max var. Williams 82
atgaaggttctaaactttattttggcattgaatcttcttcttgcagtggttcatgttcagccaaaccaagctggtagggttttgagcatgaaggaacaactgagccttatgtctctagatgataaaggtccggtgactccctcaggaccttctacatgcacatatatccccggaaccggtggcacaaactgcccccctgtgaaggaaatgaatatggcaggaaacgctcagcaccatagtcatgaaacttatcctcgtcttgttgttccatttggtgttgcaaccagtcaacattga

SEQ ID NO: 4110 - DNA, 975 bp, Glycine max var. Williams 82
atgccctcctcctcaacaatgcctctctcgccggaccctcccttcctctgcaccgaagacgccagcgaagtcacctccgaccaccaccatccaccgtcccccttcccggattccgacgaggccgccatcgccggactccttgacgccgagacccaccacatgccggaaaaggactacctccgccgctgccgcgaccgctccgtggacgtcaccgctcgcttggacgccgtcaactggatcttaaaggtccacgcattctacgagttttccccggtaacggcgtttctctccgtcaactatttggaccgttttctctctcgatgttctcttccgcaagaaagtggtgggtgggcatttcagctgttatcagtggcatgtttgtctctagcagcgaaaatggaggagtcccatgtgcctttcttactggaccttcaattgtttcagcccaagttcgtcttcgagcccaaaacggttcagagaatggaactatgggttatgtctaacctcaaatggagactccgctctgtcacccccttcgactatcttcattatttcttcaccaagctcccttcttcctcttcccaatccatcaccactgcctccaacctcattctcagcaccactcgtgtcattaacttcttgggatttgcgccgtccaccgtcgcagccgctgccgtgcagtgctccgccaacggccaattaccgctgagttttcatgacagattaaacagtgaaatggtgagatgctgtcaccaactaatggaggagtacgtggtggacacgtgtcccgcatccattaaagtcagaataaccgaggcggcggcgccgtccagccccgtcggcgtgctcgacgccgccacctgtgggagctgcgacacaccttccgagaggaattttgctggctcagccgaggaacaagccgagccgccaaataaacggcttcgatcctctgcctcggatgcaccccggcggtag

SEQ ID NO: 4111 - DNA, 1761 bp, Glycine max var. Williams 82; identical to SEQ ID NO: 3496

SEQ ID NO: 4112 - DNA, 996 bp, Glycine max var. Williams 82
atggcgtcctcactcccgctcctcctcctcctcctccccttcggcctcttctctttcggccgcgctcttcctcgcgaagccattttcgacgcctccgacgttctctccgattcagggtacgtttccatggcactgacgctcgaaattgttgccgaaacccttcttgagcagtccccttccgccaccgtcttcgccccctccgactctgccttcaagaaatccggccagccctccctcgacctcctccgcttccacctcgccccgctccctctccctccggcgagcctccgtctcctcaccgccggctccaggatccggacgatgctccctggccagactctcaccgtcaccacctcctcctccgacggcgtaacctcattcaacaacatcaagctcaccggatctcccatctacgacgacggtattctcttagtctacggaatcgatacgttcttcgaccctaactttcagtttaacattcaaggacctagtgataagtccgattcctcttgttccgcgaagaaccacaccgcgactgcctccgattccttcgaccaagccatccaaaccctaaaaaccgggggatactccgccgtggcctcgtttctcggaatgcagctctccggcgtggcggaccagagcgggatcacggtgttcgctccggcggacgacatggtgatgaaccgcatcggcgatttcggcgagtatccttcgttctttcgccgccacgtcgtgccgtgcaggctcctgtggaacgatctggtggatttcggcgacggatcggagctgcctacgttcttggagggattcgcaatcaacatcaccagatctgacggcgttttgattctcaacggagttcgggttttcttccccgacgtgttcttcaacgacagggtggttgttcacggcgttagtgatgttctggctgcacaggacaacgcgcttcgcattgatgttgatgatgaagaaatcctgtttgacccttctgaattttga

SEQ ID NO: 4113 - DNA, 1317 bp, Glycine max var. Williams 82; identical to SEQ ID NO: 3544

SEQ ID NO: 4114 - DNA, 1707 bp, Glycine max var. Williams 82
atgacgaccaagaagtggttaaacttaatcatagatggcaactcgaccttgggtccttattggccaaaaattgtttcagaatatctcgaaaagattgttaggaccttcattgacaactcaagagaagagggagctaatcatcattgtgaggtgggtctggttatgtataatgacaactccgacctagggtcgaacgtccaatatatccattggacaagagatgtggattattttttaggtatcctatcatgtttagttttcaaaggggatagtttaaatcaaaataccatggtagaaggcctagcatcggctctaacgttgtttccaaggccgtctaataaaatgacagcacaagaatactatgatggagaaaggcattgcattcttataacagctagagatcctattcctaagagaatgctagtctcggtgcctgagattcaaggaagatttattggcacaaaattacatactttaaaggcagatttttacgaagtggctaaaatgtttggttcgctagcagtatccctttcaataatttcaccaatccaacatccaatttttggagtgatattcaatatggggaataatgattcttcactagccaacactcccatctctgattgcagaaacgaacaatttattgtgttattatcaagaaattttagggaggcacattatgcccttcatgagaaaagaacaatggatccacccacaaaagaaagtgtagaatcacttaagacaacaaatgatattatacttgccatagattttgctgacgaccatgaagaagatctattctcaattatgatgactgggaagcaaatcattgaagctgacaaagatgaccgacttgtacatgatcctataagcctactgcccctatctgtcccgaatgcctcaaccggtgaagttggcatttcaactctaccaatggtaatatccacaacaccaactttcatagttggagaagggtctttgaaaggtgtagttggaggcaactcgggaaactgctcaacaagcacagcaattgctgtaggcatggctgatccaagggatgctccaccagctcaaaattccatgctccctcattcaattggaaatacattcgatgttcaaccatactcatcactatcaatgcttccttatgctagttctagtagcagaagtcgcccatatcttccattccaggtgattgggtttggtccacttggtagaattgcttttggaacaagcaccggggttcctcctgcaccaataacacctcaatttaatccttatgatttttggcctcccccatcatctcttacaaattttaatgactatttgctggaatgggagggatctttggctggaaaaattgtcaagaagaatcgtcaattacatctttgggtaaaggttctgaggaaagcaacatcgcccttgacgcttactattgagtggccaagtaggctagagatagccctatatttaccacagaaagctgttaatcatacagtaaagatttgtcgtggtcccgttgattacgtgttcttgtatttaaagcaatttgacaatctcgacttgcatgaccatctgaacaacaagaacctgagtgcgaaaattcatctcccttctcaaattttgatgttaactccaaccaaaagtaaacaccacttcataggaatagtcttccctggggataccatatttattgaacttctctaa

SEQ ID NO: 4115 - DNA, 1005 bp, Glycine max var. Williams 82
atggcaaacaagagaaaaagatgggaaggtcaaggagatcaaggaaacagtgaagaagggaacattgaattggagcaactaagggaagaagcagcatcaatggctgctgatatactcgttgctagaagagctaagaaacgttacattggtgtacgccaaagaccctcagggagatgggtgtctgaaatcaaagacaccatacagaacattaggttatggttaggcacttatgacactgctgaagatgctgctagggcttatgatgaggccgcgcgcttgcttcgtggcgccaacactcgcacgaacttcttttcttcacaatcttctcctaattctgttcctgctcttcctctaaagattgccaaacttctccttcttaggctcaaagctagaaacatggcctcttcatgtgtggttaccccttttcctagtaaccactatgaacccgaacccgagtcacatttttatcatcaaatagaagaatcctattatgggaattctttagatatggtaggaaatgggattgttgaacaaaattattattgtgctagttatagttcttctgccataataactacttgtgactttagttgtggtactaatgaagaaaattctaacctagagggtagtagtagggaggattcaagattagggtatcattgtgatgacaatgtttatgatcaaaacaaccagattgtgagtggtaaagagtttgaagactgtgatgctgggattagagatcttcagtttttggacactgctggatcattgagttgctttttttctccttttgagatagcagaagagatggtgggatcaatagaggaagaagagaaatatcgtgttgatgattcaccattaggtagagaatctttcaggatgaagtatgaacgtaaattctcagcttgtctttacaccctaattggggtgtctgagtgtttgagcctacaagttggaccaggaaatggaaaggaattggaaaaaaaaattgaggatggaaaatag

SEQ ID NO: 4116 - DNA, 1350 bp, Glycine max var. Williams 82
atgtctaacgttttagcatgttaccaactcctagaactcaatgtcatatccgcacaagacttagctccggtgggtcgttccatgcggacttatgcaattgcatggattgacccagatcgcaaactctccacccgggttgattctcagggtggaaccaacccaacatggaatgacaagtttgtctttcgagttgatgaagattttttatacgatgaggagtcagtaattacaattgacatctatgctcttcattggtttcgagacatccatgtgggcagcgctcaggtgctctcgggtgaccttttcccaccaccaacacaaccccaaaaaaatacctacaaatccacaggtatgcaatttatggggctccaagtccaaaggccctcgggtcgccccaaagggattttgaacatcggggcggctataattgacagctccatgcggagcatgcctctctacacacagaactccccagccgttggatacagtcatgacgatctcaataagccaagccatcaagccaagtcagagcttcggcgcacaaagagtgactccagctcaatgctcggctcggaagccatagctcctgagcaccaagccaaggctagaaagggaaaagcaagctcccaaattaccccttccgaagtaagcaccaagagtaaaaacaagaccagctccacattgagtgactcaaatgtgaaggcaaccccaaagaggggtaaattgggtagaaagaagacgaaaataacatctcatgactcacaaaacaacctcaatgcaaggctatatgttgattaccaagtaaagtccacgccaaagcgagagtttcaaaacactccctcgaggacttacaacaataacaacaataattataaaggtaacctgagagccactccattgcatgcatttgcggtgacaaacgcggcattagaatatggcaccccatatcggtcaaacttgggtcgtcgtccctttatgacggactctgaactgggtccgtcagcttcggaggttgcagcagtggtggcgagactaccgatcgaggagggagagaattctacggtgggagggtggagcttggatgatagtgtggaggggttgcaacctaaagtggagaggtggcaaacagagctgccgccggtgtatgacggcagcgagaggtcaaacatgacaacgtcaagcaagaaagggaagcattcacgtaggcaaacagatggtggaaatggcttgttctcttgctttagtgttatatgtggtgttgagtgctctattgtttgtggtggcggtgacaacaacaagaagaaccggcgccgccgggttcagtcagtggacaatgaaagctttctataa

SEQ ID NO: 4117 - DNA, 624 bp, Glycine max var. Williams 82; identical to SEQ ID NO: 3497

SEQ ID NO: 4118 - DNA, 264 bp, Glycine max var. Williams 82
atggcagctggtaataggcaaaggaaatcttcttcgggtttcttctctattttcaacatcttctcatcaaggaagcccagaggagggtactctgatgcccctgattcgtggcgcagagtctatcctagtgattacgacaaaggtaactggggtgttgctgagcccaatattgacatgaaagctgaagctttcattgccaagtacaagaaacgtgtttcagaatctgcactctatcaacttgatcccgctgctgaaaatgcataa

SEQ ID NO: 4119 - DNA, 684 bp, Glycine max var. Williams 82
atggaatctaaagagtccatctttgtgaagcttttgctgattctgcatttgtccgttctctgtgtttcacaggattttgatttctactactttgttcagcagtggccaggatcatattgtgacacgacacagaacagctgttgctaccctacaactggaaaacccgctgcagattttggcattcatgggctttggcctaattacaaagatggttcatacccatctaactgtgattcaaacaatcgttttcagccatctcagatatcagacctcactagtagcttgcagaggaactggcccacactagcatgcccaagtgggaatggggttcaattctggacccacgaatgggagaaacacggcacttgctctcagtcagtccttaaacaacatgactattttgaaacagctctcgatctcaagcagagagccaacctcctccaagctcttacaaatgctggaatacaaccagatggagggttttacagcctaagcagcatcaagggagctataaagaatgcaattgggtatactccatatattgagtgcaatgtggacacatcacgtaacaaccagctttaccaagtttacttgtgtgtggacacctcgggctctaacttcattgaatgccctgtgttccctagagggaaatgtggctcccaagttgagttcccaactttctaa

SEQ ID NO: 4120 - DNA, 294 bp, Glycine max var. Williams 82; identical to SEQ ID NO: 3533

SEQ ID NO: 4121 - DNA, 1200 bp, Glycine max var. Williams 82
atgagaacaatggctgcaactttctcatatccagcctctacctactttgtaaggtgttgttccatgagagaaaaccatgaccaggttaaccaccaaatgaacagcagcatcagaactaatgggagttttaggtccccggttaaagttgagtcactaagccaaacagcttcaaccatcaccactcttggtcaagctgttacaattggtgaaaatggtctgcgccaaaacatcccaacaaagaagcaattggttgatcctcatcgacaagggctcatcattgaaggtggagttggttatagacagactgttgtcattaggtcctatgaagttggagctgataaaacagccacacttgagagcatcctcaatcttcttcaggaaacagcattaaaccatgtttggatgtctggactgctcagtgatgggtttggagcaacacatggaatggtgaggaacaatctcatttgggttgtctcaagaatgcaagttctgattgattactatcccatctggggagaggtggttgaaattgacacatgggttggagcatcaggcaagaatggaatgcggcgggattggctgataagaagccaagccacaggccacatttttgcacgtgcaacaagcacgtgggtaatgatgaaccgcaaaacaagacgtctctccaaaatgccagaagaggtgagagcagaggtttcaccttggtttattgagaagcaagcaataaaggaagatgttcaagaaaaaatagtcaaattagacaaagaggcaaaatacatgaattctgacttgaagcccaagagaagtgatttggacatgaaccaacatgttaataatgtgaagtatgtaagatggatgctagagaccatcccagaccaaattctagaggagcaccaattatctggtatcacactagagtacagaagggaatgtggaagctcagatatagttcaatcactgtgtgaacctgaggaggatgaaatacttcatggtgtggtagaaccagattactgcacaaatcttctcaatgggttatcatcagatattataaatggtagtggagtcctaacttgccttgagaagaggccattaaggtatacacaccttctacaaaccaaaggagagaaacaaaacgacgaaattgtcagaggaaggactacatggaagaggaagatttctacaatgccattttccacttag

SEQ ID NO: 4122 - DNA, 588 bp, Glycine max var. Williams 82
atggccattttttcaagtcaccacagaatgttggtgtctctcttgcttacgttggtccaaatccaagccaaggtgttttgctatcaatacaaagtgggagatctagatgcttggggcatacccacatcagcaaatccacaagtctacacaaaatggtccaaatatcataatctcacaattggagactcccttttatttctatacccaccaagtcaagattcagtgattcaagttacagaggaatcctacaagaggtgcaacattaaagacccgatattgtacatgaacaatggcaactctttgtttaacattacatcaaagggccaattcttcttcactagtggtgagcctggccattgccaaaaaaatcaaaagcttcatatatctgttggtgaaggaataatagaaactatggatacagcacctggtccaagttcgtcattgcctgcatctgcaccctcctatcccacagtatttggcaatattccagtagctccttcaacctcaacctcacctcaactcacatcaacttttcaacttctcatcattggatttatgatatgtgcgcacttcgcttccttaatgtga

SEQ ID NO: 4123 - DNA, 1584 bp, Glycine max var. Williams 82
atgctccatttcccgctcttgttcagttcagaatattgtttgttttccatggatcaatattgcttaccagcagattcttcgaacgcttactggcttctcctccaagttctctctcttatccctctctggcactaccttctccttgcagccttcattctcttctccattctctacaacttcctcgagctctatttcctccaagacctcttctccggattctcaggctcccctgtgcttctctcctacaacacttcctctagcattctcaacgccgtcgtttccaagtgcaagattcttcacggcagatatttcgccacgccctggctctgcagccctcacctccagactcttttcttgaactacttcgggaggcctcctcctttgaaatacaccaagcaattatttagcactgctgatggcgaaaccattgccttggattggctatccacttctcatgtttctggtgatgttgcttctgaagatgaatctgttcccattgttgtagttattcctggcctcacaagtgactcttcgtctcaatatatcaaacatcttgcgtatcacactgcaaagcgtggatggaaggttgttatctgtaaccaccgaggttttggaggtgtttcaatcacgtctggtttttcctacaatgctggatggactgaggatatccgcgcagtggttaattatctccataaagagaaatccatggcacctctgtttgttgttggaactagtattggagctaatattctggttaaatatcttggtgaggatggtgagaatattcctgttgccggagctgttgctgtttgctctccttgggaccttttgataggggacagatatatacgccgtaggcgtgtgcagaaaatttatgacaaagcgattgcatttggacttcaagattatgcaaaattacaccagtctcacttttctcgcaatgctaattgggaaggaatagaaaagtcgtttactgttcgggattttgatgaccatgccacccgtgttgttgctaagtatgagagtgtggatacgttctatagacgctgcagtagttctacttatgtgcaatctgtttccgttccgcttctctgtattagtgctttggatgatccaatctgtacaacggaagccattccttgggatgaatgcaaggcaaataaaaatatagtgttggctactgtaaaacatggaggacatcttgccttttttgaagggataactgcatctcatctttggtgggtaagagctgtaaatgaattccttggtgtactgcatagtagcaattatatgcatgtacaggagaagatttctaaaccaaacataccattggactcgtcaattgatcatggccgttattttaatgtagctgaagatggaatggtggctgaattgaacaatgaccaactgacaatgtggaagaaacacattgataaacatgaggttgtcaagagtggaaacaagctgggattcttcagttggttcgggttcttctggcaatatgaactccaccacaatcaccttcccatttggagacaatgctttgtgacaattcctcagaaattctatgcatttttcgtctga

SEQ ID NO: 4124 - DNA, 675 bp, Glycine max var. Williams 82; identical to SEQ ID NO: 3461

SEQ ID NO: 4125 - DNA, 201 bp, Glycine max var. Williams 82; identical to SEQ ID NO: 3540

SEQ ID NO: 4126 - DNA, 1587 bp, Glycine max var. Williams 82
atgctctcacgtttccaatgccgatcacaacaaatcacaatgcagcaagctccaaccacactcaccggattgctccatcgcgtcgccggaatattcccctcccgccgcgccgtctccgtctccggcaagttcgacctcacgcactcccgtctccaccacctcgtcgaactcgccgcctcgcgcctcctctccgccggcatcaaacccggcgatgtcgtcgccctcaccttccccaacaccgtcgagtttataataacgttcttgggccgttattcgagcgcgagccacggcggcgccattgaacgcggcttacacccgccgaggagttcgagtttttatctatctgactcagattcaaagctgttactaacctcaaaagaaggaaacgagccggctcaagccgcggcttccaagcttaacattccgcacgcaacggcatggctcgcggaagccgaggagctgagtctctctctgagttccaccgagtcagcaatcgactcggtctccgaaatcgccaacgacgcttccgacgtggcactgttccttcacacttccggcaccacgagccgccccaagggcgtgccgttgacgcagcacaatttggcctcttccgtggagaacatcaagtccgtgtacagactcactgagtctgactcgaccgtgatcgttctcccgttgttccacgtgcacggcctgctcgcggcgctgctcagttcgctagccgccggagccgccgtggttcttccggaggcggggaggttctccgcctccacgttctggagcgacatggcgaggtacgacgccacgtggtacaccgcggttcccaccgtgcaccagatcgtgctggagcgtcacttaaaaaacgcggaaccggtttacccgaagctccggtttatccggagctgtagcgcgtcgcttgcaccggcaatattggaacggttggaggaggcgttcggtgcaccggttttggaggcgtatgcgatgacggaagcctcgcatttgatgtcgtcgaatccgttgcccgaagatgggcctcaccgagccgggtcggttggaaagcccgtgggccaggaaatggtgatattaaacgagaatggtgagattcaaaagaatgaggtgaaaggtgaggtttgtattagaggacctaacgtgaccaaagggtataaaaacaaccctgatgcgaatgattctgcgtttcaattcgggtggttccacactggtgatatcgggttttttgattcggatgggtatttgcaccttgttggtcgcatcaaggagcttattaaccgtggaggggagaaaatatcaccaatagaggttgatgctgtccttctatctcatccagacattgctcaggcagttgcattcggagtaccagatgacaaatatggcgaagagataaattgtgcaatcatcccaaaagaaggatcaaacattgatgaggcagaggtgcagagatttagcaagaagaaccttgcagccttcaaagtccctaaaaaggtcttcttcactgattctttgcccaagactgcaactggcaagattctaaggcgtcttgtagcagaacactttgtttctcaaacttga

SEQ ID NO: 4127 - DNA, 2346 bp, Glycine max var. Williams 82; identical to SEQ ID NO: 3522

SEQ ID NO: 4128 - DNA, 2457 bp, Glycine max var. Williams 82
atgggttctagaaaccttgttatgctcaaaacacacattggttcaatcaatttgtcttttgctaatggttttgtgtatgaaaacgtgctttgggccttggcttctctttgggttttcttctgcaactatgtcatgtattacttggggttgattctcagatacatcttcagatttcatgtagaagataggaaaagtgagcactttgttccacatgatctgcttgatcaaaccaagagaaatcagactgaagatcctaaggttgatggagtcgcacaagagttggcaaatttgttatttccgatctttgaaaattttcatgtagcaattgatgaaagagaaggagaaacagagtgccctgttttattggaggtagactctgatataaaaattcatcaagatgctaggaaattagaaggagaaacagattgctctgttttaatggagatagactctgatgttaatgaagatgcaaagaaattggtaggagaaacagagtgctctgttttaaaggagaatgactctgatatgcatgaagatggtaggaaaagagaaggtgaaacagatgagtctgttttcctgaagagtgttgcatatgttcatgaagatgttaagaaaattggtgaaaatgaaacagagagctctgttttcttggagggtgattccaatttttctcaagataatagggagaaagttgaagaagaagaaacagaagagtctatcttcatagatacttactttgttgaagctagtagtttggtagaagaaccaaggatcttgaccttcactttccaacaaaattatatagctgcaaatgcttcttataatgcattttccagcactcaaaatattgctaaaatggaatttcatgagaagaatttggagaaaacccttgttgctcaagaagaagagaatgagcactgtgttctagaacagagaaacatcacatccaattccacttccggtcaaatctttcaaattaatgcggttggtagaagtgactcatcggatgatgatcacgttcgacacgatggtgacgcatttcaatctgattttaggtcagaatcatgcagcggcagcattgatgattcgttaaaacatcgaattccgagttctaaccattcttgtgaaggatttgattttgtaagtcataaagatgaaagagttgaagacattgaggaaactcaatattcatgtgaaagtgaagtctcaaacagtcagaaaacaaaagaaaccatgtgggaagataacttggatgaatcagattttgatgaagcagaggatgaagatgaagatgattttgagtgggagcatgatgaggtagtggaacaattgagaatggaacttaaaaacgcaagacaaggagggcttgccactattttggaagaggaagaagaagaggaaacagagtctccaaaaaatgttgaggatctaaagccattgaagattgaagagaagttagaattcaaggatcacattattgaaattcaaaaggtttataggtgctatgcagagaaaatcaggaaacttgatgttttgaattaccagaccatgcatgcaatagggcttcttgaactaaaagaccctctaaaattaatgtcaatcccaaaatcaaccgtccaaagtgcaaaacctctatctcagaatttgtggccacgcaaagcacaaaagcaaatatctgacccaatattgaagtttgtccaagaactgcatggagatttggaattggtgtacgttggccaggtttgcctctcttgggaaatattgtgttggcaacacaagaaagttcaagagttgaaacaatatgattcacaatggccacgtagctataatcttgtggctggtgattttcaactttttcaagtcctcatgcaacggtttttggaggatgaaccatttcaaggcccaaggattcagaattatgtcaagaaccgttgtgttattcgcaacttgctccaagttccggtcattaaagatgataatacgaaggacaagaaaataattaagttgggtgaagagcatgcaattgatagtgaaaggttggcacagatcatcaaagagtccatgcgggtgttctgggaatttgttagagcagataaagattatgggaatgtgatcaaaatttctcatcaaataggagttgatgtcaaagacccagcaatttcagatcttcttgggaatgttcgaacccaattgcaaaagaaggagagaaagctcaaggatatagtgaggagtgggaattgcatagtgaggaagttccaaaagcaccatgaggaacaaattcaacttgatgaagaacagttgcttgctcaagtaggattaagattggtgtcaagggtgatgcacatgaaaaaattgagaaaagatcaactaatgtggtgtaatgaaaagttgaacagaatcaaattcgatggcaggaaggtccaagtggagccttcttttttgttttttccttgttga

SEQ ID NO: 4129 - DNA, 981 bp, Glycine max var. Williams 82; identical to SEQ ID NO: 3538

SEQ ID NO: 4130 - DNA, 1710 bp, Glycine max var. Williams 82
atgtcaggagagcaaatcttgtcatccaatgaagaatataataaatctcagcctccatttggtagcaagagtggttacgattcaagaacaggcatctatcactctctaattaagcttgtcaccaagcatgaaatcccaacaaggcctgatcttaacactgccaattttgtgctgtcacagttcccacagacacaccttgctgaggcaagaattgcattcattgattcaggtactagtaggagtgtaagctatggtgagctaaaaaggtctatttactcccttgcatcagctttgttccatggacttgagattaggaaaggtgatgttgtatttgtattgtcaccaaactcaaccttgtactcagccatatgcctagctgttttatcagttggagcagttcttaccactgccaaccccatcaacactgcaacagaaattgcgaagcaagtgcatgattcgggtgctaaactagccatctcagcacctgaggagctacacaaattggtcccaactggggttcctataattctcacttctcgtccttctgatggcaacatgttatcagttgaagagttaatagaaggctgttgtacttcaccagagttgcctcaagttcctgtggcacaatcagacactgctgctatactttactcttcaggaaccacaggggtaagcaaaggtgtggttctgacacatgcaaatctcatttccataatgagactactcttttggtctgctgatgtaagtggatcccaagatgatgttttcttggccttcattccaatgtttcacatctatggacttgtgttctttggattaggattgttgtgtgttggtgtcacgacaattttgatgcagaaatatgacttccaaggcatgcttgatgcaatccagaagcacaaggttaacaacatagcagcagtgccaccagtgatccttgcactagtaaaacaagcaaagaaaactaggtgtgacttgtccagcctaagaagggtggggtcaggtgctgcacctttgagcaaggaagtggcacaagagtttagaaggatgtttccttgggttgaactaaggcaaggttatggcctaacagaaagtagtggtggagcaacattttttccctcggataaagatgctaaagctcatccagattcatgtgggaagctgattccaactttttgtgcaaaagttgtagacatcgaaacggggaagcctttgcctcctcataaagagggagaattatggttcaaaagtcctactattatgaaaggatatctaggaaatttggaggcaacaagtgcaactattgattcagaaggttggttgaagactggtgatcttggttacattgatgagaagggatttgtttatatagttgaacgaataaaggagctaatcaagcacaatggttatcaggtggctcctgcagaactggaatctgtgctgctaagtcatccccttatagttgatgcagcagttataccggttgaagatgaagaaactggacagataccaatggcatatgtggtgagagcagctggttctgaactctcagaaaaccaagtcattcaatttgttgcaggccaggtggctccatataagaaagtgagaaaggtgagtttcattgtcactattccaaagtcagctgctggcaagatattgcggaaggatcttgtttctcaaagcaaatatcaacttgtctccaagttatga

SEQ ID NO: 4131 - DNA, 855 bp, Glycine max var. Williams 82
atggagtattacaaaatccagttagtggtcatagtgtcactgatgattgtgcttccaaacacacaagggtggggagaagatgggcatgccataatttgtaggattgctcagtctcgcctcagcgattcagccgcaaatgctgtgaaaaacctgctaccagaatatgcacaaaacgacttaggaaatgtgtgctcatgggctgatcgtgtcaggttttatttgcactggtctgctccattgcactttgctgatacacctgacaacctttgcaattatcagtatgacagggattgcaaggatcaggatggagtgaagggaagatgtgtagtgggagcgattaagaactacactgatcagctcctcgactatggcaaaaacactcaaaataacctcacacaggctcttatgttcctttctcattttatgggagatgtccatcagcctctacatgtgggctttacctcagacaggggagccaattcaattaatgttcactggtacacaaggaaacaaaatcttcaccatgtttgggatgttaacataattgagacagcagaagaaagattctatgactccaacatagacgagttcaccaatgccattcaagagaatattacgaaaacatggtccgatcaagtactaggatgggaaacctgcgattctaaggagactgcatgccctgatatatacgcgtctgaaggagttcaagcagcctgtcaatgggcatataaaggtgctcccgaaggttcagtgctagaagacgattacttcctatcacgtttgccagtggtcagcttgcgattagctcaaggaggagttcgactggctgcaactctcaatcgtatttttggttga

SEQ ID NO: 4132 - DNA, 2028 bp, Glycine max var. Williams 82; identical to SEQ ID NO: 3516

SEQ ID NO: 4133 - DNA, 1143 bp, Glycine max var. Williams 82
atgaagggggtgaaaggaaaattcctgaagaagctcaaatccatcaaaccaatcctgaagcaagagcgaattctccagcttaaggcctcagatgggtacgtcgattttctcccaaagattccgagtttcaatctgcattccccgtttgtttcccgagaaaacaagcccgagaaagttgttcagaggtgcgagaaaatgcaggatgaacccgaggtcatcgacgtggcagagctgatgaaagaccttgaagaagaagaagatgatgaaatggatttggatgattacaatgacaacaaagagaacataggtccatgttctcagaaaccccaacaacaccacaagggtgttttgcagaatgggaacagagcaaaaacagagccaaaacagagaggggttttggaggaaaaatggtcttcacctgcaaaagctgcaagtaacagcaacagaaaaaccccttcgttagagactgatattccatcgttccggcggccggacttgaactccggcagcctattcgatccgaatctactggcggcgttcgagcatgccgtgaaggaacatgctagaatgacagaagaacagaggagagccagagtcgaagaagagtcttcacagaaagtggaagatgatgaccctgaccctgaccctgaccctgaccctgatcctttgatgttctttgaagagaagtgtccacccgggggcgatggcacagttattttctacaccacgacgcttaggggaatccggaagacattcgaggactgcaacaaaattcgcttcctcctgcagagtttcaaggttttgtattttgagagggacatttcaatgcacaaggaattcaaggatgagttgtggagcagtttggaggggaaatcactgcctccaaggctttttgttaaggggaggtacattggtggagcagaagaagttttgagtttgcatgaacagggaaagctgaggaaaatcttagtaggggttccaatggattattctaatggtccttgtgatgcatgtggagggataaggtttgtgttgtgcttcaagtgtaatggaagccacaaggtcgtggaggaaaatggagagagcaatcagtgccttcagtgtaatgagaatggcttgattgtgtgcccttactgctgctag

SEQ ID NO: 4134 - DNA, 1065 bp, Glycine max var. Williams 82; identical to SEQ ID NO: 3473

SEQ ID NO: 4135 - DNA, 648 bp, Glycine max var. Williams 82
atggagtatttacgtttaagtctgtttctgtgcatgctgtcactgtcagcgacttcgccttcttccttcgcatcgccaaattcgatccgtgccgattatgccgttaatctgaacgcaacgaacttcgatgctgttctcaacgatacccccgctactttcgcccttgttcaattctatgcccattggtgccctgcatgcaggaattataagcctcactacgaaaaggttgcaagattatttaatgaacctgatgcagtgcatccaggaataatattaattacaagggtagattgtgggttaaagataaatactaagctctgtgataagttttctgctgatcactatcctatgctcttttggggttctccttctaaatttgttggtggtggttgggaacctaaacaagagaaaagtgatatacgtgtgattgttggtgcacgcacagctgatcggttgcttgattggatcaacaagcaaataggcagttcattcggcctggatgatcagaaatttcaaaataagcttccttcatccaatgattcagacactgtacagattgcaagagctatctacgatgatgtagaagaggtaacttctacaggttttgacatcatcatagagcaccaggaactcgtgcttcacttataa

SEQ ID NO: 4136 - DNA, 630 bp, Glycine max var. Williams 82
atggcatcatctcagtcgaggaagagagttgacgccgtcgattctcgcgctgcttccgttctcgttcgcgccaaagatggcagtgcttttgctcgttgcgacgattgcaagaagaatgtgccggttgcactcatcgacatgcacagttgcagccttgaagctaaaattaaaatgaacctagacgctcaagttgtggaacaggctgctgaagctaagaagccggagaggaagaagcccaaatctaaagagcctatggcaaaaaaagctaaagttgggaaggggaagaaagtcaaggatcctaacatgcctaagcgtcctcccacagctttctttgtcttcttggatgattttagaaaatctttcaaagaagctaatcctgattctaaggatgttaaaagggttggtaaagaggctggtgaaaagtggaggtctatgactgatgaagagaagaagccatatcttgacaaagttgctgagcttaaggaagagtacgagaaggctatggaaagctatgaagctggtcaagatgaagaagatcaaactgtgtctgataaggaaacttctgataaggaagctgctgcaaaagaagttgcaatagaagttgaagaggagctaactgacgaggactaa

SEQ ID NO: 4137 - DNA, 1089 bp, Glycine max var. Williams 82
atggatggaggcagtgtcacagacgaaaccaccacaaccagcaactctctttcggttccggcgaatctatctccgccgcctctcagccttgtcggcagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgccagagcctacgacatcgccgcgcatcgcttccgcggccgcgacgccgtcactaacttcaagcctctcgccggcgccgacgacgccgaagccgagttcctcagcacgcattccaagtccgagatcgtcgacatgctccgcaagcacacctacgacaacgagctccagcagagcacccgcggcggcaggcgccgccgggacgccgaaaccgcgtcgagcggcgcgttcgacgcgaaggcgcgtgagcagctgttcgagaaaaccgttacgcagagcgacgtcgggaagctgaaccgattagtgataccaaagcagcacgcggagaagcactttccgttaagcggatccggcggcggagccttgccgtgcatggcggcggctgcgggggcgaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaa

SEQ ID NO: 4138 - DNA, 2289 bp, Glycine max var. Williams 82
atgtttctaatcactctttggcttttactatctcaccatgccaacgctgaaagttccacgtatattgttcacatggacaagtccctgatgcctcaagtctttgcaagccatcacgattggtacgaatccaccattcattccataaacttagcaacagctgatgatccctctgagcaacagaaattagtgtacacttacgatgatgcaatgcatggattcagtgcagtgctatcatcagaggagttggagaccctaaagaacactcatggttttgtcacagcttaccctgatagatctgccaccatagacaccacacacacctttgagtttctctcttttaatccctccaatggcctgtggaatgcttcaaattttggagaaggtgtcattgtgggtatgattgacacaggtgtctggcctgaaagtgagagcttcaaagatgatggcatgagcagaaacatcccttccaaatggaaaggaacatgcgagccaggacaagacttcaatacctccacgtgtaacttcaagttaattggggctaggtacttcaacaagggtgtgaaagcagcgaatcccaacatcacaataagaatgaactcagcgagagacactcggggacatggaagccacacatcatccactgttgctggcaactatgttaatggtgcttctttctttggctacgccaaaggggtagcaagaggcattgcaccaagagctaggcttgccatgtacaaggtcctttgggacgaagggggtcacggctctgatgttcttgcaggaatggaccaagccattgctggttgccatgtacaaggaatggaccaagccattgctgatggggttgatgtcatttcaatctcattgggctttgatagtgttccactttatgaggatccggtggcaatagctgcttttgcagcaatggaaaaaggggtgttggtttcatcttcagcaggaaacgcaggtcctatacttggcaccttgcacaatggaatcctttgggtcttaaccgtggcagcaggcaccatagaccgcacatttggaagcttgacactgggagatggtaaaatcattgtgggttgtaccttgtttgctgctaactcaatagtggagaagtttccacttatttacaacaagactgtatcagcatgcaactcggttaaactattaaccggagtagccacaagagagatcattatatgtgatgccttggactcagtttctgtcttaacccaaatagcttctgttaccgcggccagtgtgtatggggctgtgtttatctctgaggatccagaactaattgaaagaagacgtttgttcactccaagcattgtgatcagcccaaatgatgcaaaatcggtgatcaagtacgcgaaaagtgctcaaaaaccatttgccagcatcaactttcaacaaacatttgttggaataaagccagcaccagctgttgcaatttactcttcaagaggtccttcaccaagctacccggggatcttgaagcctgatgtaatggcacctggctccaatgttctggctgcttttgttccaaataaaccttcagccagaattggcacaaatgtgtttttgtcaagtgactacaatttcttgtctggaacatgcatggcatgtcctcatgcatctggtgttgctgctcttttgaaagcagcacaccctgattggagtgcagctgctataagatctgcattggttacaactgctaatccccttgataatactcaaaatccaatcagggataatgcaaacctatttcaatatgcttctcctcttgctatgggagctggtgagattgaacctaatagagcacttgatcctggtctcatatatgatgccacccctcagaactatgttaacctcctttgtgctttgggatacacaaacaaccaaatcttatccatcacaagatcaaggtcctatgaatgttctgccaacccctcatctgatcttaactacccttcgtttatagttttgtatagtaacaaaacaagatcaacagtccgagagtttaggaggatcgtgaccaatgttggagatggtgctgctacttacaaagtcaaggtgacacaacccaagggctctgttgtcaaggtgtcacctgagacattggcatttggctataagaatgagaagcagagctactctgttactgtaaagtacacaagaaacaagaaagaaaacatctcatttggggacattgtttgggtcgaagatggtggtgcacgcacggttagaagccccattgtagtggcacccaatgaacttgcatga

SEQ ID NO: 4139 - DNA, 390 bp, Glycine max var. Williams 82
atgccaacgaaacaggtaacctaccgcaatgataaagtggtgctagtgaaggtatatgttgaaaagcctagaaagaagagctcatcatcaattcagcatcatcaccttcattatcacattcatcacacaattagacaagaggtagttcacggctctggtagcaagggatcatatggtagaagagcagggttgcttatgtactcgcatctcctacgtgaatctgcaagaggagcatcatcaacaccctcattctccaagtgggttgcaaacaacaatttccagcctccaacccagataaccccttccaacaagaaaaagccggagtatagggaaaagtcaacttgctttggcagtttgaaactactgattccaaggttcttaaggtcatga

SEQ ID NO: 4140 - DNA, 2316 bp, Glycine max var. Williams 82
atgttcaaagcacaccgaactaaagaagctttgcttccatttccgtcgagcagaaagcttctgctgaacatggatgctttccttttcattgttttcactttcgtgttgagcttccaaactcattttgctcaaggaagtgaactacctcgtaccacaagcagttcaaaaacatatattatccatgtgaaggggccacaggataagtcactagatcaaacagaagatttggagagctggtaccattcattcatgccacctactattatgagctctgaggaacagcctcgaatgatttattcatacctcaatgtgatgagtggttttgctgcaagactcactgaagaagagttgatagctgtggaaaaaaaggatggcttcatttctgctcgtcccgaaaggatactgcatcgccaaaccacaaataccccacaatttttggggctgcagaaacaaacgggattgtggaaagaatcaaactttggaaaggggataataattggggtgttggatactggaatcacgcctggtcatccttcatttagcgatgcaggaatgtccccgccaccaccgaaatggaaagggagatgcgaaattaatgtgacagcttgcaacaacaaactaattggagtaaggactttcaaccacgtcgcgaagttgattaaaggagcagaggcagccattgacgattttggacatgggactcacacagcaagcacagctgctggtgcttttgttgatcatgcagaagtactaggaaatgctgaaggcacagcatcagggattgccccttatgctcacctggcaatttacagggtatgctctaaagtctgtcgagagagtgatatattggctgcattggatgcagctgtggaggatggagtagatgtattatcaatatccctcggctcgaaaagggcaaagccttttttcgatcatggcattgctataggcacatttgcagcaatgcagaagggaatttttgtaagttgtgctgcaggaaacgatggccctctccctggttccgtaattaacggagcgccttggatcctcacagttggagcaagcaatatcaacagaagcattgcagcaacagcaaagctaggaaacgggcaagaatttgatggtgaatctattttccagccttctgatttttctccaacattgctacccttggcatatgctggaatgaatggcaaacaagaagatgcattttgtggtaatggatccttgaacgatattgatttcagaggcaaggttgttttgtgtgagaaaggaggaggcatagaaaaaattgccaaaggaaaggaagtaaagagagctggtggtgcagccatgattctcatgaacgatgaaaagagtggctttagtctcaatattgatgtacatgttcttcccacaacacatgtaagctatgatgctggacttaagattaaagcctatatatactccaccgcaacacctacagctaccattttattcaagggaactataattggaaactccttagctcctgttgttacatccttctctggaagaggtcccagcttgccaagtcctggtattttgaaaccagacatcataggaccaggcttgaacatcctagctgcctggccattccccctgaataacaatactgcttcaaaatccactttcaacattatgtctggcacatcaatgtcatgcccacatcttagtggcgtagctgctttgctcaaaagctctcatcctcactggtcaccagctgccataaaatctgccataatgacttctgcagacataatcagtcatgaacggaaacacattgttggtgaaacacttcaacctgcagatgtctttgccacaggttcaggttacgtgaatccatcaagagcaaatgatcctgggttagtttatgatatcaagcctgatgattatataccttatctgtgtggtttaggctataaggatacagaagttgagatcattgcaggtagaacaattaagtgctctgagacttcaagcattcgcgaaggagagctcaattatccctcattttctgttgtgcttgattccccgcagacattcacaaggactgtgacaaatgtgggtgaggctaactcatcttatgttgtcacggttagtgcaccagatggggttgatgtgaaggtccaaccaaataaactttacttttcagaagcaaaccagaaagagacatattcagtgacattcagccgtatagagttggatgatgaaactgtgaaatatgttcaaggatttttacaatgggtctctgccaaacacactgtaaggagccctatctcgatcagctttgtataa

SEQ ID NO: 4141 - DNA, 2349 bp, Glycine max var. Williams 82
atgcctctctcacactctccttccccttccatggcgccaagcctaaccgccaagcaagaagcggcgcttctcaacgctaatccacacttatccataaaactccaatcctcaactttcttcgctaacaaccacccaatcctcacccaagtcccacctaacataacaacaaccactccaccgccccacgatgcttccaccacccccgccggatgcttcgtcggtttctccgccgacgaggcacgcagccggcacgtgatctccctcggcaaactgaggggtatcagattcacgagcattttccgcttcaagctctggtggagcacccactggtccggcagcaacggccgcgacgtggagaacgaaacccaaatgatgatcctccaaaacgacgccgtcgagggccgaccctacgtcctcctcctcccactcctcgaaggacccttccgagcctcgctccaacccggcctccacgacgacgtggacatctgcatggagagcggctccgcacgtgtcaccaagtcacgcttccgaacctccgtctacatgcacgtgcacgacgatccttttactctaatcgacgaagcgctgaaagtaatccgagtctatctgggaacgtttaggttaatggaagagaaaaccgtgccggggattattgacaagttcgggtggtgcacgtgggacgcgttttaccttaacgtgcacccggagggggtgcgggaaggaattaagggcctggtggagggagggtgtcctccggggttggtactgatcgacgacggttggcaaacattttgccgtgacgacgaaaccgtgagcgacggggggagtttaaattgctctgtgccgggggagcagatgctgaataggttgataaaatttgaagagaatggcaagtttaaggagtataagtgtgggagggagggtaataagggtatgggtgcgtttgtgagggagttgaaggaggaatttagtgggttggagtatgtatatgtgtggcatgcgttttgtgggtactggggaggggttaggcctaaggtgccggggatgccggaggccacggtggttccgaccaagttgtctcccggagcggagatgactatgacggaccaggcggtggtgaagatcatggagattggggtggggttggtgccaccgcatcgggcgcatgagttgtacgaggggcttcactctcatctggaatcggtgggaattgatggtgtcaagattgatgtcacgcatattctagagatgctatcggaggaatatggtggtcgtgtcgaactcgctaaagcatattacaaagcactcactgcttccgtgaggaagcatttcaaaggcaatggtgtcatttcaagcatgcagcagtgcaatgatttcatgttccttggtacggaaaccatatcacttggacgagtcggtgatgatttttggtgcacggacccagctggagatccaaacggtacctattggctgcaagggtgtcacatggtgcactgtgcttacaacagcttgtggatgggaaatttcatacacccagattgggacatgttccaatctgatcatgcttgtgccgaattccacgctgcttctagagccatttctggtggaccaatttatgtaagcgactctgttggaaaacacaacttcaagttgcttaagaagcttgttctacctgatggctccattttgcggtgtcaacattatgcacttcccacccgagactgcttatttgtagatcctttacatgatgggaaaacaatgctcaaaatttggaacctcaataaatgttccggggttttgggtctgttcaattgccaaggaggaggttggtgccctgttactaggcgaaacaagagtagctctgactattcacactccgtgacttgctttgcaagtcctcaagacattgaatggggcaaagggaagcacccagtttgcatcaaaggggtggacgtatttgctgtgtacatgtttaaggacgacaagttgaagctgctgaagtacacagagagtgtagaagtttctcttgagccttttagttgtgagcttttgaccgtttctccagtggtgatcttacccagaaaatcaatccaatttgccccaattggattggtaaacatgctcaactctgggggctctattatgtcattggaatttgatcaacaggaaaatttggcgaggattggggtgagaggacatggggaaatgagggtatttgcatcagagaagccagagagtgtcaagattgatggagaatctgtggaatttgattatgttgatagaaccgtgaggctccaagtctcgtggccttgttcttcgaggttgtccgtagtcgagtatttgttctga

SEQ ID NO: 4142 - DNA, 1473 bp, Glycine max var. Williams 82; identical to SEQ ID NO: 1122

SEQ ID NO: 4143 - DNA, 261 bp, Glycine max var. Williams 82
atggaaaactctagcctccgaaacattgccttcgttctctttttgtttttgattttgcaccaccaagttctctttgtccaaggtaggaacttgaagtgtccgttgtgcaaagagtgctccaaatctcaaaaaaacaccatgagtgtagcttcttatgaggtgcaccaagaagggttaagacgcgtagaatatgaagtggacgattttaggccaacaacgccaggccatagccctggtgttggtcactccatcaacaattaa

SEQ ID NO: 4144 - DNA, 2064 bp, Glycine max var. Williams 82; identical to SEQ ID NO: 1111

SEQ ID NO: 4145 - DNA, 2028 bp, Glycine max var. Williams 82
atggctggaggaaagagaattatcagtaaggctattgttgaatcatctgttactcgacgtgaaactgacccatctgaagaacagcctcagcctcttgctattgttgcaccaattgtgtcctcttataatgagaggatacgtccagttcttgatgctatggaaaatctcaggcgccttaacatttcaaaggagggaattcagcttccttccattgttgttgttggtgatcaatcttctgggaaatcaagtgttcttgaatctcttgctggtatcaacttgccacgtggccaaggcatttgcactagggtgcccttggtcatgaggctccaaaaccacccttttccaaccccagagcttatgttggagttcaatggaaaaatcgtctccactgatgaagcaaacgtttctcatgccataaatgctgccacagaagagcttgcaggccatggtaaagggatttccaacaaccctttgactttgctggtgaagaagaatggtgttcctgatctcacaatggttgatcttcctggtataactcgggttccagttcatggtcaacctgagaacatttatgaccagattaaagacatgatcatggagtacattaagccagaagaaagtattatcttgaatgttctttctgctagtgttgatttcactacatgtgagtctattagaatgtctcagagtgttgacaaaactggcctcaggacactggctgtggtcacaaaggcagacaagtctcctgagggcttgttagaaaaagttactgctgatgatgtgaacataggtcttggttatgtttgtgtgagaaaccgcattggtgatgagtcttatgaggatgctagagtggaagaacagatgctgtttgagtcccatccacttctttccaaaatagacaagtctatggtgggtgttccagttttagcacagaaactggttcagattcaggcaatcagcatatctaaaactttgccagaaatagttaaaaagatcaatgagaagctagctaacaatttgtctgagttggaaaagttgccaacaaacttggcttcagtagctgatgccatgacagcttttatgcatattatcggattgactaaggaatctcttagaagaattcttcttagaggagaatttgatgagtatatggaagacaaaaacatgcattgtactgcccggttggtggagatgcttgattccttcacaaatgatctttacacttgtgctgaaagtgatgcaagcaagaattttcttatgcaagagataaaggtgctggaggaggcaaagtggattggtcttccaaatttcatgcctcgcactgcttttctttctatattgcaagggaaggtgaatgggattgccaacaagcctataggttttgttgaaaatgtgtggaactatctggaaaatgtgctgatttcagttatcacgcgtcactctgaaaactactaccagcttttgatgtctaccaggcgtgcaagtgaggttcttatttctaagaagaagataagttccacaaaacatgtaagagaggccatccaaatggagatgcatactgattacacttgtaatcctgagtttgtgaaggaatacaacaagttaatatctcagcaagatgcttttctgaatgatgttttgaacaatgaggataatccatcacatgtgaatcttgaaggtgtgggcaacattgaagttggtcatttgaggcaatacccatcgtctgtgcttgctcaagcatttgatttgaaggttaggatgatttcgtactggaagatagtgcagagacgattgattgacacaattgccttacatcttatgcttagtattaacaatcttgttaacgaggatttggagaaggagattgttcaggatctgttatcccctagtagtggtgggttagagaggttgttggaggagtcaccttcaatttctgggaagcgtgaaaagctgcagaggagtctcaaagtcctaagggagagcaaggaaactgttgctcacataattgaccgaattgcaacccattga

SEQ ID NO: 4146 - DNA, 396 bp, Glycine max var. Williams 82; identical to SEQ ID NO: 1128

SEQ ID NO: 4147 - DNA, 303 bp, Glycine max var. Williams 82
atgaacgacacgataggtaacagtggcgaggggaggttgcggtggagctggagctcctcagattcatttttgtacggtggactagtacccatttttgtggtgattggggtagcgttgcttgtactagcatgttcaaggggtcatcgaaggtctcaaacaacaacagagtcagtgcgtaacgttgacgtgaacaggtcgagagagttaacaaacataactcaagttgatgaaaggccaaacattttggtaatcctagccggagaagagcacccaactcatttggcaaagcccctatccgtgtga

SEQ ID NO: 4148 - DNA, 411 bp, Glycine max var. Williams 82
atggcttccaaaacttgctcctcccttgctcttttcctcacactcaacctcgttttcttctcacttgtctctgcatgtggttatacaccatgccctggtccaaacccaaagccaaggcccaaccccaaccctaaccctaaccccagccgaagtggctcgtgcccccgtgatgcactcaaactaggtgtatgcgccaatgtgctaaacttggtgaatgccactttgggtcaaccaccagttaccccttgctgcacccttctcgatggcctcgttgaccttgaggctgcagtgtgcctttgcactgccctcaaagcaaacattttgggcatcaacctcaaccttccaatctcactcagcttgcttctcaacgtttgctcaaggaaagtcccacgtaatttccaatgtgcttaa

SEQ ID NO: 4149 - DNA, 1398 bp, Glycine max var. Williams 82
atggacgagtcacagagaattggcatcggcttaatgcgtagtttccctcgccggagatcggtcgaggaccggtcatcttcccggcggcgacgctccatcttctccggcgcgggcatttcggaatctgtggacgccgacgactttgccgacgtctttggtggcccaccgcgaactctccttgcgcacaaattctcgagctccgggtcgttttacgaggaagttttccggccgccggagtttacgtgtccggcgccgaagggtggccggagcttgccggtgttcaggattccggctaggaatgagggattttacagcgacatattcgggtcggacgatgaacggagatcgagagagcggtcgaggtctctgtcgaaagagaattcgtcatcggcgatgagttcggaggagttaagccctcgccggccggcgattggagatgacgtggcactgtctggttttgcttcaaagctaaggccaatcaatattccatggagatggaactcatccactgtgatgcctgaggctgaggaatacccaagtaaacttggggtgcctctttttgcatgcaaggaccagtcatttgaaattcagcatcaggacaatgaatacaaggaaaacttcagaagcccccatttaggatcctcaagaagagtctcatccccagaaaccattagtctcgaatccaattcatatcaaagcatcaaagtgttcactgatgactgggagctcaattccccattttctgatgtctcttcgctttatcaagaacctggggcaaaattttcagtgcatgatcgtgtgctttcagaacaaattatagaaggtgatgatgacgacgacgacgatgatgaaattatgagctcctatgtcattgaactcaactccaacctcagaagagaagagtgtggagaatcagccattgatgaagcaattgcatgggccaaagagaagtttcaatcacgaagctctgatgaagaatcaagcgtgagaaactatggcaaagagaaaactgttggaataggaagctctgatgcaagtgaataccatgatgatggaattgaaatagttcaaactcaggagaagcaacagacagaaacagagaagttggacagagatataagattgtggtcatctggcaaggaaacagatattaggctactactttcaacactacatcatattcttaggcctgagagtggctggtatgctattcctcttaagagtctattagaaagctcacaggtgaagaaggcttatcagaaagcaaggttatgcctgcatccagacaaactgcaacaaagaggagcaacactccttcagaagtatgtagcagagaaggctttctcaattcttcaggatgcatgggctgcattcatttccatagatgtttccttctaa

SEQ ID NO: 4150 - DNA, 816 bp, Glycine max var. Williams 82
atggctgattattcagcacgaactgaatcctgcgaggtagttgtaaatgtaaccaaggacacctccaaaacaatggaaccctcagactcctttgtctctgttcctttcttgcagaagttggtagctgaggtggtgggaacatatttcttgatatttgcagggtgtgcttcagtggtggtgaataagaacaacgacaacgtggtaacacttcctgggatagcaattgcttgggggctggttgtaacagtgttggtttacactgttggtcacatttctggtgcccatttcaatcctgctgtcaccattgcttttgcttctaccagaaggttccccttgatgcaggtaccagcttatgtagcagctcaactcctaggaagcacacttgccagtggaactctgaaactattatttatggggaagcatgaccagttttcaggaacactcccaaatgggactaacctgcaagcttttgtgtttgaattcataatcacatttctccttatgtttgtcatatccggggttgccaccgataacagagcggttggtgagttggctgggattgcaattgggtctacaatactgcttaatgtgattattggagggccagtgacaggagcatcaatgaacccagttagaagcctaggacctgctattgtacacggcgaatacagaggaatatggatatatttgttggcaccggttgtgggggccatagctggagcattggtatacaacaccattaggtacacggacaagccattgcgagaaatcaccaagagtgcctctttcctcaaaggccgtggtggctccacataa

SEQ ID NO: 4151 - DNA, 672 bp, Glycine max var. Williams 82
atggctactagtacactcagccatgcagaagaagtacttcccaatccagcaaaaaatactgatcagaagcaaatccaagttactgaagatcataccaacaacattgactatgtacaaagggcacagtggcttcgtgcagcggttttaggagccaatgatgggttggtttcggtttcttcattgatgatgggtgtaggagctgttaagaaagatgaaagggctatgctacttgctggttttgcaggattagttgcagggacttgtggcatggcgataggagagtttgtagctgtgtgcactcagtatgaagttgaggtaggtcaaatgaagagagagatgaataatgaggagaaagacttggagatggggatggagaaaagaggattgcctaatccattgcaagctactttggcatctgcagtgtccttttctataggtgcattggtgcctctactttcagctgctttcatagaaaactacaggactagggttattgtggttgtggcaatggttagcttggctttggtggtgtttggaagggtggtggctcagctgggaaaaactcataagatgaaatcttgtgtaaggttccttcttggaggatggatagccatggctatcacttttgggttgaccaaattacttggtgctaaagctttagataaagaataa

SEQ ID NO: 4152 - DNA, 1590 bp, Glycine max var. Williams 82
atgtcatcatcggaactctcttctttctttctcctgcccctatcagccatactcagtttcgatgctttgctcggagttatgtttctagtggccgtgttcggctactggctggttcccggtggtcttgcttgggctttgtccaaattcaagcctgcgattcccgggccttgcggttacccggtggtgggcctggtttgggctttcatagggcctcttactcacagggtccttgcaaagttggctgaaaccttcgatgcaaagcccctgatggcattctcggtagggtttactcgctttatcatctcttctcaccccgacactgccaaagagatcttgaacagttctgcttttgcggatcgtcctgttaaggaatccgcttatgagcttctctttcaccgcgcaatggggttcgcaccctacggtgagtactggaggaatctgaggaggatttcagcgactcacatgttctctccgaagagaattgcggcccaaggagtgttccgggcccgggttggggcccaaatggtgagagaaatcgtgggcctgatggggaagaatgatgtcgtggaggtgagaaaggtgttgcattttggatcgttgaataacgtgatgaagagtgtgtttgggaggagctatgtgtttggtgaggggggtgatgggtgtgagcttgaggagttggtgagtgaggggtatgatttgcttgggctgtttaactggagtgaccactttcctctcttgggttggttggattttcaaggagtgaggaagaggtgcaggagtctggtggatagagtgaatgtttttgttgggaaaatcattatggagcatagagtgaagagggatgctgaaagtgaggataataaggccagagatattgataactcaggtggtgactttgttgatgtgctgttggatttggagaaagaggataggctaaaccactctgatatggttgctgttttgtgggaaatgatatttagggggactgatacagtggcaattcttctagagtggattctagcaaggatggtactgcatccagaaatacaagcaaaggctcagtgtgaaatagactctgtggttgggtctgggtgcagtgtgactgatgatgaccttcctaacctcccttacgtgcgagctatagtgaaggaaacccttaggatgcacccaccgggccctcttctttcatgggccaggctttccattcacgagacacaaattggcaaccactttgttccagctggcacaactgctatggtcaacttgtgggccatcactcatgaccaacaagtgtggtccgagccagaacaattcaagcccgagcggtttctgaaggacgaggacgtgccaatcatggggtctgatcttaggttggcaccttttggcgctggtaggagagtgtgccctggaaaagccatgggcttggccactgttgagctttggcttgctgtgttccttcaaaagttcaaatggatgccttgtgatgattctggtgtggacttgtctgagtgcttgaagctctccatggagatgaaacactccctcatcaccaaagctgttgcaaggcctacatcttctcttgcaatgtaa

SEQ ID NO: 4153 - DNA, 2349 bp, Glycine max var. Williams 82
atggatttgagcgaagaagttagggcagctcacaagcgagaattctccgatttcttggatcaagatgtcgggaagggcatatacatggacgaaatcaaaaccctaatcaacctcaagcgccaccgccttatcgtcaacatctccgatctccacaacttccgcgacttgggtaacaggattctgaggagtccaagtgagtacatgcaaccgttctgtgacgcggtcacggaggctactcgtgctattgatcctaagtatttgaaggaaggggaacaagtgcttgtgggatttgaaggcccttttgtttctcgccgtgtcacgcccagggatcttctctctcaattcataggttccatggtctgtgttgagggcattgtcaccaaatgttctcttgtaaggccaaaggttgttaaaagtgttcatttttgccccaccaccggaagcttcacttctcgcgaatatcgtgatattacatctaatttgggtttgcccacaggatctgtttaccctacaagggatgaaaatgggaacttactcgtgactgagtttgggctgtgcaaatacaaagatcatcaaactttgtccattcaagaagttcctgagaattctgctcctggtcaactcccaagaacagtggatgtcattgcagaagatgaccttgttgattcttgcaagcctggagatcgagtggcaattgtggggatatataaggctcttgcagggaaaagcaaaggaagtgtgaatggagtattcaggactgttctcatagccaacaatgtttctcttctcaacaaagaggctaatgcaccaatctacagtgctgaagatgtcaaaagcattaaagagatagctgcaagagatgatgcatttgacctgctaagtaattcacttgcaccatctatatatgggcattcttggataaagaaagcagtgattttgttgatgcttagtggggtggagaagaacttaaagaatggcactcacttgcgaggtgacattaacatgatgatggttggcgatccctctgttgccaagtctcaactcttgagagcaattatgaacattgctcccttggccatatcaaccacaggccggggttcttctggggttggtttgacagctgcagttacttcagatcaagaaactggagaaagaaggcttgaagctggggcaatggttcttgctgacagaggtgttgtctgcattgatgaatttgacaagatgaatgatcaagatcgtgttgctatacatgaagttatggagcagcagactgtgactattgccaaagcaggtatccatgcatcacttaatgcccggtgcagtgtggttgcagctgcaaatcccatttatggaacttatgatcgttcattgactccaaccaaaaatattggactcccagactccttgctttctcgatttgatctactgtttattgtgttagatcaaatggatcctgatattgatcgtcgaatatcagagcatgtccttcgtatgcatcgatttcgttctgctgttgatggaggtgaggcagtgcttcatgggagctcgagatatggaagagaagatgaagctgatatggactcatctgtttttgtcaaatataacagaatgttacatgggaagaaaactggaaggggtcaaaaacgtgatacgcttacaattaagtttcttaaaaaatttatccactatgctaagcataggattcaacctgaacttactgatgaggcatctgagaacattgccacggcctatgctgagctcagaaatgcaagttcaaatgcaaagactggaggaacacttcccataactgccagaactttagaaaccataatacgtctctcaacagctcatgccaaattgaagttgagcagagaggtttcaaagtctgatgttgaagctgctttgaaggttctaaattttgcaatatatcacaaagaactaacagaaatggaggagcgtgagcaagagagggagagagagctggacaggaagcgcaaggctgatcatgatgaaaatgatggtcctgatcatggtcctaaagatagaagaggtcctaaagataaaagacggtctacatcaacagatgccatggatgtagatgataactcagcagctcaagctgctgttggactcacccctgaaagaattgaagaatttaattctctatttaatcagcatatgcatgccaaccgcctggaccaaataactgttgtaaacttagtgaatgttatcaacagaggggaagatccaccatcttacagtgctgcagatgtactactcctattagagaggttgcaagatgacaatagagtcatgataactgatggagtggtgcatatgatatcataa

SEQ ID NO: 4154 - DNA, 672 bp, Glycine max var. Williams 82
atgctcccctacgcttccatcccagaggccgcggcggcgctaggccgcaacctcaccttcgcggagaccctctggttcaactactccgccgccaagtccaattacttcctctactgccacaacattttgttcctcttcctcttcctcgtcttttcccttgtccccctccccctcgtcttcctcgaattcaagcgcttctccttcgtctcttcccacaagatccaaccaaaagtccacttgtccctcaccgaaaccttcaagtgctacaaagacatcatgcacatgttcttcctcgtcgtcggccccttccaactcatctcttacccttccatccaatacgttcccctcaccgtcaccatcaccgtgctcatcgagggaagagatttatttattgatttattaatcactatcttttttctcgtagaggattacaccaattactggatccataggtttctgcacaacgattgggggtacgagaagattcaccgcgtccaccatgagtaccatgcacccattggattcgtcgcgccctatgctcactgggttgagatcttgatcctcgggattccctcctttcttggacctgccatggttcctggccacatgatcaccttttggctctggaaagccttgcgccagattgaagccattaacacacacagcgggtaa

SEQ ID NO: 4155 - DNA, 1077 bp, Glycine max var. Williams 82
atgggaacaaacggcaaggagggaggatctggggtaacatatcaagaaatggtggaagatgaagccaaggacattaagaatgttcctttaggacctatacacaaactaatagcagagaacaccaagtcaaacagtttggttataaagaaaccacatgtggtgattcctcctcatatcatagcagaagccatatcaacgatccgtgatattgacattagatggtcaggtccaataacacagaaagaaatggaatatgttgaacagtatgtcttggcaaagtaccctgaatatgccggcctaattgaaggggatgggaatggtatagacatgtctagctttattatcaatgaggagccttcagaacccttatcagatgacaggaagaaatcgccaagagggacctttagagaacctttgtttggcagtaatctccctgaaatggataagactcaattggagccatcaagactactagatattctcaacaaaaagtcctcctttccaggaagtttcatctcaatccctgaaatccaagcccaaaacaaggttttgaagcattgtgggttgcctgatgatgaatatctggttctcttcactccaagctacaaggatgcaatgatgttggtgggggaaagctaccctttcgttaagggaaactactacatgacaattcttggtgaagagaaagactatatcagggaatttgcttcttttaaggagtccaaggtgattctggcacccaagacttggctggatttgaggataagagggtctcagcttagccaaaattttaggagaaagtgtaaggtcagcctgaaaggtttatttgcttatgaagcagacgtgaacgggacaaatcattgggtctcagaggctcataggaactactggcatgttctgcttgatgcttctgcattggtgctgggaaaggacaggctacatcttggtcttcacaggcctgacttcttagtctgttgtcttcatagcactcactccaatccttcaagaatcacttgcctcttggtgagaacgaaatcttttggcacctccactgcttcttctcaggtcaatggctga

SEQ ID NO: 4156 - DNA, 894 bp, Glycine max var. Williams 82
atgggatccaaaattgactgggatttcatctgggtgttgcttctcaccttgtgttgctgcggctccttggtgcacagcttggacaacactgctgctgcatgtgaatcattgaattccttggttcaagattttgctttcaggtcactggtcaaacacaggcctcaaactggtgctctatatgatgctcttcttccaaggaacctgtccggtatggatgtttcagtagtacgtctcagaagcagaaggctctggaacaaaggtgccaactttagttactttcagatcccaccaagaaccatgtccattccccatgtgaggaggttggctattgtctaccaaaacttgggcaactggtcttcccactacttcaatttgccaggttactcactcatctcttctgttgtcggcttcatggtttttgatgcctcaaatgtaacagacacgagtgagagaaacatcactctcaacacaatggggcagcccatatctgttcaatttcccaacgttacatttatgggtaggggtagcatcaacacaagggtgagatgtgtagctttcaatgccaatggaacatttcaacttactgagatgagttcccctggagtgtgtaactccagagaccagggccacttttcagttgtactcccattggagaagaagcggggaacatggtatctgtgggtgattggctttgttgttggattttttgggttgatcatagcgggctatgcggttttttcttctatgagacttctcaagaccaagaggattcaagccatggaaaaacaagctggtgaagatcaggttctagaaagtagatgggttggcaacagtaaaatgccctccgcagcagtgacaagaactcagccagttcttgagagcggtgttctttag

SEQ ID NO: 4157 - DNA, 258 bp, Glycine max var. Williams 82
atgttgggaacgatgttgaaaatagacaagcttacttctattcactcgaggggtcattttgcacaaatttgtgtagaaattgacctagataaacatgcttgggcatatcatcaaactcaaatacaaaggattgcactccatatgcttagcatgtggccattatgggtaggcataaacagactcaatgtactcccaatatgggagttcagaaggcttaagagatggttactgagaagcatgcaagcagtacaacaatag

SEQ ID NO: 4158 - DNA, 306 bp, Glycine max var. Williams 82
atgggaaactgtggtagcaatcccaaaaccaatgagggtcctgaggcagtgcctgagcctgtgatcgaggaggttaaggttgagcagaaggagagtagtgaagcaaatgttgagaccaagttgaaggatcaaacccccaacgactccgagattaagtctctaggcacattgctcaacgagaaagtagaggaggcaccaaagacagaagaagtaacggctgaacccaagccagaagagcctaaaacagatgaggtaaaggttcaagaagagaagcccaaagcagaagaagcaaaggctgagacctaa

SEQ ID NO: 4159 - DNA, 1524 bp, Glycine max var. Williams 82; identical to SEQ ID NO: 1165

SEQ ID NO: 4160 - DNA, 1410 bp, Glycine max var. Williams 82
atggctgtgcatgtaccgagaaggtgggatgtgaaatgggttgctggaaaggctcttattgcttttcttcttcttgtttcagtctcagctacttcttctcatcaaaatacagacaacaaaacaacttcaccatccaatggaactataggggttgattatcatgctaaagcattttacaagcaccactggccgagtatgaaatttggctggagaataatagtaggcgccatagttggatttttaggatcagcatttgggaccgtgggaggtgttggtgggggtggcatctttgtgcctatgcttacccttattgttggattcgatcaaaagtcagcaacagctatatcaaaatgcatgattacgggtggagcaacagcaaccgtgttctacaacttgaggcaaagacaccccacccttgatttgcctgtgattgactatgacttagcacttcttttccaaccaatgttgatgcttggaatcagtattggagttgctttcaatgtcatctttcctgagtggatgctaacagttttgctaataatatttttcgttgggatttcagttaaatccttctttaagggtgttgatacatggaagaaagaaaccattatgaagaaggaagctaagaagaattcacggattgatgatattggaagtcctgaagatgatgcacattatattcaaacaggagaccccgctaaagacgatactaatcaatcaagaaaaaaagtttctatcattgagaatattcgttggaaggaacttggacttcttttcgctggctggatcatgatactagcattagagattggaaaaaaacacaccacaacttgctcacggttattttggctattgaacctacttcaggtccccatagctgtaggaatgagttcatatgaggctgtgcgtctatacaaagggaagagaatcatagcatcgaagggagatcaacaaacacattggtgtgtgttgcagttagtcctattctgcgcttgtggcacacttgctggcatgattgctggtttgctaggccttggtggaggattcatcttaggacccctattccttggacttggaattcctcctcaggttgcaagtgctacatccactttggtaatggcattttctgcatctatggcagtggtggaatattaccttctcaaacgtttccccgttccttatgctctttacttcgtagccatagccactgctgctgcacttgttgggcagcatttggtgagaaaggcgattgccatattggggagagcatctgtgatcattttcatcctaaccctcacacttagtgttagtgcagttttattaggtggagtaggtattgcacacatgattcaaaagattgaaaataaagagtacatgggatttggagacctttgcacgtacagaaaataa

SEQ ID NO: 4161 - DNA, 402 bp, Glycine max var. Williams 82
atgtcgtggcaaacttacgttgatgatcatttgatgtgtgatattgatggcacaggccaccacctcactgcagctgccatcatcggccatgatggctctgtttgggctcaaagctcttcttttcctcagattagacctcaagaaatcactgatatcatgaaagatttcgatgaaccgggtcatcttgctcctacaggtttgcaccttgcaggaaccaaatatatggtcatccaaggagagtcaggagctgtcattcgtggaaagaagggacctggaggcatcaccataaagaaaactggtcaagctttagtttttggtgtctatgaggaacctgtgactcctggacaatgcaacatggttgttgagaggttgggagattacctcattgatcaaggtctctag

SEQ ID NO: 4162 - DNA, 3090 bp, Glycine max var. Williams 82
atggacaccgtcccaagataccgtaagcggaaccaaccttctggaacactcacccgcaccagatcacagctctatcatcaccggaaccgctccggtcaactccgcttcgatcccgttcccgtacaggacgaaccctacgccgtactccttggctttcgccgaatcaattgcaagaaaccgaagcgccacgacgacgagcttcctggccctccgaccaaggaccttcgcgctaggcgagtttattccccgccgcaatctacaaaccccggtttgatcgaaagcacgtttcccaagggaagcgccgaagcaaccgagagtcctgatttggggcttttttgtgaggctcggggcttcggtggagattgttcggagaaaattgatggtttggatggagcaacgactctactcgacgttgagatttgcggtggttcaaattccaaggtcaacgaagatgtagggaaactggaggcagaggttcctgccaaagataccccttgtactgggaatgtttcttctctcaagagcaaatttgttctcagaccacgtttccaggggaagttgttcaaagccccgggttcagtcaattacagaaggttgtttccgtttctaaaggataccgtgagagatgattctggtacaccaaaattgggtttttgtcagaaagatgaggagggtagacagggattccaacttcctttgtcatctcaaagtcaagaagagtctaaacaagaacttaagacggatgccaccgcagattatggtgttaaagatgttgcaagtgatttgcataatgatgacttgaagcaattgtctagccacgggaataatcttgatcgtgctgaggctagtacagcacaggagtttggtattttgaatgaagaatgtatacagacaactcctcctgatgctgatatatatgttaattcagaggtcaatgtcaaaccgatggattttaccagaagcactccggaaaatgctggtgaagggtcttgtctgaaagctgacaaggggaaatattctctcaagagtaaatccgtgcctagacaacatttgcaccggaaactttttaaaaccccaggttctatcagctataaaaggttgcttccatttctaatggatcttaccaaagatgactctgatgcatccaaatctgatcatcaagatgaggcaaatatgcatgcgaagagctcccaacttcctttgtcatctcaaagtgaagaagcttccatagacgaacataagacaaacagcagtcccatgcatggcacagttgagtctaatggtttggaaacctatgtattagttaatccttctaatgagctatctcatggcaaccagccaaaattggcaccttcccaagacttgcctgaattgtcaacgcaattggacgcaaaagaagtggtttgtggggatttatctgcaccctctgtcaatgaacatacacagaactttgcggttgcttctaaagatgaatgcttgagtgcatcagagcttaatccatgttcagtaatggtggatgattttcactctgctaagaatgttgcacataatgatgacatcaaggaagtacagaataagatatccagacaacacaataatgagtcaccacccaaagatcaaaatatgctctatatcaacggtgatgtctctgagcttacatatgtgcatcattcaagtaaagaaaaaggattcactattgcttatgatgaaagcaagcagtttgtgaatctggaggagcatgaatctgttagcagatttccccctgaatgtcagactctaagtcaattggatcccaatgtgctagatgctgaggagaatgtaacaagtttaaatcatgtccgggtttcaaatgatatatttagagctccacctgagaatattacctctgaaaaatctgacatggcaggggatagtggtgacaaagcaggaagtgtgcagaatggcatagttttatgttcaagcaggccttcaaaaggtagtgataaccaaaatgccagtgaaattgaaaatggctctgaatccaagatcacgtcggttctcaaacgctgtccgcagcttaaattgttgaaacaggctggatctttaaactacaagagattgcttccatttctattgaataccatgaacgatgattcatgtgcttcagtaaatgatcattacccaaaacttgcgaaatccatggatcaaacacctcttctgccaatttcaacttcaaacttacaactaactcctgtaaatggttcaaatggctgtgttcctatggaacattgtgctggcaattctggtcctcagcaacaaacagggttgcaggcttgtgatttaaacaatgatagttctcaaattcctgaataccagtcatctcatgattcatgcaatgtgattcaactgcaagatgaacaggttgtattaaatggactctgcaagccagagagctccactgatacatcaatttctgttcacggaatagacttaccaatcacaacattggcgcctatgattaacaaagttaccaacagagaagaaaaggctccacctatctcgtccatgtcattatcagttttctctgaagtaaaaggaaataattctttcctgatgccttctaatgagaagctaccagaaacacacgaatgttgtcagagcttgtctcaactgcaagttgtagagcaacttagagtccctgccattggtttgaaaaaaggaattttaaaaagaaatccaagaggatgcagaggggtttgcacatgtttgaactgtgtttcttttcgccttcatgcagaaagagcatttgaattttctaaaaatcaactgttagatgccgaagaggttgcccatgatcttatgaaggaactatttcatctaagaaatatgttagaaagttctgctgatagtgccaacaacaatcctgtttttgatggaagccaggtgaaagaagcttgcaggaaagcatgtgcagcagaagaagttgcaaaggaccgtcttagtcagatgcacgatgatcttaatactcattgcagaataacgagcttgcagccaccaacggttacgtttgcggttcctgttgaagaaaaagtcattcaaccaggcggataa

SEQ ID NO: 4163 - DNA, 828 bp, Glycine max var. Williams 82
atgaaccaccttcattccctagcttacactaccactactagcctctgtggttcttccctaggttgggattatcacaaccttggagttctcaacgtggacaaaatgtctttaatgccagctatggagggaagtactacaccatcactctcatcacctcaacactctgatttctcaactgggtatctcgaagatgctttgattgaatcatgtgagcgttcaaaacgtagacgtgtgttgccatgtgctactgatgaacatagcaagagtttcattgatgaccttgagcagagtttctggaatttcaaccccttatggaaccaaccagtagagaacttcaacttctactgcatgaaccagatagaaaggttttgtggaatttcagatgagcatataagcacatcaaggagcgaggaagcaaacattcttctagcagacactaaaacaccggaagagacaatatcagcctctgaatctttaaattcatcctcatcttcatacaaacaaccggcgacatgcaaaaccacagaccccacagttgccccaacagaaaatgatgatatgaggaacaagaaggtggtaacaagagtggtgtatccatttgcaatggtgaagccaggaggaagagaaggtgatgtgacattgaatgacataaatgagaggatcctaatgcctcccacaagaccagtgaggcatccagttggagactttgcatgtcggccatgcgtgtccgcagagggtccagggctttcagggaaagcagtggtggcccttactagaattcacacacagggaagaggcacaatcactattatcagaaccaaaggctaa

SEQ ID NO: 4164 - DNA, 1029 bp, Glycine max var. Williams 82
atggcagctttttcatcccaatactaccattcctttgtggttgactccgcatgcttctcaattactcctcccattataaacacttctagtaactttcttccttctcctcattatcttcacaataataatattcaggaaacgtcttatagtgtcactgataataaggaaacaagctgttttgaacaaagctccaaggttaccatcagtgacattgaactttctgtggtaaaaaaccatagtcctgagacttccatggtagtggacaagcttgaaaaaggtgaacaggtcactcagaaggtggtgacccgcatggagaagaagagaagagcaagaaatggatcttcctcgagtgaccctttatcaaaggagtcaacagaagggggaaagaagaaacaaaagaagccaaaagaagtgacgaaggacaagaaaataggtgctgaagatcctccaactgggtatatccacgttagagcaagaaggggtcaagcaaccgatagccacagccttgctgaaagggtgagaagagagaaaataagtaaaaggatgacgacgttgcagcgacttgtgccaggctgtgataaggtaaccggaaaggcccttgtgttggacgaaataatcaattatgttcagtccttacagaatcaagtggagttcttgtcaatgaaacttgcatccgtgaatcccatgttctttgactcggccatggacttagacaccctcatggttagacccgatcagaaattgagtaatatagcatcaccatcaccactaccatgtgtagcacaattcagaccccaccaggccattgcttttgctgacacaattaccaccccgaccaccactaccaatagcttccccacagctaataatgatggctatcttttggattattcatcctcactttttcttcaaggccatagaccaaatatctttgaggataacggtggtcagttttgggacgtagaagaccaacgacaaaagtttcttcatccatatagattcggcaataattcgggttctttcaattga

SEQ ID NO: 4165 - DNA, 1785 bp, Glycine max var. Williams 82; identical to SEQ ID NO: 1159

SEQ ID NO: 4166 - DNA, 1221 bp, Glycine max var. Williams 82
atggccaccacttttctttctctcctcttcctcatcttctctctcctcaccccagccctcatttcctcttcccctgtccaagaccctgaatttgtggcccaagaagttaacaggaaaatcaatgcttccgtagctagaaggaatttggggtacttgtcctgtgcgacagggaaccccattgacgattgttggaggtgtgacccgaactgggagaagaaccgccagaggctagcggattgtgcgattggtttcgggaaaaacgccatcggaggaaagaacggaaaaatctacgtggtgaccgattccggcgacgacgatccggtgacaccgaagccgggaaccctccggtacgcagttattcaagacgagcctctctggatcatcttcgcaagagacatggtgatcaagctgaaggaggagctcatcatgaactccttcaagaccatcgacggaagaggcgccagcgtgcacattgcgggtggtccatgcataacgatacagtatgtgaccaacgttataatccatgggataaacattcatgactgtaagcaaggtgggaatgctatggtgcgggactccccacggcactacggctggaggaccgtgtcggacggtgatggcgtgtcgatctttggagggagccacgtgtgggttgaccattgctctttgtctaactgcaatgatgggttgatcgatgccattcatggctctaccgcgattaccatctccaacaattacatgactcaccatgacaaggtcatgcttttgggccacagtgattcctacactcaggacaagaacatgcaggttactattgctttcaaccactttggtgaaggccttgttcaaagaatgccaaggtgtaggcatggatattttcatgtggtgaacaatgactatactcactgggaaatgtatgccattgggggaagtgctaatcctaccatcaatagccaaggcaacaggtttgttgcacctgatgacagattcagcaaagaggtgacaaagcatgaggatgcagcagagagtgaatggaaggggtggaattggaggtcagaaggggacttgttagtaaacggtgcgtttttcacggcatcgggggctggagcctcctctagttatgcaagagcttctagcttgagtgcaaggccatcttcactggtggggtccataaccactggtgcgggtgcactcacctgtaggaagggttcccgctgctga

SEQ ID NO: 4167 - DNA, 462 bp, Glycine max var. Williams 82; identical to SEQ ID NO: 1170

SEQ ID NO: 4168 - DNA, 1659 bp, Glycine max var. Williams 82
atggagcagagaaaaagcatatggtctcccgtcacagatccaagaagtggtttcaaccgggaatccagaactttccacagcctcaagccccctctccgtctccctccccccaacgccgccgtctccgcagccgccttcgccctcttcctccgccgcaactcgcagttcccggactcctccaccgcctttatcgactctgccaccggccaccgcctctcctacggcgagctcctccaccgcgccaaaaccctagcctcgaatctcgccacaatcctcaaactcaccaaaggcgacacagcgctcgttctctcaccaaatattctccaagttccgatcctctgcttcgcgcttctttctctcggcgtggtcgtctcccccgcgaaccctctctccacgcgctccgagctcacgcgcttcttcaacatcagcaacccctcaattgtcttcacagtaacctccgtcgttgaaaaaacacgcgagtttcaagtgaaaaccgtgctcctggactctcccgagttcgacacgctcacgaagtctcagattcacacaaaatacatccaagagtgtgattctcatcagaggggactcgtgtcaaacatgcaagtgactcagtccgacgtggcagcgattctatactcctcgggaaccacgggaacgataaagggtgtgatgctcacgcaccgtaacttaaccgcgatcgccgcgggatacgataccgttcgggagaagcggaaggagccagcggtggtgctctatacggtgccgtttttccacgtgtacgggttcacgttcagcttgggggcgatggtgctgtcggagacggtggtgatcatggagaggttcagcatgaaggcgatgctgagcgccgtggagaggttccgggtgacgcacgctacgatggtgccggcgctggtggtggctatgacgaaagactgcgtcatcgccggctacgatttgacgtcgctggaagggatcgtttgcggcggatctccgctgaggaaagaaaccgatgaggcattcaaagctaagttccccaacgtcctcgtcatgcagggatacggtttaactgagtctgcagttacccgaaccactccagaggaggcaaatcaggtgggagcaacaggtaaactgataccaaatatagaagccaaaattgtgaacccagaaacaggggaagccatgtttcccggtgaacaaggagaactctggatcagaggaccttatgttatgaaaggttattctggtgacccaaaagcaacttcagcaactttggtggatgggtggttaaggactggggacctctgttattttgatagcaaaggtttcttgtatgttgtagataggttgaaagagttgattaaatacaagggctaccaggttgctccggcagagctagaagagttactcctatctcattcagagataaatgatgctgcagttattccataccctgatgaagtagcaggccaagtgcccatggcgtttgtggtgagacaacctcaaagttcccttggcgcagcagaagttattgattttgttgccaaacaggtttcaccgtacaagaaaataaggcgtgtagcatttgttaattccatacccaagaatgctgcgggaaagatactgaggaaggacttaaaactggcgctctctaggttgtaa

SEQ ID NO: 4169 - DNA, 405 bp, Glycine max var. Williams 82
atggctgaaactccctctccctctctctctcagtctccctcacccccctttggccccatcataagtgatggccaagttggtggattcgattggatggtccttttggcagcaattttatgtgcctttgtgtgtgctcttggcctcaacacaatgttacaatgtgcttgtcgtgtcttcacagagcctcgccaatggattgcttcacgcaggctcaactctggcctcaagagaaaggaaatggtggctttgccaacctcaacttacactacacactcttctgctgcctcttctccatcttcttcacctaattctagtacttgtgtcatttgcttggctgagttctctgatggggaccctataaggcacctcctcaagtcaaatgattctcttcactccttacagtag

SEQ ID NO: 4170 - DNA, 282 bp, Glycine max var. Williams 82
atggatgccattggaataaggttagcgccattccctcttgagctctccccaaccatagcctttttagtgttttgtatgtttgctttgtctttaggtggtgatggtggttttaacaatgaaacaaaaccactgacctttggtggtgacactgcaccttcactattcatgataggagatgaatgcaaaggtgatgcttttggaatttccattcttagagaaaatggtagcagaggagaaggaggtggcggtggccgaggtggtatagttctattcttaaaataa

SEQ ID NO: 4171 - DNA, 3513 bp, Glycine max var. Williams 82; identical to SEQ ID NO: 1151

SEQ ID NO: 4172 - DNA, 414 bp, Glycine max var. Williams 82
atgaagtcttctggaccttcaacaactcttgctctttttttaaccatcaatttgcttgtctttgtcatggcaagtggctgctacacttgcacacagcctaagccaaaccctagccctaacccattcccttaccctaaccccagccctaccgcaaagagctgccccagggacgcacttaagctgggtgtgtgcgcaaacgtgcttaatggaccaattggtgcgattgtggggtcaccaccggaccacccatgttgctcagtgctagaagggcttcttgaccttgaagttgcggtttgcctctgcactgccatcaaagctaacattcttggcattaaccttaacatccccatttcacttagcttgatccttaacgcctgcgagaagtctccaccctctgacttcctatgcaactag

SEQ ID NO: 4173 - DNA, 1494 bp, Glycine max var. Williams 82
atgatttggatagccatttttttggtttctcttgcttatatgtggctacggagaattagcaagaacaaggcaaagaaattgccacctggtcccagagggttgccaattttgggaagccttcacaagttgggaccaaatcctcatcgtgacctgcaccaactagcccaaaaatatggacctgtcatgcacttgcgcttaggttttgtgcccaccattgttgtttcttctccacaagctgctgaactgttcctcaagacccatgaccttgtctttgctagtagaccacctcttgaagctgcaaaatacatctcttgggagcagagaaacttaagctttgctgaatatggctcttactggcgcaacgtgcgcaagatgtgcacgttggaattgctaagccacaccaaaattaactccttcagaagcatgagggaagaggagcttgacctgatggtcaagcttctgcgagaggcagccaaagatggagctgttgttgatctcagtgccaaagtttcaacactcagtgcagacatgtcttgcagaatggttttggggaagaagtacatggaccgcgacttggatgagaaggggttcaaggctgtgatgcaagagggaatgcacttagcagcaactcctaacatgggagattacattccttacattgctgcacttgaccttcaaggcctaaccaagcgcatgaaagtagttggcaaaatcttcgatgacttcttcgagaaaattattgatgaacacttgcaatcagagaagggtgaagacaggacaaaggattttgtggatgtcatgttggactttgtcggtactgaagaatctgaataccgcattgaacgccccaatatcaaagccatattgctggatatgttggctggttcaatggatacttctgctacagcaattgagtggacgctttcagagctcctaaagaatccaagggtgatgaagaaagtccaaatggaattagaaactgtggtgggtatgaagaggaaggtggaggaatcggacttggacaagttggtgtatttggacatggttgtaaaggaaagcatgaggctccatccggtggcaccgttgctcataccacaccagtccacggaagattgcatggttggagatttgttcatacctaaaaagtcaagggtgatagtgaatgcatgggcaattatgagagacccaagtgcttgggatgaggcagagaagttctggccagagagatttgaaggaagcagcatagatgtgagagggcgtgacttcgagctgataccatttgggtctggcagaaggggttgtccaggattgcaattgggtctaactgtggttcgtctaacagtggcacagattgtgcattgttttgattggaaactaccaaaagacattttgccagatgacttggacatgaaagaggagttcggactcacaatgcctagggccaatcatctacatgccattcccacttatcggctttccaatgaaagggattag

SEQ ID NO: 4174 - DNA, 1095 bp, Glycine max var. Williams 82
atgaccacaaacacaattgttactcagcaacctcaacattcaagactcgagaaatacaaaagatggttgcgagtgtccctttatacaatccttcttcttgcaggccaatgttcaggcactctcttggtaaggttttactttgtcaaaggtggtaaaagcatatggattcaaacatctgttcagtcagctggattccctatactaattccactcctatttcactctaaaaaacatgacaaaacaaatgtgcccaataatgatacctccaaaaccaaaccaaaacttcccatcacatttttcttgtacctagttttcggcttaatgatagcagctatggaccttacgtatgcatgtgcacttttatatcttcctctttccacttttgcactagtatgtgcatcccaattaatcttcaatgcagtgctcactttcttcatcaattcccaaaagttcactgcattgatcttaaactctataatcgtccttaccatatcagttaccctgattgcactcaatactgaatctgaggaaacaaagaacctttccaaacagaagcaaataattgggttcttctgtgccctaggtgcatctgccatatttgcattgcatcactctcttatgcaattttattttgagaaaattataaagactgaaactttttctactgtattaagcatgattttttacccaatgatcgtgggtacaattggtggccttgtgggattgcttgtaagtggagattggagaactatgggaatggagatgaaggaattcgaaaacggtagtgtgtcatatgtaatgactctggtttgtacttctgtgacatggcagataggttgtgttggtatgttggggttgatttttgaggtatcttcattattctcagttgtaataagtaatctggaattgaccatagctcctatccttgctgttatggtctttcatgacaagatttatggggttaaggttatagccttcttgttagctatgtggggatttctgtcttatatttatcaacattatctagatgatcaaaaggccaaggaagataaaagtgattgccttgagattttaaaaggaaatggagaaatttga

SEQ ID NO: 4175 - DNA, 882 bp, Glycine max var. Williams 82
atggtttctgactgtgactcggtagaagtgctttacaaatatcagcactacaccaagactcctgaagaagctgcagccatatccattctggcagggttggacttgaactgtggaagatttcttggccaatacacagaaggtgctgtcaagcaagggcttattgatgaatccattaacaatgctgtctccaacaacttcgccacgttgatgcgtctaggattctttgatggtgatccaagaaagcaaccttatggaaaccttggaccaaaagatgtctgcactccagcaaaccaggaacttgcccgagaagctgcaaggcaagggattgtgtcgctgaaaaacagtccagcatcactgcctctcaacgccaaagccattaaatcgttggcagttataggacccaatgctaatgctactagggtcatgattggaaactatgaaggcatcccatgtaagtatatatcacccttgcaaggcctaacagcctttgttcctacaagctatgctgccggctgtcttgatgtgcgctgccccaatccagtactagatgatgcaaaaaagatttctgcctctggagatgccacagtaattgtagtcggtgcaagtctagcaattgaggctgaaagtctagacagagtcaacattcttcttccaggacagcaacaacttctagttactgaagttgcaaatgcatccaagggaccagtgattcttgtcataatgtctggaggaggcatggatgtgtcctttgctaaagacaacaataaaatcacaagcatcttgtgggttggctaccccggagaagctggtggagctgccatagcggatgtgatctttgggtttcataatccagtaagtcacttgaagacactgttcggataa

SEQ ID NO: 4176 - DNA, 927 bp, Glycine max var. Williams 82
atggaagatgtgaatcgcaccccaagagaagcaaaggattactattctagatcaatatggttgtcagaaactgcgcagacatttgggaatatcaagagaagtgacagaaatgttgttgatggcagagattcctacggctataactcccaagaaatagtgactcctgaagtttctggagcattcgatgaaatcaaaggtttaatcagagttaatgatgagggtgttggtgaagaaagcggtgactatggccactattctagacaatcgttgacaacagaaattgtagagatagttgaagatggcaagagcataagcaacaaagatagaagagttgatgatctttatgtggctgttggcaaagatgacttggatgcagtgaaatgggctcttgatcatgcagtttctcccggttcccggatttttcttatccatgtctcttctccaatcacattgattcctacaccagttggtaagtttgaaagaagtaaactgacccagcaacaagtgggaatatacgtgaatgaggtgaacaacaagaggaaggatcttttgcaaaagtacattcagatgagtaatgaagccaaggtaactgcagaaacgttgctcctggaaagcaatgacacagaaaaagcaattctggacctcatctctattctcaacataaccaacattgtcatcggaatcaaaaagctaccctacacacggcgcaagaacaaattgagcaaaggagagttcgtaaagaaacatgcaccgagttcctgtgaagttaccttggtttataacggcgaggtgttagtgtctgacccttacatggatggcttggtatcctatggcctagcatcgcaaaataaaagtcactcgaaaaacaacttctttcagtgcatgtgcttttcaggatgggtgagagaagacaatggtagttgctag

SEQ ID NO: 4177 - DNA, 1596 bp, Glycine max var. Williams 82
atggtgtcaccaatctcacacttgccacttataatagtcctcttgttatcattttctttagcaaattcagcctcactacaagaaagttttgtccaatgtctcaacctgaattcggacagaacatttccattttactcatcaatttacactccaagcaacccttccttcaccagcatccttgactcctccgcacagaatctaaggcttttggtgccttcagcgccaaaacccgagttcatattcacaccctcccgtgattcccatgttcaagcagcagtgatttgctccaagaaacttgggattcacattagagtgcgaagtggtggtcatgactatgaaggaatatcctacgtctctgaaattgaaacccccttcatagttgtggatttggtcaagctccgaggcatcaatgtggatgtaaaaagcaacactgcttgggttcaagctggtgccacaactggtgaggtgtactacagaatatatgagaagagttcagttcatggtttccctgcaggcctttgcacaagcttaggcattggagggcacatcactggaggagcatatggaaccatgatgagaaaatatggccttggagttgataatgtcctagatgctcaaattgttgatgccaatggaagagttcttgatagggaagccatgggggaagacctattttgggctataagaggaggtggaggtggaagctttggtatccttctttggtggaagataaagcttgttcctgtgccaccaactgtgacagtttttacagttaccaagagccttgagcaaggtgcaaccaagattcttcacaggtggcaagaagtggcaccttatattgatgagaacctcttcatcagagtcatcattcagccatctagtgatggaagaaacaagactcagagaaccatcacaacttcttacaatgctctcttccttggtggggccagaacactcctccaagtcatgaagacaagtttccctgaattggggttgacaagaaaggattgcttggaaactagctggatcaaatctgtgctctatattgcaggcttcccgagtgacacacccccagaagttctgctcaaaggaaagtcaacattcaagaacttcttcaaggcaaaatcagattttgtgagggaaccaataccggaaaccgggctcgaggggttgtggcaaaggttgctggttgaagacagcccgttgatgatttggaacccatatggtggaaggatgagccaattttcagaatctgagaccccatttcctcacagaaatggaacactctacaaaattcagtacttgtctttgtggcaagagggagacaagaatgctgcaaagcacatagattggattaggaagctctacaactacatgggcccttatgtttctagcttgccaagggaagcatatgtgaattaccgggatcttgacttgggaataaacaccaagaacagcacaagttacattcaagcaagtgcttggggttataggtattacaagaacaacttcgacaggttggtgaagattaagaccaaagtggatcctcaaaacgtgtttaggcatgagcaaagtatcccaccacttcctctctga

SEQ ID NO: 4178 - DNA, 987 bp, Glycine max var. Williams 82
atgtcaaacgaggaaacatcagagagagtcatgtacaaagaaaaagaagtggaagggaaccaaagaattattctagaagctgcaaaagcagaactagacaaggtaaaggaagagctcaataaagctaaagagagttccatgcaatcatggctcgactccgagcctctcatagatgaacttgagaagcagaaatccaatcttgctaatgctcaacagagttcaaatgcatcaaaagctgtcattgaagagttggaatcccagctagagaccatccacaagagcatcaaatccaaaagagaggatcaactcaagacagaattgatgatccatgacatccaaaatgctttggattacacgcataagaacatggaaaggctcaaacttgagggaaagaaagaaaagcaagcactagcaaagctgaggcaaaccctgcatcaaaggaagcagacagttcaaaccttgcatctcactctccaagctttgctactggagtcggatgctgtggaagaatcttctgccaaagctcttcaacatatcaagttttcagaaaatcacagagatgttgtgcagcttactaatgaaaactactatgccctaagaagaagagccaaagcaaagatttcacaggcaaattcgcgtgtttctgtttccatggagcaaaaactcgcagctgaggctacccgtgagttggtgttatcaagattgaagaatatgtactccagtagatcatggagcatgaacaaaagaaacacaatggggcaaccgtacacagaaaggaacgcaaaaggccaagacataattgttgaagaggaagtgaaaactaaaatagcaagtgcttcacccaaatcctctgctgaagaatcattacccaagtccaaagggggaaaactacaacagtccagaaaatcaggaagtaataatatgaaaactataaagaaaaagtcatccattttgtataacatgagaaaatgtctttatggaagttaa

SEQ ID NO: 4179 - DNA, 1128 bp, Glycine max var. Williams 82
agaaacaatcaaacccttcatcccctgtccttcatagatcacatcgtttttcgcaactacatccccttacttttcttttacaactcttccacaaaccatggccaaacatccaaaatatcaaatctcaagaaatccttatcccaagtcttgtcccggtactacccttttgcaggcaaacacagagatcaagtttccatcgactgcaacgaccaaggagtgtcctttctagtcgcaaggctgagatgcaaactatcatcaattctccagaaccccacgggagcatcgttgaaccctttgttccccgatgaactacagtggaagcctatgaagaacacaacttcaactatagtagccattcaaataaactgttttgcatgcggaggaatagcaataagcgtgtgcatgtctaagtcattattagccttcccagttcccggggcttcactcttcccgcaagaaaacttacctgttttctcagaagttttgttcgtggaaaacgacgccgtttgcagaaggtttgtcttcgaggcctccgagatcgactccctcaaagccatagtgtcctcccacaacgttccaaaccccacgcgcgtggaagttgtcagcgcgttgatctacaagcgcgcggtttccgctctagggttgagtttcaagacgacgtcgttccgcaccgccgtgaacctccgcaatagaacggttccgccgctcccggagaagagcctggggaacttggtttggttcctgttagtgcttaacccttcggaagcggagctgcatgaaagttttggagcgaaggataaggacatgccgttcgtctcggagtgtctgaagcaggctgcttcggttcccgaggctggtggttcggatgatgaggagagtcaaatagtaactatgttttgttgtgcgagttggtgcaggtttccgatgtacgaagcggattttgggtggggaaaaccggtgtggttcaccactagtgagtccaatagcattgttttgatggatacgagagatggaggtgggattgaagcgcttgtgaacatggaggagcaagacatgattaggtttgagcgtgacgtggagcttcttcaatatgcttctcttaatcctgcggttggacatggtagttaa

SEQ ID NO: 4180 - DNA, 267 bp, Glycine max var. Williams 82
atgaattattcagtactatattccttattgctcatcgcttgcttgatccccatttgccgatcttccttgccaacaaattctagagcttatggccatcatgatcatgggctgattggccaaatttgcaatgaaaccaaacaagaccagatgatcaactgcacaaacattctgagagcagatgcaagaatcctgtttgcaaaaaaatttgttgaattttcaaaggctgtccttggacaaagcaatagaagggcagaactttcttcttaa

SEQ ID NO: 4181 - DNA, 726 bp, Glycine max var. Williams 82
atggctccaagctttgatttttccaataggtggatgaaggagactcagaagagtaccccagttgtggtgacaatggagaaccccactttctcggttgtggagattaatggtgttgatgctgcattcaggccagtggagaaaacccgcagcaagaatgctaagcaagtcacatggttcttgtttctcaaggcttaccatgctattggttgtgtaacttggtttgccacagttttgtggtctttgatgggagctaaaaggaagaggttgattgatagggagggtgtgaccttggagagtgagaaaatggaaaaggggaaggtgctgtttacggtcatcaaggtgttccttgtgagttctttggtggttctggtgtttgaggtggtggcttatttgcaaggttggcattttgggaatcccagtttgcacattcctcgtgccgcagatttggaaggcttgatgcacttggtttatgttgcttggctgaggttccgtggcgagtacattgctccaccaatgcaggcactttcaaagttttgtattgttctgtttcttatacagtcagtggaccgtatggtgctttgctttgggtgcttttggataaagtacaagcggattaagcctaagattgatggggatgccctcaaggttgatgatattgaaggatctgcgtgtagccatccaatggttctggttcagattcccatgtgtaatgagagggaggtatga

SEQ ID NO: 4182 - DNA, 1863 bp, Glycine max var. Williams 82
atggccgccaaaacggtaacccccgacgccgtttcgacgctcctcgcaaacccttcccccgattccacatcggatctccccgacatcgtcgttcaagtcctcgatcttaaggcgacaggcaataaatacatgtttactgctaatgatggaaaaacgaaactgaaagctatgattccttcggatatgcgctctcaggtgctctccggggctattcaaaacctaggtcttattcgcgtccttgattacactgtcaacgatatccccaataaatcggacaaataccttcttgccattaaatgtgaagctgtatctcccgcgcttgaaatggagataaagagtgaggaatctggatctgggattcttttgaagcccaaagtagagggtggagtcaagactgaaggtgctgctgctgggattcttctcaagcccaagcaagaagtggtgacaaaatctgctaaccagattctacgcgaacagcatggaaattcggctcctgctgcacgcatggcaatgacgcgtagagtgcgtcctcttgtttcgttgaacccttatcagggtaattggacaataaaggttagcgttacgagcaaagggaacatgcgtacctataagaatgctaggggtgatggttgcgtcttcaatgttgaattgacggatgaagatggtactcagattcaggcaactatgtttaataatgctgcaaggaaattttttgacaaatttgttctgggaaaggtttactacatttcaaggggaactttgaaagttgctaacaagcagttcaaaactgtgcaaaatgattatgaaatgacgctaaatgagaattccgaggtggaagaggtggtcggtgaagcaagttttgttccggaaacaaaattcaactttgtgcagattgatcaactgggtcctcatgtcaataagtctgagcttgtggatgttattggagttgttaagaatgtgtcttcaacaatgagcattcgtaggaagagtgacaatgagagtattccaaagcgtgacattactattgctgatgacacgaagaagacagtagttgtgtccttgtggaatgaacttgcaactaccacaggagaagagctactggacattgttgataaatctccagttgttgcaattaaatctctcaaggttggggacttccaaggtgtttctttgtcaactataggcagaagtgtggttctggtaaatccagacatacccgaagcaaaaaatctcagaagctggtatgattttgaaggcaaggatgctgcaatggactctgtaggctctggttcaagtccaatatctaacaatgggattagatcagtgtacactgatcgtattcatctttctgacataatctcaaacccatcattgggagatggaaagcctgcttttttcagtcttagaggacatataaccttcataaagcctgatcaggcaatgtggtatcgtgcctgtaagacatgcaataagaaagttactgaaagctttggttctggatattggtgtgatggatgtcagaaaagtgatgaacagtgtagtttaaggtatattatggttgccaaggtttctgatggaagcgctgagacttttatctctgtcttcaatcaggaagctgagaagatcgttggatgctctgctgatgatctagataatcttaaattacaagaaggagaagataatccttatcagatgacattgaaggaagctacttgggctcaacatcttttccgggttagtgttactccgaacgagtataatggcgagaagcggcaaaggataacagttcgagcagttgttcctgttgacttcgctgctgagtcaaggtttatactggaagaattatcgaagatgagagcataa

SEQ ID NO: 4183 - DNA, 1785 bp, Glycine max var. Williams 82
atgttccttctcgatctctctttctcttctcaccggctggtcaccggcttctctcattctccgaccgtccccacccccttcattcccgattcgttcgtcttcgctgcttcgcgtcaacactttttttctcttctagtgttcgggaagatgtcgagtcacggtggttcttctttaaggaacggttccttgtccaatagccccacgcgggccaagaagaaagcctttggctctgagcattcaacgcctgactttattgctcgtaaaacctttacctcaccgcgcaccatgggagagagaactgtgaaatcattgcggctttcaaaggcattgacagttcctgaaacaacaaccgtctatgaagcttgccgtaggatggctgctcgcaaagttgatgctctattactaactgattctaatgctttgctctgtggaatcctcacagacaaggatatagcaacaagagttattgctcgtgaagttaatctcgaagaaacacctgtttccaaggttatgacaaggaatccagtatttgtcctttctgatactcgtgctgtggaagccctccaaaagatggtgcaagggaggttcagacatttacctgtggtggagaatggagaagtagttgccatacttgacatagcaaagtgtttgtatgatgccattgcccgtatggaaagggcagctgagaaaggaaaggcaattgcggcagcagttgaaggtatcgaaaaacactggggaacatctactcctgcctccaattcgacattcatggagactcttcgcgagcagatatttaagccatctttgtctacaattattcctgagaattcaaaggttgtaacagtttcaccaacagactcggttttgactacaacaaagaagatgcttgaacttcgtgcaagttcagctgttgtgacgattgatgacaaaccttgtggtattcttacttcaaaggatatcttgatgcgggtaatagcacagagtcttcctccatcgtcaactcttgttgagaaggtcatgactccaaatccagaatgtggaacaattgatacaccaatagtcgatgcacttcacactatgcatgacggaaaatttttgcatcttcctgtggttaatagaggtggcattgttgttgctacggttgatgtgattcatatcacgcatgcggctgtggcgacagctagtcaggtcggaaatacgcccaattttaacaacgaagctgccaactccatgatacaaaaattttgggattcggccatggccttagctccaaatgaggaggatgaggattcacaaagcgaggcttccttgaaaatgatttccgagggaggagaaacagggagatccatttcttatcttacgtcaagcatgcagaacgtattttcgttcaaattacaagacaggaagggcagattgcataggttcacatgcgatactcggagcttggcagaggttataacttccatcgttcagagagtcggtgatgatattgaccccatgaacctgccccaaattttgtatgaagatgaagacaatgataaagttgtactggcttcggacagtgatcttgctgcagctgtggaccacgcgaagacggctggtttgaagggattgagattgcatttagactactctggaacacatggttatggaactgattcaagttcagtaagttggaaatatgctaattcagaagcatgggcatcggcatacagtgccattgctgctggaactgcagttgttgctgccttaggtctattggcgtttgtgaggcgaagtcgatga

SEQ ID NO: 4184 - DNA, 1998 bp, Glycine max var. Williams 82
atgaagagtatggaaaatgatgacaatgctgaccttaataatcaaaacaattggttgggtttctcactctctcctcaaatgcataatataggagtttcttcacactcacaaccttcctctgctgctgaagtggttcctacaagcttttaccaccacactgctccacttagtagctatggtttctactatggacttgaagctgaaaatgttggattgtattcagctttgccaatcatgcccctcaaatctgatggctctctctatggattggaaactttaagcaggtcacaagcacaagcaatggctactacttcaacaccaaaactggagaacttcttaggtggggaagccatggggacccctcatcactacgaatgtagtgccacagaaacaatgcctctgagcttagacagtgttttttacatccaaccctcacgccgtgacccaaataataaccaaacctaccaaaaccatgttcaacacattagcaccaaccaacaacaacaacagcaagagcttcaagcatattactctaccttgagaaaccatgatatgatattagaagggtcaaagcaaagccaaacttctgacaacaacaatcttcatgttcaaaacatgggtggtgatgatgccgttcctgttcctggcctcaagagttgggaagtgaggaacttccaagctagccatgcacatgagtcaaagatgattgttcctcatgtggaggaaaatgctggtgaatcagggtccattggatcaatggcttatggtgacttgcaatcgttgagcttgtccatgagtcctagctctcagtctagcagtgtcacaagttctcaccgtgcttcacctgctgtcgttgattctgttgccatggatactaagaaaagggggcctgaaaaggttgaccagaagcaaattgttcataggaagtccattgacacctttggacaaagaacctcccagtatagaggagtaacaaggcataggtggactgggagatatgaagctcatctttgggacaacagctgcaagaaagaggggcaaagcaggaaaggaagacaagtttatctagggggttatgatatggaagaaaaagctgcgagagcttatgatctagcggcactcaagtattggggaccctccactcacataaactttcctttggaaaattatcaaaatgaacttgaggaaatgaagaacatgactagacaagagtatgttgctcatttgagaagaaaaagcagcggattctcaagaggggcttccatgtacagaggagtaacaagacaccaccaacatggaaggtggcaagctcgaattggtagagtggctggaaacaaagatctatatcttggaacctttagtacacaagaggaagcagctgaagcctatgatattgctgctataaaattccgaggagcgaatgctgtaaccaactttgacatcacaagatatgatgtggagaaaatcatggcaagcagcaacctccttagcagtgagctagctaggcgcaaccgagagacggacaatgaaactcagtgcattgatcaaaatcacaataagccttctgcatatgaggacactcaagaagctattctaatgcaccagaagagctgtgagagcgaaaatgatcagtggaagatggttctctaccaatcctctcagcaacttgagcagaatccaccaacaattgagagtgacagaactaaccagtccttcgcagtggctttggacaacatgtttcatcaggaagtagaggaatcaagtaaggcgaggacgcatgtgtcaaatccttcttcattggccacaagtttgagcagctcaagagaaggtagccctgataggacaagcttgccaatgctctctggaatgccttcaactgcatcaaaactattggctactaatccaaataacgtgaattcttgggacccttcaccccatttgaggccagcacttactttgcctcaaatgccagtttttgcagcttggacagatgcatag

SEQ ID NO: 4185 - DNA, 3519 bp, Glycine max var. Williams 82
atggaggtggagcgttcgtcgctgtgtaactgcgtggtgaactttttgttggaagagaactaccttctcaccgccttcgagcttctccacgagcttctggacgatggccgccacgaccaggccattcgcctccaacagtacttctccgaccccgcccgcttccctcccaaccaaatctcccgcctcaactctctccccactgccgatccacaaactctcctccaactcaagaacgaatccgaccacaagttgtccatcaccgattacgaactgcgcctcgccaacgaagacattgccaaactcaaatctcaactctatgctgctgaagctcctcagtctaatagtggacatgtttccgagggacaaattcaggaacaaaaacccaatcataacaataatcattcttcctccttcactgcttcctctttgggaccgctaaaggatacagaacgtcgagatcttaattgtgctgtcaaagaatatttgcttattgctggctaccgtcttactgcaatgactttttatgaagaggttacagaccagaacttggacaattggcagaatacaagtgcattaatgccgcaagccttgcgtcattattattatcagtatcttttatcaacttcagaggttgctgaggaaaaaattgcccaagttccagaaaatataacactgctgaaagaaaatgagaggctgaatcaagaaaaggagagcttgttgaaggacaaagatttggccgatggtcaaatagcagcattaactaaatccttggaggcactgcagagagatcttaaagaaaaagagaacatggtgcaagttttaaagcagtccttggagaatcaaagaaaagggctccacgctagcagagttgagatcagtaagctgaaaatgagtattgaagggtctggttctggaaatagtctagttgttagtgatgttgacaattttcaacctgtgtctttagatgagtacaaggaagaaattaagaaattgcaaatggaagttgaacggttgaaggaaaagaatataggaattcctgaaccaggaaattttgttggttctgaaaatgaaactctgcagatagaagacaaagtgcgagagattcatgaggatcaaggtgcaatttcttaccatgttgatgcaccacaagatgtcatacgcgatgaagatgctcaatcaacaacttctcaaactcttaacaaatatactgataaacacgaagatgcactgcatgcattatttaatccagcaaatggaaatagtgcttttgaaaatattgataatgtctctgaacaaaatgttggcaagcaagaaggggataacaggttaaatgcaaaatcagacagtgcaaatgatgaagcaatatccgagaagatggggttaggaaccattcagatacttgcagacgctttgcctaaaattgttccgtatgtcctcatcaatcatcgtgaggaactgcttcctctaatgatgtgtgcaattgagcaccacccggatagcagcactcgggattctttgacccatacattatttaatttaatcaagcgtcctgatgaacaacagagacgcataataatggatgcatgtgtcagccttgcaaagaatgttggagaaatgagaacagaaacagaattgcttcctcaatgttgggaacaaataaatcacatgtacgaggagcgtagactacttgttgctcaatcatgtggagaacttgcagaatttgtacggccagagattcgggattctcttattttatctattgtgcagcaactaatagaagattctgccactattgttcgagaggccgcagctcataatttggctatgctgcttccactttttcaaaacatggataaatatttcaaggtggaggagttgatgttccaattgatatgtgatccctcaggagtggtggttgaaactactctcaaggaattggttcttgcaattataaagtggggaaacaaattagaccacattttgggagttttattctcacatattttgagctctgctcagcattgtccacctctttctgtaattgaagggtgtatagagtcacatctacatgaattgggtgaaagagagcgctggaatatagatgttctattgagaatgctgatggaattgcttcctttggtgcaccagaaagcaattgagacatgtcctttcttgtccagagtagaatctacacaagttgtgttttctgccacattgtttgaattgtatgcaaggggacatgttgaatgggatgcatttgaatggatgcatgttgagtgctttcctaaattgatacagctggcttgcttgttaccatggaaagaagataatctacggagccgaatttcaaagtttctgttatctgtttctgaaaggtttggagattcctatacgacatgcatcatgctacctgtatttttaacagcagttggagatgatgctgatttgacattttttcctagtgccatacattcaaaaattaaaggtttgagaccaaaatctgttctttcggagaagctctctatattgtgtgtcctaccgcttctgttggctggtgttttgggtgcttctggaaaacgtaatcaattagaagattactcaagaaagctgttagtagaagacagtttgaaggagaatctggcaacaaagcacactgtagagatcattaatgctgtccgcttcatttgcatatatgaagaaaatcatggtatgatatttaatatactgtgggaaatggttgttagctctaacgtgaacatgaaaataagtgctgccaagcttctaaaagctattgtgccatatattgatgcaaagcttacttcaactcatgctttgcctgctctaattactcttggatctgaccaaaacctcaatgtgaagtgtgccagcattgatgcatttggtgtagtggctcaacgctttaaaaatgagatgatagttgacaagatacgtgttcaaatgggtgcttttcttgaagatggatcccatgaagctactattgctgtcattcgtgcattggtggttgcaatttctcaacttacagccgtgcctactgctgcttctagtgatttgatgcttcggcaagaaagagccaatgcattttgtgaggcaatccgggctttggatgctacagatcttcctgcaaatagtgttcgggattacctcctgccagctatacagaacctattaaaagatttggatgcactggatccagcacacaaagaagccattgaaatcatcatgaaggaaagatctggggcaagtgttggtggtggtgcaagcaagtcgatggcttctcatcttgggattgcatcatcagtgagcaacttctttggtgatggtggcttgcttggaaagaaagacagcacagaagcacagccacagccagagagagttgtataccccaacaaggctgctgctacatcacaaccacaaccagaggacactagattaaagcgcatcatgctgggacatttcagcgacatacttaggaccaagggaaaatcccaagacgaataa

SEQ ID NO: 4186 - DNA, 753 bp, Glycine max var. Williams 82; identical to SEQ ID NO: 1199

SEQ ID NO: 4187 - DNA, 1299 bp, Glycine max var. Williams 82
atgggaggatgtgcaactaagccgaaggtctcccaggacgatcccgatggaaagcccaaggcaccccaaccagaaccagaacctgaacctgaacaccaacaacccaacaacaaagacaccctgcaaaccaaagtaccccaagtggaacaaggtgctgctcacaaagaccacaacaaccttaatgtcaacgaaattgttgacgacgaccaagcaaacaaaccacgctctctcagctccttgttcaagcagaatgaagataaaaggggttccacagaaaatgagaaaaacaaagttgaggagtctgtgaaagaagaagtgttagaggtcaagaaacctgcggaagatactaaaagcaatgagccaacagttaaacaagaatctctaaagccagaggagaagctgtccgaggagagtaaaaacaatgaatcatcaaaacaagaatacgagactttgaaggcagaaactcatgtcaatgaaccatctaaggaaacagtgaaacgagagtcagaagctgagaaaccttcagaggaaactcatatcagtgaaccagttaaggaaacagagaaactagagtcagagactgagaaaccttcagtggaaactcatatcagtgaagcagctaaggaaactgtgaaactagaatcaaaagctgagaaaccttcagaggaaactcatatcaatgaaccagacaagaaaacagtgatagttgagtcagaagctaagaaaccttctgaggaaactcatatcaatgaaccagttaaggaaacagtgatagtagaagctgagaaaccttctgaggaaactcatatcaatgaaccagctaaggaaataatgatagtagagtcagaagctgagaacccttcaaaggaaactcttgtcaatgaaccagctaaggaaacagtgaaactagagtcagatgctgagaagccttcagaggaaaacaatcaaagcagcgagtcactgaaagaagaatttgtagaggccatggaggcaccttcagaggaaacacaaagcattgaacccatcaaactcaaagaagagcctattgaaccatcagaagaaggtaagccaagtggggaatcagagaagaatgcttcagaaactaagactctcattgtagagagcataaactctgaggtggctcctgtgcctgaggagagagtaattgaagaaattccaactgctgccaagtcttttgagaaggtaacaaaggaagctgcatcaagcacagaagagaaaagccataatggggtggagaatgcacctaaggctgttgatgctggcgctgagattcactaa

SEQ ID NO: 4188 - DNA, 624 bp, Glycine max var. Williams 82
atggtggatgagttacttgatgaattgggcttcaccatcaccgacccctccatcccgggacaccccatcgtcttcgccaacccaagcttcctcaagctcacgggctactccctccgcgaagtcctgggctggcccgcagccatcttctcgggcccattaacatcccaaaaatttgtcattttgctcaactaccacagagatggtatgccgttttggatgcttttttgtgtttcccctattttcagtagcgacggtggcgctgtcgtgcactttattgttgtacagagagaagagtcgtgtgaggcgagtgatgatgagaagcgaagtgttgttactgccatggactgtatattttctgtgctaacccattacggtgaggccacagggagattggtgtgtagaaagaggtccagcattcctgacgtgggtcttttaagcacatccttgattatttctcttggtagaatcaaacaaagctttgtattaactaatccgcatttaccagacatgcctactgtttatgctagtgataccttgttgaatttgacaggttttaaagtcgttaccttatataaattagatcaagttcaaatgaacttattaatattctcccatagttcatag

SEQ ID NO: 4189 - DNA, 1026 bp, Glycine max var. Williams 82
atggttgttcattctcaccaatctgcactaaacgagttatttctcgtgaaagcatcatgcaagagcaggttcatgtgggtgcccgaggttgatctcacgcaccccgaggccaagacggtcatagtcaaggcatgtcaagagttcggtttgttcaaggtggtcaactatggtgtaccactggaattgatgacccatttggagaatgaagcactcaagttcttcatgcagtcccaatgtcaaaaagacaaggctggtcctccagacccttatgggtatggaagcaagagaattggcacaaacggtgatctgggttgggttgagtacctactcctcaacacaaaccctgatgttatctctcccaaaacactccaactttttgaacaaaacccagaagtgttcaggtgcgcggtggaggaatacataggggcagtgaagaagatgtgctgtgaagtgttggagctaatggctgatgggttggagatagaaccaaggaacgtgttcagcagaatgataagggatgagagaagcgatagctgctttagaatgaaccggtacccagcatgtccagagcttagagttgaggcattgagtggacgaaatttgattgggttcggagagcacacagacccacagataatatctgtcctgagatccaacaacacatcaggactgcaaatgtgtctccgggatgggacttgggcttctatccaacctgatcacacttcctttttcgtcaatgttggtgaccttttgcaggtgatgacgaatggaagctttaaaagtgttaagcatagggtattagccaattcaagcatgtcaagactttcaatgatctactttggaggaccaccattgaatgaaaagattgcacctttaccttcactcgtgtcaagggaagaagagagtttgtacagagaattgacatggcgggaatacaagaatgcagcatacaagtcaaagctctctgataataggcttagtctttttgacaaatttgctgatcacagtgacaaatctccattgtga

SEQ ID NO: 4190 - DNA, 648 bp, Glycine max var. Williams 82; identical to SEQ ID NO: 1136

SEQ ID NO: 4191 - DNA, 2382 bp, Glycine max var. Williams 82
atgtttttatgcatttggaaagcctttgaagctctcctcctatcagttaatctgataatggatactaattcaagaaactggagatgggcaagaaaggcccaattgcttattgcttctgctcttctcttactgcaagactctctggtcaactctgctgaagcaagctctgtgcacattgtatacatgggagataagatatatcaaaatccacaaactactaaaatgtatcaccacaaaatgttatcatcactcctaggaagcaaagaagctgcaaagaattcaattctttacagctataagcatggtttttcagggtttgctgcaagattgacaaaatatcaagcagaagcaatagcaaagtttcctggtgtagtgtctgtcattccaaatggcattcataaacttcatactaccagaagctgggactttatgggggtccatcattccacttcaaaaattgctttctctgacagcaacttaggtgaaggaaccatcataggtgtcatagacacaggcatttggccagagtcaccaagtttcaatgatgaagcaatgggacaaatcccatcaaggtggaaaggaatttgtcaagggggaaagcacttcaactccaccaattgcaacaagaagataataggtgctagatggttcatgaaaggaataagtgatcagactaagaaactcctccaaggaaacaactctgatgaatatctctcggcaagagatgccattggccatggcactcacacagcttccacagcagcaggttactttgtaggaaatgcaaattataggggacttgcttctggtttagccagaggaggagcacccttggcacacttagctatctacaaggcttgttgggactttccaattggagattgcactgatgctgatatcctcaaagcttttgacaaggctatacatgatggagttgatgtcttaactgtttctcttggctttgccattcctctgttctcctatgttgatcaacgtgattcattagcaattggttcttttcatgcaacttctaaggggatcacagtcgtttgctctgccggaaattctggtcctgtctctcaaaccgttacaaatactgcaccatggatcatcacagttggagctaccaccatagatagggcctttccagcagccatcacccttggaaataaccgcactgtgtggggacagtccattgatatgggaaaacataatcttggatctgttgggctcacatattctgaacgcatagctgtagacccatcagataatttggccaaggattgtcaatctggaagtctaaatgcaacaatggcagcaggcaaaattgttctatgcttttcagtatcagatcaacaggacattgtttctgcatcacttacagtgaaggaagctggaggagttggactagtatatgcacaatatcatgaagatggactcaatcaatgtggttcatttccatgtatcaaggtagattatgaagtggggacacaaacactaacctatattagaagatcaaggtttccgacagcaagcctaagttttccaaagactgttattggaaaatggacatcaccacgagttgcatctttctcatctagaggacccagtagcatgtctccaacagtgctaaagcctgacatagctgcaccaggtgtggacattttggctgcatttccaccaaagggcactacaaggagtagtggatttgcattcctatctggaacttcaatgtcatgtccccatgtggcaggaatagcagctctcatcaaatccaaacacccaacttggtcacctgcagccataagatcagctttggttacaacagcatctcaaactggaactgatggaagccttatatctgaagagggttccacacataaggcagcagacccgtttgatattgggggtggacacgtggatcccaacaaagcaatggatccaggactaatatatgatatcaccactgaggattatgttcaattcctatgttccatgggtcacagtagtgcatccattagcaaagtgaccaagaccaccacaagttgtaagaaaggaaaacaccaaacactgaacctcaaccttccttccatattagttccaaacctgaagagggttgcaacagtaatgagaacagtgacaaacgtgggaaatattactgcagtctacaaagctctactgaaggttccatatggcataaaagttagagttgaacctcaaactttgagtttcaattcagatgcacgaatccttaactttagtgtcagtttcctgtcaactcaaaagtttcatggagattacaaatttgggagcctaacatggacagatggcaagtattttgtgaggaccccaattgctgtgaggaccatacagtttgaatga

SEQ ID NO: 4192 - DNA, 2070 bp, Glycine max var. Williams 82; identical to SEQ ID NO: 1102

SEQ ID NO: 4193 - DNA, 1014 bp, Glycine max var. Williams 82
atgaaggcaacacttcgatacttagcaggccttgctgggccaagtggtttcggctcaaattcaacagctgagcaagtcactgaagattgctgttccttgctcccttcaaatctaaccgctctcatcactgttgttgaatttttaattgaaggtgcgacttctggtattggagctgaaacagctagagtgttagcaaagagaggagtgagggttgtgattggtgccagggacttgagaaaggccaaggaagtgagagagaaaatccaaaaggagagtcctcatgctgaggttattctgttggagattgatcttagctcttttgcttctgtacagagattttgttcagagtttttagctttggaactgccccttaatattctcataaacaatgcaggaatgtactctcaaaacttggagttctccgaagagaaaattgaaatgacatttgctacaaattacttaggacattttttgctaacgaaaatgctactagagaaaataatagatacagcaaagaagacaggcattcaaggaagaattataaacgtttcttctgtgattcatagctgggtgaaaagatcttgtttttctttcaacgacatgctctgtggaaaaaattacaatggcacacgcgcatatgctcagtcaaaattggccacaattctgcatgtgaaggaggtagccagacagctgaaggaaaggaatgcaaatgtaactattaatgcagtgcatccaggcattgtgaagacgggaattattagagcccataagggcttaataacggattccctttttttcattgcgtcgaagctactgaaatcgatatcacagggtgcatcaacgacgtgttatgttgctctaagcggacaaacagatggaatgagtgggaaatattttacagattgtaacgagagtaactgctcaagtctagcaaatgacgaatcagaagccagaaagctatggaacgacacccatgccttgcttcacaaacggctacgtcaagcaacaaattga

SEQ ID NO: 4194 - DNA, 1539 bp, Glycine max var. Williams 82
atgtctgcgaaagatacaaatggacaatgccaactgcccaaggaagatggtaatggtgaaaatggggacagtcaaaagctcaacaagtatgcttgtgcttgtgtgacggctgccactattatctctgctatatttggttatgtaacgggagtgatggctggagcactcttattcataaaggaagaacttcagatcagtgacctacaagtggggctcttggcagggatcttaaatgtgtgcgcgctacctgcatgcatggttgcaggaagaacctctgattatctcggtcgccgttacaccatcattctagcttctgtcatcttcttattgggctcccttctaatgggctatggcccatcctattcaatcttaatcattggaagatgcattgttggaataggtgtaggttttgcattgatcatagcaccggtttacagtgcagaaatttcatccccttcctacagaggctttctcatttctctcccagacgtttccctcaactttggactcttgcttggctatgtctcaaactacttccttggaaaactgtctctgaaacttggatggagaaccatgttggttgttcctgcagttccttcacttgttcttgtcattctcatgttcaagttggtagagtctccaaggtggttaatcatgcaaggacgtgtaggtgaggcaaggaaagtgcttttattagtctctaatacaaaggaagaagctgaaaaacgcttgaaggaaataaaaggtgctgctgggattgatgaaaagtgcacagaagacattgtccatgttccaaagcaaattcgaagtggtgcaggagctcttaaggaactgttgtgtaaaccttcactaccagtgcgtaatatactagttgcagctattggagttcatgtgttccaacaggtttgtggaatagaaagtattttgctatatagtccaagggtgtttgagaaaacaggaatcatggacaagagcatgctccttctagccacggttggtatgggaattagccaagctgtgtttacattcatatctgctttcttgttggacagggttgggaggaggattctgttgctgattagtgcaggtggtgtggttgtgaccctcttaggattgggtttttgcatgaccatggtggaaaactccaaagaaaaacaattgtgggcaatgggttttaccattgtttttacctacatatttgtagcttttgtggctattggtattggacctgtgacgtgggtttatagctctgagatttttcccctcaggttgagagcacaaggtcttgccattggtgtgactgtgaatagaattgccaatgtcgtagtggttaccagtttcatttcaatttataaaaagataacattaggcggtactttctttatgtatgttggtatcactgcgttggcttggtggttctactactccttgcctgaaaccaaaggaaggtcattagaagatatggagacaatctttgggaaaaattccaagtcggagatacaagtgaagcctgagttatggatttcatgcatgaaataa

SEQ ID NO: 4195 - DNA, 1101 bp, Glycine max var. Williams 82; identical to SEQ ID NO: 2185

SEQ ID NO: 4196 - DNA, 270 bp, Glycine max var. Williams 82
atgatgaagggtcaatgcatgccccggttgaaaagcagctcctgcaagaacaaaacaccttctccaatgaccttattagagcgtttcagagaagcagtgctccgcttaatgatgttatctgcactttctaaagccacaaaccaccgtcgctccggcgacggagaacgccagaatcgacattttaatagccctcatgatcctcaccacagtgaagccgtagcagattgcatcgagttcattaagaaaaaggctgctaccgacaccggttaa

SEQ ID NO: 4197 - DNA, 267 bp, Glycine max var. Williams 82
atggtgagcgtcagaagttgtctgccggtaaaagaaaaggagagttttgtgtcttacgaaaaatggggacaaagcgtaagccgaaaaaggcccgtcaccggccgaaaaacgcatttgctttgccgcacggacaaaaaaatacttctataccccatatgggccctctcctcttatataccaatctctttcatctctctcttcccatgcctattctttttctttctcatacacactcactcactgaatttcttgcactttgaaccttga

SEQ ID NO: 4198 - DNA, 579 bp, Glycine max var. Williams 82
atgaagatggaaattgaggaagttggcaactgcgaagcacttcccctgctttcactgaaccacgtgtcccttttgtgcagatcagtgtgggagtctatgaggttttatgaggatgtcttgggctttgttcccatcaaacgcccttcttctttcaagttcactggagcctggttttacaattatggtattggaatccacttgatcgagaatcccaacattgatgaatttgatacctgcgtggttgaagaaaggcctattaatcccaaggacaaccatatctcattccagtgtactgatgttgaacttgttaagaagaggttagaagagagggggatgaggtatgtgacagctgtggtggaggaaggaggaatccaggtggaccaggtgttcttccatgacccagatggttacatgattgagctctgcaactgtgagaatatcccaatcattcctatttcttcttgctctttcaagcctcgaggccacagctttaagaaggctgctcccaacaagtgtggattcatggagaatgtgatgatggaaagcttgagcaccgacatgatcaatttctccttttaa

SEQ ID NO: 4199 - DNA, 2217 bp, Glycine max var. Williams 82
atgacaatggatacttgtaaaacctctccacatttgctgatacttctttgctttgcttcatttctccaactatgtcattcagcatcccaacaaaagagctacattatctacactggcaatagcatgaatgatgaggcttctgcgttgactctttattcagacatgctacaagaagttgcagacagcaatgctgagcccaagttagtacagcaccacttcaagcgtagtttcagtggctttgttgctatgctaacagaggaggaagccaatagaatggctagacatgatagagttgtagcagtctttcctaataaaaagaagcaactccatacaacaaggtcatgggattttattggctttccactacaagcaaatagagcaccagctgaaagtgatgtcatcattgcagtatttgactctggaatctggccagaatctgagagcttcaatgacaaaggtttcggtccaccacctagtaaatggaaaggcacctgccaaacttctaaaaatttcacatgcaataataaaatcattggggctaagatttacaaagtagatggattttttagcaaggatgatccaaaatctgtgagggatatagatggtcatggcactcatgtagcatcaacagcggctgggaatccagttagcacagctagcatgttaggccttggtcagggaacatcaagaggtggcgtgacaaaagcacgcattgctgtgtacaaagtgtgttggtttgatggttgtactgatgcagacatacttgctgcatttgatgatgcaattgcagatggggttgacataataacagtttctcttggagggttcagtgatgaaaactactttagagatggaatagccattggagcatttcatgctgtgagaaatggagtattgacagtaacttcagctggaaacagtggtccaagaccttcctccctgtccaacttttcaccttggtcaattagtgtggctgctagtaccatagacaggaagtttgttaccaaggttgaattaggtaacaaaatcacctatgagggtacctcaataaatacatttgatctcaagggagaattgtatcctataatttatggtggagatgcaccaaacaaaggcgaaggcatagatggatcatcatcaaggtattgctccagcggttcgttggacaaaaaattagttaagggtaaaattgttctctgtgagagcagaagcaaagcactaggccctttcgatgctggtgctgttggggcattgatacaaggacaaggttttagagatcttcctccctctcttccattgcctggatcttaccttgccttgcaggatggtgcctctgtatatgactacataaactctacaaggactccaattgcaaccatatttaagactgatgagacaaaagatacaatagctcctgttgtggcttctttctcttcaaggggtccaaacattgttacacctgaaattctcaagccggatttagtggctcccggagtttccattctagctagttggtctccagcttcccctccttctgacattgaaggtgacaacagaacattgaatttcaatattatctcaggaacttcaatggcttgtccacatgtttctggggccgcagcgtatgttaaatcatttcatccaacatggtctcctgctgctattcgttcagctctaatgacaacagctaaacaacttagtcccaagacccatcttctggcagaatttgcatacggcgcaggccaaattgatccttccaaggctgtgtaccctggtttagtatatgatgctggtgaaatagactatgtaagatttttatgtggacaagggtatagtacaaggactttacaactcatcacaggagataacagtagctgccctgaaacaaagaatggttcagcaagggatctaaactatgcttcatttgcactctttgtcccaccctacaactccaatagtgtaagtggcagttttaacaggactgttacaaatgttgggtcaccaaagtcaacatataaagctactgtgacttctcccaagggactgaaaattgaggtgaaccccagtgttctaccattcacttctcttaaccaaaagcaaacatttgtgctcacaattacgggaaaactagaaggacctatagtttcaggctctttggtttgggatgatggtaagtaccaagtgaggagccccattgttgtgttcaatacagcataa

SEQ ID NO: 4200 - DNA, 207 bp, Glycine max var. Williams 82; identical to SEQ ID NO: 2110

SEQ ID NO: 4201 - DNA, 1401 bp, Glycine max var. Williams 82
atgggattctacacacagaaccttttttcttctttcacctcagcttcatcatggttcgaggtgtacgctgccttctccacattcacgatgctcctcagaacagcattcattcaactcattccccagcaattccgatccttcattgtctcaaagctagagtccttcttctccaaataccaagcaaatagcgaaatccgtctaaaaattaacaaattttgggacaaaaattcgggagaccgcaatgaacttttcgatgctgcccaggagtacctccccaccaggattattcacacctacaagtcgctcaaagttggcaaactacaaggcgagaagcacattgagctcgcagtgtatggaagtgaagatgtggtggacgaatttgaaggcaccaaattcacttggaagctggatgaagaagggtccaaacaggactctaataatcacaacaagaagtatagctttgaattaaccttcaatgagaagcatagagagaaagcattggatctgtatattccacatgtgattaaaacatatgaggtcatgaaagctgagaggaggattgtaaggatctattcttggttagatgatgattggaacgatagcgagttatcacatcctgccacattcgactcactggccttgagtcccgagttgaagaaagatatcattgatgatttggaacggttcctgaggaggaaggagcattacaagaaagtggggaagccttggaaacgtggctacttgttgtatggacctcctggaactggaaaatcaagccttattgcggcgatggcgaactacttgaaattcgatgtgtatgatttggagcttacttctgtttattctaactcggacctcatgcaatccatgaaggaagcatctaaccgttccatcgttgtgattgaagatattgactgcaatgaagagctgcacgctagatcaattggtctttcagatgatcaagattcagacgctgacaatgaggctgccaaggttaagacaagtaggtttagtctgtcgggtctgcttaactacatggatggtttgtggtcaagcggaggagaggagcggattataatattcacaaccaaccacaaagaaaaaatagaccctgctttgttgcgcccgggtcgtatggacatgtacattcacttgtcctacctaaaaggcaaggcatttcgagtcttggcttccaattatttggatattgaaggagatcatccactctttgaagaaattgatgagctattggagaaattacaagtcacccctgcagtagtagcagagcaactgatgagaaatgaggatcctgatgatgctttggaagcccttgttacatttctcaaagaaatggacaaggatagtaattgtgacttagagctaagagggactagtgagtag

SEQ ID NO: 4202 - DNA, 399 bp, Glycine max var. Williams 82
atggttaagaagacagtcttgaaggttgatatcagttgtctcaaatgcaaaaggaagctcctcaaaatcgtctcttcaattcaaggggtggataaaattgaagctgatgaagggaagggcacgttgaccgtgacaggggatgcagacccatatgaaataatagttcgcataaggaaagctggcaaacatgctgaagttgtgagtgttgggcctccccaggcccctcaaaaaaaggatgagaagaagcccgaagaaaagaagaagcccgaggcagagaagaaagatgaaaaacctaaggagtccagtatccacatgccatattactatcctccttaccaaccagtagtgctgtacatgaacagatacgaggagcccaatccatcttgcactatattgtga

SEQ ID NO: 4203 - DNA, 2856 bp, Glycine max var. Williams 82; identical to SEQ ID NO: 2155

SEQ ID NO: 4204 - DNA, 204 bp, Glycine max var. Williams 82
atggttttgttttgttataaagatttgcggcttaatgctaatggtagtgccagtgagtcgatctgggacctgcaaaaggagacgacgaggaatttgaagccaaagcaaagtttgatacgcagctttccaatctatctcagatctaacaggataagtatgatgaccagttcagtttatattattttgaactcactacatatatag

SEQ ID NO: 4205 - DNA, 1236 bp, Glycine max var. Williams 82; identical to SEQ ID NO: 2191

SEQ ID NO: 4206 - DNA, 2091 bp, Glycine max var. Williams 82
atggagcctcgcaaagcttcaccattatcgtgggtcttgatcttcttccttaccatttccttgtggggagttaaggtatcaagtgaagagcaccaccaccatggcaaatctaaagagggacctgtggtggaaagggatcaaaggaggacattacttgtcactgaatttggagagatcactgccattgacatcaaggaaggacaaaaggaactaccctaccatcttcagttcatcacattggagccaaactcgctatttctccctgtgcttctccaagcagacatggtcttttatgttcatacagggagtggaaagctgacttgggcaaatgatgatggtactagtacgattcgtttacgcgaaggagatgtctgcagtctcaatgaaggatctgttttctatatacagagcaacttagaggctgagagaaggaaacttaggatttatgcaatgtttaccaacacagacgacaatacttacgatccatcaatcggtgcttactcaaggatcaatgaactggtcaaaggctttgataagaaaatcatgcaagcagctttgaaggtgccggaagatttgatcgaagcaatcattaacaagacggagactccagctatagtgcatgcggttccagagaagcgaaatattgtccaggagctggaggcttcgtttcttaaaaactttttaggcgttgggtccaactccaagaaactcgaaacatacaacatctttgagcatgaccctgacttcaaaaatcccattggttggagcacagcagtgaccaaaaagcaactaaagtcattgaagcggaccaacattggatttctgatggtgaatttgaacatgggatcaatattggggcctcattggaatgcaaaggcaacagagttgacagtgggagtggatggggaaggcatggtccgagtagtatgtggaagcggcaatgaaaatgagacagaatgccaaaacatgaggtttaaggttaaggaaggtgatgcttttctggtgcctaggtttcatccaatggctcagatgtcattcaacaatggaccatttgtttttctcggcttcagcacttcagcaaagaaaaaccaccctcagtttttggcgggaaagggatcagtgcttcatattctagacaaaaagatactggccaggtctttgggtgtgagtaacagaaccattgatgagcttctgcgttctcccgaggactccatcattttcagatgcagttcctgcgcagaggaagaggagaagataatgaaggaggaggaggaggaagaggagagcaagaaagaagaagaagagaggaagaaaaaagaagaggaggaggaggaagaggagaaaaagaaaaaagaggagaggaagagagaggaagaggaagctaaaaggcaacaagaagagagggaaaagaagcgaggggaggaggaagctaagagagaaagagaggaagaaaaagctaggatggagaaagaaagggaaaggaaaggagaagaggaagcagaaagggaggaagaagaagctagaagagagcaagaatggagaagaaaaaaggaagaagcagctgctaaaagagagcaagaaaagagggaaaggaggagacaggaagaagaagctaaaaaatgggcagaagagaaggctgaaagggagcaagaacaagctacgagagaagcagaagaagcacagagggaacaagaacaagctaaaagagaagcagcacagagggaacaagaacgggcaaaaagagagcaagaaaggaggcggcgagaagaagtagctggaaagggagaagaggaggaagaacacgcaggaagagggcacgaaaggagaaaagaagaagaagaaacagcacggagggaacaagaacaagaacaggctgaaagacagcaacaaaagagagaaaagaggagacaaaaggaggaacaaggagaaggagaagaagaagaagaagaagatgaagaagaaccaacatggtgggagagaagagaaagaagaaaacagaaggggaaaagtccagaagaaggagtagaatgggagcaagaagaagccaggacagcaagcagggagggagagaagaaaacaccgagagagtga

SEQ ID NO: 4207 - DNA, 2508 bp, Glycine max var. Williams 82
atggcttccgactcttctcccccgaatttcaacaacggaccttcatcccccgatgactccctttccagccccatcggcaataccttctcgtcaccggccagtagacgccgccgccgctcctccaccccctccgcattcgccactccgtcggagcgccgctcccgattcgcctcctccgatgccacccctaccgcgccgcgctcccgccagagaagcggcggcgggcgcgttcccgccacttccacctccaccaccgacgacgttccggcctcttcagacggcggagacggcttcgacatggacgatgccaggcccaccttcgtgtggggcaccaacataagcgtggaagacgtgaacgacgccatcaaaaggtttctgaggaacttcagagacgcgtcttcgtcgcagggtggtgacaacgatgacgggttgcacttgcacacagaagggaagtatgagaaactgatcagacaggttattgaagttgaaggagattctcttgatgttgatgcgcgtgacgtgtttgatcatgaccctgatttgtacactaagatggttaggtaccctctcgaggtgcttgcgatctttgacttggttttgatgaacatggttggcgaattgaagcctatgttcgagaagcacattcagacccgtattttcaatctcagaaactcaacctctatgagaaatttgaacccttctgatattgagagaatggtatcactgaagggaatggttataagaagcagctcaatcattccagagatcagggaagctatatttaggtgtcttgtgtgtggattctgctctgagccagttcctgtggagagagggcgaataaccgaacccactatatgtttgaaggaagagtgccaatccagaaactccatgacacttgttcacaaccgatgcaggtttgctgataagcaaattgtgagggtccaggagacacctgatgagattccggaaggaggaacacctcacacagttagcttgctgatgcatgacaagttggtggatactgcaaagccaggtgacagagttgaggtgactggtatttatagggctatgagtgtcaggattggaccaacacagagaactgttaagtcattgttcaagacatatattgattgtcttcacataaagaagaccgataagtccaggatgttggtagaggatgctatggatgttgatggccaagacaaaaatgcagaagttctctttgatgaagaaaaggtggctcaactgaaggagctctcaaaacggccagatatatatgaaatactgacaaagtcaatggccccaaacatctgggagctagatgatgtgaaaaaaggtcttctttgtcagctttttggtggcaatgctttgaagttagcttctggtgctaactttcgtggcgatataaatattcttctcgttggcgatcctgggacaagcaagtcccagctacttcaatacatacacaaactatctccacgtggcatttacaccagtggaaggggaagttcagctgttggattgactgcttacgtaaccaaggaccccgaaacaggagaaacagttttagagagtggtgcccttgttttgagtgaccgaggtatatgttgtattgacgaatttgacaaaatgtctgacaatgcaaggagcatgttacatgaggtgatggaacaacaaaccgtttcaatagcaaaggcaggtattattgcttccctcaatgctaggacttcagtgttggcttgtgcaaatccaagtgggtcaagatataatcctcgcttgtctgtcattgacaacatacaccttcctcccactcttttgtccagatttgatttaatctacttgatgcttgacaaggctgatgaacagactgacaggcgccttgctaaacatattgtgtccctacactttgagaatcccgagaacgtggaacaggacgtgttggacatttctacattaaccgattatgttagctatgcccgaaagcacatacacccacagctttctgatgaagccgctgaagaattgactagaggttacgtagaaataagaaaaagaggaaattttcctgggagtagcaaaaaggtgataacagcaacaccaaggcagattgagagtctgatacgcctaagtgaagcattggctcggatgcgcttctcagaatgggttgaaaagcatgatgtaatggaggcatttcggcttttggaagttgcaatgcagcagtctgcaacggatcattctactggaactattgacatggatcttattactactggagtttcggcaagtgaaagaatgaggcgagaaagtctgcaacaagcaactcgtaacataatcatggagaaaatgcagattgggggaccatctatgcgcttattggagttattggaagaattgaagaaacaggatactggtagcgaagttcatcttaatgatctaaggaatgcaattgctactctggctacagaaggatttgttaccatgcacggtgacattgtaaaaagatcttga

SEQ ID NO: 4208 - DNA, 2862 bp, Glycine max var. Williams 82
atggattctgttggaggggaagaggcaattcaagagcctacagaccatgatgagaggattcttgtttcggttcgtcttcgtccccttaatgaaaaggagcttgcaagaaatgatgtttcagattgggaatgcatcaatgacaccaccatcatatacaggagcaacctttcagctactgacaggtcactctacccaacagcatattcctttgacagtgtgtttcgaacagattcttctacaaggcaggtgtatgaaaaagcagctaaggaagttgctctttcagttgtcggtggcatcaactcaagcatttttgcatatggacaaacaagtagtgggaagacatacaccatgagtggcataactgaatacacagtggcagacatttttaactacattgaaaagcacacggaaagagaattcatgttgaagttttcggcaattgagatttataatgaatctgtaagggacctccttagtccagactgtacccctctcagacttctcgatgatccagagagagggacagttgttgagagactgactgaggaaactttaggagattggaaccattttacagaacttatttctttctgtgaagctcaaaggcagataggggagacagcactgaatgaagcaagctccagatctcatcaaattctaagactgacaattgaaagttctgcacgtgaattccttggaaatgacaagtctagctctctttctgcttcagtgaattttgttgatcttgctggtagcgagcgagcatcccaaacccattcagctggcacgagattgaaagagggttgccacataaatcgtagcttactaactctaggaactgttatccgcaaactcagcaaggggagaaatggacatattcctttcagagattcaaagctaacccgcatattgcagtcctcattaggaggcaatgctagaactgctatcatctgcaccatgagccctgcccggagccatgttgaacaaaccagaaacacactcttatttgcaagctgtgctaaagaagtgtcaactaatgcacaagtcaatgtagtggtgtctgataaagcactagtcaagcaattacaaaaagagttggctagactggaagatgaattgagaaattcagggccagcccaccttacttctgagactgcagcattgttgagagaaaaagaccgtcagatcgatatgttaaagaaagaggtaagagagctgaccttgcagcgggaccttgcacaatctcgaataagtgacatgctccgagtgcatggagaagatgtggctacaatagaactgcaaagtatggatcctcaatatccaaatttacacatgagaaattcatggaactttgaaaatcaaagagaggagccaaatgtattaagtcttgatggtgaagagagtgtcaggtcttttgatgcatctcaatattcagatggacatagttttagttctgatgaaaacttattccaactccctgaccttgaaaagaatcttctggtcagaaattctcccccagggttgccagtcaaaaggactgatgctgtaccgaatgatttggatcagaaacgcattgaagaacagcatgaagaggacaattgtaaggaagttagatgcattgagttggaagatgtaatcacaaacacacataaacactcaaatacatcagatttaagatcaaatacatacactgattctaatgcatcatctcctagtgcaaacacagctatctcaggattgattgtagttgataatagagacaaggaaaaagtagtagatttgagttcatctgggtcaaaggaagacaaaagattgaaccatttgcaccaagattttgttcttccctctccaaaagaaatttctgtgtgcatgacaggaaacagtacaagtagttctagaactttgaagttgagccgaagtagaagttgtaaagcaagtatcatgaggaatttatcttcagattggtttgaagatgtagacgtaattcagaacactcctccaatagggattgaaaaagccttccctggaagaccggagggctttccgaagaacatttatgcactaaactataatgccaatgcagaaaggctttcatgtaatggccatgggaattctgtacaaaattcttctgttgatgatgtacagaatgtgaaatcctccactaacaaggaaagagagggaacagaaaatattaacaggttgaatttactggctggccatgaggttccggggacaggattggattatgcaaagaatgtcaaagatattggcttggaccccatgcaaactgatggagaaagtctctcacactcacactggccttcaaaattccagaggctgcaaagagagatcattgaattctgggatgcttgtaatgtttcattggttcacaggacttactttttccttctattcaagggggaaccatcagattctatttatatggaggtagagttgagaagactatcatacctcaagcaaacgttttcccaaggcaatcagactgtggaagatggacgaaccctcgcacctgagttaagcatgagatatcttagaaaagagaggcagatgctgagcaagcaaatgcataagagactgtctaaatatgataggcagaacctgtacttgagatggggccttcgtttgagttcaaagcataggagtttgcagttggcccatcaattgtggagtgacacaaaagacatggaccacgttagagacagtgcatcaattgttgcaaagctggttggtttagtagagccagaacaagcatttaaggagatgtttggactcaactttaccccacaacctacgagtaggaaatcttttagttggacagccagtgtgaggcacattttgtga

SEQ ID NO: 4209 - DNA, 912 bp, Glycine max var. Williams 82
atggggattaaaagattaggacatactagatttactctgtccaatcttttttttaataaacagaaaacagtaagttggaaaggcgttttagagtggaaaatggcaggaagcagcattaacagaggagaaagatggtctctcaatggaatgactgctcttgtcaccggcggcactcgtgggatcgggcactccatagtgagtgacttggctgcgtttggcgctgcagtgcacacctgttccaggacccaaacagagctcaacaaatgcttacaagagtggcagagtcaggggtttcaggtaactgggtcgctctgtgacgtgtcctcaccaccccagagagagaagctcattcaggaagttgcatccaccttcaatggcaagcttaacatctacgtgaacaatgttggaataaacattagaaagccaaccattgagtacactgctgaagaatattcacagattatgacagttaatttagactcctcattccatctgtgccagcttgcatatcctcttctgaaagcatctgaaaagggaagcattgtgttcatttcatctgttgctggtgtagtgagtttaggtactggagctgtctttgcagcaagtaaagctgcaattaatcagcttacaaaaaacctggcttgtgactgggccaaagacaacatacggagcaactgtgttgtaccatgggcaaccagaaccccggttgtagaacatttgttcaaagaccaaaagtttgtggatgatattatgtctcggactccaattaaacgtatagcagaaccagaagaagtgtcatcgttggtgaattttctttgcttgcctgctgcttcattcatcactggacaggttatttgtgttgatggaggattaactgtgaatggatttcaacccagcatgagaattacctga

SEQ ID NO: 4210 - DNA, 1644 bp, Glycine max var. Williams 82
atgaagttgatcaataaaccatcgcaactacgttccctcttgagccttttctgctccattttgctgctcttggaattagctttcgtggctgcggaggacccttatagattcttcgactggaccattacctatggtgacatttatcccctaggagttaaacaacaggttattcttatcaatggccaattcccaggccctgaaatctattctgttaccaatgacaatttgatcattaacgtgcacaataacttgaccgagccgtttcttctatcatggaatggtgttcaacaaaggagaaattcttatcaagatggagtttatggcaccacatgccccatccctcctgggaagaacttcacctacacacttcaagtcaaagatcaaattggaagtttcttctatttcccatctcttgctttccacaaggcagctggtggttttggagccatcaaaatccttagcaggccaaggatccctgtcccgttcccagacccagctggtgatttctcccttcttattggtgattggtaccaaatcaatcacaagaagcttcagagtgttctagattttggacacagacttccattccctcaagccgttctcatcaatggtcgtccaagtggcacaacattcacagttgagcaagggaaaacatataggcttagaatatcaaatgttggacttcaaaatacactaaactttaggattcaaggtcatgacatgaagttggtggaagttgagggaactcacaccatacaaaccacatattcttcattagatgttcacgtgggacaatcttattctgtgcttatcacagttgatcaagcacccaaggactactacattgtagtgtctacacgtttcactaacaaaattttcacaagcactgctatccttcactacagtaactcccaacaatctgtttctggcccaattcctagtggcccaaccactcaaatcgattggtcaatcaaacaagctcgttcaataaggacaaacttgacagcgagtggaccaaggccaaatccacaaggctcctaccactatggattaataaacattagtaggacaattaccttggtgagctcaacagcacaagtgaacaagaaacaaagatacgcagtgaacagtgtttcattcacacctgctgacactcctttgaagctagcagattacttcaacattggagggattttccaagttggaagcatcccagatagcccttctggtagacccatgtatcttgacacctcagtcatgggtgccgactttcgagccttcgtcgaggtcgtgtttcagaaccatgaaaacatcatccagagctggcacattgatgggtactcattttgggttgtaggaatggacggtggtgtgtggacgcctaatagtcgtaaccaatacaacctcagagatgcagtatcgaggagcacaacacaggtatatcctaagtcatggaccgcaatttacatggcattagataatgtgggtatgtggaacatgaggagtgaattttgggcacgccaataccttggacaacaattctatttgagagtttatttaccagttggatccattagggatgaatatccaattcccaagaatgctcttctttgtggcaaagctgcaggcaggacaaccaggtga

SEQ ID NO: 4211 - DNA, 639 bp, Glycine max var. Williams 82; identical to SEQ ID NO: 2130

SEQ ID NO: 4212 - DNA, 2226 bp, Glycine max var. Williams 82; identical to SEQ ID NO: 2101

SEQ ID NO: 4213 - DNA, 870 bp, Glycine max var. Williams 82
atgagtttgactggaactgtgaatgatgatgcaactgctacaaattctccgtgttgttctgaagtttcagggtctgtgtcttattgtggatgttcatctaacaacagttccactcatctttgcatcaagtgtgacttcaattgtgattctttactcactcttgaaaatgaagactccaagtggatgatctcagattcaaagccttattatggatgttgttcatctgagaaaccttcatctcctcttagcaccaatggaataatacattttgacagatcagaagataataatatttcagtggagcatctactagaaattgaaggcatgcaagagttcaatgctgatgaaccacttttttggccatttgaagggaaattcaactggaattattctgaggaatcaaggagtccattttgtatctcaccaaggaaaaaggttgtgtttggttctagatcaatgacatcaaggatagaggaaagtaaacgtaaagacgatggaagcgaatgcagtgtaacatctgaaccatcaaggatagtcatgccatctaaaggttcagcattggtagtaaattcagagttgaatgatgagaaagttgtattgaaaagcagagatggcaacaaactaatatttgttgacaaccttaatgaggatcatgggccaaactatgagcttcttccattggctagaggagatttttctttggatcaagagcctgagattccaattgaggcattggtaggactcaaggaatttgatggacatgaagggcttgattcagaatttaatggtgatgatgttttcatgctggaggaatctctcttaataactcatgcaagtgaatgtgtagtttccaaaaaggatgaatattga

SEQ ID NO: 4214 - DNA, 342 bp, Glycine max var. Williams 82
atgtgttatagggtggactgtaaaacctgtgggaagtatacatgggggggatgtggtgatcacttgaccaccctctacgccagcattgatgagggaatgcactgtacgtgccgctcctggccgggtgttgttacacgcacacgcacaaccaccactcagcaacctactcaatccaataatcccaaccaaggaattctcaaaattaacgaagctgcgttggattctgatacgcagcagttcttttcgggttatatgacacgcagagggatagagatcggtactgtcggggtactagtgtatgttaaaagtgttaagggggttgatattaataatgtaatgtag

SEQ ID NO: 4215 - DNA, 1743 bp, Glycine max var. Williams 82
atggagcaagaaatggagaagaggaaggaaggtacaagtgaagaagagaaatgggtgcatgatgcatctgtggattataaaggaagacttcctttccgtgcttccacgggcgtatggaaagcttctctttttgttcttatatttgaatttagtgaaaggataagctactttgcgatgttctctaatcttatcacgtacctgactaaagtgatccatcaagacctcagtacagctgccaagagtgtaaactactgggcaggaacaacaaccttgatgcctctggttgggggatttgttgctgatgcctacactggtggatttaacatgatcatattttcttccctcgtatacttaatgggattaagcctcttgattctgtcacaattcatcccaagtctaaagccaaacaacaataatcagcctagggtggctcatgaagtggctttcttccttgccatttactgcatctccttgggcactgggggacacaaaccatgcttgcaaagctttggagctgatcaattcgacgaggatcaccgggaagaaaggaagaagaagatgtccttcttcaacttgtggagcttcactgtgtgctttgctatgttgcttggtgcaacagtggttgtttatgttcaagactttgtcagttggggagttgctagtctcatcataactattctcatggctctcactaccatagctttctatgcagggaggcctttttataggtacaagcagccagcaggaaacccttttaggccaattttacaggttttagttgcagcaattaggaaaaggaatttgtcttgtccttcaaatccagctcttttgtatgaaatcccagagttagagaagtcgcaaggaagacttctgagccacactagcggactcaggtttctagacaaggctgcaataattgaagagaaatatgttgagcagagagataatgcatggagattagcaacagtgacaagagtggaggagacaaaacttgttctaaatgtagttcccatatggctaacttcattaacaactggagtatgctgggcacaagcctcaacactttttgtcaagcaagcaactaccatgaatttaaagatgaccgaaagtttcacactgccacctgcttcccttgtttctgttgcggcaattggtgtcttaatatctctcccaatatacgatagggtcattgttccaattctaaggaaagtcacaggcaatgaaagaggcatcagcatccttaggaggatcagcattggcatgacattctcagtcatagtcatggttgctgctgccttagtagaagcaaagagactaagaatcgttggacaaaggacaatgagtgtgatgtggttgataccccaatacttgatacttggcattgcaaattcattttctcttgttgggttgcaagagtatttctatgaccaagttcctgactcaatgagaagcataggaatggctttatatctcagtgtgattggagtgggaaacttcttaagcagctttctaatcatcattgtgaaccatgtcacagggaaaaatggcaagagttggattgggaaggacataaattcaagtcgtttggataggttttattggatgttggctgtcatcaatgctttggatttgtgtgcctttctcttcttggcaagcagttacacttacaagactgtacagaggacaactatggatactgatggttgtaacaagagtgatggtgtggagacagtggcaaaatga

SEQ ID NO: 4216 - DNA, 1884 bp, Glycine max var. Williams 82; identical to SEQ ID NO: 2163

SEQ ID NO: 4217 - DNA, 840 bp, Glycine max var. Williams 82
atggaaaagcttgctaagcaggttttgttttgcagtttattaactgcacttgttttgctaccattcccggtaataatgtctcatttagttgaggacgagagcgagtttaattatgatgttaagagtaagagaggaccatataactggggaaacattaaacccgaatggagtatatgcaaaaatggatccatgcagtcaccgattaatctgttgaataagagggttcaaatagcaccccatttgggaaaacttcatatcaactaccaaccatccaatgcaactcttaggaataggggtcataatataatgctggaatggcttgctggcacaagctatctacaaattaatgaaactcagtatgtacttaagcaattccattggcattctccctctgagcacaccatagatggcagaaggtttgatctggagttacacatggtgcatgaagcttcatccggagaaattgcagtgattggaatgttgtataaggctggaagaccagaccctttattgtcattgttagggaatcacataaaggccatttctgattgtacgggagcagaaatagaattgggtgtactggatccttggctggttagcatatgcagaagcagaacacagtattacagatatagtggttctctgactactcctccgtgcactgagaatgttgcttggaccgtgcttacagaggtgagatatgtttcaagggagcaaatcagactgcttagagttgccgttcatgatgattcaaatgcaagaccattgcaaccaataaacaatcgcttagtgaaactctatataccattgcaggattcaaatcgcttagtgcaacgttag

SEQ ID NO: 4218 - DNA, 966 bp, Glycine max var. Williams 82
atgggaggaagaatgcacacgaaatcagactcggaggttacgagcaacagcatggagcagtcgtcaccgtcgcgttcccctccgcggcggccactctactacgtgcagagcccttcgaaccacgacgtggagaaaatgtcgtacggttcaagccccatgggttcccctcaccaccatttccactactacctctcttcccccatccaccactcccgcgaatcctccacctctcgcttctccgcttccctcaaaaaccctcgcagcaacttctcctcctcctcctcctggaagaagctccacccacaccccaaccccgacgccggcctcgacgacgacgacgacgacgacgacggcgacgacgacctcaaccacttcccccgcaacctccgcctctacttctgcttcttcctcctctttcttctctttttcaccctcttctctttgatcctatggggcaccagcaagagctacaagcctcgaatcattgtcaagagtatagtgttcgagaacttgaatgttcagtcaggaaacgatggaactggggtacccactgatatgttgtcgttgaactcaacggtcagaattttgtatagaaacccagccactttcttcggcgttcatgtcacttctacccctcttcaccttagctattaccagcttgcaattgcctctggccagatgcagaagttctatcaatcgaggaagagtcagcggaagttggcggtagtggtgctaggacaccagattcctctctatggaggagtgtcagttcttggaaatactaaagagcacttggagaacgttgcattgccactaaaactgacatttgtagtgagatcaagggctttcatcttgggaagattagttaagtctaaattctatcgaagaatcacatgttctgtcactttgcatggcaacaaacttggaaaacatcttaatttgacggattcatgtgtctacaagtga

SEQ ID NO: 4219 - DNA, 1164 bp, Glycine max var. Williams 82; identical to SEQ ID NO: 2236

SEQ ID NO: 4220 - DNA, 1419 bp, Glycine max var. Williams 82
atggaaaacggtattggtgaaaatgaaaacagtcatggaagtcttaacaagtatgcctgttcctcagtgatggctgcctctattatctccgctgtatttggttatgttgttggagtgatgtctggagccctagtattcataaaggaagatcttcaaatcagtgacttgcaagtgcagctacttgcaggcatgttacacttgtgcgcactaccgggatgcatggctgcaggaagaacatctgattacaaaggtcgacgctacaccatcattctagcatccaccatcttctcgttgggctccattctaatggcctggggtccattctatctaatcttaatgattggaaattgcattcttggagtttccgtgggttttgcactcatcatcgcaccagtttacagtgcagagatttcacctccttcctacagaggctttctcacttctctcccagaactttccatcaacataggactccttcttggctatgtctcaaactacttctttgaaaaattgtctcttaaacttgggtggaggatgatggtgggtgttcctgctattccttcactttgcctaatcattctcatgttgaagttggtggagtctccaaggtggttagtcatgcaagggcgtgtaggtgaggctaggaaagtgcttttactagtttccaatacaaaggaagaagctgaacaacgcctaaaggaaataaaaggtgttgttggaattgatgaaaactgcaccctaggcattgttcaagttccaaagaaaactcgcagtggtgcaggagctttgaaggaactgttttgtaaatcttcaccaccagtgcgcaggatactgatttcagctattggagttcatgtattccttcagattggtggaataggggctattttgttatatggtccaagaatctttgagagaacaggaatcagtgacaagagcaagctcatgctagccactgttggcattggagtcagcaaagttatattcgcattcatatcaatatttttaatggatagagttgggaggaggattctctttctggttagtgcaggaggcatggttgtgaccttgttagggttgggtgtttgcttgaccatagtggagcgatccactgaaaaagtagtgtgggcaataagctttaccattattgtaacctacctcgttgtggcttttatgacaattggaattgggccagtgacatgggtttatagtacagagatttttcctttaaggtttagggcgcaaggccttggtgtctctgtggccgtgaacagaatcacgaatgtgatagtggttacaagtttcatttcagttgataaagccataacaatgggtggggttttcattctgtttgctgctatcaatgctttggctttgtggtactactatacgttgcctgaaactaaaggaagatcttag

SEQ ID NO: 4221 - DNA, 852 bp, Glycine max var. Williams 82; identical to SEQ ID NO: 2147

SEQ ID NO: 4222 - DNA, 1302 bp, Glycine max var. Williams 82
atgaaggttgaagttgaagtaatctccaaagaactcgtgaaaccctcctctcccacccccaaccatcttcgtcattacaatctctccttgctcgaccacctcactccccaactcaacaactccatggtctacttcttcgctgccaataatgtttcaaaccaattcttaaacacctgcaccgaaaatgcttccaaccacctcaagaaatctctctcagaagccttgacacattactaccctcttgcgggaagactcgtggacaaggctttcatagagtgcaacgacgagggtgccctctacttggaagccaaagtgaggtgcaagctcaacgatgttgtggagagtcctatccccaacgaggttacaaatttgttaccctttggaatggatgatatcgttgacacaccccttggcgttcaacttaacgtttttgaatgcggtggaatagccattggtgcatgcatgtcccacaagattgctgatgctatgtccttttttgtgttcattcaaacttgggctgctattgcacgtgattacaatgaaatcaagacacatttcgtttctgcctccttatttcccccgagggatataccttggtatgatcccaacaaaaccatcacaaaacctaacactgtgtccaggatatttgtgtttgatgcttctgttatagatggtcttaaagcaaaatatgcagaaaaaatggctctgcagaaacccccttcacgagttgaggctctatcaactttcatatggacccgctttatggcttccactcaggttgcagcatctgagagctctaaattctacgtggtggctcacactgtgaacctgcgttcgagaatggaccctccactaccagcacatgctttcgggaactactatcgggctgttaaagcgtttccatcacttgatgataaaggggaatgctatgagctggtggagaagctgagagaagaaataaggaaaattgacaatgaatatattctcaaacttcaggagggctctgagtacttgagctctcttagagaagatttgcgcagattcgagaatattaagggggaaattgtgccgtttaccttcactgctttgtgcaggtttccagtgtatgatgctgattttggctggggaaagccaatttgggcatgcccacctgcatggaaagtaaaaaatgtggtcgtttttacagataccaagtttggtggtggcattgaagcacatatcagcatgatggaggaggatatggctagatttcaaaatgacaaggagctccttctacatagttctactaaatatctaaattga

SEQ ID NO: 4223 - DNA, 2001 bp, Glycine max var. Williams 82; identical to SEQ ID NO: 2242

SEQ ID NO: 4224 - DNA, 1488 bp, Glycine max var. Williams 82; identical to SEQ ID NO: 2125

SEQ ID NO: 4225 - DNA, 345 bp, Glycine max var. Williams 82
atgtttcactcaatcaaaacggttttaacctgtccacaagtttcattccctgcacggtctctctcttccaaccttggtcgggaaacttgcgcagttagattctgcactgacagtgctcgtaagatggacaagactcagaagcctagtactgaggaaaataaacaaggagatacgatgtctcattcatttggggaagggtacgctacgaggtctgacgaagaagggtttggtggagtttatggtggaaaccaatcgaagcctgagatggacccagcttatgacaagacgcagggaagtgaggtgaaggagaaggaaaaagcgaggcaccagaccagcgccaattaa

SEQ ID NO: 4226 - DNA, 1731 bp, Glycine max var. Williams 82
atggagaagaggaaggaaggtacaagtgaagaagagaaatgggtgcatgatgcatctgtggattataaaggaagacttgctttccgtgcttccacgggtgtatggaaagcttctctttttgttcttatatttgaatttagtgaaaggataagctactttgcgatgttctctaatcttatcacgtacctgactaaagtgatccatcaagacctcagtacagctgccaagagtgtaaactactgggcaggaacaacaaccttgatgcctctggttgggggatttgttgctgatgcctacactggtggatttaacatgatcatattttcttccctcgtatacttaatgggattaagcctcttgattctgtcacaattcatcccaagtctaaagccaaacaacaataatcagcctagggtggctcatgaagtggctttcttccttgccatttactgcatctccttgggcactgggggacacaaaccatgcttgcaaagctttggagctgatcaattcaacgacgatcaccgggaagaaaggaagaagaagacatccttcttcaactggtggagctttactgtgtgctttgctatgctgcttggtgcaacagtggttgtttatgttcaagactttgtcagttggggagttgctagtctcatcatcactattctcatggctctcactaccatagctttctatgcagggaggcctttttataggtacaagcagccagcaggaaacccttttaggccaattttacaggttttagttgcagcaattaggaaaaggaatttgtcttgtccttcaaatccagctcttttgtatgaaatcccagagttagagaagtcgcaaggaaggcttctgagccacactagcggactcagttttctagacaaggctgcaataattgaagagaaatatgttgagcagaaagataatgcatggagattagcaacagtgacaagagtggaggagacaaaacttgttctaaatgtagttcccatatggctaacttcattaacaactggagtatgctgggcacaagcctcaacactttttgtcaagcaagcaactaccatgaatttaaagatgaccgaaagtttcacactgccacctgcttcccttgtttctgttgcggcaattggtgtcttaatatctctcccaatatacgatagggtcattgttccaattctaaggaaagtcacaggcaatgaaagaggcatcagcatccttaggaggatcagcattggcatgacattctcagtcatagtcatggttgctgctgccttagtagaagcaaagagactaagaatcgttggacaaaggacaatgagtgtgatgtggttgataccccaatacttgatacttggcattgcaaattcattttctcttgttgggttgcaagagtatttctatgaccaagttcctgactcaatgagaagcataggaatggctttatatctcagtgtgactggagtgggaaacttcttaagcagctttctaatcatcattgtgaaccatgtcacagggaaaaatggcaagagttggattgggaaggacataaattcaagtcgtttggataggttttattggatgttggctgtcatcaatgctttggatttgtgtgcctttctcttcttggcaaggagttacacttacaagacagtacagaggagaactatggatactgatggttgtaacaagagtgatggtgtggagacagtggcaaaatga

SEQ ID NO: 4227 - DNA, 888 bp, Glycine max var. Williams 82; identical to SEQ ID NO: 2109

SEQ ID NO: 4228 - DNA, 1029 bp, Glycine max var. Williams 82
atggagctgagtttggatttgagtttaggctttgttcccaaacctctttccctgtttttcgccgacgtttctgcgaacagagacaaagtggccacactcgatggcttcgtgcagagattggaggaagaattgaaaaaggtcgaggctttcaaacgtgagcttcctctctgcattcttctcctaaacgatgctatagctagattgaaggaggaaaaagtgaagtgttcgggaatgcaagatccgccactgaaaaccagttctggaggaaacaaaaatgaaagctctgagaagatgaattggatgagttcagcgcagctttggagcactcagaaaaccaaatcgagaaatgaggaagatgataggtctgtgccagcgaacccaattaatgggaattcgtgtgtcctcgagaaggagggttcccaagttccgaggtttggtttgatggctcgtgcttctgaactgagtcatagcaattccaagagtgttggtggagatattagttctggctcctctttgctccgtgttgaggtacagagtcagccacaaccgccgcaacatatgcaacagaatccgaggaaacaacgccgctgctggtcgccggagcttcaccgccgctttgtggacgctcttcaacaacttggtggagcacaagtggccactcctaaacagattagagaactgatgcaggtggaaggccttacaaatgatgaagtgaaaagccatttgcaaaagtacaggcttcacgttaggagatttccagtttcttcaactggccaggctgataatgggtcatggatgtcacaagatgaatctggggataaatcaaagggaaacaacatgtcacagtctggttctccacaaggtcctctcacacctctgatcctaggaggaggaggaggaggatctgctaagggtctctcaagccctggacagaacagtgtggatggagaagatgagcaatctgattgccggaattggaaaggagggctccaccaccaccagcttgaagctgataatcaatgcctctaa

SEQ ID NO: 4229 - DNA, 450 bp, Glycine max var. Williams 82
atggcggttgctgtagccatgttacctcgttggtcggtttttcttctttttctgtttgtcttgtgtatctcaggagcaaaggttgtcaccattgatgtacgtgcagccaagagtctcatccagaccggttccatttatcttgatgttaggacggtggaggagttcaagaaagggcatgtgtatgcagataatgtccttaacattccatacatgttgaatacacccaagggcaaggtaaagaatggagactttctgaaggaggtttcatcagcttgcaacaaagaagatcatctcgttgtgggttgtcaaagtggggtgagatctctgtatgcaactgctgatcttctatctgatggttttaagaatgcgaaagacatgggaggaggttatgtggattgggttaaaaacaagtttccagtgaatataccagaggccaaagaggagctataa

SEQ ID NO: 4230 - DNA, 909 bp, Glycine max var. Williams 82; identical to SEQ ID NO: 2211

SEQ ID NO: 4231 - DNA, 1653 bp, Glycine max var. Williams 82
atggaattgggaagcataaccgacttccttcagaacaagaacattttggtcattggtgccactggcttccttgccaaaatttttgtggagaaggtactgagagtgcaaccaaatgtgaagaaactttatctacttttgagagcaacagatgccgaatctgcctctcaacgattgcacaatgagattatgcggaaggatttgtttagattgttgaaagaaaatgttggtgcaaagttcaatgcctttgtttcagaaaagttgactcttgtgcctggggacatttctcaagaggacttgaatttgaaagatcccattctacgcgaagaaatttacaatcaaattcattgtatagtcaattttgctgccacaactaactttgatgaaagatacgatgttgcattgggtataaatacattcggagttaagcatgttttgaactttgccaaaagttgtattaagctaaaggtgcttgtccacgtatcaacagcatatgtatgtggtgagagaggaggactcatagtagaggatccatgccaattgggtgtgtcgctaaatggagtgcctggactagacattggcatggaaaagagagtggtggaggataagatgaaccaacttcatgaagagggagccacggaggaggatgttaaaatggccatgaaagacttgggtatgaaaagagcaactttatatggatggccaaacacatatgtcttcacaaaagcaatgggagaaatgcttgtagaaactctaaagaaaaatatgtctgttattattgtacgtcccacaatgattaccagtacttacaaagaacctttccctggatgggttgaaggagtaagaaccatagatagtgtaattgttgcttatggcaaaggaaaactaccatgcttccttctagacatcaacgcaatttttgacgtgataccagcagatatggtagtgaatgcaataataactaccttggtggctcatgcaaatcaaccttgtgataatattatatatcaagtaggttcctctattgcaaatccaataagataccacaatctcaaagactacatctatagatatttcaaggcaaaaccatgggtgaacaaagagggaaatcctgtaatggtcggcaaagttactgtattggacaccatgactagcttccagagatacatgttcattcgttacttgcttccattgaagggactagagctagccaatgtagccttttgtcaatattttcaaggaatgtgtcttgacattagaaggaagatccatatagtgatgcaattggtcgacctttacaagccctacgtgttcttcaaaggcgtatttgataatatgaacacagaaaagttgcaaacagcggtcagacaaggtgaggtagagatggaatattcgttttactttgaccctaaaatgattgattgggaagactacttcatgaatatccatattcctgcttctcaaactattagtttttctaatattcaatgtgatgttcccaaactcaaaggagataactataagatatggaaggagagaattcttctacaattggggtggatggacatagactatgctatatggaaagacgaaccacctgcaatcactgatgaaagtagcccagctgacgttgcgctatataagcggtgggagtga

SEQ ID NO: 4232 - DNA, 564 bp, Glycine max var. Williams 82
atgaatcttcctatcatagatttctactcagctgaatcagaccgtctttccactgccatttccatccgtcaggcgtgcattgagtatggtttcttttaccttgtgaaccatggggtggagaatgacttggtcagagcctttgatgagagtaagaggttcttctcacttccattggaagacaaaatgaagttggcctacaaggaatttagaggctatactcctcctgatccttctttgggactccaaggtgattcaaaagagagctattacattggtcctttgtcagattcaacaagtgctaatctgaatcaatggccttcacaagaattacttggaaattgcagaccatcaatagaatccatgtattggaaactcttcggagttggaaaaaaactgttatctctaattgccctttccttgaatatggatgaagatttctttgagaagataggtgccgaggacaaaccagcagcttttcttcgccttttgcactatccaggtttagtagcattgacggttttagttagagttggatcataccatagcattatacatgcttgttaa

SEQ ID NO: 4233 - DNA, 1482 bp, Glycine max var. Williams 82
atgcttgaggaatatgcattttcatttagctattcagattctgataatcaagaggtgtcgatgaatatcaaccgcactggaaacaaaaagaaccgggggaccttcaagtgtaattcgactacagaagttactccccatcagatgaggagttctgcgtgtaagatgatccgaactctcgttcagttgatgagaactctggagaaaatgccagaagagcgcactattatgatgaagctcctctactatgatgatgtgacgccagctgattatgagcctcctttcttcaagggatgcactgatgaagaaacttatcatccatgggagaagaatccattgaaaatggaggttgggaatgtaaacagcaagcactttgtgttagctctgaaggtgaagagtgtgctcgacccttgtgaggatgataatgagggagtccaagacgatttcagcgctggagatgattccatgcaacagaatgaatattatgatactgacagtgaggtttatcttactcaagggaatcgatatatagttgctccaatagacaatacccaggacccggtggatgatgagcaacaactggtccgggtcaaggagtggatcaactgttgtcaccgtgacactatcgagtttaatgatgttctatcgaattttccagacatctccgtgatcacagacaagcttgttgaggaaggtgtgctatcaaagatagggaaggaaacctacgccattaacaaggacaagaaccttgaatatgagttcgccattgtgaaggaagaaattgacggtcaaattcctcaagtctttgacagagctttgcaggttgaagatcgcatatacatgaaagctctctatcatgttcttccgatgacacacgtttcagtcactaagcttcaaagcttgcttgagggagaagtaaaccagatagcagcacgaaagatcctagataaaatggtgcgggatggaattattgaacccaaaggcagcaaaagattagggaaacgtgttatccattctgacttaactgaaaggaaattcattgaagtccagaaagctctaagtgctactactgaagcaatggatgttgatcactgtgaaccaaatagcaagtccaaaaaaactggtttccgtttaaatggaagcaactatgacgtgtctacatatggggttctccactctattggatcagatttaacacgaatgaaagtgacatctgagacaaactatagtgactccgggaatggacagaaagcatcaaaggcaaaagagcccgggaacacccccataagcaggccagttatttcaagagagagttttgcgcaaggcaaagagaacggaagaacaaatggaatagcaaatcaaggggacgaagctgacacaatcatatgcagcaagtcttcccaagacaaacgaccaaggaaaactagcgcggcgaaggagcctatccatcaaaacatgaagcgacagagatctgaggctcagtga

SEQ ID NO: 4234 - DNA, 1011 bp, Glycine max var. Williams 82; identical to SEQ ID NO: 2094

SEQ ID NO: 4235 - DNA, 504 bp, Glycine max var. Williams 82; identical to SEQ ID NO: 2098

SEQ ID NO: 4236 - DNA, 2277 bp, Glycine max var. Williams 82
atggaacttgcattgcctcttgctcttgctcttattttcgtgctaattagtatatacccaacttcagcacaccaaaatacagaattcgtgaatgcaaaagaggaactcgatgttccaagcagcttattgacttacattgttcgtgttaaaaagcctcaaagtcagggtgatgattctcttcagtataaggacttgcatagttggtaccattcacttctaccagctagtacaaaaactgatcagaaccaacaacgcattactttctcataccgcaacgtggtggatggattcgccgtgaaattgaacccagaagaagccaaagctcttcaagagaaagaggaggttgtgtcagcccgtcccgaaaggacattttctttgcacacaactcacactccaagcttcttggggttgcaacaaggactaggactatggaccaattccaattttggcaaaggcatcataattggaattctggacacaggcataacccctgaccacctttccttcaatgatgaaggaatgccacttccaccggcaaaatggagtggccactgtgaattcacaggggagaaaacttgcaacaacaagctcattggtgcaagaaatttcgtgaaaaacccaaactcaacccttccactggatgatgttggtcatgggacccacacagccagcacagccgcaggaagatttgtccagggtgctagtgtctttggcaatgctaagggtactgcagttggcatggcacctgatgcgcacttagcaatttacaaggtttgtgacctctttggttgttccgaaagtgcaatactagctggaatggacactgccattcaagatggtgtagatatactttctctctcacttggaggaccccctgctcctttctttgatgacccaattgcacttggtgcattcagtgcaattcaaaagggtatttttgttagttgttcagctgctaacgctggccctttttattcctctttgtctaatgaggctccgtggattctcactgttggtgccagcaccattgacagaagaatagtagcagcagcaaaacttggcaacggggaagcatttaacggggaatcggtgttccaacccaacaacttcacgtccacgttactaccacttgtctatgcaggtgcaaatggaaatgactcttctaccttttgtgccccgggatccttacagagcatggatgtgaagggaaaggtagtgttgtgtgagataggtggattcgttagaagagtagacaaaggacaagaagttaagagcgctggtggtgcagccatgatcctcatgaactcaccaattgaagacttcaatccctttgctgatgttcacgttcttcctgctacacacgtgagttacaaggctgggttagccatcaaaaattacataaactcaacatcaacgccaacagctacaattttgttccaaggaaccgttattggaaatccacatgcacccgcagttacttccttttcctcaagaggtccaagtttggaaagccccggaattctgaagccagacatcattggaccgggacagaacattctagctgcatggcctttgtcattggacaacaatcttcctccattcaacatcatttctggcacctcaatgtcttgtcctcatctcagtggcattgctgctttgctgaaaaactctcatccagattggtctccagctgcaataaaatcagcaatcatgacaagtgctaacactgtgaatcttggagggaagcctatattggaacaaaggcttctaccagctgatgtgtttgccactggtgctggacatgttaaccctttgaaggccaatgatccaggccttgtttatgatcttcaaccaactgattacattccttatttgtgtggtttgaactacacagacaaagaagttggattcatcttgaaccagaaagtgaagtgcttggaggtgaaaagcatagcggaagcacaactcaattatccctcgttttctattcggttggggtctagttcacagttctacaccagaacactcacaaatgttggacccgccaacataacctactctgtggaagttgatgcgccttcggctgtaagcataagcataagccctgcagagatagcattcacggaggtgaagcagaaggtttcatactcggttgggttttatcctgaagggaaaaacaatagaaggaaacacccgtttgctcagggatctatcaagtgggtatctagcaacggcaagtattctgttagcatccctatagctgtcatcttcctgtga

SEQ ID NO: 4237 - DNA, 513 bp, Glycine max var. Williams 82
atggttatggctgacgaagaagaaaacggagtatcgatccaactggaattcccgaagggtcgagtgaagaagattatggcgctggacaaagacgtgaagagagtgagctcagaagcgttgttcctggtgtcgcgctccaccgaattattcctccaatttctggctgaaaaatcggctcaggttgcaattgagaagaaacggaagaccgtgaatctcgaacacataagagtggcggtgaagaggcaccagccaaccagggattttctcctcgatgagcttccgccgccgtctcaggccgccaagcccgataagcccactcagcctgcgggtcggcccaaattggatcctgctccccgtggtactcgctgcatcgatcaattcttccggaaaccagaacctgaaaacacagcccaagccccaggccaaccacctgaaaatccagctcaagctcaatcgcctgaaaatccagaccaagaccaagcccaatcaccggtacctgtagatgagtcttag

SEQ ID NO: 4238 - DNA, 324 bp, Glycine max var. Williams 82
atgatatttgttttttttttgtggtgcataatattatatgacacttctattagagaagtcctatgccaagtcattcaacaaaatgtgccatgtgagcactgtactgatgcaacaattgcaattcgtctactatatatattgtacaacaaacaaatacaaatacacaactcattcttgattagtactttgagcaagcttacctaccaccagtctttagaaaaagaaaaaagaaattccttcacacctgttttcttaaactctcctatactccttaattttgttaattgtcaggtcaaaagaaggaagaaaaaagagtgcgaataa

SEQ ID NO: 4239 - DNA, 1530 bp, Glycine max var. Williams 82
atgtctacggaagatgataataacaaaccttaccaagtacccaaagaaaattattcagttaacagtcatcgaagactatttaacaagtatgcttgtgcttgtgtgatgactgcctcgattatatctgccatatttggttacgttatgggagtgatggctggagcactgatattcataaaggaagatcttcaaatcagtgacctacaagtgcagctcctagcaggcatcttagacgtgttcgcagtatcaggagccatggctgcaggaagaacatctgattatataggtcgccgctacaccgtcattctagcctcactcatcttcttgttgggctccattctaatgggctatggcccatcctactcaatcttaatcattggaagatgcattgttggaattggtgtgggttttgcattgatcatagtaccagtttacagcacagagatttcatctccttccaagagaggctttctcacctctctcccagacctttgcatcaacttggggttcttgcttggctatgtctcaaactacttgtttgaaaaattgcccctgaaacttggatggagaataatggttgctcttccagcaattccttccctcattctagtcattctcatgttgaattcggtagagtctccaaggtggttagtgatgcaaggacgtatagctgaggccaggaaagtgcttttattagtctctaatacaaacgaagaagctaaacaacgcttgaatgaaatagaagtttctgttggcattgttgaaaactgcaccctagacattgttcaggttccaagggaaactcgcagtggtgcaggagctcttaaggaactgttttgtaaaccttccccacctgtgcgtaggatactaattgccgccattggggttcatgtgttccagcagagtagtggaatcgagggtattttggtatatagcccaagggtgtttgagagaacaggaatcagtgacaagagcaagctcatgctagtcactgttggcatgggaatcagcaaaactgtgtcaacattagttgcaacatttttgttggacagagttgggaggaggattctctttctggttagttcaggaggaatggttgtggcactgttagggttaggtgtttgcatgaccacagtggaaagttccactgagaaattattgtggacaacaagcattgccataattgctacctacgtttatgtggcttttatggctattggaattgggcctgtgacatgggtttatagcactgagatatttcctttgagattgagggcacaaggaattggcatatgcgtggctgtgaacagaactacgaatttggcagtggtcacaagtttcatttcgatctataaaaagataacaatgggtgggattttctttctgtttacagctattaatgctttggcttggtgtttctactactttttgcctgagactaaaggaagatcattagaagatatggagagtatctttggggaaaattccaaatcgaaggtacaaaatgacgaagccagagagcaacactag

SEQ ID NO: 4240 - DNA, 1659 bp, Glycine max var. Williams 82; identical to SEQ ID NO: 2181

SEQ ID NO: 4241 - DNA, 1329 bp, Glycine max var. Williams 82
atggactcaggttcgccatatcagtggctgagggagctgagatgggagtcacagggcttaaatccaatgatccttcttcttgactgtgctaaatgtgttgcatctggaagcatcaagaatgcagatattggccttgagtacatatctcagatttcatcacctgatggtagtgcagtgcaaaggatggtcacttatttcagcgaagcacttagttacaggataataaaacgtttgccaggtgtatataagtctctcaatccaccaaaaacatcactgtcttcagaagacatccttgttcagaaatacttctatgatctgtgtccttttttaaagttctcatacctgatcacaaaccaagccattgtggaggcgatggaattcgaaaaggtggttcacattattgatctccactgttgtgagccagctcaatggatagatcttctactaactttcaaaaaccgtcagggaggtccacctcatctcaaaattacaggcattcatgagaagaaagaggttttagaccaaatgaactttcatttgacaactgaagcagggaaattggattttcctttgcagttctatccagttattagcaaactggaagatgttgactttgagaagttgcctgtgaagataggagatgctcttgcaatcagttctgttcttcagcttcattctcttcttgccactgatgatgacatggcggggaggatctcaccggctgcggccgcgactatgaatctgcagagagcagtgcatatgggccaaaggacttttgcagagtggcttgagagagatatgatcaatgcatatatcttgagtcctgattctgcattgtcacctctttccttaggtgcctcacctaagatggggatctttctcaacgctatgcaaaaactccaaccaaaactggtggtgattactgaacaagaatcaaacctgaatggatccaatttgatggagagagttgatagagcactgtacttttacagtgcattgtttgactgcttggaatctactgttttgagaacatcagtagagagacaaaaacttgagagcatgcttctgggtgagcagattaagaacatcattgcttgtgagggtgttgatagaaaggagagacacgagaaactcgagaaatggattcgaaggcttgaaatggctggttttgtgaaggtacctttgagctacaatgggaggatagaagccaagaatctgctgcagagatatagtaataaatacaaatttcgagaagagaatgattgtttacttgtctgctggagtgatacaccaatgttttctgtatcagcttggagttttagtagatga

SEQ ID NO: 4242 - DNA, 651 bp, Glycine max var. Williams 82
atggcgtacaaagtggaccatgaatacgactacctcttcaaggtcgtattgattggggactccggggttggaaaatctaacatactttccagatttacgagaaatgagttctgcttggaatctaagtctactattggggttgaattcgcaaccagaacattgcaggtggaggggaagactgtgaaggcacaaatatgggacactgcagggcaagagaggtacagagctatcaccagtgcctactatagaggagctgttggagccttgttggtgtatgacataaccaagaggcaaacatttgacaatgtgcagaggtggcttcgcgaactaagggaccatgcggactccaacattgttatcatgatggctggaaacaaatctgacctgaatcatctgagagcagtgtctactgaagatgctcaaagtttggctgagagggaaggtttgtcctttctagagacttcagcattggaggcatacaatgttgagaaggcattccaaaccattttgtttgatatatatcacattataagtaaaaaggcactggcagcacaagaggctaattcctctactggccttccccaaggaactaccataaatgtctcgaatatgtccagtaatgctggcaatagaagttgttgctctaactaa

SEQ ID NO: 4243 - DNA, 978 bp, Glycine max var. Williams 82; identical to SEQ ID NO: 2634

SEQ ID NO: 4244 - DNA, 1644 bp, Glycine max var. Williams 82
atgagagcaaaaatgacgctcaaaacagcggcggtggctgtggctatagtgtgcatttctgcctttagcatcactgtggtggctgaagatccatacaggttcttcaactggaatgttacatacggagacatttatccacttggtgttcgccaacagggaatacttatcaacggtcaattcccaggtccagacattcattctgttaccaacgacaacctcatcatcaatgtcttcaacagcttggaccagccatttctcctctcctggaacggggtacagcagagaaggaactcattcgaagatggggtattaggaacaacatgccccatcccaccaggagggaacttcacatacattcttcaagtgaaggatcaaattggaagcttctactacttcccatctcttgcatttcacaaagctgctggtggttttggaggcattaggattttgagcagacctagaattccagtccctttcgatgatcctgccggtgattacactgtcctcattggagattggtacaagctcaaccacacggatttgatgtctctgcttgatagcggtaggaagctgcctttccccaatggaatcctaatcaatggtcgtggttctaatggtgcatatttcaatgtggaacaaggaaagacctacaggcttaggatatcaaatgtggggttggaaaattcccttaactttcgcatacaaaaccacaaattgaaactggtggaagttgaaggaacacacacccttcaaactacgtactcatcccttgatgtccacgtgggccaatcttactctgttctggtaaccgcggatcaacctgctcaggactactacattgtggtctccactcgatttacctccacagttctcacctccactggagttcttcgctatagcaactctgcaggcccagtttcaggcccaccccctggtggacccaccatccaaattgattggtctttgaatcaggcccgctccatcaggaccaacctgacagcaagtgggcctaggcccaacccgcaaggctcctaccattacggtctcataaacacaaccaggaccatcatactgtcgagttcacctggtatagtgaatggcaaacaaagatacgcaatcaatagtgtgtcttacgttgctccagacactcctcttaagctcgccgactactttaaaatccctggcgttttccgtgtcggaagcttttccgacaggcccactggcggtggcatataccttgacacatctgtgctgcaaactgactacagaacatttgtggagtttgtcttccaaaacgacgaagacatcattcagagctatcatctcgatggctactctttcttcgtggttggtatggatggaggacagtggacacctgctagcaggaacacgtacaatcttcgagacgcagtttcgcggtgcactactcaggtatatcccaagtcatggactgctatatatattgcgcttgacaacgtgggaatgtggaacttgaggtctgaattttgggcacggcagtaccttggccaacagttttacatgcgcgtttatacaacatcgacatcaatccgagatgaatatcctgttccaaagaatgcactactttgtggtagggcaagtgggagacacactcgacccctttga

SEQ ID NO: 4245 - DNA, 1578 bp, Glycine max var. Williams 82
atggattctcaaatactcaactcattagcccttatcttgcccttattcctcttcatgattctgatcctaaaactagggagaaaactcaagagaactgaattgtctctaaacataccccgaggaccatggaaactgcctattataggaaatttacaccagcttgttacatcgacaccacaccgaaaattaagagacctggccaaaatatacggacccatgatgcatctccaacttggggagatcttcacaatcgttgtttcctcagcagagtatgctgaggagatactgaaaacccatgatgtcaactttgcatcaaggcccaagtttctagtttcagaaataacgacctatgaacacacaagtattgcttttgcaccttatggagaatattggagacaggtacgaaaaatatgcgccatggagcttctctccccaaaacgtgtcaactcattccggtcaattagagaagaagagttcaccaatcttgtcaaaatggttggttcacatgaagggtcccccatcaacctcactgaagcagtgcactcatcagtgtgcaatataatttcgagagctgcgtttggcatgaagtgcaaagacaaagaagaattcatatcaatcataaaagaaggtgtaaaagttgcagcaggttttaacataggagatttatttccttctgctaaatggcttcaacatgttactggtttgaggtctaagcttgagaagctgtttggacaaattgatcggatactaggagacatcatcaatgaacacaaagaggcaaagtcaaaagccaaagaaggcaacggcaaagcagaggaagatctgttagctgttctccttaaatacgaggagggtaatgctagtaaccagggatttagcttaactattaacaatatcaaggcagttacctcggacatctttgctggtggaattgatgcagtagcaactgccataaattgggcaatggcagagatgataagagatccaagagtgatgaagaaagcacaaattgaggtgagagagatattcaacatgaaaggaagggttgacgaaagttgcatggatgaactaaaatatttgaaatcagttgtcaaagagaccctaaggttacacccaccagctcctcttatacttccaagagaatgtgcacaggcatgtgagattaatgggttccatataccagtcaaaaccaaggtatttatcaatgtctgggcaattgcaagagatccaaattactggagtgaaccagagaggttttatccagagagattcattgatagctctattgacttcaaagggtgtaattttgagtacattccatttggtgctggaagaagaatctgcccaggaagcacctttggtttagcaagtgttgagctgatacttgcatttttgttgtatcactttgattggaagcttccaaatggaatgaaaaatgaggactttgacatgactgaggaatttggagtgactgttgcaagaaaagatgatatatatttgatacctgtcacttataatcctttcctgggaaatggtgcagacagtagggaagtgagtagtgcaagcaaagaaggctga

SEQ ID NO: 4246 - DNA, 2628 bp, Glycine max var. Williams 82
atgtcatcaagccggcaaaggaagacgaagatgtttgggatgtgtggcggtgattataacgacgacgacaaggatgatgcagacaagagagagattgatgaagcaagagaagatggcagccaatatagtctcacaggcattcttcttccgtctctcggtgccacggctgtccgcaatgacagcggtagaccaaagcttcgccgatacattgtctcaccatataatcgtcgttacaaactatggaacaagtttctgctgatattggttttctacactgcttggatgtgcccatttgaatttggtttccttgagaaatcaatgggtgcagtggctataaccgacaatgttgtaaatgggttttttgccatcgacattgttctcaccttcttcgttgcctaccttgataagtccacatatttgctagttgatgaccacaaactcattgctttgagatatgctaagtcctggttgatcttggatgtcattgcaaccattccttatgaagttgttattctaattttgccaccttctcttaagatatatagttacttcaatattcttcgcctttggcgcctccatcgagtgagtgccatgtttgcaagattagaaaaggacaggaaatatagctactttttggtgcgctgttgcaagtttacatgtgttactctattttcattgcatgctgctgcatgctttttctattttcttgctgcacgggataatccagaatctacgtggcttggacttgttcctgatgccattgaccagaatctttggggaaagtatgtagtagcaatatattggtccatagtgaccctttcatcagttggttatggtgatctacatcctgtaaacacaaaagaaatggtatttgacattttttatatgctctttaatcttggactcacctcatatctgataggcaacatgaccaacatggtagtccagtggacggaaagaactaagagatatagagacactgtacaatctgcctcaaatttcgctcgtaggaatcacttgccaaatcgtttacaagaacaaatgtttgctcatttgcttatgaagtacagaactgatttagaaggactacaacatcaagagatcattgatttccttccaaaagccattcagtctagcatctcacactacctattcttttcaattgttgacaaagtgtacttatttcatggagtgtcaaatgacctactttttcaactggtcacagagatgaaggctgagtattttcctccgaaggaagatgtgattttgcaaaatgaagcaccaacagacttttatatattcattactggagctgcagatcttatcattcataagaatggaatagagcaggttgttggcgaggcaaagcctggagatgtagttggggaaacaggagtgttatgttataggccacaagtgtttactgttcggaccaagcggttgagccagatattgcgtttgaatcgaaccacatttctaaatcttgttcattcaaatgttggagatggaacaatgatcataaacaattttcttcagaatttacatgaatcagaggatccattgatgaaaggaatcttggcagaaacagaagcaatgttggccagaggaaaaatggatttgcctattagtttattgtttgcagctagcagaggtgatgatatgttgttgcaacaactgctaaagaagggttcagatccaaatgaaccagataagaatggaaagacagcattgcatattacagcttccaaaggcagagaccattgtgtagctttgcttctagagcatggggctaatcccaacatcaaagacttagatggaaatgtcccactatgggaagcaatcaagggtgggcatgattctgtgatgaaacttcttatagacaatggtgcagatatatcatctggtgatgtaggttctcttgcatgcgttggtgttgagcaaaataacttagaattactcaagcatattgttcaatgtggaggggacgtgacacagtccacgagcaatggaaccacagcactccatgctgcagtgtgtgaaggaaatgttgaaatagtgaagttccttctagagcatggagcagacattgataaacaagatggtagtggctggactccaaggtttttagcagatcaacaatgccacgaagaaataataaatgtattcaagaaagttggacacaagaaaacaccacatgctattcctacaacatccttttttgaaaggtatcaaagtgaacccactataccaggcattccccagggaagcaagccacctaatgaagaaccaacatggtttgataatcatcaaagaagaagagttagccctttccataattccttttttgggataatgtcaaatgcaaattatgataaaaaagactccacaaccgcatctcaaagtagtcacattagtagggaagaattactagccagagtaactcttagttgtccaaagaaaggtgaacatgccaaaaagcttatttttctgccaaaatcccttgaagaattgctacatattggtgctgaaaagtttgattactctgccaccagaatattaagcaaagaaggagctgaaattgaagacatatatgttataagagatggtgatcttcttattcttgcatag

SEQ ID NO: 4247 - DNA, 330 bp, Glycine max var. Williams 82
atgcctgtgagaatccctcgtgatagcccaatgaagataattcctgatccaaatcgcaagacaggtccagatgacgcggttataatgcagaaaataatgggaaaattgagagaagcagatagcaacaacgacggtcgttacgacaaagatgagctgaagcatgctctcaagggtttaggtgccatcctccctgggtggagagccaaccgttgttttggaagggttgatgccaaccacgacggtgagattagtggcgctgaaattgaagctctccttcaatatctccgttctcatggcttacgtgaaggggacattaatttgtgggcataa

SEQ ID NO: 4248 - DNA, 1449 bp, Glycine max var. Williams 82; identical to SEQ ID NO: 2664

SEQ ID NO: 4249 - DNA, 1440 bp, Glycine max var. Williams 82; identical to SEQ ID NO: 2673

SEQ ID NO: 4250 - DNA, 426 bp, Glycine max var. Williams 82
atgcaaggccttcgccgctgctcgaacgacgtcgtccagctagacctctccaccccaaccaccaccaccaccaccaccaccaccacctcttcttgttctctctccatcgacgtggacgaatcaacggaggcccgcatccagcgcctgatctcggagcaccctgtgataatcttcacgcggtcctcgtgctgcatgtgccacgtcatgaagaagctcctagccaccatcggcgtcaaccccaccgtcatcgaattggacgaccacgagatcgccgccctcccctttcccgacaacaaccaccgcaaccccatccccgccgtcttcatcggcggcgactccgtcggcggcctcgagtctctcgtcgcccttcacgtctccggccacctcgtccccaaactcgtccaagttggcgccctctgggtgtga

SEQ ID NO: 4251 - DNA, 300 bp, Glycine max var. Williams 82
atgactctctctaagcttatagttgcttcccttcttgcctcgcttctccttcttcatcttgttgatgctgatcaatcggcacatgtacaaacgcaggggtctcttctgcagaagatagattgtaatggagcatgtgctgcgaggtgtcgtttatcatctcggccacgtctctgcaaaagagcctgtggaacttgttgtagacgctgcaactgcgtgccacctggcactgctggaaaccaagaagtgtgtccctgctatgctagtttgactactcatggtggcaaacgcaagtgcccttag

SEQ ID NO: 4252 - DNA, 945 bp, Glycine max var. Williams 82
atgatggcctctcctacatctccaagagttctcttcttgagtctctttgtaactctttccatgattttacatttgagttcagccaggaagttgtctgagtcagacccccaattgcagttccaataccacagaggccctctcctcacaggcaaaatctccgtaaacctaatttggtacggtaagttcaaaccttctcagaaagccattgttgctgatttcatcacctctctctcctcttccaaacccctcaccgcccaaccatccgttgccacgtggtggaaagccaccgacaaatactacaaaaactcgttccccaaacttgcactctccctagggtcccaaatcgttgatgaaaactactctctaggaaaatcactcaccaccaaccaaatcttaaaactcgcgtccaagggtccacagagaaacgccatcaacatcgttctaacttctgctgaagtggcagtggaggggttctgttcgagtaggtgcggaacacacgggtcctccgtgggggcgcgtgtgaacggtaagaggtataagttcgcctacatgtgggtgggtaactcagagacacagtgccctggtcaatgcgcgtggccgttccaccaacccatttacggtccccagaacccagcacctttggttgcacccaacaacgacgtgggtctcgacggcatggttatcaacgtggctagtcttcttgctgggactgtcactaacccttttggaaatggctactttcaaggacccaaagaagctcctttggaagctggttcggcttgcactggggtttatggtaagggcgcgtatcctggctatgcagggaatctcttggtggaccccaccaccggtgccagttacaacgcgaatggggtcaacggaaggaagtatctgttgccagctcttgttgatcctaaaacctcatcttgttccacgctcgtgtaa

SEQ ID NO: 4253 - DNA, 579 bp, Glycine max var. Williams 82; identical to SEQ ID NO: 2693

SEQ ID NO: 4254 - DNA, 2211 bp, Glycine max var. Williams 82; identical to SEQ ID NO: 2639

SEQ ID NO: 4255 - DNA, 666 bp, Glycine max var. Williams 82
atgtcaaagggtgacaaggttgaggttttggacttctgggctagcccattttgtgcaagagtgaaagttgctttggaagagaagggggtgaactatgtagccagtgaagaggatttgtttggaggcaagagtgagcttctcctgaagtcaaatcctatccatcaaagggttcctgtgctcttgcacaatgacaaacctctagccgagtcttctatcattgttagctacattgatgaagtctggtcttccaacccactgcttccaactcttgcttatgatcgtgcccaagccagattctggactgattacattgacaaaaaagtatttgaaaccgggaggagtatctggggaagcaatggagaagagagagaagtgggcactagggacttcattgaagttttaaagcatcttgaggaagccctaggggagaagaactattttggtggtgatgcctttgggtatgtggacatcatagccattggtcactcggcttggtttttggcttatgagaagcttgggggcttcaaagttgaagaccattcaccaaaaatctcagcttggattaagaggtgtttgcaaagggaatctgttgccaaagttctgccagaccctgagaaggtctaccagtttgtccttcatttcaggaagatgttaggacttgaataa

SEQ ID NO: 4256 - DNA, 1194 bp, Glycine max var. Williams 82
atggcccttcgttgttctcaaaactcttgtggtcttttggccttatttttgtctcttcttgtcctagtagtttctcttcaatgccaagtagcttcttctgctgtgctgttaagcatgaaacataagcacaaccatgtgaacaatcagagaccaatggtccaaaaaaccaaccaaagcatttgttcattgtttgagggtgcttgggtccgtgatgaaactgaaggataccctctttaccaatcttctagctgccctatcatagacccagaattcaattgccaaatgtacggtcgacccgattctgattacctcaaataccgttggaagcccgtcgattgtgaactcccaaggttcaatggggttgagtttctgctgaatatgaaaggcaaaaccgtgatgtttgtcggtgactcgttgggaaggaaccaatggcagtctttgatttgtatgctatcagctgcagcacctcaggcacaaacacatatggtcaggggagatcctctttcagtcttcagattcttggactatggtgtgagcatttcattttacagagctccttatttggtggatgtggatgtgatccaagggaagagaattctgaggctagaaaaggtagatgagaatggtgacgcatggaggggtgctgatgtgctgtctttcaacacagggcattggtggagtcatcaaggatctcttcaagggtgggattatatagaattgggaggcaaatactacccagatatggatcggttagcagctttggaaaggggtatgaaaacatgggctaattgggtggacaataatattgataaaagcaaaatcagggtgttctttcaggccatttctcccacacactacaacccaaatgaatggaatgtgggtcagacaactgtgatgacaacaaagaactgctatggtgaaactgccccaatcagtggcacaacataccctggagcataccctgagcagatgagggttgttgatatggtcataagagaaatgaaaaaccctgcatatcttttggacatcacaatgttatcagcattgaggaaggatggtcacccttcaatttacagtggtgaattgagtcctcaaaagagagctaaccctaatcgagctgattgcagccattggtgtcttcctggattgcctgatacttggaatgaactattctacactgctttgttctactaa

SEQ ID NO: 4257 - DNA, 360 bp, Glycine max var. Williams 82
atgagttcgaagaagaagatagcaatacttatcccagcaagcatgttggccatgctccttctgatatcttcatcagaggtggcagccagccattcaaaggagggtgaggttgtcaaaataactaacgaacagggtgatgccaaatttgttggtggtggtgaccttgatgttatggtcatttgttttcctcctccccctcgttatggccggggtgtttactacgaatacgttgacaatctttctcaaaagcaagcagataaatgctattgtggttgttgctggctgacagagtcgggagattgcagacaatgctgccgagaatactattggtcgcctagaagtggcggtgcctccccctga

SEQ ID NO: 4258 - DNA, 1659 bp, Glycine max var. Williams 82; identical to SEQ ID NO: 2694

SEQ ID NO: 4259 - DNA, 444 bp, Glycine max var. Williams 82; identical to SEQ ID NO: 2633

SEQ ID NO: 4260 - DNA, 396 bp, Glycine max var. Williams 82; identical to SEQ ID NO: 2632

SEQ ID NO: 4261 - DNA, 1335 bp, Glycine max var. Williams 82
atggagtgctcagatactaagcctgtgaaacccaactcgaataatatatcggaaatggtgtgcaagtttgccaaagtttgtaaattgaagtctattggggtgttctcttccgaaatccccaatctccctcacttgcaaagatccatttacaatgagacccttctgagtgaagacagcagtgaagagagcagatgctatgaccagaaagtgcatccccaccccactgaagttcctgccaaagaaaatgcttgtgctggtttggaggtcatgaggaagctgtttgatgctgtttcggcgctgaaattggcataccttcagcttcagcaggctcatatcccttatgaccctcagaagattgttgcagctgatgaccttgttgttgctgagcttgagaagctttgcaagttcaagcgcgaatatgtgcagaaacattgcaagaaaacaaggttcaatgccgctcgttcttctctcttgatggctgaaattgtggccaaagaggcacttttggggaagctgaagtctcagaacagtgccaaagattctgatattcttcagttgtggcgggagctgcaagatttggagatggggaatagaaatctgagtgagaagatcaagcagataagtttggagaaaaggagagcaggtgttttgagtgttactaagtttcaggatgtcttcaaggctgcttcaaagtccattcatgattttgcaaaaccgttgattagcttgatgaaagcttcgggttgggaccttgatagggctgcaaactccattgagaatggtgctgtttattccaaaaggtgtgacaagaagtatgcttttgaggcctacattgcgcgcagaatgtttcatgggatcgctttaacatcttatgatgtgagtgatattatgaagtttgatgacccttttgatgcactgatggagaatccacattctgattttgccaaattttgtcaagcaaagtaccttcttgttgtgcatccgaaaattgaagagtcattctttggcaatttggatcacagaacattcgtaatgagtggcaagcaccctagaaccaagttctatcagttgtttgctaaaatggcaaaatgggtttgggttttacttggatctgctgtgtcaatagatcctgaagcaaccttgttttcggtgagcagaggaagtgtgttttccagcttgtacatggaatctgttgaggaagaaaaggagagtgcaatactttcagatgaagaaagagtgacatataaagttcagttcatgatcatgccagggtttcaaattggaaagatggtggtgaagtctcgagtttatgtctcgaaacattctttaagctaa

SEQ ID NO: 4262 - DNA, 501 bp, Glycine max var. Williams 82
atggctattgaagtgagaaatggtaaatggcaaggttcagttggtggcatagtttgtgtacctattgacaaggtttggaccttggtctctcaaactaaaagactacccgaatggatgccaatggtagaaagatgcagttccttggctggagatgacgatgaaccgggctatgttaggctagtctcgggtttcatgtttcctcaacaagatggagaaaggtcatggatcaaggagaggttggtttcactggactcatcatcacatagctatgtttacagaatggaagcaagcaatgtaggtctagatggatctgtaaactctctaaaactagttgactatggggatgaatcaactcttattcgctggtcatttgagataaaccctttagaagatgtatctgaggacaccatagtggattatctaggatttctctacaaatcttgcatcaataagattgagggtgcaatagaagcagcatcaagaaatgtttcaccaccatag

SEQ ID NO: 4263 - DNA, 2211 bp, Glycine max var. Williams 82
atgatttctttaaggctaagccttcttttcacacttatctgctgtctgattattaatcagacatattccaagaatgatcggaagacttacattgtctacatgggcgaccaccctaagggcatggactctgcttccttaccttcccttcatataaccatggcgcaaaaagtccttggcagcgactttgaaccagaagctatacttcacagctacaaaaaaagctttaatggtttcgtcatcaagttaacagaagaggaagcacaaagaatggcagaaatggacaatgttgtctctgttttcccaaataggaaaagtcgtctgcagacgactagatcgtgggacttcataggcgtttcacagcaaatccaaagaacaagtttagagagagacataattgttggagtaatagactcaggactttggcctgagtctaagagcttcagtgatgaaggatttggtcctccaccaagcaaatggaagggatcatgccacaactttacctgtaacaaaaaaataattggagcaaaatactttaacatcgaaggtgactatgccaaagaagatagcatatcacctagagatgtacaaggtcacgggtcacacactgcatcaacaattgctggaaatttggttaagtcttcaagtctactagggtttgcctcagggacagcccgtggaggtgttccatcagcacgcattgctatatacaaagtatgttggatcaaaataggttgtcctcaagctgaaacccttgcagcatttgatgaagcaattgctgatggagttgatataatttccatttcaaccggacttactagtatagtgtacattccgtatttccaaagcgcatttgatataggaagtttccatgcaatgaagagaggtatattaacgtcaaaatcagccgataattcgggtccagggttatcctctatcacaacttattcgccatggatactctctgtggcagctagcactattggcagaaagttccttactaaggtgcaattgggcaacggcatggtttttgagggggtttcaattaacacttttgatctcaaaaacaaaatgtttccactggtttatgctggagatgtacctaacactgctgatggatataatagttccacatccaggttttgctacgttaactctgtggataaacatttggtgaaaggaaagatcgttctgtgtgacggaaacgcgagtcctaaaaaagttggggatttgtctggggcagctgggatgcttcttggagccactgatgtaaaagatgctccattcacttatgcactgcccacagctttcattagtttaaggaactttaaactaatacattcttacatggtttcattgagaaattcgacggccacaatatttaggagtgacgaagacaacgatgattcacaaacccctttcatagtttcattttcatctagaggtccaaatccacttacaccaaacactctcaagcctgatctcgcagccccgggagttaatattctagctgcatggtctccagtctatacaatttcagaatttaaaggtgacaaaagagcagttcaatacaacatagaatctggcacttcaatggcttgtcctcatgtatcagctgcagctgcatatgtcaaatcatttcatcccaattggtctcctgctatgatcaagtctgcactaatgaccactgccacaccaatgagtcctactcttaatcctgatgctgaattcgcatatggcgcgggtctaattaatcctcttaaggcggcaaatcctggtttagtgtatgatattagcgaagcggattatgtcaagttcttgtgtggagagggctatacagatgaaatgcttcgagttctcactaaagatcatagtagatgcagcaaacatgctaaaaaggaagctgtatatgaccttaatctcccatcattagctctttatgtaaacgtctcatctttcagtcgtattttccatagaacagttacaaatgtgggattggcaacgtctagttataaagccaaagtggtatctccatctttgatagatattcaagtgaaaccaaatgttctgtccttcacatcaattgggcagaagaagtcattctccgtcataattgaagggaatgtcaatccggatatactgtctgcttctctggtttgggatgatggaacttttcaagttagaagccccattgtagtgtatggtgatacataa

SEQ ID NO: 4264 - DNA, 1104 bp, Glycine max var. Williams 82
atggtgtttcctctcctatctatctttgctttactcaatcttgcagtggtggcaacccatgcagaaaccttgccccctgaagtttactggaagtcgaagcttcccaccactccaatgccgaaagccattacagatatccttcacccagatttggcagaagacaaaagcacctctgtggccgtaggaaaggggggcgtaaacgttaacgcagggaaaacaaagccaggaggcacatcagtgaacgtaggaaaaggaggagtgaacgtgaacacagggaaaggaaagcccaacaaaggcacatcagtgaacgtaggcaaaggtggagtgaacgtaaacacaggaccaaagaagggtaagccagtgcacgttggagtgggcccacattctccatttgattacaattacgcagccagcgaaacccagtggcacgatgaccccaacgtggcactcttcttcttggaaaaggacttgcactacggaacaaagttgaaccttcacttcactcgctacttcacctcaagtgttgatgcctcgttcttgcctcgatcagttgctgattccatacccttttcatcaaacaaggtgaatgaagtgttaaacaagttctccatcaaggaagggtcagatgaggctcaaactgtgaagaacaccatcagtgagtgtgaagtgcctggcattaagggagaggaaaagcgttgcgtgacttcacttgagtccatggttgatttcgccactaccaagctcgggagcaacgatgttgatgctgtttccacagaagtgacaaaaaaagataatgagttacaacagtatacaatggcaccaggggttaagaggttgggtgaggacaaggctagtgttgtgtgtcacaaggagaattacccttatgcagtgttttattgccacaaatcagaaaccacaaaagcctattctgtcccattggagggtgctgatggaagcagggtcaaagcagttgcagtgtgccatactgacacatcaaagtggaatcccaagcatttggcgtttcaagtgcttaaggttcatccaggaactgttcctatctgccacttcctgcctcaggatcatgttgtctttgttcccaagtag

SEQ ID NO: 4265 - DNA, 1092 bp, Glycine max var. Williams 82; identical to SEQ ID NO: 2625

SEQ ID NO: 4266 - DNA, 813 bp, Glycine max var. Williams 82
atgccactagaccaccacctcttcttagaagaaattaaaatggcacatcgttacccaaaacccctcttagacaccctctactgcttaaaagaccatattcattgggaggaagaacaagtagaagatgatgagtacagtagtagcacaaccacaacaatcacaaacacaaacacagacacctcctctgtggtctttttagaacacgacctcttctgggaccgcgaggagctatcttctcttctcgccaaagaacaccaaaaccaactctcgaatactctccaaaaaaacctcgttttagcctcatctcgacaagaagcagtggagtggattctgaaagtgaatgcccattattccttttctaccctcaccgcggttctcgctgttaactacctcgataggttcctcttcagcttcagattccagaacgacagcaacaacaatccttggctcacacaactagccgcagtagcttgtctctctctcgctgccaaggttgaagagacccacgtgcccctctttgtagacctccaagtggaggagagtaagtacttgtttgaagcgaaagcggttaatagaatggaaatcttagtgctttcagcacttggatggcagatgaaccctgtaacacctctctcgtttcttgattacatcacaaggaaacttgggttaaagggttatctgtgtttggagtttcttagaaggtgtgaaaccgttcttctctctgttttcgcaggagaaggtggaagaatgctacaagctgatgatggaggttgtgtctgggtaccgatgaggagggaaaacgatccaagttga

SEQ ID NO: 4267 - DNA, 783 bp, Glycine max var. Williams 82; identical to SEQ ID NO: 2641

SEQ ID NO: 4268 - DNA, 735 bp, Glycine max var. Williams 82
atgagagtttccacccagaataattccgagacggagagtagttctacctcattcttaccaccatcaccatcaccatcaccgtcgtcaccaccgtcatccgaattcaagacggagaaacgcaaccgcgagtcgaacaagcaccccgtgtaccgaggggtgcgcatgcggaactggggaaaatgggtgtccgaaatccgcgagccccggaagaaatcgcggatatggctgggcacattccccacgccggaaatggcggcgagggcgcatgacgtggcagcactaagcataaaggggaacagcgccattctcaacttccccgaactcgcggcctcgctccctcgtccggtgtccttggctccccgcgatgtccaggccgcggcagccaaggcggcccacatggacctgccttctacttcatcttccatttcatcgtctttggttccaactactcagtccgcgtcctcgtcatcttcttctctatcgtcgttgacttccgctgacttgttgcccactgcctccgaagaactgagcgagatcatcaagttgccgaggctggaaacaacgagttacgagctggggaacgagtttgtgttcatggactcgcaggacgcgtggatgtatcagccaccgataccgtggttgcatactacctacgacggttctgatgcagatgagtttgtagtgccagagagtggggttgtgactagttttgagagttttctgtgggactactga

SEQ ID NO: 4269 - DNA, 1254 bp, Glycine max var. Williams 82
atgggtgcatctggaaaatgggtaaaagcattaatcggactcaacaacaagaacgacctcggtgggaagaagaagaagtggaggctgtggaagatttcttctgcaggggaaaacagatctcaagactacgactacgctagcgtggcttcggattctttcaatgctgcggtggccactgtggtcagagctccgcccaaggatttcaaactactcaagcaagaatgggccgccacccgaatccaaaccgctttccgcgccttcttggcaagaagggcactgagggcattgaagggagtggtgagacttcaagctcttgtacgaggtagactcgtgaggaagcaggctgcggtcacattgaggtgcatgcaggccttggttcgtgtccaggctcgtgtaagagctcggcgcgtgcgaatgtctattgagggccaagcagtgcagaacatgctcaatgaacgccgcaccaaggctgaactcatcaaacaagctgaggaaggctggtgtgatagcaaaggatcattggaagatgtcaagacaaaattacagatgaggcaagaaggagctttcaagagggagagagcaattgcatactctcttgcccacaagcaatggagatcaacccccatctctaattcaagagcaaatgccactctcaacaatcaggatacggacaaggcaaactggggatggagttggttggaacgttggatggcagctaagccatgggagagtagattaatggaacaaacccatcatgctaatgccacagagaagacccctcctcctccgccaaagaaatgtgttgactcctcaaattcaaaaacatcagaaccatgcaatgtcaaaatcagaaagaacaatgtcagcacaaggatctctgctagacctccccttatttggcaagctaatcatttgtcctcaagtccaagttccgagtttcactatgatgagagctctaattcatcctcaatatgcacttctacaacgccaatatctgggagtgctgcattgccctgtgacaggacagaggatactaacaacacaaggcctagttacatgaacctcaccgagtcaaccaaggcgaagcagaaaaccaacaaccatcaatacaatagatctcataggcagcagtccatggatgagttccagtttctcaaaagaacagcggttttctctaatggtgcttctgacccttcaaccaacttctgtaggcctctttacctaccaacctacatggataagaggtcacagtga

SEQ ID NO: 4270 - DNA, 1044 bp, Glycine max var. Williams 82
atggttactactctttctgaagcctatagggaccaccctctccaccttcatcatattatccccttagacttttcttcacttaggaccatacctgattcccatgcatggcctcaatctgaagatggtgatgatgataatcatggagctggatcatgcatacccatcattgacctcatggatcctagtgccatggaactcataggccttgcttgtgagaattggggtgccttccaattgacgaaccatggcatacccttgagtgttgctgaaggggttgaagaagaggcaaagaggctcttcgcactccctgccgaccagaaactgaaggcattgagatcggccgccggtgccaccggctacggccgagctcggatatcaccgttcttccccaagcacatgtggcatgaagggttcaccatcatggggtctccatgtgatgatgccaaaaagatctggcataatgactgtgcacggttttgccacataatgaacaattaccagaaacaaatgaaggctctagcagagaagctaacacacatgatattcaacttattggggaatatttctgaggaacaaaagcggtggattggttcaaccaacctctgtgaagctgttcagttaaacttctacccttgttgccccgagcctaaccgagccatgggccttgcccctcacacagacacttccctcctcacaatcctccaccaaagccaaaccaatggcctccagatcttccaggaaggagcagggtgggtccctgtgcaccctcaccctggcaccctttttgttcacactggtgacatacttcacatcttgtccaactcatggtttagatgtgcactgcatcgtgtcatggtgaatagtatgaggcaaagatactcagcggcttatttctatgccccccctatggatcatgtagtttctcctttggttcttgattccttgcctcggtttcgttccttgactgtgaaggagtatattggcattaaggccaagaaccttgggggagcattgtcgttgattagtatgcttaataataactaa

SEQ ID NO: 4271 - DNA, 738 bp, Glycine max var. Williams 82
atggttaagtcagagaacaagatccacccagaacaaccatcatcatcatcatcaaagccaatgagaccattatcatcatcaagtgacaacaagaagaagaagtacaagggggtgagaatgagaagctgggggtcatgggtgtcagagattagagcaccaaaccaaaagacaaggatatggttgggatcttattcaactgctgaagcagcagcaagagcctatgatgctgcacttctatgcctcaaaggctcctcagccaatctcaacttcccttcttcaagctcctcctcacaacactatatcatccctcaagacactgccatgatgtccccaaaatcaatccaaagagttgctgctgctgctgccaacaatttcttggacaataatgctattgctattaataatgctaccaccccaccttctcctcctcttgcttcaacctcttcttcatttgtatcgtcaccatcaatgtcatcatcatctcctttagaccaaattgatgatgatgtctctcttctgacaccatttggggcctacactactactactgctactactatctgtgacgaaacaaatgaatcaatggccatgatggaatcttggtatgacttggaggggttgcaatccccaaagtatgttgatcaaatgctaagtggggcattctttgacattgattcaacacagttgcttgatgatctgtatgaagaaagtgacattcgcttgtggagtttctgctga

SEQ ID NO: 4272 - DNA, 1386 bp, Glycine max var. Williams 82
atggatagagaaaatgctgtaatgggtggtgtaagagagggtgaagagcgtggtgttcgggtcactcgagcaatggcaagagctgctttgggttgggtctctgcctcttctagaccgtctttcaagaaggaatgtaaaaacaacagtaggacagcactagcagatgtatctaacataagcagaaaatcacaggcaagaggaggttacaagaagactaacacaaagggatcttccaatgtctccattcaagttttgtcaactcaagaagatgttagagcagagttagcaaaagatttatccacaatatcgatggtacagacacatgatgctattgtagaaaggccggaagacacagagctagtgcaaccctctatgtctgttatggcaggtcctctgctttcaatgcagaactctatgaagtctgatgaaatccttagccctccaaacaaagacattgatatgattactgagaaactaaaactttcagaacgtttgggcattgtggacattgattcagtggagttaaaggatcctcaagtttggagttcatatgcccctgatatatacaataatatatttgtcagggagtttgaaaggagaccgttaagtgattacatggacaagttacagcaagatatcactccaagcatgcgaggaattctgattgattggcttgtggaggtttctgaggaatataagctagttccagatactctttaccttactgtgaatctcattgatcggtttctttctcaaagtttggttcagaaacaaaggctccagttgctgggtgttacttgcatgctgattgcatcaaagtatgaagagatttgtgctcctcgagtggaagaattttgcttcatcacagataatacgtacacaaaagcagaggtattgaaaatggagagtggggttctaaatctgttgcattttcagttatctgttcccaccacaaaaacatttctcaggaggttcatcctagcagcacaatcttcttacaaggtttcttatgttgaactggaatttctggcaaattatttagcagagcttactcttgttgaatacagcttcttgcagtttctaccttcccttatagctgcatctgcggtattaatcgccagatggactctcaaccaatcagaacatccatggaattcaaccatggaacactatacaaattacaaagtgtctgagcttaaaactactgtccttgcactggcagatttgcaacttgatacgaaaggctgttccctgaatgctattcgcgaaaaatataaacagcagaagttcaagagtgtggcaaatttgtctccgaaaccggtgcagtcacttttcgaggctcaagttaaaactgtaaatgatgcatatgtgaagactaaatattga

SEQ ID NO: 4273 - DNA, 582 bp, Glycine max var. Williams 82
atggaaaccctacgaagacatttctcaaagaaaaaaaaggacacatattgtgttattggccgggtcaagcacaatggctattgcaagaagcaccccaaacaccaccaatcacccggtgtgtgttctctttgtttaagggaaaagctttctcaactatcttcttcttcttctgactcacatagaagaatctcatctatttgttcttctagttcttcttctttgtcatcatcatcttgttactcctcagcttcagcctcttcttcatgtgcttctccaatgcaatgtttctgtttcactactaccgaggggaagagtagttcttcttcggtctcgattttcctgctgagtggtaacgatggaatcataaagggtaggtgtaggccattggatattgttccaagaagaagagattgtgaaggtggtggttttgatcatcatggtcatgataagagtgccaacaaaagtggattttggttcaagttgcttcatcctaaaagcaagagaatgaaggaatgttatagggaggacaataagcagcttgttcgtgctatgtctatagaaataagagaaacaatggcttaa

SEQ ID NO: 4274 - DNA, 1473 bp, Glycine max var. Williams 82
atgcccatgtacactccatcactctccgcaccctcctccaatcacattcaaccaagtgtcacactccccttatatatcacaaccaccaagctcaatctcaagcagcagcatcacaccacaccaatgccaatacccatgtgcaacgaaattcaagcccaagcccaagcccaagcccaagcccaacctgggtttaagctcgtcggtttcaaaaacttcgtccgaaccaatcctaagtcggaccgctttcaagtcaaccgcttccaccacatcgagttctggtgcaccgatgccaccaacgcctctcgccgattctcttggggacttggaatgcctattgtggcaaaatctgatctctccaccggaaaccaaatccacgcctcctacctcctccgctccggcgacctctccttcctcttctccgctccttactctccctctctctccgccggctcctccgctgcctcctccgcctccattcccagtttcgacgccgccacctgccttgccttcgctgccaaacacggcttcggcgtccgcgccatcgccttggaagtcgccgacgcggaagccgctttcagcgccagcgtcgcgaaaggagccgagccggcgtcgccgccggttctcgtcgacgatcgcaccggcttcgcggaggtgcgcctctacggcgacgtggtgctccgctacgtcagctacaaggacgccgcgccgcaggcgccacacgcagatccgtcgcggtggttcctgccgggattcgaggccgcggcgtcgtcgtcttcgtttccggagctggactacgggatccggcggctggaccacgccgtcgggaacgttccggagctggcgccggcggtgaggtacctgaaaggcttcagcggattccacgagttcgcggagttcaccgcggaggacgtgggaacgagcgagagcgggttgaactcggtggttctggcgaacaactcggagacggtgttgctgccgctgaacgagccggtttacggaacgaagaggaagagccagattgagacgtatttggaacacaacgaaggtgctggtgtgcagcaccttgcgcttgttactcacgacatcttcaccacactgagagagatgagaaagcgaagtttccttggtggatttgagttcatgccttctcctcctcccacctattacgccaacctccacaaccgtgccgctgatgtgttgaccgttgaccagattaagcagtgtgaggagcttgggattcttgttgacagagatgatcagggcactctgcttcagattttcaccaagcctgttggggacaggccaacgatattcatagagataattcagaggatcgggtgcatggtggaggatgaggaagggaaggtgtaccagaagggtgcatgtgggggttttgggaaaggcaatttttctgagcttttcaaatccattgaagaatatgagaagactttggaagctaaaagaaccgcgtaa

SEQ ID NO: 4275 - DNA, 288 bp, Glycine max var. Williams 82
atgaattgtgaggccaaggtgttcaaccctaaggaaaccagtgtcgtagttctgactaagattaatgtacaacttatttcaacgatacttagaggcaggcaatcgaggatgctggccggtgtcattgttggtctcaatgttgctagaattattaaggaacccactgcggctgccattgcgtgtggattggacaagaaaggtggtgagaagcacaagaatagaaatgtgaaatacaaggacattgatgagattgatcttgttggtgggagcataaggatagggaagtag

SEQ ID NO: 4276 - DNA, 2481 bp, Glycine max var. Williams 82
atggagaacaagaacctgacctcgaaatgttttttttactacaacccaagtcattttttccggttgtttttctgtttgtggattctcatggtaccagtggcgagtgaagagcgttgggatggggtggttgtgacgcaatcaaacttcctagcacttcaagcgttcaagcaagagctggttgatcccaaaggcttcttgagaagctggaacgacagtggctatggagcttgttctggagcttgggttggcatcaagtgtgctcagggacaggtcattgtgatccagcttccatggaaggggttgaagggtcacataactgagaggattggccaacttagggggcttagaaagcttagccttcatgataaccaaattggtggttcaatcccttcagcacttggacttcttctcaatctaagaggggttcagctcttcaacaataggttcacagggaccatccctccttcgttagggtcatgtcctttgcttcagtctttggacctcagcaataatttgctcactgggacaatccccatgagccttgggaatgccactaagctttattggcttaacttgagctttaactccttgtctggcccaatgccaactagcttaacttctctcacctacctatctcttcaacacaataacctctcgggctctattcctaactcatggggtggtagcttgaaaaataacttctttcggcttcgaaatctgatcatagatcataacttgttgagtggaagcattcctgcttctttgggtggcttgagtgaactcacagagatttctcttagtcataaccagtttagtggagctatcccaaatgaaataggaaacctttctagacttaaaactctggatttttctaacaatgccttgaatggaagcttgcctgccgctctctctaatgtttcctcactcactctcttgaatgtagagaacaaccaccttggcaatcaaatcccagaagccttaggcagattgcataatctttctgttctagttctgagcagaaaccaatttagtggccacattcctcaaaatattggaaacatttcaaagcttaggcagcttgatttgtcactgaataatcttagtggagaaattccagtcgcctttgataatctgcgtagtcttagtttcttcaacgtttctcataacaacctctctggtccagttcccaccctacttgcccaaaaatttaactcgagctcatttgtggggaatattcaactatgtggctatagcccttcaaccacatgtccctccctagctccttctggttcacctcctgaaatatcagaacaccgtcatcataagaaattaggcaccaaagacataattctcatagtagcaggagtgctccttgtagtcctggtaacaatttgctgcattctgctattctgcttgataaaaaaaagagcatcatcaaatgctgagggtggccaggccacggggagagcatctgcagcagctgctggcaggacagaaaaaggagtccctcctgtcgcaggcgaagccgaagcgggtggcgaggtcggaggcaaactagtccattttgatggaccattgacctttacagctgatgatctcttgtgtgcaacagcagagataatgggaaagagtacatatggaactgtgtataaggctacattagaggatggaagtcaagctgcagtgaaacgattgagggaaaagatcactaaaggtcaaagagaatttgaatctgaagttagtattataggaagaattagacacccgaatcttttggcattaagagcctattacttgggacccaaaggagaaaagcttctagtatttgattacatgcctaatggaagtcttgcttctttcctacattctcgtgggccagaaacagccattgattggccaacaaggatgaaaatagcacagggaatggctcatggcttgttataccttcattccagggagaacattatacatggaaaccttacgtccagcaatgtgctgctggatgagaatgtgaatgctaaaatagccgattttggtctttctcggttgatgacaactgctgctaattctaacgtcattgccactgctggagcattgggataccgagcacctgagctctcgaagctgaaaaaagccaacacaaaaacagatgtatacagtcttggtgtcatcttgttagaactcctaacggggaagccacctggtgaggctatgaatggagtggatttacctcagtgggttgcctccattgtcaaagaggagtggacaaatgaggtttttgatgtagagttgatgagagatgcttcaacatacggcgacgagatgctgaacacgttgaagcttgctttgcactgtgttgatccttctccatcagcacgaccagaagttcagcaagtccttcagcagcttgaagagattagaccagagatatcagcagccagttcgggtgacgatggagccatcccttcgactagtgaatga

SEQ ID NO: 4277 - DNA, 1116 bp, Glycine max var. Williams 82; identical to SEQ ID NO: 2666

SEQ ID NO: 4278 - DNA, 1236 bp, Glycine max var. Williams 82
atgctatctcccaacccactttctcttctttgcgcactccttctctgcttacctctagccatatttttcaccaccgataccacacatacagcaaccaccacccccatcatgttccacataccaatgcctcttccaagaaacattagcatccaggaaaaccctaacaaaaacttaacatcattgtcaccattattatcatcattaaatatccaagatgacaaaccacacaaagtaaccactcgcgtaaaaggaaggcccattaagcctaaccaaaaacaactctcaacattgttgttatcatcattaccatccccattaagacaaaaccccgatgatgccctattcaaggcagccatgcgcgtgaaatcaaagcccacaaggcctaagaaggtagcgttcatgttcctaacgaccaaacccctcccgttcgcgccactttgggaatcctacttcaaccaaaccccaacatcaaagaatctattcaacatttacgttcacgcagacccatctttctcctaccacgcgcctttctccggcgtattctccaaccgcgttattagctcacaatccaccaggagattctcccccactctctccgcagcagcgcgtcgtctacttgcgcacgcgctcgtagacgacatgtcaaattctgtgttcgtgctaatctctccctcttgcatccctctccactcgctcaagttcacctaccacgtgcttctccgtcagggcaaaagctttgtagagattcttgcgaatgaagaaacggcttatgatcgctgggcggcgcgtggaccacacgcgatgctcccggaggtgaggcttgaggagttccgcgtggggtcacagttttgggcactgacgcgtcggcacgcacggcttgttgtgagtgaccgcgtgctgtggtcaaagttcgacgcgccgtgcgtgcggtttgattcgtgctatcccgaggagaattactttcctacccttttgagcatgtgggacccgcaggggtgcgtgccagccacgctcacgcatgttaattggacggggcgcgtggacgggcatccccgcacgtacgaagcgtgggaagtggggcccgaactgattcggaggatgagggaagatagaccaaggtacggtgacggtaacagtgacggacggagtgatccgtttttgtttgcgaggaagttcgccccagatgcgttgcaaccgttgatgagaattgctaacggcgtcatcttcagggactaa

SEQ ID NO: 4279 - DNA, 210 bp, Glycine max var. Williams 82
atgattttttttagaatggtacaaatcttcagggttcttgtgaaagaatccattcttcatgttggaaacctcaaatctgtctctagtgaaagatcttgccaagaccaggttgagctcaataacccaactcaatatccagcatttaagatgttcaaagaggcatactttgaattcaaacccatcggacatggctgtttgtgctttaggtga

SEQ ID NO: 4280 - DNA, 1884 bp, Glycine max var. Williams 82
atgggggcaatttcaacaccccttgtgttggttcttctattttgctgcctggtttctgtttcacaagcagaatacttgaagtacaaagacccaaaacggccactgaatgttagaatcaaggacttgttgaagcgaatgaccctggaggagaagataggccaaatggtgcagattgaacgaagtgttgccacccctcaagtgatgaagaagtacttcattgggagtgtgctgagtgggggagggagtgttccagaaacaaatgcatctgctgagacttggatccaaatggtgaatgggatccaaaatggatctttgtctacccgtcttgggattccaatgatttatggaatagatgcagttcatggccacaataatgtctacaaggcaaccatttttcctcacaatgttgggctaggagttaccagggatccagtgctgataaagaagattggagatgcaactgcccttgaagttagagctactggaattcaatatgtgtttgctccatgcattgcggtctgcagagatcctagatggggacgttgctatgaaagctatagtgaggaccctaagattgttcaagcaatgactgaaattattcctggtttgcaaggagacatcagtgacaattccagaaagggggttccctttgtcgctggaaagaacaaggttgcagcttgcgctaaacactatgtaggagatggtggcacaaccaagggcattaatgagaacaatactgttgtcagctataatggattgcttcgaattcacatgcctgcatatcatgactccattgtcaagggggtttcaacagtaatggtctcctactctagctggaatggccaaaagatgcatgctaatcattttcttgtcactgattacctcaagaacaaactgaagttcaggggttttgtcatatcagattggctaggcattgacaggattacttctccttctcattctaactattcatattctattcaagttggtgttggtgctggaattgatatgatcatggttccctttaatttcaccgaattcattgatgtcctgacttatcaagtaaagaacaatattatcccagtaagtaggattgatgatgctgtgagaagaatcttaagagtaaaatttgtcatgggcctatttgagaatcctcatgctgatataagcctggtgaaccaacttggtagtgaggagcatagacagttagcaagggaagctgtaaggaaatcacttgtgttgctaaagaatggtaagtctgctgagaagcctctgcttccccttcccaagaaagctgcaaaaatactggtggcaggaagtcatgctgacaatttgggttatcaatgtggaggatggacaattacctggcaggggggtgggggcaataatctcacagtcggtacaacaatccttgatgctgtaaaacaagcaattgatcctgctactaaagttgtctacaatgaaaatcctgactccaactttgtcaagtccaacaacttctcttatgccatagtcactgtaggtgaacacccttatgcagaaacatttggtgatagtttgaatctgactatatcagagccaggtccaagcaccatcaccaatgtatgtgggtctatacaatgtgtggtagttctcatcaccggccgaccagttgtgattcagccatatctatcaaaaatagatgcacttgtggctgcatggcttccagggactgaaggccaaggtgtaactgatcttctctttggtgactacggattcactggcaagttggcaagaacatggttcaagacagttgaccagctcccaatgaatgttggcgataaatattatgatcctctatttccatttggatttgggttatctacaaacaccacccggtactaa

SEQ ID NO: 4281 - DNA, 516 bp, Glycine max var. Williams 82
atgagtggcaaaagcagcttccctgtttgcttttctttggggacatttttcctccttctactcaaccacgtcagtgctgaaaatagaactgaaccgaggaaaaatgcaaatctaagcccattcgagagttggaggagcgcttacttctgcatgaacaatacacccataccaccttcttgcttgggaaaacatggatacataatgaaactggatggtgtgctagacgtgagtgcctctgatatcagcgacttttgtaacaatggttgcaaaagtcacaccttagatgtcttaagttgcatccaagatgtgaagagagacttctacttcgggaccaaacaaaacgtctcctttgtcaaggatgccattatcaatgcatgtgctgcttctcagcgttacgctttaaatacaaatgttacgaaggaccctaacagtgccactagtttgtatgggagattatatgtgccccttgtttcaacactaaccaccatggccttcattgccacctttggggtgtga

SEQ ID NO: 4282 - DNA, 282 bp, Glycine max var. Williams 82; identical to SEQ ID NO: 2662

SEQ ID NO: 4283 - DNA, 153 bp, Glycine max var. Williams 82; identical to SEQ ID NO: 2624

SEQ ID NO: 4284 - DNA, 1758 bp, Glycine max var. Williams 82
atgatggattcctctggtgccaccaacgagaagctcttagaaaatggcactccatcttcttctcaaatgagaaaaggtggcttacgaaccatgcccttcatcatagtgaacgagtctctggagaaagtggcgagctacggaatcatgcccaacatgatactgtatctgagggacgaataccgcatgtctattgcgaagggcacaagcgtaatttacacttggactgccgcgtccgacatcttgtccatcttcggggcattcctctcagattcttacttgggtcgattcctcgtcattgctatcggttccttctccagccttcttggtttaaccatgttgtggttaactgccatgatacctgacctaaaacctacccgtgaatcagacatgttaggctgcaactctgctacagcagtccaactagctctgttgttcttttcaatgggattaatttctattggagctggatgcgtcagaccgtgttccatagcctttggagcagatcaactgacaattaaagaaagatctaatgatgagaggctcttggatagctactttaattggtattatacctcaattgcaatatctagcatgattgcattgagtgtaattgtgtacattcaagaaaatctaggatggaaaattggatttggactacctgctttgctaatgttcatatcggctgccagtttcatcctcggttcgccattctatgtcaaagtgaagccaggtcacagcttactcactacttttgtgcaagtagctgtggtggccgtaaagaacagaaaacttagtcttcctgattgcaactttgatcagttctatcaagatcgtgattctgagccgatgatccctactgatagccttaggtgtttgaacaaagcttgcataaaaaatactgggacagtctcaaaccctgatgtatcagtttcagatccgtggagccaatgcacagtgggacaagtagagtcgctaaaatcattggtcagactcctacctatgtggtcctcgggcgtcttgatgatggtgtcccaaggctcattctctaccctccaagcaactaccttggaccgaaggttatttggcaatttcaagatgcctgcagggtccttcaatcttatcatgatattgaccttatcaatagtcattcccttgtatgaccgcataatggtacctctactagccaaatacaggggcttgccgaatggattcggtagtaaaactcgaattgggattggattgttgtttgtatgcgcagctaagggaacatcagctgtagttgaaactattagacgaaatgcggccattgaacaaggctttgaggaccaacctaatgctataattgacatgtcagttttttggctgtttcccgagtttattttgcttggaataggcgaggcttttaacactgttgcgcaggttgagtttttctacaattatatccccaagaccatgtctagttttgcaatggctcttttcactcttgaacttgctgctgctagtgtagtagggagtgtgttagtgaacattgtggacaaggtcactagtgtaggaggggaggagagctggttagcaaccaacattaacagggcacatctgaattactattatgcactgctcacttgcataggtttaattaactacctctactttcttgcaattagttgtgcctatggtcctcctccagggcaaacacttggagcttcagcaggcaaggaagaagagaaatttgattacagggagttacatacttcctag

SEQ ID NO: 4285 - DNA, 1857 bp, Glycine max var. Williams 82
atgcaagccaaacccattcacaacaccccaacatacattcctccacccataaggccatcaccaccggtgcaccaaacccctccctctataccatcaatcaaacctcgtgcaatatccatatccgcacctaatattcctattgccgtaccaattccaccaattgtagagcctgatgattccaatgctgcttattatgactaccaattcttgttcatgtcacaaagatccgaagcaacccgacccgtcactctaagcaccgtggaaggtgcgatccccgccgatttcccgtctggcacgtactatctaaccggaccagggcttctggccgacgatcacgggtccacggtgcaccctctagacggccatgggtacctaagggcatttacttttgataataatgttactaagaatgtcaagtacatggctaagtacattaagacggatgcacatgtggaggaacatgaccctaagaccaacaagtggaaattcactcatagaggcccattttcagtgttgaagggtggaaaaaaagttgggaacactaaggtcatgaaaaatgtggctaacactagtgttctaaagtggggggaaaagctcttgtgtatgtgggagggtggggaaccgtatgagatccaagccggtacgttagatacgattggacagtacaacatgatggatggtgctgatatggaaaatcatgatcagagcaaaggtggtggtggtggtgatgtttgggaggttgctgccaacctattgaagcctatattatatggagtgtttaagatgcccccaaggagactcttgtctcactataaggtcgattctagaagaaacaggctactcactgtgtcatgcaatgcagaagacatgttgcttccacgcagtaattttacattttccgaatatgactcaaattttaatgtagtacagaagcaagttttcagaatcccagatcacttgatgatccatgattgggcattcacggatacccactacatagtatttgccaatcgcataaaacttgatgtactgggatcaatggcagcagtgtatggcatgtctccaatgatatcagcattgagggtaaacccaagtaagagcacatcccccatttacctgattcctaggtttccaggaaaaaataatggcaaagagagagattggagagtaccagttgaagcaccttcacagttgtggttgctccatgttggcaatgcctttgaagttagacaccctcatgggaatttggacataaaaatacaagctgctgcttgctcttaccagtggttcaatttcagcaagttatttgggtacgactggcaaaagaagaagctagacccatcaataatgaatgtaaaaggtggaagtaagttattgcctcatcttgttcaggtgtctataaaactagattctgactacaattgccaagaatgtgatgtgaaacccatgaagaaatggaagaaatcctcagattttcctgctacaaatccaacgttttctggcaagaagaacaaatatctctatgcagcaacaaccttaggatctcgcaaaacattgccatgtttccctttcgataccgttgtgaaattagacctagagactactgaatctgttgcacaaacttggactgctggaagtagaagatttattggtgaacctatttttgttcccaaaggttaccaagaagatgatggctatcttcttgttgttgagtatgctgtttcaatgaatagatgttaccttgtcatcttggacccaaaaaggataggagcagataatgcccttgttgcgagaatcgaaattccaagccacttaaattttcctctaggttttcatggtttctgggcagctaattag

SEQ ID NO: 4286 - DNA, 834 bp, Glycine max var. Williams 82
atggctcttacacctcaacgtgcattatctcaactacccatcctagtagctatactctcaatattcttagttatcccttccttttgtttcaaccctaaaatgctttataatgcttcatattatcctccatctggttcagattggtcaccttcggtggccacttggtatggacctgccaatggagatggaagtgaaggtggagcctgtggatatggcaacgccgttgggcaacctccattttcttctttaatatccgcgggaagccctcttatatatgactcgggcaaagggtgtggatcttgctatgaggtgaagtgcacagggaattctgcatgctcaggcaaccccgtgaaagtagtcatcactgatgagtgtgctgggtgtggctcagatgctcaatatcattttgatctgagtggcagtgcttttggagcaatggcagtttcaggtcaagatgagaatctacgtaatgcaggaaaaataaacattcagcacagaagaattgaatgcaactatcccggtaggtcaatagctttccacgtggactctggctcaaaccaagaatattttgctaccttggttgaatatgaggatggggatggtgaccttgccaaggttgaactcaaggaagcacttgattcagggtcatgggattccatgcaacaatcatggggtgcagtttggaaaattgacaagggctcaccactgagagcaccattctctatcaagctaaccacacttgagtctggcaaaacgattgtggccaacaatgtgatccctgcaggatggacacctggtcaaacttacagatcaattgtgaattttgcaacctaa

SEQ ID NO: 4287 - DNA, 618 bp, Glycine max var. Williams 82
atgtcaacaaaatcttcgttggaatccatattcgggttctgtggaagccaagctttgagaaagcgacttgaagagcttggttatgatcttaaggaagatgaagttgatagtgtgtttaggcaattcaaagcaatggctgagaaaaaaaaggttgtaactgatgtcgacctcaaagcactagtatcacataaagcttgtcatgcagaatctatctggaagcttggtggtttacaagtgacttgtggaactattggtctttctacagcaacagtaaaacttgttaatattgatggtagcacacatgttgcttgttctattggtataggagcagtggattcaacttacaaggccattaatctcgttgtgaaggaacctacaaaacttttggattactcattgaattcagttacagaaggcattggtgtaaatgtcacagcacgtgttgtaatttgtagggagaacaatcatacatctacttatgctttcactgaagatgctaattatccaacatttagtgggattgcagcagaaatggatgttgttgtttccactgctaaggcctatctggttgcactaaacaagttgttacgatggaaggaatcatttagatgtgcttaa

SEQ ID NO: 4288 - DNA, 573 bp, Glycine max var. Williams 82
atggcaaccaaaacctccattccaagttctcaatccccaaaactctctcgtctccgccctcaatacattcccaaccacatccccgactcctcctacgtccgcatcttggacaccaccctccgcgacggcgaacaatccccgggagccaccatgacagcaaaggagaagctcgacatcgcacggcagctggtgaagctgggcgtggacatcatccagcccggcttcccttctgcgtcgaatagcgacttcatggccgtcaaaatgatagcacaagaggttggcaatgctgttggtgatgatggttatgtgcctgtcattgctagcttctgtcggtgcgttgagaaggacattgctactgcatgggaggctgtgaagtatgctaagaggccacggctttgtacttccatagctacgagccctattcacatggagcacaagctgagaaagagtaaagatcaggtgattcagattgccagggatatggtcaagtttgcacggagtttgggttgcaatgatattcagtttggtgctgaagatgctactagtggcagccatgtttccattattttgtga

SEQ ID NO: 4289 - DNA, 957 bp, Glycine max var. Williams 82; identical to SEQ ID NO: 3562

SEQ ID NO: 4290 - DNA, 1431 bp, Glycine max var. Williams 82; identical to SEQ ID NO: 3566

SEQ ID NO: 4291 - DNA, 1209 bp, Glycine max var. Williams 82
atgaagttcctatttgctgtgctagcaatttttgttgttgctttaccttgtgcgtggactaaactggagcttgatgcaggtcctagcttcaatgttatcgattatggtgccacgggcaatggtcaaactgatgattcccaagcttttctgaaagcatggaaagacgcgtgtaatgcaagttatggcaccgcaacacttctcatacccaaagagaaaactttcatgttacagccggtgttgttccgtggtccttgcaagcctccaaccgttcacattaagctcaagggaaccatcattgccccaaacaagattgaggcttggaaattgccaaaaagtacaaggatggcatggattcgttttaggcacataagtggtcttgttatccgtggagggggatggggactaattgatggtcaaggttctccatggtggaattcttatttcaataccgaaattaagaggccaactgctttacattttcgtgaatgtgactatctattccttagtggattgactcacattaacagtcccaaaaatcatataagcataaatagatgcaacaactcactcatctccaaaattcatatgattgccccagacgaaagcccaaacactgatgggattgatatctcacagtcatccaacattgtcataaagaattctaagatggaaactggtgatgattgcattgccattaaccatggatccaccttcatcagcataattggtgtcttttgtggaccaggccatggcatcagtattgggagcttaggaaaaaatggagcccatcaaacagtggaagaaatatatgtacgaaattgcaccttcaatagaacaacaaatggagctagaatcaaaacatggataggaggtcaagggtatgcaaggaagatcacttttaaggatattatacttatggaagctacaaatcctgtgattattgatcaacaatacaacccatatgacaatgtaggtggagtgagagtgagtgatgttagttaccacaatgtgaggggaacctcaagttccatgcatgcaatcaaactgcattgtgacaaaagcgtaggttgcaccaacattgaattgaaagggattaacataactaccattactggaaagaaaacttatgcatcatgcaaaaatgtaaaaggggtgtgctctttttgtaatccacatgtgtcatgtctttctcataaaggatcaaattag

SEQ ID NO: 4292 - DNA, 1854 bp, Glycine max var. Williams 82; identical to SEQ ID NO: 1591

SEQ ID NO: 4293 - DNA, 2145 bp, Glycine max var. Williams 82
atggccttctgtggtggtactttcgttaagccaaactattctgcgtccccatgttacaaatatacagctctaagtccataccatggctgcagaaacaagttctgtgtgagagtttcagcaagtggctcagctgatgaggaaaggactattataaagaaagagaaagatgggtggaagatcaattactcaggagagaaaccagcaacaccactgttggacactgtcaaccacccaattcacatgaagaatctgtcaacacaggatcttgagcaacttgcagcagagctgagggcagatattgtacacagtgtgtcagaaactggtgggcatcttagctcaagcttgggagtggtggagttatcagtggctttgcatcatgttttcaacacccctgaagataaaattatatgggatgttggtcatcaggcataccctcacaagattctcacaggtagaaggtctaggatgcacaccattaggaagacttcaggactagcaggctttcctaaaagggatgagagtgttcatgatgcttttggggtaggacacagttctactagcatatctgctggtcttggcatggctgttgcacgtgatctattgggaaagaataacagcattatttcagtgattggagatggggcattgacagcaggccaagcttatgaggcaatgaacaatgcagggttccttgattctaacatgatagttgtacttaatgacaacaaacaagtctctttaccaactgccacacttgatggtcctgcaactccggttggagccctcagtagtgctttaagcaaaattcaagcaagttctgaattccgcaaactcagagaagctgcaaaaaccatcacaaagcaaattggaggacaaacacatcaggttgcagcaaaagtagatgagtatgcaagaggcatgatcagtgcttctggctctactctttttgaagagcttggcttatactacataggtcctgtggatggtcataacattgaagatctggtcaccatctttgaaaaagtgaaagcaatgcctgccccaggtccagttttgattcatgttgtgacagaaaaagggaagggataccccccagcagaaaaagcagctgatagaatgcacggtgtagttaagtttgatccaaaaacaggccatcagcttaaggccaagtcctctacactttcatacacccagtactttgctgaatctttgataaaggaagctgaaatagacaataagatagtggctattcacgcagcgatgggtggtggtaccggcctaaattatttccaaaaaaagtttcctgagcgctgtttcgatgtgggaatagctgaacaacatgctgtaacatttgcagctggtttggctgctgaaggcctcaagccattttgtgccatttattcatcattcttgcaacgtggatatgatcaggtagtccatgatgttgatcttcaaaagctgcctgtccgatttgctttggatagggctggtttggttggagcagatggaccaacccattgtggagcatttgatatcacttacatgtcatgcctacccaacatggtggttatggctccttctgatgaaactgaactcatgcacatggttgcaaccgcagcagctatagatgatagaccaagctgctttagatttccaaggggaaatggaattggagccactctgccactcaataacaaaggaaccccacttgagataggaaagggaagaattctggtggaagggagcagagttgccattttgggatatggttctgtggtccaacaatgcagacaagcctcagaaatgcttaaggaactaggcattgatgtgacagttgctgatgccagattttgcaaacctttggatactggtctcattaggctactagctaaagagcatgaaatactcatcacagtggaagagggttctatcggtggttttggatcacatgtatcacaattcctgagcttatctggtatcctagatgggcctctaaagtggagagcaatgatgcttcctgataggtacattgagcatggatcaccccaagttcagatagaagaagcagggctttcatcaaagcagattgcagccacagtcttgtctcttatggaaaggccaaaacaagctcttctgttcaaataa

SEQ ID NO: 4294 - DNA, 900 bp, Glycine max var. Williams 82; identical to SEQ ID NO: 1608

SEQ ID NO: 4295 - DNA, 819 bp, Glycine max var. Williams 82
atggttatcactcaccatactttggcatttacatttggcatgctaggtaatgtcatttcgttcttggtattcttggctccagtgccaacattttaccggatatacaagaagaaatcgacggaaagttttcagtcactaccttacttggtggcactattcagttcaatgctttggttgtactatgcgttgctcaaaagagatgctgttcttctcattaccattaactcattcggatgtgttatagagatcatctacatcgtcttgtacatcacctatgcaaccagggatgctaggaacttaactattaagctattttcggcaatgaacatgacctcctttgctgtgatactcttagtgacacactttggtgtgcatggtccccttcgtgtccaagtcctcggatggatttgtgtttctatttcagttagtgtctttgcagcgccactaagcattgtggcacaagttgttcgcacaaaaagtgtcgagtttatgcctttcaatttgtcatttaccctaacattgagtgccataatgtggtttggttatggcctctttctcaaggacatatgcattgctctcccaaacgtgcttggttttgtgctggggttacttcaaatgctgctctacacaatttacagaaaaggaaataagaagacaaatacaaacgaaaagagtctatcagtaaagccactgaaaaacattgctgtagtgaatccgttgggaactggagaagtgtttcctgtggaggaagatgaacaagctgcaaaaaagagccaaggagatggagaggacaaaaaggctgaagactgcctagtctaa

SEQ ID NO: 4296 - DNA, 573 bp, Glycine max var. Williams 82; identical to SEQ ID NO: 1671

SEQ ID NO: 4297 - DNA, 237 bp, Glycine max var. Williams 82
atgtcaggggcacaaggagcacaaccaaaggagtcaaaaacagcaacaacatatgagtcagtagaaggaggagagaaccgaacaaggactgacttgctttcaagggaggatcaaggctgcattcaagtggaaaaacttcaggagaaggtccatgatcctgctggcaaaggtggtcctgtctttggtgctggcaaagatgaagacaaacaagaccttggagttactggcacaggctaa

SEQ ID NO: 4298 - DNA, 999 bp, Glycine max var. Williams 82; identical to SEQ ID NO: 1589

SEQ ID NO: 4299 - DNA, 795 bp, Glycine max var. Williams 82
atggccataataaaaaacacaagggctcaatctaaaaccccaatctctattctcatgctcattatttccttccttgggttggtccacaacgttaaatcagtttctttctcattccctagttttggctcctacacaaacgacatcaccctccaaggcgaagcctatgttaattcagaaggtgccataaagctcacacctctttcccccaacaacgttggtagagcctcctacgctgcacccttgcacctttgggacgccaaaaccggcaagctcgcaggcttcaacacaaccttctccttcgtcgttgcgccgagcggacccggactctttggcgatggcatcgccttcttccttgctccgttcacctccaacctccccaacaattcaagtggcggattcctcggactcttcagccctaactctgccctaaacgtgtacaaaaaccaaatagtggccgtcgaattcgactccttcagtgggaacccctgggaccctccctctgcccatgtgggcattgatgttaactccattgcttctgtgacaacgaggaaatgggaaactgggaattcgtttgaagttgcatatgccactgtgaactatgagcctattggcaagagtttaaacgtgcttgtaacataccctggaagcagtttgaacacgactagcctctcgtttgtgattgatttgaggactgttctgcctgaatggattagagttgggttctcgggtgccactggacaattggttgaaacacacaagatttattcttggaccttcgcttctagcttctattag

SEQ ID NO: 4300 - DNA, 462 bp, Glycine max var. Williams 82
atgatgatgagcaaggttgtcctgttctcgggggaaactgttggcattattgggctaggaaggattggccaagcaattgctaagagagccgaaggattcaactgtcccatatgctactactctagaactgaaaaaagagactcaaaatacaagtactatccaagtgttgtagaactagcatctaagtgcgagatactggtagttgcttgcccactaacggaggaaactcatcacatcatcaacagggaggtgatcaatgcactgggtcccaagggttatcttattaacattggacgaggcaagcatgttgatgaggcagagttagtgccagcactgctagaaggtcttttgggtggtgctgggctagatgtgtttgaaaatgagcctactgttccagaagaattattcgggcttgaaaacgttgtcttgttgccccatgttgcgggtttttgtcatctctaa

SEQ ID NO: 4301 - DNA, 504 bp, Glycine max var. Williams 82
atgttcatgggattttcatgcggggaggatcattttgacgaaaaagagagcgagtttcccttgatagatgagaccagtgcaacacaagaacaaaacagtatcatcatggaagtgcatcatcatcttcaaggggttgctgataaaagcactgatttctgcccagttgaacaccctatggagccaccagatgaagatcgtcccgtgaaatgcccaatgcccgagtcttcagttatcaatgatgaaaggatgcatgaaaagaggtttgcagaaagctcaaagaaaagagtagagacaaccagggtcgtggtgaatggagaaagaacgaccaccatggacgcagagcctccagctcgaggagtaagaaagcggcatcacaccctcacacacgaaggaggagaccttgtgatgactccattaatgagaatgccacctcttcctcccctaccatcccaaaatatcaccatctttcaggtgcttcagcagttggacaagtttgagtcttaa

SEQ ID NO: 4302 - DNA, 1839 bp, Glycine max var. Williams 82
atggcaccgaattccatgagtttcccaatgttctttgttatgttttccatagctttccctgttgttgtcacagttaccttcatgtatcgaaactctagtttcggactattcgaggggtattcagaaggcaacttacaaagaggaacatctcagaacgttactactgctgctgagcggttgccaaacgttacagaaactcatggctttcaattgggaagagcaatccaaaatacaacacatgacagctcaggaggaaaagatcaaggaaataataacagtactgtcagcagtggagttaaggaacgacaaaggagatcccaaaatcatacctctattgaaggaagaatcaaaaataatattataacagcagatgatggctcaaaaatcgcttcattgacaagttcaaaaaatgattcaactccagcacatgttaatcttgatgacaatgacaagctacttggtggactgttaacctctggatttgatgaagaatcgtgcataagtaggattcagtcccacttgtaccgcaaagcttctcctcacaaaccttctccatatttgatatctaaactacgtaactacgaagaaattcatacaaggtgtggacctaatactagagcttatcacagaagcatgacaatgattgaacactcaaagaacaaaggtgctgctacattgtgtaagtaccttatctggacacctgctaatggtttgggtaaccaaatgattaacctggctgcaacatttctttatgccatcctcactgatcgagtgctacttgtagaatttgggaaagacaagcatggcctattttgcgagccatttctcaattcaacttggatattgcctcgtaagtctcctttctggaatgaaaagcatatagagacatatcagatcttgctagagaaggatagggctagcaattcaacggaggatttaccatcagttctgtttattaacctacaacacacacgtagtgaccctgagaaatattttcactgtggccatagtcaagatctgctccagaagattcctttgttgactttgcagtctgatcaatactttgtgccctctctgttcatgaacccatttttcaaccaggaggttaccaaaatgtttccagagaaagaaacagttttccaccatttgggtcgctacctttttcacccttcaaacgaggcatggaaactgatcagcgattactatgaggcacacttggccaaggcagataaacagataggcttacagattagagtatttagtcctgtttctactccacagcaagcagtcatggatctagttttaagctgcacattgaagcataagatactgccacaagtggatttgcaaacttctgctggaaaaaaccagactactgtaaaagcagttcttgtggcatctttatatcgagagtatggagataatctaaagaggatgtatcggaagaatccaacacttagtggggaagtgataaaagtttatcagccaagccatgaagagcatcaaaagtataatgataataagcataatatgaaagcttggatagacatgtatctgctaagtttatctgacgagttggtgactacctctctctctacttttggctacgttgctcagggattggggaatttgaaaccgtggcttctttacaagctagtcaataacgagacccattttccaccatgtgaacgagatttctcatcggagccttgttaccattttcctcccaagcattactgcaacggagagcccctcaaagatattgtttcttctttcccctatttgaggccgtgcaaggattttagggttggtttgaagatggtcaaagattctatatag

SEQ ID NO: 4303 - DNA, 852 bp, Glycine max var. Williams 82; identical to SEQ ID NO: 1766

SEQ ID NO: 4304 - DNA, 882 bp, Glycine max var. Williams 82
atggaaaaccataaccgtctcaaactgcgaatctctcgcatgttccgatcctcattcgggtcgtgcagaacccgtaacctaaccgatgttatggaaaaaacggtgtttgcaccacccagccccatcgatgaaccaccctcacccaaaacgagacccatttttaggcccaaaaccatcaacgacacttgcatcctgtcgtttaaggattctcattctctccccagacgcaaaatctccgagtggtcatcaccttttgtagtgggtggcggcaacaaaatcaaaaacaacaacctcaaccttaacctcggtgtcatgtcgtgcccacccacttccccaaacatttccctcaacacaatccacgaacacgatttcggttacgacgacaaaaaaaaggtctcgacgaaaaactcgaggaccaacaagaagaagaagaagaagaagaagaagaggcatgcccagaagaaaagggagtttttccctttcaattcatgcgccaaagacaccaactttggtggatactggtggtatagcagtgacgaagacgacgaaaccgacacccttttctcctcgaaaagcctctcctcggattcctcccggtcccggcgccggcgccggaataatgaacggagctccgacatgggtgttctgccgctgaacgggaaggtgaaggatacattcgcggtggtgaagcgctccagcgacccttacagtgatttcaggacttcgatgctcgaaatgatcgtcgagaagcagattttttcgcccgctgatttggagaatctcttgcagtgttttctgtcgctgaattcgcatcaccatcataagatcattgtccatgtcttcaccgagatttgggaggctctgttctctgactggttttga

SEQ ID NO: 4305 - DNA, 1461 bp, Glycine max var. Williams 82; identical to SEQ ID NO: 1626

SEQ ID NO: 4306 - DNA, 201 bp, Glycine max var. Williams 82
atgatggagtgctgcaagattgctatagttctcaccatctacattatggctatgttggtttttgctcactgttgtgtggctgagaatgtagctgaagatgttgctgcaattccacccacaccaatggaaagtgcaggggtgcatctttgtgcctcagctgtttttgtagtcactgcttttgtggttgctatgttcacctaa

SEQ ID NO: 4307 - DNA, 264 bp, Glycine max var. Williams 82
atgatgaagtttagtagcatcagctttgctctgattttatcatttcttctcattaccatgtttatagctgaaagtcgaccaacaccaaccgttgcagacccagtatgtagcataatccatggcgtagaagaaggtgaaacttgcttcaccatcactcaaaggttcattcttcaggaacgccaattccttgagatcaatcctaatatcaactgtaacactatctttgtgggccaatgggtgtgtgtgaacggcaaagtgaattga

SEQ ID NO: 4308 - DNA, 885 bp, Glycine max var. Williams 82
atgtcctcgccgcttacctaccccgcggtgctcgacgacaaggacctcgacgacgccgcattgtgggccatgatcgactccgccacagcctcacactcctcctccaagtgcaagtccctagcctccgccaaattccccatccgccagctcccttccccgatctcaaacccctccccgccgcccaagttccggaaggtcctccgggactctggcgacagcggcgaggtggtgcaagacccgtggccctaccgccctccgcggaagatcgcgaggacgtgtccttccgaggagagcagccccctcgctctggtcagaagcgtgcagaggacgccgccgccgctgaagggcttctcgtcgccggcggctcaggagatcagctgttacacggaggtatcgccgcggtgctatgggagaaacaacgaggtggaggagaaggagagcagcgtggggcatagcttgcttggaatgttcccttcggtttcgttgtttaaggagtaccagaatgctgcaatggcgattttggagaatactgattacactttgatttcggggcatccttacattaagaagtcaggcggggcatgcttttttataggttggagaaagatatcttgttacttcaatatttcttatgaaatcagggacaagaatattgagtttgatgagaatcgtaatgttcagcgtgctgagtttgtgattcgtgcatacatgcaaggtggcaggttctcagacggatggggctcttgtgatcgacgcgagaagagatttcagaaaccaaatcatgatgttcccagcactgcagagactagagcaaaaaataaagcttgtcaagacttgctaggaattggagattaccgacctggtgcaactagtcaatttcgttga

SEQ ID NO: 4309 - DNA, 639 bp, Glycine max var. Williams 82
atgaagagccctaccattttcattctctttctactttctgccttctacacctcactcctaccttcagccaccgctcaagtcgtggttgacatggaaggtaatgatcttcaaaatggtgggaaatattatgtgttgccagtaatagagtcatcatatggtggaataagagtagccgcaactggaaaagaaagatgccctctcactgttgtacaatctgccgatccgtatgataaggggattgcaacaattatttcaaccccatatcgagttcctgttatccgcgaaggctttcctttgaacattacgttcggtaattttgcagttatactgccttgtgtcccccttcgttctgagtggaccgtcgttaatggccaaccagaaggacccgcagttaaaattggttcgcccccaaatgcagaaaatggttggtttgaaattgagaaattgttaacttcgggctataagcttgtgttctgtacgcggcctgagcgtagctattgtcaggatattgggattcatgtcgatgatgaaaatcacgcgcgtttggtgttgacaaatgatgatccactagtggttgagtttctgaaatatgatcccttctggccccagaataatctagtgcttcctacaagtcaatga

SEQ ID NO: 4310 - DNA, 459 bp, Glycine max var. Williams 82; identical to SEQ ID NO: 1709

SEQ ID NO: 4311 - DNA, 1740 bp, Glycine max var. Williams 82
atggagatgccaatggagcaaaagaaagccaccgagctgcttgaaaggaaaaagggtggttggagaaccatgccctttatcataggtgatgacccctttcaagcaaacgagacctttgaaaaggttgcagtagtggggctccgtgtaaacatgattttgtacctgcttcaggagtatcattttgaccctgcaactggaactattataatgttcctgtggaacgccttgaccaatctgttgcccatcttttgtgctttcctttctgattcttgccttggacgatttcgtgttattgcaatgggaacagtcatccaccttgttggcttagttgtgttatggctcactactattattaggcatgcaaggcctcaatgtgatacagaaccttgtgcaaatccaacagtaccgcaactcctgattcttttctcttcccttactctcatggctcttggagctagtggcattaggtcatgtaccttggcctttaccgcagatcaaatctacaaccctgaaaacccacaaaacgagaggaccatgaagagctttttcaattggtactatctttcagttgccatttcagtaacaatttcaatggcattcatagtgtacattcaagttaaagcagggtgggttgtgggttttgggatttctatggggattgtgtcactgtctgcaatcatgttttttttgggcacttccatatacgtcaaagtgaaaccaaacaagagcttgctcactggcttcgcccaagtgattgttgcggcctggaaaaacagacacttacccctgcctcccaagaactctgacatttggtatttccgcaatggttctaatcttgttcaaccaacaaacaaagtaaggttcttgaataaagcttgcataatcaagaatagagagaaagatttggactatgaggggagacccaatgagccatggagtctgtgtacagtgagacaagtagaggagttgaaagccataatcaaagtccttcctatttggtccactggcatcatacttgcgactactgtaagccaacaacaatttttcatagtccaagcaggtaccatggacaggatggtgttcggtatagatatcccagctactaatttcgctttattcatgatgctaactttgaccatgtgggtgattgtgtatgatcgcattctagttcccattttgcctaaccaacgaatactcactgtgaagctacgaatgggaattgggctagtgatctcatgtttagccactctagtagcaacattggtagagaagaagagaagaaatcaagccataagtgaaggatttatagacaacccgaaaggagtggtcaacatgtcagctatgtggttggtgccctcctattgcttatttggtttggcacaaggttttactgtcattggacaaatagagtttttttactctcaatttcctaaaacaatgtccactgttgctgtttccctatctacccttaacattggggtgggaaacttggtgggaagcctcatcatcaaggttgtgaaagatgggacaaggagaggaggaagagctagttggctagcatcaaatatcaatagaggacactatgattactactatggactccttttcattctaaatttggttaatttggtatgtttcttggtatggagtagggcttatgggagtactcaggatataaaagattgggatgaagatgttgacaaaattttgacatcagagaaagagaccaacacacaataa

SEQ ID NO: 4312 - DNA, 3423 bp, Glycine max var. Williams 82
atgccacaagagagctcccaaaactcattttttacatctccttcaaagagaggattgaagagtttggtctccatcaacaaggaggcttcatgcactgctgccacagaagagagtttcaatgataatgaattggctcagaggaaggcagaggaagcagctttgagaagatacaaagcaacagaatggctacgtgaaatggaccatgtggcatcatcatcactctctccaacaccctcccaacaagacttttgcctttcactccgcaatggcctcattctatgcaatgtcctcaacaaagtcaaccccggtgctgtccttaaggtggtggacaatcctgggcttgctgttcagtctgcagagggcgcggcccactctgcaattcagtattttgagaacatgaggaactttttggaggctgttaaggatatgcaacttctcacatttgaagcatctgatttggagaagggaggttcatcaaataaagttgtggactgcattctatgtttgaaagggttttatgaatggaagttatctggtggggttggtgtatggagatatggtggaactgtgaggatcacttcctttccaaagaagtctccttcctccatagttggcagtgaaagtgctgatgaatcattggatgagccagaatcatcacagtatgaacaactgctagaatttcttcaactatctgaagactttttgattgaagaaaccagaactgccaatgctcttgctttcctttatgatcactttggactcagacttcttcaggcttaccttagagaggccaatgggattgaagatctgcctttgaatgcaatggtaattgataccttactcagcaaggtagtcaaagatttctcatctttgcttgtttctcaaggcaatcagcttggacttttcctgaagaaaatactaaaagttgatattggttgtctctcaaagagagagttcatagaagccatctcactatatcttaaccaaagaagtagtttggcatcaaatgatttctccaaattctgcaattgtggtggaaaacgtgatagtattcgacagaatgccaattattctgcaaaatatgttgaagtgatcaatactcaacagaaacaacttgagggtatgaagtacttttttgaagagacaaaattggaggtcagacaaattcaatcagaatgggaagaagaattgagtaggctagagcatcatatcaaaagccttgaagtggcctcctcttcctaccacaaacttttggaggagaaccgccttctttacaatcaagtacaagacctcaaaggagccattagggtctattgtagagtaaggccattcttaccaggacaatcaaatggaccctctacagtagactatattggagaaaatggagatatgatgattgtaaatccccttaagcatggaaaagatgctagaagggttttttcattcaataaggtgtttggaacaagtgtaacacaagaacaaatttatgctgacactcaatcattgatcagatctgttttagatggttataatgtatgcatctttgcatacggacaaactggctcagggaaaacatacacaatgagtggccctgatctgacaactgaagagacatggggtgtaaactatagggctttgcgtgacttatttcatatatcaaaggaaagggcaggttccataaaatatgaagtttttgttcagatgattgaaatctacaatgaacaagtgagagatttattagtcagtgatggctctaacagaagattagacatacgaaacacttctcaattgaatggcatcaatgtgcctgatgcatttttagttccggttacttgtactcaagatgttctagacttgatgagaattggtcagaagaatcgtgccgtgggtgctacagctctaaacgagagaagcagccgttctcatagtgttttgactgttcatgttagaggaagggagttagtttccaactccattcttagaggctgtcttcatcttgtggatttggctggaagtgagagggttgacaaatctgaggctgttggtgagagactaaaggaggctcaacatataaatagatcactatctgcactaggggatgttatctctgccttggcacagaagagtccacatatcccttatagaaatagcaagctcacacaagtgttacaagattctttaggagggcatgctaaaactttgatgtttgttcatataaatcctgaacttaatgctattggggagacacttagcacactcaagtttgctgagagggtttcgtccattgaacttggagctgctcaatctaacaaagaaaccggtgaaatccgagatctaaaggaagagatatcaagtctcagattagcattggagaagaaggaagctgaattggagcaatggaaggcagggaatgctcgaaacgcccttgattctcaaaaaccaagagctgtttcaccttttcaattaccaaaatatggcactagtggcaatatgaagcatgaaactggtcaaagactcatggatgatagaagctttgagtctagaagttgctcttctggtaagcaaagaaggtcaaggtttccctcatcatttatagacaaggactctatgccaaaaatgactcttctgagtgaagaaaagttagtgagctcagggaaaggaagatcaccatctcctccagtgagaagatcattatcaaatgatagagggacagtcattaaaagcaaggctaaaactgaaacaacagacaaccaaccaatattaaagcatccatttcctgctagagtaccagctaacaaatccatttccacaatgccagtggcttcatccactgacaacaacacaagaatgtatgtgaattcacaagagccggtaaagcaggaaaacatttctgaaacactcttcaacctccagaaggtaaactataagaaagtacatcaagaacatgaagaggaacaattcaagcaagcactcagtgcagtaagacaaggtggtattagaaaaagcaagtttgagagtaaggctaaagccaagcatcctcctcaactattatcaccctttaagattcaaaagcctgatttgatcgcaacatttattcctgacatggattttgctggtgaaatgactttggagccaactccaaagaacgattactctgaggctgaaaatgatcttagatttatggagtctgctgtccatggtgctttgagtctcaaaaaaatacgccagaactttgcaaggaattttcagaaccttgaatcaagaggaatagtgcaaacaggagagcctttattggttagcaaagttgaaaacaaagtcgtgaatggttcgggtagcaatcttaaagaaggaagcaatgcatccacgcctgaatttagaaggagccgatctaccccacgtggaaagttttttggtttatcttga

SEQ ID NO: 4313 - DNA, 1002 bp, Glycine max var. Williams 82
atgatcatggtcttgctcatagtcctatacctttctgcaccagcactctcaaaactgtgcaaccaagacaagcaagtcctcctccaaatcaagaaagagcttggcaacccaaccaaactctcttcatggctcccaaccactgactattgcgacaccatttgggaaggtgtcgcttgtgtcaccgacagcaacaaccagacatgccgcgtcgacatcctctacctctcccaccttaacctccccaaaccctaccctattcccccctccataggcaaccttccctacttgaattatctttacctcattgacacaaacttcttcggcgcaatcccctcttccatcgctaatctcaccaacctcaattatctcaacatcacatacaccaatgtctctggcacaataccagatttcttgtcccatatcaaaaccctagtcagcattgacttctcttacaacaacctctccggcaacctccctgcctcgctctcctcgctccccaacctcggcgaaatgatcttcaccggcaaccgaatctccggcgccatccccgactccttcggctccttctccgaggagctcatattgatgaggctctcccgcaaccgcctcaccgggaagattccggcgacgctggcgaagctgaatctgcggttcttggacttgtctcggaacatgctggagggtgacgcgtcggtgctgtttgggtcggagaaagacacggtgcagataaatctggggaagaacaatcttgcttttgacctggggaaagtggagttttcagagatattggccatcttggatcttaggcataaccgtatctatggaacgttacctcagggacttacggcgcttaagcatctgactaagctgaacgtgagtaacaacaatctgtgtggtgagattccgcaaggtggcaacttgcagagaattaaggtgaattcctatgctcacaacaagtgcttgtgtggctctcctcttcccgcttgcactttggttaattaa

SEQ ID NO: 4314 - DNA, 1419 bp, Glycine max var. Williams 82; identical to SEQ ID NO: 1670

SEQ ID NO: 4315 - DNA, 2037 bp, Glycine max var. Williams 82
atggtgcttatgtatatccctggaattaagcatggagtagatgctaaagttgtgaacatgcttacagtgggggagattataagatgggtgcttgctacaccagtgcagttcattatagggaagaggttttattctggtgcttacaaagcattacgccttggctctcccaacatggatgttttgattgccttggggacaaacgcagcatacttttactcagtgtattctgtgctgagagctgctacatcgcagggtttcaaggggactgatttctttgagactagtgctatgcttatttcgtttattttgctagggaagtaccttgaggttttggccaagggcaagacgtccaatgcaattgccaagctcatgaacttgacacctgacactgctatactgttgaccctggacagtgaaggaaatgttgttggtgaagaggaaattgatagcaggctgattcagaagaatgatgtgattaaagttattcctggtgcaaaggtggctgcggatggatttgttatttggggtcagagccacgtgaatgagagcatgattacaggtgaggcacgtcctgtggctaagaggaaaggtgaaactgttattggaggaactgtgaatgagaatggagtgttgcatgttaaggctacctgggttggatcagagagtgctctttctcagattgttagacttgttgagtcagcacagatggccaaggctcctgtgcagaagtttgctgaccgcatttctaaatactttgtgcctctggttattttaatctcattttcaacttggcttgcatggtttttagctggaagatttcatgcttaccccaagtcttggataccatcttccatggatagctttcagcttgctttgcagtttgggatttctgtcatggtcatagcttgtccatgtgctttaggtttagcaacgccaactgctgttatggttggcactggagtaggtgcatctcagggaatacttatcaaaggaggtcaagcattagaaaatgcacataaggtgaactgtgttgtatttgacaaaacaggtactctcacaatcgggaagcctgtggtagtaaatacaaagttgttgacaaatatggtactccgggaattctatgaacttgtggctgcagctgaggtgaatagtgaacatccactggctaaggccatagttgagtatgccaaaaaactgagagatgatgagaaccccatttggccagaggcacgggattttgtgtccattgctggacatggagttaaggccatggttagaaacaaggaaatacttgtgggtaacaagagcttgatggaagaccacaatgttgcacttcccatcgatgctgaagagatgcttgcagaagcagaagcaatggctcaaactggaattatagtgtctattaatagggaagtagttggggttttagcagtatctgatccattgaaaccagctgcacaagaagtcatttccattctcaagtctatgaaaattaggagcatcatggtgactggggacaattggggaactgccaattctatagcaagggaagttggaattgaaacagttattgctgaggccaaaccagatcagaaagcagagaaagtgaaggacttgcaggcttctgggtacagggtggctatggtgggggatggtatcaatgactcgccagcacttgtggcagcagatgtaggaatggcaattggtgctggtacagacattgctattgaggctgctgatattgtcctaatgaagagcaacttggaggatgtcataactgccattgatctttccagaaaaacgttttctcgtatccgcctcaactacatatgggctttgggctataatctacttggcattccaattgctgctggagctctttttccttctacacgatttcggttgccaccatggattgctggggctgccatggctgcatcttctgtcagtgttgtatgctgctctctaatgttgaagtattataggagaccaaagaagctggacaaccttgagatacggggcataagcattgagtga

SEQ ID NO: 4316 - DNA, 822 bp, Glycine max var. Williams 82
atgggtcgtggaagaatacctatggaactcattaaggaggagaaagcctgtgaaaaaacatttcacaagagaaaaaaggggttattgaagaaagcttatgagttttccaccctttgtgcagttgatgttggcgttattatctatgctcccaaatatcttaatgaacctgaaacatggccccaagacaaagactcaagagaggtaaaacgtgtcattcaaaaatatcataacaccactagtgataggcatcctaaggtgtatgatgtgcaagagtattttaacgatagaatgaaaaagattgaaagtgagatttccaaagtgcacaaagaggagataaagctcatgtacccaacttggaatgagtcttacaatactcttggagagaaacaattgaggatgtttgttggtattctggatgccaaacttgatgcttgtaatcaaaggatgaatatgttaaagcaagattcaaagggaaaaggaatagcaaaatcggacaaaattgagacgcttactccctacatggcctcaaatttaggtagtcacctaaatttcatgtctcaaacacaacttttcactcctagtgataacaatcaagtagcattttacccatttcagcttagccaaagttctcaaccttctacgtttcatggtggtcaaagttgtgtgcaattgatggagaaaaatgcaatggtggattgggctaatcaagttggtgttggtgctaattgtgatcccaaaatgggtgtactaaaggaggatcaatctaacaaaactcaaaactcctcaccatgctactacaatggaaatatgcaaactacatag

SEQ ID NO: 4317 - DNA, 432 bp, Glycine max var. Williams 82; identical to SEQ ID NO: 1590

SEQ ID NO: 4318 - DNA, 1365 bp, Glycine max var. Williams 82; identical to SEQ ID NO: 1655

SEQ ID NO: 4319 - DNA, 204 bp, Glycine max var. Williams 82
atgagcagtcactccaacattgagcaagaagcccctgtatcatatccagcaccttctgccacaccacatatgggttatccttccaaggatggtcctgcagctgtagggtacacccaacaaagacttccagaggaaaccaaaaccaggggtgatggattttgggagggatggggagtattgattgccaaaatcactacaccttaa

SEQ ID NO: 4320 - DNA, 1296 bp, Glycine max var. Williams 82; identical to SEQ ID NO: 1686

SEQ ID NO: 4321 - DNA, 987 bp, Glycine max var. Williams 82
atggccgtggttcatggcagttgggtcaagcttgatcaaagaggagaagggcaaggagcgagaagctcacatgctatagccatagtagcacagaaggtgtatgcatttggtggcgaattcgtgccacgtgtccccgttgataacaaacttcacgtgttcgacctagagactttgacttggtccgtggctgatgcatcaggggatgccccaccgccacgtgtcggtgtcacaatggccgtagtgggagaaaccatatatgtctttggtggaagagatggtgaacacaaagagctcaatgagctctattcttttgacacaagggccaacaaatgggccttgatttcaagtggcgatattgggcctcctcaccggagctaccactccatgaccgcagatgaccaacacgtgtatgttttcggtggttgtggggtccacgggaggcttaatgacttgtgggcttttgatgttgttgagaacaagtgggtggagtttccttctcccggtgagaattgcaaggggagaggtgggccgggcttggttgtggctcgagggaaaatatgggttgtgtatggcttcgctggaatggagatggatgatgtgcattgctttgatccagcccagaaaacttgggcccaagttgagactagtgggcaaaagcccaccgcccgcagtgtgttttgcagtttcagtgatgggaaacatataattgtgtatggtggggaaattgatcctagcgaccaaggtcacatgggtgctggtcaattttctggtgaggtttatgcattggacatggagacactagcatggaagaggttggaggataaggtggatttcggtggccatcctgggccccgagggtggtgtgcttttgccagagcttggcggggcggccacgaggggttgttggtgtatggtggcaactctcctagtaatgataggcttgatgacatcttcttccttgctctttctcaagggttggtgaaatag

SEQ ID NO: 4322 - DNA, 1332 bp, Glycine max var. Williams 82
atgtggcctacattagtggctaataagatattcaagaagagacttggaagcagcaattttatagcggattatcctagttataaagaacccttgctgggtattgtagacattgatcagaactcaaaaaccattcttaatgatcacaaggactcacacaaatacaaggtatttgttagtacatggaacgtaggtgggattgcaccggatgaagatttgaatatagatgatttgttggagacatgcaacaactcttgtgacatctatatactagggtattgtcagaactacttcaggtttcaagaaatagtgcctctaaaagcatcaaatgtattggggtccgaaaacaatgagatttctatgaaatggaattccataatcagggaagccttgaacaagaaaataacacatcaaagggacaaagatgctaaaaaacaggagctaaagaataattttcccaataagaaagaaaatccagctaagtgctgtgatgccccacatgatttccaatgtatcattagcaagcaaatggttggattattcatatctgtgtggattagaagagatctttgtccattcattcggcatccaagcgtgtcatgtgtaggttgtgggataatgggctgcttaggaaacaagggttctatatcagtgagatttcagttacatgaaaccagcttctgctttgtgtgcagccatctagcttcagggggcagagaaggggatgagaagcacaggaactctaatgttgctgaaattttttctcggacaagttttcctagaggccctttgcttgatttgcctagaaccattcttgatcatgatcatgtaatattgcttggagatctaaattacagaatttctctaccagaagaaaccacacgcttgcttgttgaaaaaagagactgggattctttattagcaaatgatcagctaataatggagctaatgagtggaaacatgttaagaggatggcacgaaggagcaattaaatttgcacctacctacaaatattgtccaaattcagacatttactatggatgctgctatcatggcaaaaaggcagaaaagagaagagcaccagcatggtgtgatcgaatagtatggtgcggtgagggtctaaagcaacttcagtacactacaattgaatcaaaactatcagatcataggcctgttaaggcaatgtttatagcagaagtcagggttttaccagagctgatgaaaaacttgcaaagcttgttcctatcagaaagatacgagcaaattaaaactccctttgaagtttccaccactgaagattttgtaaatagaaaacgatcaagcttccggttgtga

SEQ ID NO: 4323 - DNA, 834 bp, Glycine max var. Williams 82
atggctaaaacacaaactccatttcctgctctcatgatttgcctattctttgtgttgctactcaacaacgtaaagtcagattcaatttcattcagcttctccaatttcgagccgggacaaaacttcgacatcggtttcctcggcgatgcgcgtccagtagacggcgcaatacaactaacaagaagagacaataatggaccttatggtactcccaacattcgccaacacagcgttggtcgtgcagtatatattccaccagtgcgcctttgggacaaaaccacaggcaaacttgcagacttcgaaacagacttctccttcgtcgtagatttcgctgcttcccaaatccacgctgatggcttgtcctttttcatcatacctttcgatgctgaccccagaatccccaagaattcatctgggggataccttggactattcagccccgaaactgctttcaatgcttacaaaaaccaaatcgtggctgttgagtttgacagcttcggaaatgaatgggatcccaagcctgtccccgttgctcctcatattggaattgacgtcaactctcttgaatcggtggaaactatcgattggcctattaattcacttcctctaggttcggttgggaaagctagcattagctatgattctaatgctaaacaattgagtgtcacggttggctatgatagtaatcacccacctatttttgttgggttgaaacaaatcattgatttgaggggtgttcttccggaatgggttagaattggtttctctggtgccactggtgaaaaggttgaaacgcacgatattctgtcttggtctttcacttcacgcatctag

SEQ ID NO: 4324 - DNA, 1299 bp, Glycine max var. Williams 82
atgggatgcttcttcgcttgcttcagagcccgcgactcctcctccgccaccgcccccacagctacggtgccttcttctccttccggcaaacacaaacctaccgatgttgtggtctctcgaaatcagttatccactttgtttctatccgaagagagagaaaactctgttgtgcgtgatgatcggaagagttttgaagtgggatctcagaaaggtgactatgaggccaagtttctcaaagctggtgataccttggcaaggaccccccttgagaaagcccaccctgttggtcaacctttcaatccctcaactcctgtaaaatgttgtgaggaaggggggaagagaactgattccttagagcaaacaccaagcagctgtatctccaatgtgctaagtactcaatgtgacactcttgattctacggaaggaattaggacagggagtcttcacagtttggataagaatgacaagaatacagcttctgtttcaccttggccatcaaccacatacacgaggaggaacaagtctataggttttgaatgtgacagtgatttatcgtcctgtgactcatccgattatggtgggcgacatatgaaaaaaacagattcactaaataatgagagtacatataaaccatcgcctaatcctaccccgatgaagctatctgatgagatgcaaactcctggaactgcttacccttcagcaaaagacttgccaaatggtaagcctcgagttaagtcccagtttgtgtatccaatttacaaccctggtcatcatttctctcagaagaaatttgaagagagtgaatcagttgagccgtctcaagttacaacttcaacttctgaaaaagagttaaagaaaatgtcttgtgaaaatgaatgtaaggtagaggaaagcttgtcttcctggttgaagcctgcagctgtcattctggaggagagaaacaagagaatgcagaccagttataatcaggtccgcaaaacacctgctgataggcctatcattgggatggttgcagctcactggaacaaggatggggattctcaagctcctcctccgaagtggtgggatggtaacggcataccaaattcaaccaataagtataaagaagatcagaaagtaaattggcatgcaacatcatttgaagagaggttagagaaggcattatctgaggagactgtcatctctcaaaggaaggatacatgtggcaaatcaattccttttgatgagaacgaagaaagtgatactgctctatctcagctgcaatcttcaactcatccacagtccgtggtgtcattttga

SEQ ID NO: 4325 - DNA, 1128 bp, Glycine max var. Williams 82
atggaaaatcacactctccctatggatttgatgagagaaattcttctaagattgccagtgagatctgtttcgcgtttcaagtgcgtatgtaagtcatggctttctatcatctccgatccccaatttggcaattcccattatgacctcgcagccgcaccctcccatcgactcattctcagatcaaaatgttattctcttgaagttcaatccattgatacagatgcaccaccagacacatgttctgctgcaatgtatttgcttctcccccttcaatcacctccacctaaacccaatgactatgacaattatgatggtttgcccaatcgagctaagattttggggtttatacttttatattacgagatgagtcgtgatcttattatgtggaatccgttgacaagattccgtaaacgatcactaaactttgaaaatatgctaacccatcgatttttatatggttttgggtatgacacatcaacagatgactacttgctaattatgatcccgtttcattggaaaactgaaatccaggttttctcattcaaaactaattccaggaacagaaagatgattaaacttaatgttccataccagggtatcggctcgaaattcagtattggatcactcttgaatgagacacttcattggttggttttctctaaggataaatgggttgatgtgattattgcctttgatcttataaaaaggagtttatcagagattgctctgtttgatcatttaacaaagaaaaaatatgaaatgtttagtttaagagtaataggaggatgtctcagtgtgagttgctcggaccaagactgggcaatgactgaaatatggataatgaaagaatataaagtgcagtcatcttggactaagtcttttgtaatccctacatatggcttttcccccatatgcatcaccaaagatggaggaattttgggatcaaatatgagagaaagattggagaaacataatgacaaaggagagttgcttgagcatctcgcctgtgttgctgctgcaggtgaagagtactactgtgccaaccaagatcaacaatctgcaatgtatagagagagtcaactgtttcccaatgtcagttgggaaacaagtgaagatcaccaacagtaa

SEQ ID NO: 4326 - DNA, 1449 bp, Glycine max var. Williams 82
atggaggataataacttgcatctctccctccttctcctcttcgtttctatagtgaccctctccctcttcgtcctcttctacaagcacaggtctgcatttgcggccccgaacctgccaccgggagccaccggttacccggtgatcggggagagcctggagttcctgtccacaggatggaagggtcatccggagaagttcatcttcgaccggatgatcaggtactcctcccagctgttcaagacctccatcctgggggaaccggcggtaatattctgtggggccacctgcaacaagttcttattttcgaacgagaacaagcttgttgcagcgtggtggcccaacagcgtcaacaaggtgttccccaccacgcttcttagcaactccaaacaagagtccaaaaagatgaggaagttgctccctcagttccttaagcccgaggctctccaacgctacgttggaatcatggacaccattgctcgaaaccacttcgcttccctttgggacaacaagacggaactcaccgtctatcccttggccaagaggtacacgttcttgttggcttgtcgtttgtttatgagcattgaggacgtgaatcacgtagcaaaatttgagaacccttttcacctgttggcgtctggaatcatatcagtgcctattgatcttcccggaacgccgttcaacaaagcaattaaagcagcaaacgcaatcaggaaggagctgttgaagatcattagacagaggaaggtggatttagctgaagggaaagcatcgccaacacaagacattttgtctcatatgttgttaacatgcgatgagaagggacagttcatgaatgaattggatattgccgacaagattcttggccttttgattggaggccatgacactgctagtgctgcaatcactttcattgtcaaatatcttgctgaactccctcacatttatgatagagtctatcaagagcaaatggaaattgcaaaactgaaatcgccaggagagttattgaattgggatgatgtcaacaggatgcagtattcttggaatgtagcttgtgaagtaatgagaatcgctcctccacttcaaggaggttttagggaagctatcaatgactttattttcgatggcttttcaataccaaagggatggaagttgtattggagtgcaaattcaacacataaaagtccagaatattttccagagccagagaaattcgatccaactagattcgaaggacaagggccagctccttatacttttgtaccatttggtggaggaccaaggatgtgccccggaaaagagtatgctcgattggaaatattggttttcatgcacaacctagtgaagaggtttaagtggcaaaaattgattccagatgagaaaattatcgttgatcccttgcccatacctgcaaagaaccttccaattcgtcttcatcctcacaaaccctga

SEQ ID NO: 4327 - DNA, 1296 bp, Glycine max var. Williams 82
atgcggatccagtggtggctaaacacatgctcctcggccaactgcgccaccgccacccaccattcaacaatctcactccccaaacaaaaagaacatgcatgtgatgattccatcagctactcctccatttccgaagcacctgcatcttccacaacctccaacaacagcacttcctctctcgaaagcaacctctccatacaaaccctcccatccgttccatctctccaaagcctctctccacaaaacttcaccttctccgtctcccaccattgcgtcaccaccctcgagccacacctttctcgccccgtcacctccctcgctgtcaacaacaacctcctctacgccgcaaccgaccacgaaatcaacgtctacgaccgccacacctgcaccaccatccacgccttcaacacccagcccacctccacctccaactccaccaaaaccatcgccttctccaacaacaacaccgtcatcaccacccaccaagactgcaagatccgcgtgtggcaaaaccacaagaatattcaccaccgcatgttagccactctccccaccgtcaacgaccgtctccaccgtttcctcctcccgaagaactacgtcgcaatccgtcgtcacgagaaacggctctggattgagcatgcggacgccgttacgggactcgccgttagtaacggtgctatatactccgtttcgtgggacaggactctcaagatatggcggttatctgattttcgctgcgtggagtcgttgaaggcgcacgaggacgcggtcaacgcggtggcagtgtccaacgatgggaccgtctacacaggatccgcggacaagcgcatacgcgtgtgggcgaggcccgcgggagagaagcggcacgtgctggttgccacgttggagaagcacaagtccgcggtgaatgctttggcgttaaacgacgacgcttcggtgctgttttcgggtgcgtgtgaccgttcaatattggtgtgggagagggaggacagtgcgaaccatatggtggtgagtggagctctgagggggcaccagaaggcgatactgtgtttggtcaacgtctctgatttgcttttcagtggatccgctgatcgtacggttaggatttggaagcgcgcttatgatggacggtatggatgccttgctgtcctcgacggtcaccggaaaccggttaaatccttggcggcgattccggaggagtatgatcaaacttcacctaaatgtagcgtctcggttttcagtggctctcttgatggagagatcaaggtttggcaggtttctatcacgagtcagtaa

SEQ ID NO: 4328 - DNA, 255 bp, Glycine max var. Williams 82
atggagagcagcttaggagacatgttggttaaggttgtggtgttcattctagttcaagccttggtttaccttatcctctccaattcatcaaacgtgttcaacaagaacatgaagaaatctaacagcttcaggccggcacgttcggtgagcattcgccggatgctcgctttgatctctgattttcctccagaagaagaaccctctccttcaccgaagggtgctaaaacaacatcacttcatcaaagtgatcaataa

SEQ ID NO: 4329 - DNA, 759 bp, Glycine max var. Williams 82
atgggagttcagcaaaagttcattgctttcctctttcttgcaagttttgtttccatcatatttccccttgttagatcatcccaagagcaccaccaaattacaagcagtccttcaaaaaccatagatagcaaccacattaagatgagtccgggacttcagtttcagattacattgcatggctttctcctatgggcttcaatggggttcttgatgcctgttggtatacttgcaattagactgtcaaacagagagaagaatccaaaaaggcatagaattttgttttatgttcattcaattttgcagatgattgcggtgctacttgccacagctggagcaatcatgtccataaaaaatttcaacaacctcttcaacaatagtcatcaaagattaggagttgcactatatggtgttatctggctgcaagttttactgggcatttttcgaccacaaaggggatccaaaagaagtgtgtggttctttgcacactggatactcggaactgcggtcacattcctgggtgtcttgaatgtatatcttggtttaggagcctaccaccaaaagacatcaaagggcataaaaatttggaacattcttttcactgttcagatatctttgattgtgtttttctacctttttcaagaaaaatgggtctacatacaaaaccaaggagtggttttgggcaatgaaataaaaactcctagttgtaatgaaggtgatccagatgaaaaggagaaggtattgaagggtgacacatgttga

SEQ ID NO: 4330 - DNA, 1311 bp, Glycine max var. Williams 82; identical to SEQ ID NO: 1658

SEQ ID NO: 4331 - DNA, 1800 bp, Glycine max var. Williams 82
atggaaaatctgaggcgccttaacattacaaaggagggaattcagtttccttccattgttgttgttggcgatcaatcttcaggtaaatccagtgttcttgaatctttggctggtattagtctgccacgtggccaaggcatttgcactagggtgcccttggttatgaggctccaaaatcaccctcttccaaccccagagcttgtgttggagttcaatggcaagaccatttcaacagatgaagcaaacgtttctcaagccataaatgctgccacggaagagcttgctggccatggcaaagggatttccaacaaccctttgacgttgttggtgaagaagaatggcgttcctgatctttctatggttgatcttcctggtataactcgggttccagttcatggtcaacctgagaatatttatgaccagattaaggatatgatcatggagtatataaagccgaaagaaagtattatactgaatgttctctctgctagtgttgattttactacttgtgagtccattaggatgtctcaaagtgttgataaagctgggctcaggacattggctgtggtgacaaaggctgacaagtctcctgaaggcttgttagagaaagttaatgctgatgaggtcaacattggtcttggctatgtttgtgtcagaaaccgcattggtgacgagtcttatgaggatgctagagtgaaagaacagaggctgttcgagttccatccacttctttccaaaattgacaagtctattgctatgagcatatctaaaactttgccagaaatagtgaaaaagatcaatgagaagctggctaataatttgtctgagttggaaaaattgccaacaaacttggcttccgttgctgatgccatgaccgctttcatgcatattattggattgacaaaagaatctcttagaaaaattattcttagaggagaatctgatgagtacccagaagataaaaacatgtattgtactgcacgtttggttgagatgttagattcctattcaaatgatctttatcgttgtgctgaaagtgatgcaagtaagaattttcttatgcaagagataaaggtactggacgaagcaaagtggattggtcttccaaatttcatgcctcgcactgcttttctttctatattgcaagggaaggtgaatggaattgcaagcaagccaataggtttggttgaaaatgtgtggaactatcttgaggatgtgctgatttctgttatcacgcgtcattccgaaaactactatcagcttttgatttctacctatcgtgcaggccaccatgtaatggaggccattgaaatggagaagcataccgattacacatgtaaccctgagtttgtgcaggaatacaataagttaatatctcagcaagatgcttttctgaatgacgttttgaacaatccggataaaccatcacatgtgagtcttgaaggtgtgggcaaaattgaagtcggtcatttgaggcaatacccatctttgcttactcaagcctttgatttgaaggttaggatgatttcgtactggaagattgtgcagaaaagattgattgacacaattgcgttacatcttatgctgagtattaacaatcttgttaacaaggatttgaaaaacgagattgttcatgatctgttatctcccagtggtggtgggattgaaaggttattggaggagtcaccttcaatttctgggaagcgtgaaaagctgcagaggagtgtcaatgtccataaagagagcaaagaaaccgttgcaaacatcattgaccgtattggcagctgcagtgattattga

SEQ ID NO: 4332 - DNA, 711 bp, Glycine max var. Williams 82
gagaaggttgataaagtggaagcccctatctccattgtagaagtcaagagcctagagagcttgttccaagagaatcaagagttagaagatttgtcctgtcaaaaggaacacaaggaagtgaagccactgattgctgagttcaataaagttgaagaaagcaaagagaaatggcccttgagaagtggatccaaagtggtgatgggtaatagagacaataaagtgaggagggtcaagtccttatcacaaaggctagaagcaaatattgggagtccagaaagcaactgggtgtacagtggaaaaggcatggggaataataatcaagcacttggtagttttggttcaatgagagtggagaaagagtggaggaggacattggcttgcaagctttttgaggagaggcacaatgcagatgggagtgaaggaatggacatgctttgggagacatatgagacagagtccaacaaaattctgaagaagagcaacaccaagagagggaagaagaaaggtgaggttgagaatagtgaggatgatgaggaagaggaagaagaggacatggagggtaagttgtgctgcttgcaggccttgaaattctccacagggaagatgaatttaggaatggggaggcctaaccttctcaaattctccaaggcactcaaaggaattggatggttgcacaatgttggaaagaatggcagaaagagtaaccattga

SEQ ID NO: 4333 - DNA, 1086 bp, Glycine max var. Williams 82
atgatgaaatttcaagcatgttcaaaccccatctcaaacttgttctatgcgtgttgtgtccttcttttaccaccaaccatggccttaggagattgcacctgtgacacaaaagaggccacaaagagtgactcaattgaagtcctccactacaaaattggctcaattgcttctgtgcttgttgctggggcacttggggtgagcctcccattgttaagcaagagaatcccaacacttaaccccaagaatgacatattctttatggttaaggcctttgctgcaggggtgattcttgcaactgggtttgtgcacatacttcctgaggcatatgagagcctaacttcaccttgccttaaggaaaatccttggggcaagtttcccttcactggatttgttgccatgttgtcctccatagggaccttaatggtggactcatttgccacagggttttatcataggcaacattttaacccctctaagcaggttcctgctgatgatgaggaaatgggagatgaacatgctggtcacatgcatgttcatacacatgccacacatggtcatgctcatggatcagctgtgtcccctgagggttcaattacatctgaagtaattaggcagcgcatcatatcacaagtgttggagataggtatagtggtccattcagtgatcattggaatatcattgggtactgcagggagcattgataccataaagcctcttctcgtggccctgtctttccatcaattttttgagggtatggggcttggtggttgcatatctcaggcaaagttcgagtccaagtctacggtaattatggcgacctttttctccctaacaaccccaattggaattgcaattggaatgggggtgtcaagtgtgtacaaagagaatagccctactgctttaactgttgaagggattttcaattctgcttctgctggaattttgatttacatggcattggtggatttgttagcagctgattttatgagcccaaagttgcagaaaaatttgaagctccaactaggggcaaatatttcccttctcttaggtgcaggttgcatgtctctattggccaaatgggcctaa

SEQ ID NO: 4334 - DNA, 831 bp, Glycine max var. Williams 82
atggctgggattgtagtgatatttgactttgactcaacaatcattgagtgtgatagtgataattgggtgcttgatgagaccggtttaactgaaaagttctatcagcttcttcctagcatggcttggaaccctctaatggataagatgatgaatgaacttcattcacaagggaaaaccattcaagacattgtagaaattctgaataggacaccaatgcatcctaggactgtccctgctattgaggcagcttattctcttgggtgtcacctgaagattgtgagtgacgcaaacattttctttattgaaacaatcctgaagcatcatggagtgtggaattgtttctcagaggtcatagccaaccccagccatgtcaatgaagggaggctcaatatttgtccataccatgattatcttaaatcttctcatggatgcaatctttgtccaccaaacatgtgcaagggattggtgatagaaaggatccaaaattcccttgcagcagcaggaaagaagaaaataatctatcttggagatggaaatggagatttttgcccaagtttgaggctcaaagatagtgactatttgatgcctagaaaggactttccattgtgtgatttagtttccaaaaattctaataagataaaggcagaggtacatggttggagagatgggaaagagcttgagcatgttctgctacatgttatcaacaaagctattggggaaggaagcaacattaacaattctactcagaaagtctcagttgattgcaagatggggcccattcctattgacactcttcaaccattgcctaaagccctatcagttcctcagtaa

SEQ ID NO: 4335 - DNA, 3171 bp, Glycine max var. Williams 82
atggcgccaaatttcgcagatctagcattagcgcgctcagaggccatggacaccgtcccaagttcccgtcagcggagccactcctctggtacactcactcgcgccagatcacagctctatcatcatcggaaccgctccggtcaactccgcttcgatcccgttccctcactggacgaaccctgcgcggaacttcttggctttcgccgaaccaattgcaagaaagcgaagcgcgacgacggcgaccttcctcgccgcctgaccaaggatcttcgcgccaggcgagtctattcgcctccgcaatccactaattccggtttgatcgaaagcgcgtttcccaagggaaacgccgaagcaatcgggagtcccgatttggggctttttttcgaggctcggggtttcgataggggaaatgctgatttgtttgaagagagcggtggagattgttcggagaaatttgatggtttggacggagcaacaactctacctgatgctgagatttgcggtggttcaaattccaaggttaacaaagatgtagagaaactggacgcagaggttcctgtcaaagatacaccttccactgggaatggttcttctctcaagagcaaatctgtaggggttctcagaccatgtttccaggggaagttgttcaaggccccgggttcagtcaattacagaaggttgtttccatttcaaaaggataccgtgagagatgattctgtagatacaccaaaattgggattttgccagaaagaccaggagggtagacagggattccaactgcctttgtcacctcaaagtgaagaagagtctaaacaagaacttaagacggatgccactgcagattatggtgttaaagatgctacaagtgatttgcccgatgatggcttgaagcaattgtctagccacatgaataatcttgattgtgttgaggctagtacctcacaggagtttggtgttttgaatgaagaatgtatacagacaactcctcctgatgctgatatatatgttaattcagaggtcaatgtcaaacccatggattttaccagaagcactcatgaaaatgcgggtcaagggttttgtctgaaagctgacaaggtgaaagattctcttaagagtaaatccgtgccgagacaacttttgcacaggaaactttttaaaaccccaggttctgtcagctataaaaggttgcttccatttctaatggatcttaccaaagatgactctgatagatccaaatttgatcatcagacacatcatcaagaagatgaggcaaagaggttccaacttcctttgtcatctgaaagtgaagaagcttctatagatgagcataagacaaacagcagtcccatgcatggcacagttgagtctaatggtttggaaaactatgtattagttaatccttctcatggcaaccagccaaaattgacaccttcccaagactttcctgaatttccaatgcaattggacgcaaaagaagtggttcgcggtgatttatctgcaccctctgtcaatgaacatacagagaactttgcaattgcttctaaggatgaatgcttgagtgcatcagagcttaatccatgttcagtaatggtggatggttttcactctgctaagaatgttgcgcataatgatggcgtcaaggaagtacaaaatacgatatccagacaacacgatagtgactcaccacccaaagatcagtatatgctttatctcaaaggtgatgtctctgggcttacatctgtgcatcgttcaagtaaagaaaaaggattcactattgcttatgatgaaagcaaacagtttgtgaatctgaaggagcgtgaatctgttagcagatttccccctgaatgtcagactctaagtcaattggatcttaatgtgctagatgctgaggagaatgtaacaagtttaaatcatgtccaggtttcaaatgatatacttggagctccatctgagaatattacctcagaaaaatctgacatggcagggcatagcggtgacaaagcaggaagtgtgcagaatgggatagttttatgttcaagaatgccttcaaaaggtagtgataacaaaaatgctagtggaataaaaaatggctctgaatccaagatcacttcggttcttaaacgctgtccacagtttaaattgttgaaacatgctggatctttaaactacaagagattgcttccatttatattggataccatgaaagatgattcttgtgcttcagtaaatgatcatcacccaaaacttgcgaaatccatggatcaaacacctctgccaatttcaacttcaaatttacatctaactcctgtaaatgattcaaatggttgtgttcccgtggaacattttgcaggcaattcttgtcctcagcaacaatcagggttgcaggcttgtgatttaaacaatgatagttcaagcccaaaatctcaaattcctgaatttcagtcatctcatgattcatgcaaagtgattcaactgcaagatgaacaggttgtattaaatggactctgcaagccagaaagctccactgatccatcaatttctgttcatggaatagacttaccaatcacaaccttggcacctatgattaatgaagttaccaccagagaggctacacctgactcgtccaagtcattatcagttttctctgaagtaaaaggaaacaattctttcctgatgtcttctaatgagaagctacctgaaacacacgaatgttctcagagcttgtctcaactgcaagttgtagaacaacttagagttcccgctgttggtttgaaaaaaggaattttaaaaagaaatccaagaggatgcagaggggtttgtgcatgtttgaactgtgcttcttttcggcttcatgcagaaagagcatttgagttttctaaaaatcaattgttagatgcggaagaggttgctcataatcttatgaaggaactatctcatctaagaaatatgttagaaagttctgctgatagtgtcaacaataatcccgtttttggtggaagccaggtgaaagaagcttgcaggaaagcatgtgcagctgaagaacttgcaaagaaccgtcttagtcagatgcacgatgatcttaatattcattgcagaataacgagcttgcagccaccaacggttacgtttgcggttcatgttgaaaaagaagtcattcaacctggcggataa

SEQ ID NO: 4336 - DNA, 270 bp, Glycine max var. Williams 82; identical to SEQ ID NO: 1666

SEQ ID NO: 4337 - DNA, 1197 bp, Glycine max var. Williams 82
atgtacttgtcacatgttgaagaagtccaaaagattgacaagttaaaggtttgcttcacatttcgccataatgagtatggctccactgatcttgatcggtggattcgtttcgccgtcgagaaaaatgtggaagagattgatctttgcttgttggaagagaatcatcatcaccagatcaatgctagtccaaatgatggatactatgttttcccctgtgaagttgttggcaattatgagggtgaaagtggctccaagtcatttctgaagagtcttcgattggcacattgtgtacttgcaccccacatgttacataacttgggttttagcacacttaccactatggaactcttcaaagtagatctgaaatctgaattgcatattcagattttgttgtctagctgcagtaaccttgagttttttgggctgtctgaatgttacaacatgaagaatctgaagatagagcacccctattgccagaagttaaagtacctgaaggtgaagctttgccaggagttgaagaaacttgtgctctacagcaccagcttggaggccttggaattcaagggaagcaaaattgaatttgtgttcgatgctccaagacttaaaactttctacagtcctgtgagtgatactgatgcttgtcataaggagctttggccagtctttaggcttcccattgacataccccagctggaaactttgatcatggaatgcagctgtaacatgggtaaggttatgacaaacagattgccgacgttgacatttccatgtttgaggcatctggaagttatcaaagtgtccacacaacgacaggacctgtggtgggttgcgagaattctgaaggcatgccctatgcttcaacgactagagttgcatctgaagacctatctttgtattgatgatgatgtaagggaaagaggttggcctcccaaatttgagcataatcatctcaaggaagttgtaataaccggcattaaaggatacttatgtgaaattgaaattgcaatttatcttctaaggaacgcaatttcacttgagaagatgacaatagatccacgtgcaaaagtttacactgaaaacggaaaatggggtcaagcagaagcttttgggaattggagcagggtagggaagccgaaggtccatagacatctaaagcaagaagctaattcttcagcagtggaattgttgataaagtaa

SEQ ID NO: 4338 - DNA, 585 bp, Glycine max var. Williams 82
atgggagtatcggggaaccaacgaggcaaggaagtggagaacacacacacttcaagcggtgttagacaagagtatgcattttctccactcaatctaagtttgttcgccaaatggaatcgatttcgtagtttcttagtaattttgtccaaaaaggtcaaaaagaaagttcctactactactaggacggattcaaaggattcagttgacagagatgctgtgcttgcaagggttgaatcagagaaaagactggctttaataagagcatgggaagaaagtgagaagacaaaagcagagaacagggcatataaaaggcacaatgctgtcgtattgtgggagaatagtaagaaagcatctgcggaggcacatcttaaaaggattgaggaaaaattggacagaaacaaggccaagtgtgttgaaaaaatgcaaaacaatgttgctgaaattcatagaacagcagaagagaaaagggcaatgatagaagccaacaggggagaagaattcctagaaatagaggagaaagctgctaagtttcgtacccgtggctattcacccaggaaatatcttccatgcttcggcagcagttaa

SEQ ID NO: 4339 - DNA, 1335 bp, Glycine max var. Williams 82
atggtgaatgaacaaagagcccatttatgtcttcaatgtagaaacttgatttggacaagctcaagagcattccatcagtgtcttgagctccaaatggagaacacctggatcctgacttttcaccttctcctcctcctgctccatccaaatgcagcaaaaggggccattggtgttggtgttggtgttggtggcagaggtggcataggtgttggcattggcattgggggcagtgttaacaccccagggccctctggatcaaacctcaagagtgccttcacagcactccaggcatggaaatctgccatgaccgatgacccattgaagattctggatacttgggttggtcccaatgtgtgttcctacagaggtgtcttctgtgcaaactctcaggatgataatggaattgtcacaacagcagcaaccgagtcttctattgttgcaggaatagatctcaaccatgcaaacctccaagggacccttgtcaaagatctctctttgctctctgacatcactcttttccatctcaacagtaacaggttttctggctcactccctgacacattcagggacctcacttcactccaagagttggacctcagcaacaaccagctctcaggccctttccccatggtcactctctccatgccaagcctcatctacttggacctcagattcaacaacttctcaggccaacttcctgatcaactcttcaacaagaaacttgatgctatattcctcaacaacaacaactttggaggtgaaattccagacagtttgggaaattcacctgcctcagtcatcaacttggccaacaacaagttgagtggaagcatccctttcagctttggcttcatgggttcaggactgaaggagattctcttccttaacaaccagttaacaggttgcattccacaaggagtagggatcttcactgagatgcaagtttttgatgtgagcttcaactcactcatgggccatttgcctgacactatgagttgcttgcaagacatagaggttcttaatttggcacataacaagctttctggggagttatccgatgtggtatgctctttgagaagcctattaaatctaactgttgcttacaacttcttctctgggctgagccaggaatgttcaaggctattcagtgtggggtttgatttctcggataattgtattcctggaagggatatgcaaagaccccaaccggactgctctataatccctggtggtagtctcaattgtcttagaattcctactccaaaacctcttgtttgcgctgctctggctgcaactttgtctaagcacacaaattcacgttccttttctccctga

SEQ ID NO: 4340 - DNA, 2844 bp, Glycine max var. Williams 82; identical to SEQ ID NO: 1772

SEQ ID NO: 4341 - DNA, 1101 bp, Glycine max var. Williams 82
atgggcaacagaattgttatgggaaattcccttctctttatctctttcttcatcttcagctttagtttcttggaggctcaaaaggctccagcagtttatgtgtttggagactcacttgttgatgttggcaacaacaattacttgagtctctccattgaaaaggcaattcttcctcactatggcattgattttccaactaagaaacccactgggagatttagcaatggcaagaatgctgcagatttaattgctgaaaacttgggcctacctacttctccaccttatctctccctagtatctaaggtccacaacaacaacaagaagaacgtatctttcttgggtggtgttaattttgcctccggaggtgctggaatatttaatgcctcagataaaggatttaggcaatcaatacctttgccaaagcaagtggactactactcacaagtgcatgaacaactgatacaacaaataggagcatctactctcgggaaacacctctcaaagtccatcttcattgtggtgattggtggcaatgatatctttggttactttgactcaaaggatcttcaaaagaaaaacacccctcagcagtacgtggattccatggcttccacattaaaagtgcaactacagagattatacaacaatggtgcaaagaaatttgagattgctggtgttggtgcaattgggtgctgccctgcatacagggtcaagaacaaaacagaatgtgtttctgaagccaatgacttgtcggttaaatataatgaagctcttcaatccatgttaaaggaatggcaattggagaacaaagacataagttactcttactttgatacttatgctgccatccaagaccttgttcacaatccagcttcttacggatttgctaatgtgaaagctgcatgttgtggacttggtgagttgaatgcccaaattccatgcctgccaatttcgagcatttgttccaatagaaaagaccatattttctgggatgcattccatcctacagaggcagctgctcgcatctttgtggatgaaatttttaatggaccttcaaaatacatatctcctattaatatggaacagttactggccatttga

SEQ ID NO: 4342 - DNA, 1455 bp, Glycine max var. Williams 82
atggatctcattcgtgtgtttttcactctatggtttactttgatacttttgaaccataattttggaaatgtggagggaagataccaccatcacaccaagcagaagaaagtttccactgctcctaatgattcttctgattctccaagtgttccttccgacccttcagcttcaccaccttctaattctcctagtccttctaattctcccagtgttccttctgacccttatccaaatgataaccaaacttcctcttctgactgtgttttcgatgtgagatcctttggggctgttggagatggctgtgctgatgacacacgtgcattcagagcagcatggaaagcagcatgtgctgtggactctgggattgttcttgctccagaaaactacagctttaaaatcacttcaactattttttcaggtccatgcaagccaggattggtattccaagtggatggaacactaatggcaccagatggaccaaattcgtggccagaagcagatagccgcaatcaatggcttgtattttatcgacttgaccaaatgactcttaatggtacaggaaccattgaagggaatggagacaaatggtgggatctcccctgcaagcctcacaggggtcccaatggaaaaactttgtcagggccatgtggtagtcctgctatgatacggttcttcatgagctccaatttgaaggtgaaggggttgaaaattcaaaacagtcctcagttccacatgatattcaatggctgccaaggagtactgatcgataagctctccatttcttcaccaaaactcagccccaacaccgatggaatccatgtagaaaattccaaatatgttgggatatataattccatgataagcaatggtgacgattgcatttcaattggacccgggtcctcaaacgtggacatagctggtttaacttgtggtcctagccacgggattagcataggaagccttggagtgcacaactcccaggcatgtgtgtccaacttaactgtccgtgacagcatcataagggaatcagacaacggactcagaatcaagacatggcaaggtggaatgggatcagtgtcaagtctgagattcgagaacatccaaatggagaacgttggaaactgcatcataatagaccaatactactgtttgtcaaaggaatgtctaaaccagacttcagctgtgcatgtgaatgatgtgtcctacagcaacataaagggaacctacgatgtgagaactgctcctattcactttgcttgcagtgacactgttgcctgcacaaacataacactctctgaggttgagcttttgccattcgaaggagcattgctggatgaccctttttgctggaatgcttatgggacacaagagaccttgactatacctccaattaattgcttaagggagggtgaccctgaaacagtgggcgatctttctgaatatcaatgcagttaa

SEQ ID NO: 4343 - DNA, 1071 bp, Glycine max var. Williams 82
atgtctctcccttctgttttggggaattctgaagacaattcaaaaagtgttgctgttgaaaactgtgctggcataaactgggatgagcttggatttaacccagttcccacagatttcatgtatgtcatgaaatgtgcaaaaggagaaaagttttctgaaggatccctcattccctatggtaacatagagatcagcccttttgctgtgatactaaactatggacagggaatctttgagggactaaaggcatatagaactgaagatgggtgcatccttctgtttagaccagaagagaatgctcaacgaatgaagataggagcagacagattgtgcatgccatccccatccattgaccagtttgttgctgctgtgaagcagacagttcttgccaacaaacgttgggtgcctccaccagggaaagggtcactatatattaggccattgctcatgggaaccggagcttctttgaacttgtctccagcacctgagtacacattacttatttattgttctcctgtcactaattaccacaagggttcactgaacttaaaagtggagagtaagttctaccgagcaatatctggcactggtggaaccggagggatcaagagtgttaccaactatgcccctgtttatgctgcaagcattgaagcaaaggccagtggattctctgatgttttgttcttggactcagcaactggaaaaaatatagaggaggtttctgcatgcaatgtgtttgttgtgaagggtaatgctatctgcaccccggcaacaaatggagccatcctccctgggatcacacgaaaatccatcattgagattgccttagatatgggttatcaggtcacggaacgtgccatatcagtggaggaaatgctagatgctgatgaagtgttctgcacaggaactgcagttgttgtcaactctgtttcatctgtaacctacaaagaaacaagaactgagtataaaacaggaccagaaacattgtcccaaaaactgcgcaaaacactggttggaattcaaactgggtgtattgaggacacaaagggctggacagttcgaatagattga

SEQ ID NO: 4344 - DNA, 1374 bp, Glycine max var. Williams 82
atggagatcgttcgtcctcagaatcgcagaaactcgttttcctcttccaatgacgccgtttctgctcccaccattcccctctatcgctctgctcccccactcgaagtcaggctcgaggatttcgagtccttcgccatcgatcgcctccgagttctcaaggggatttctgatggtatgtcgcgtggaaaaaaatcggaagaaatggagaatttggtaaaggacctgtggaaaatgaatatgagacatcaagacgcatctcaggttctgaacaaggatattatatcacattttgttctacgtctggtgtattgcagaacggaggacttgaggaaatggtttctttccacggaatctgcactctttcgctaccgttttcgccttctgaatgctgaagctcagagagcagtcatggaagaatttgaccttccttacaaggccgttagcaatgtggaatttgagagcataaaagagaaattgggacaagttgcacgttctatgggtcagccttcgcctactgcagatgctatcttctacaaggtaccatttgaagaagttccagagcttgttgctggacggaaggtgtttataaatcaaggatatgcatatgttgcaatgaatcagattgtttcacttgtagccacactattccgtagtcaactgtcaaaggcactaatccttacaaacagaaaatggacatcttcagttagagagcaagagaaacataggttgactcctattgtggaagccctgtcctcaagttatctgggtcctgattattctcagtcaaaagaatatgctgatatatcattaaaggacattgatcaagttgccaagagctcatttcctttgtgcatgcgtcacctatttgataagctgaaagaggatcatcatttaaagcatggagggaggatgcaactaggcctctttctgaagggtgttggcataaatctggatgatgcacttgcgttttggaggtcagagttctctaaaaaggttggtttggagaagtttgagaaacaatatgcatacaacatacgccataattatggaaaggaagggaagagaactgactacactccctattcttgtcaaaagattatttcatcaactcctggagctggagatcatcatggttgcccttatcgaaatttcagtgaagagaatctaagagctgctctcagcagaatgggggtaaacagttgggcaatggaagatgtgatggacaaagtgaaaaatagacattatcagttggcttgcaccttgacatttgaagctcttcatggcatgacgtgtgatgcagggattaaccatccaaatcaatacttcagtgacagtcaaaagatattaaagccaaagaaggattcttcagcctaa

SEQ ID NO: 4345 - DNA, 1959 bp, Glycine max var. Williams 82; identical to SEQ ID NO: 1720

SEQ ID NO: 4346 - DNA, 1026 bp, Glycine max var. Williams 82; identical to SEQ ID NO: 1615

SEQ ID NO: 4347 - DNA, 846 bp, Glycine max var. Williams 82; identical to SEQ ID NO: 1728

SEQ ID NO: 4348 - DNA, 1542 bp, Glycine max var. Williams 82; identical to SEQ ID NO: 1763

SEQ ID NO: 4349 - DNA, 1434 bp, Glycine max var. Williams 82
atggagttcatatcaagagaaaccatcaaaccctcgaaccccacccctcctcacctcagaatccatcctctctccttcatagatcacatcgtttttcgcaactacatccccttgcttttcttttacaactccccaaaccatgagcaagcatccacaatatcaaaactcaagaaatccttatcccaagttttatcccgatactacccttttgcaggcaagctcagagatcaagtttccatcgactgcaacgaccaaggagtgtcctttctagtcacaaggctgagatgcaacctatcaacgatcctccaaaaccccacagaagaatcgttgaaccctttgttccccgatgaactacagtggaaacctatgagtagcagtagtagttcaagtataatagccatacaaataaactgttttgcatgcggaggaatagcaatgagcgtgtgcatgtgtcacaaagttggagacgcggccacactttcaaatttcatcaacgactgggccacacttaaccgccaaaaagaactagaacaagaaacagcagagttgttattattacccttcccagtacccggggcttcacttttcccgcaagaaaacttgcccgttttcccagaagttttgttcgtggaaaacgacaccgtatgcagaaggtttgtcttcgaggcctccaagatcgactccctcaaatccacggtgtcttcccacaacgtcccgaaccccacgcgcgtagaagtcgtcagcgcgttgatttacaaccgcgcggtttcggctctagggttgatttccaagacgacgtcgttccgcaccgccgtgaaccttcgcacgagaacggttccgccgctcccggagaagagcgtggggaacttggtctggttcctcttcgtgcttagcccttgggaaacggagctgcatgagttggtgctcaaaatgaaacaaggcttaaccgagttttgtgaaacgtatgcgaagaaatttggaggggaggataaggacatgtcgttcatctccgagtgtctgaagcaagctgcttcggttcccgaaccacagcctggtggttcggatgatgaggagagtcaaatagtaactatgttttgttgtgcgagttggtgcaggtttccgatgtatgaagcggattttggttgggggaaaccggtgtggttcaccactagtaagtgtcccgtgaagaatagcattgttttgatggataccagagatgggggtgggattgaagccatcgtgaacatggaggagcaagacatggccaggtttgagcgtgacgtggagcttctgaaatatgcttctcttaatcctgctgttggacatgttgaaattgttgcagcacgtgattcaatcgataaaaataaggattctaatgctttagtgtttgcttgggggtgtattgcgcaatgtaatgtgtacatgaataattaa

SEQ ID NO: 4350 - DNA, 2715 bp, Glycine max var. Williams 82
atggagtccgattccgactccgatggatctcacatctccgcaactccaccaagaaaatcaactccatcaccaccaccaccaccacctgtagtagtttcaaaaaaatccagaatcagaatcaaaccttcaaaatcaaaaccaaaaccagacccttccggatcctccaaaacccagtccaaatccgacccgatccagcaagccacccttctctccctccccaccgatctacccttccaaatccggcgaccttccgacgcgccgtcgatttcgtactccatcgaaaccctccccgccggctacttctcctcctcccattctgcttccttctcgaaaattcgaagacctctcctcaatctagaaccttctgaagtcgaacaaccggtttttacttccggcgcgtctgactcacgcgccgagggcgccgacttgaggaagcgtgggaagagccagcttcccaacctgattggctccagtgcgccaatgccgagcgtgaagccgcgaacatccggagccggcgaagggaacttcgtgaagctcaacatgaatggcaagagaaagaagttccttaacaagagagggaaatttggcgggaaaaggtacaagagttggagattcaaatcgcagcgcgagaaggaggaggagcaagaagaggctgttggagagttgaaacagagagggggttgtaagaggagggagattgatggtgatgcagtggaggaggctgcgaccgcagcacgcaaggagccttcggaggagaatttggtgaagctgttgagattggttcatggttatgattgctttcgagatgggcaggttgaggcgattaaaatggttcttgccgggaagtctagtgtggttgttttgccgaccggtgcaggaaagtcgctgtgttatcagttgcctgctgtgatcttgcctggtgttacattggttgttagtccattggtagctttgatgattgatcagttaaggcaattgcctcatgtgattatgggtggtcttctatccagcactcagacacctgaagaagcctctgaatcactcaagcagcttcgtcaaggggggataaaggtgctttttgtttcaccagagcggtttctgaatgaggagtttctgtctactatttcttctttgccagccatctcacttgttgttattgatgaagcacattgtatatctgaatggtctcacaatttccgaccatcttttatgagacttagagcatctctgcttcataagacacttaatgttcgttctgtgcttgctatgacagcaactgctacaaccacaactttagatgccatcatgtctgctctagacattccttccacaaatcttattcagaaggcgcagttaagggacaattttcatttatcagtgtctttggtcagaaatagaatgaaagacctactgaatctgataaagtctcctccttttgtggaagttcaaagcatgatcatatactgcaaatttcagtatgaaactgatcaaattaacagatatttgaatgataacaacatcttggcaaagagttatcatagtggtatctctgcaaaggaacgtagctatgtacaggagttgtttaattccaacaagatcagagtggttgttgcaactgtggcatttggcatgggactagataaaagagatgtcggagctgtaattcattacagtttgcctgaaagtctggaagagtatgtacaggaaataggacgtgctggaagggatgggaggttgtcgtactgtcacctattttatgatgatgagacatatttcaaacttcgtagtctaacgcacagtgaaggagtagatgaatatgcagtgaacaaatttctgcgtgaagtgtttcctgctgacaaaaactcctgtgggaaaatctgttcattaatcaaagaatctgcttcacgcagatttgatatgaaagaagaggtgatgcttacacttttgacacgcttggagttgggtgatgtacagtacttgcagttacatccacagataaatgtaactggcactttgaattttcacaagtctcctccgccattacttgctcagaaggtttctgctatagctgtaattctaaaaagatctgaaaccaagcatgggcaatatatttttgacattccaactgtggcaaatgatatgggggttacagcagtggaattaataaatcagttgtacgacctgaagttgatgggagaaataacttatgaaatgaaggacttggcctactgttataggatcattgaagtcccaacagacttgttatctctatcagcagatattacccgatggttatcagaagttgaaaattgtaaggtacgaaaaatggatgcaatgtttaatgctgcatattttgcattaaatctatgtgatacgatgcaaggttgcagtggtgccaatcatacaccatgcttgcaaaggaaaatattggattacttttctggagttgataatgctgatttctgcaagaaaattggtcaaagcagccctttcctgcgggcagatataaaggtctttctgcagagcaattcacaggctcgatttacaccaagagccgttgcgagggtaatgcatggaattgcaagcccagcttatccttcaacagcatggagtaaaactcatttctggggaaggtatacgcatatagactttcaggtagtgatggaagcagcaaaggaagaacttaagaattttgttggaaaagatacactctag

SEQ ID NO: 4351 - DNA, 816 bp, Glycine max var. Williams 82
atgcaaaagttagtagtagtgaagaaaatgaaagtccttgttttctttgttgctatagttctagcagcatggcattgccatggctcagaccatgaccatgaccatggccacacctaccaaattttccctctgagaatgaaaactggccatggtggccactacattccggaggtatcatgccaaagttggaggcttggtgtggaagcacacaacgtcattgactggaaaaccgttcctcaagattgcgagggatatattgggaactacatgcttggcgaacaatatagatcagactccaaaatagttaaccaacaagcttatttctatgctaaaaccctcaatatcactgccaaaaccgcatgggtgttcgacatagatgagactacactctctaatctcccttactatgctgaccatggatttggggtggagttatataatgaaacatcgtttaataaatgggttgaccttggcgaggcaccggcactgccagagagtctcaaattgtacaagaaactgttgtctcttggcatcaagattgtattcatcacaggaagaccactggatcaaaaggctgtaactgctaccaacttaaagcttgctggatatcacacatgggaaaagttaattaccaagaatacatctgaataccatggtaagacagcagttacatacaaatctactgagagaaagaagctggaggaaaaaggatacaaaatcattggaaacattggagaccaatggagcgatctattaggaaccaacacaggcgataggacctttaagttgcctgatcccatgtactacattagttga

SEQ ID NO: 4352 - DNA, 1476 bp, Glycine max var. Williams 82
atggcaggtatcgctggtacatgtcctttaggagcattgctcagaaacagtgtctcagaaaacaatgggaagatatctgtggttcattatgaggggcttagattgcagcagagaatgcaaatgccttcaccaagccagtacatttcagcttcttcatcagctccaagatgcagaacaatcaaggccatggcttccccaactgttggagcaccaaagagagaaaaggatccaaaaaagcgggtagtaataacaggaatgggtcttgtgtcagtctttggtagtgacgttgatgccttttacaacaagcttcttgagggagaaagtgggataagcctaatagataggtttgatgcctcaaacttctcggtccgttttggaggtcagatacgtgatttctcttcagaaggctacattgatggcaagaatgaccggcgccttgacaattgctggaggtattgcattgttgcaggcaagagggcccttgatgatgccaaccttggaaagcaagtccttgacactatggacaaaacaagaataggagttctggtgggatcaggaatgggaggtataacggctttctcgaatggtgtggaagctcttgtacaaaagggatataagaaaattactccatttttcattccctactccatcaccaacatgggttctgccttgttggctatagacacaggcctaatgggtcccaattattcaatttccactgcttgtgcaacggcaaattactgcttttgtgcggctgctaatcacattagaaaaggcgaagcagatatcatggtggttggtggaactgaggctgcaatcatgcctagtggtcttggaggcttcattgcttgcagggctttgtctcacagaaacgaagaccccaagaaggcttcaagaccatgggacaaagatcgtgatggttttgtgatgggtgaaggctctggtgtgctggtaatggagagcttggagagtgcaacaaaaaggggagccaaaataatagcagaatatttggggggtgccataacgtgtgatgctcatcacatgactgatccaagagctgatggtcttggagtttcatcttgcataagcaagagtttagaagatgctggagtttctcctgaagaggtgaactatgtgaatgctcatgccacgtcaacactggctggtgacttggctgaggttaatgcaattaaaaaggtttttaaggacacatcagaattgaaaatgaatgcaactaagtcaatgattggtcatggtcttggggctgctggtggtttggaagccatagcaactatcaaagccataacaactggctggttgcatccaagcattaacctagataacttggaggctagtgttacaattgacactgtccctaacgttaagaagaagcatgaagttaatgttggtatatccaactcatttggattcggtggacacaattcagtagttgtctttgccccattcaggccataa

SEQ ID NO: 4353 - DNA, 1515 bp, Glycine max var. Williams 82
atggctttcgtcaattttcattgctcttccatgttcctgcacacatgttctaaaaggcggtgtattgtaagtggcgccccttcactcaatgcaagcagatacaaatctgatttcatgttggctagtcccattagaaaagtgaaattcagtttcaagtttgataaagtgagggctgtgatatctggagaaggagatatactatctcatcctaacaactataacagtccaagacaagatgtcttaatagacaaattggcagaagaaccaattagaattaggcagcaacttgatacattttcttttggaacagtcgctgatgagataagtcctacaatcaatggcttctttgctgatagaaatgaatatgatctggattgtcctacacaggggttttcttctatccctgaggccattgaagatattcgtcagggaaagttagttattgttgtagatgatgaagatagagaaaacgagggggatctgataatggcagcatcaatggtgacaccaactgcaattacatttattgttgagtatggaactgggatagtgtgtgtaagcatgaaagaagacgacctagagaggctgcaactcccactgatggtgacactgaaggataatggagaacaacttggcaccgcattcacaatgacagtggatgcaaagcaaggcactacaacaggagtgtctgctcaagatagagcaacaacaatcctgaaacttgcatcaagaaattcgaggcctgatgatttcaataggccaggtcatatatttcccctgaagtacagagaaggaggggttcttaaaagaccaggacacacagaagcttcagttgatcttgctgtgttggctggcttggaacctgctgcagttttatgtgagatagtagatgatgatggttcaatggctaggttaccaaagcttcgacaaatggcaaagcaagaaaacttgaaaatcatatccattgctgatttaataagtagcagatacaggagaaagagggagaagttggtagagtgtgcttcagctgcactgataccaaccttgtggggacatttcaaagcttattgctatcagtcatttctggatgggattgagcatattgcgatggttaaaggtgagataggtgatgggcaggacgtacttgtgagagtacattctgaatgtctcattggggacatttttggggcaacatgtcaatgtaaaaaccaattaaaacttgcattgaagcaaattgaagcagcaggtaggggtgtcttggtgtatctccgaggaaatgaaggtagaggtattggcttaagccacatggtccgtgctagcccattggaagatgacaagtatgaggaattgcagttacctgttgattctagggagtacggtattggagcacagatactacgagatctcggggttcatacaataaggttaatgacaaaatatcctgctgagtacgacgggctcaaaggttatggcttaacagttgcaggagaagttcctcttttgacaccagactaa

SEQ ID NO: 4354 - DNA, 1464 bp, Glycine max var. Williams 82
atgaaaacgatggattttgagcaattttattactcatttggccctccttacatgaatcaactccatgagtgtatctcagaaaatgcatttccatttcaaacagaaaatctcttatctccaaatactttcctagatgaaatgtttgatcaagagtactccatggaaggattgctgcagcaacatgcaaacaaccaggaggactttggtttcttgaagcatgatgatccactagagactgaattttgtcatggatttagccctagtgctgaggaaaatatgcatgtttcaatggaagaaggggattcttgtttgaagggaatccaagcagagctaatggaagagactagtttagctgatctgttgctaacaggagctgaagctgttgaagcacaaaactggccccttgcttcagatataattgagaaacttaacaatgcctcatctttagaaaatggtgatggtttattgaacaggttggctcttttctttactcagagtctctattataaaagcacaaatgcccctgaattgctacagtgtggtgctgtttctacgcacacaaatgctttctgtgtgtttcaggttctccaagaactctctccctatgtaaaatttgctcatttcactgcaaaccaagcaatcttagaggccacagaaggtgctgaagatcttcacatcattgattttgatatcatggaggggattcagtggccacccttgatggttgaccttgcaatgaagaaaagtgttaattcccttagagtaacagccatcacagtgaaccaaagaggtgcagattctgttcaacaaacaggaagaaggctcaaagagtttgcagcttctatcaactttccattcatgtttgaccagttaatgatggaaagggaagaagattttcaaggaattgaacttggtcaaacactcatagtcaactgcatgatacaccagtggatgcctaataggagcttctcattggtcaaaacattcttggatggtgtgaccaaattgtccccaaggcttgttgttttagtggaagaagaactatttaattttcctaggctcaagtccatgtcctttgtggagttcttctgtgaggctttgcatcactacactgcactttgtgattcacttgctagtaatctatggggtagccacaagatggagttgagcctgatagaaaaagaggttattgggctcagaatattggacagtgtgaggcagtttccttgtgagagaaaggagagaatggtgtgggaggaagggttttattccttgaaagggtttaaacgtgtacctatgagtacatgtaacatttcacaagccaaattcttggtaagcctctttggtggagggtattgggtccaatacgagaagggtaggttggccttgtgttggaagtcaaggcctttgactgtggcttcaatctgggaaccaatggcttatctggatgacaaggtcaaatag

SEQ ID NO: 4355 - DNA, 231 bp, Glycine max var. Williams 82
atgctctcatcttggtcgaaacctgcacctggatacatcaagataaacattgatgctgctagctttaaagacatcaacaaatatgacgtcagcgtttgtatacgagatgaccaaagtaatttcatttcagccaaatctcttcaccatgagggaacaccagaacctcgggaggcagaagcaattgatctcttacatggtttgctttgggctaaaagagctacgacttcataa

SEQ ID NO: 4356 - DNA, 1617 bp, Glycine max var. Williams 82
atgagtggcttgagtttcaagggcttcacatacatgttcctcattgcatttctcatttggtccttcaattttgaagcctgcattgcaagaagaggcaagcactggaggcaaagcagggatgtctctgcttctttgtacaagaagaaaggcaaaaactatagcaatgctcacaacaagaaccatggtggaggatcaaaatcaaagcctccatcatcacacaaaggcacaccaacattaccaaagcctccaccacaacataagaacactccctcaccaccatatccaactccaccaagtgatgatacccccacaactccaccaccaaaaggttacaatggtggtggccattctcccaccaccaccttcaatgtgcttgattttggagccaagggagatggaaaatctgatgacacaaaggcatttcaagaggcttgggctgaagcttgtaaagtagaatcatcaaccatgctcgtcccagcagactacgtattctttgtggggcccatttcattctctggcccatactgtaaacccagcatcgttttccagcttgatggcaccattgttgcaccaacaagccccaatgcttggggcaaaggactactacagtggttggaattttccaagttagtgggaattaccatccaaggaaatggcatcattgatggaagaggctcagtgtggtggcaagacaatccatatgatgatcctattgatgatgaagaaaagctcattgtccctttgaaccacacaatagggagcccgagccctccactgccgattcaaagtgagatgggaggaaaaatgccatccgtcaagccaactgcattgcggttctatgggagttttaatccaacagttacaggcataacaattcaaaatagtccacaatgccatctcaagtttgacagctgtaatggggtcatggtccataatgtgaccatatcatctcctggggacagtcctaacacagatggaattcaccttcagaactccaaagatgtgttaatatacggcagcaccatggcctgcggagatgactgtatttcgatacaaactggatgctcgaacgtatacgtacacaatgtcaactgtggaccagggcatggaatcagcattggaagtctaggaaaggataacaccagagcctgtgtctcaaacattactgtcagggatgtcaacatgcacaacacaatgaatggtgtcagaatcaaaacatggcagggtggatcaggttctgtacaaggagtgctattctcaaatatacaagtttctgaagttgaactcccaattgtgatcgatcaattctactgtgacaaaagaacctgcaaaaaccaaacgtcagctgtgtctctcgccggaatcaactatgaaaggataagggggacatacaccgttaagccagttcattttgcctgcagtgatagcctaccttgtgtggatgtttctctaacctctgttgagttaaaaccaattcaagaaaaataccatctttacaatcctttctgctggcagacttatggtgaattgaaaactccaacagtcccaccaattgattgtctacaaatcgggaagccaacaaacaatcggattcagacagatcatgatttatgttga

SEQ ID NO: 4357 - DNA, 618 bp, Glycine max var. Williams 82
atgataactaatgttacagagtatgaggcaattgcaaaggaaaaattgccaaagatggtttatgactattatgcatcaggggcagaggatcagtggactttgaaagaaaatcgaaatgcattctcaaggattctgttccagccacgtattcttgttgatgtaagcaagatagatttgactacaactgtgttgaaagacaaaaatgtggttgctcagcttgtgagaagagctgaaagagcaggtttccaggcaattgcccttactgtggacagtccagttcttggtcgtagggaggctgacatcaaaaacagatttacattgccgccaaacatggtatttaagaattttgaaagattggatcttggaaagctggacaagacttgtgactctgttgttaccacttatgttgctgtactatttgatcggtcactcaactggaaggatatcaaatggctccttacaataacttcattgccaattttattaaagggtgtacttactgttgaagatacaaggatagccatacaagctggagctgctgggatcattgtttccaatcaaggagctcggcaacttgactatgtccctgctactattatggctttggaagagaaatga

SEQ ID NO: 4358 - DNA, 306 bp, Glycine max var. Williams 82; identical to SEQ ID NO: 1660

SEQ ID NO: 4359 - DNA, 3528 bp, Glycine max var. Williams 82
atgccaccatccctatcatttagaagctctcccgttagagagccaagatcagacagtcacaagcgtgggcgcagtcttgaaagcggattgccctcaagagagaaagatgatgatcttgctttgttcagtgaaatgcagtccagagaagaagagagttttttgcttcaaccatctgatgacttggaagactcattttcgtcaaagttgagagattttcctgatatcaagcttgggatatccattcctggtcgaggagaaaccagtgaattgcttaatgcagatggtgacgagaatgactatgactggttattgacacctccggacacaccactgtttccttctttagatgatgaaccacgagaattaaatgttgtaagcagaggaaggccaaggagtaaacctatttccatatcaagatcatctacgacagagagaagttacaaaagcagaaggggtagtgcaagtccaggtcgtttaagttcatcccctcattctgggaataatacattgcaatcgaggggaatgtcttcatcaacaccaaattctagtccaactcaagttttacgacatgctactccaacaagaaggtcatctcctccaactaagcccacgacacctgctcctagaccttccactcctactcctcggcgaatcagcactggctccagtagtcctgcactctcattggggattaggggaacttcccctgttaagacaagccgtggaaactctgcttcaccaaagataagatggcagactaatattcctgttttctcttctgaagctcctctcaatctccgtacctctttggctgatcaaccagcatcatatgtgagaggttcatctccagcatccaaaaatagtagggattctacttctaaatttggtaggcaatcaatgtctcccactccttccaggagcagcagttatattcatagtcatgatcgagcccaatctagttcacacagcaaaggttctgttgtatcttcaagtgatgatgatctggactctcttcagtccatcccagtgggtagtctagatcgatttggttcaagaagggatggttcattttcaaacagcaaatctccttcaatttccaagaagtcagccaagatggtgtccccaagttctgctcctaaaagatcttttgattctgctatccggcaaatggatagaaaaagtcctcagaacatgttcaggcctctcttatctagtgttccaagtacaaccttatatgtcagaaaagcaaattctgcacaacattccctggtatctaggaactcctctgtcacaacaagtagcaatgcaatctgtgatcatggtacaaattttgtgccagatgctgaagggagtgaccacaatcaagatgatatggcttgtgaatctaagatattatacactgatattcgtgaagaagtattttcctttgataaaattggtggattaaatgcaaacattgggcatgagatcaatgatgaatcagttgatgtcctgcacaacaaaactagaggccctgtgattgctttagaccctactgaatctgaagcttctttttatcatggtattgacaaagaattcaatgaaagcttagaaacttcccatgccataggggacatttctgaaactggtggttttgagaatacaacaatttgttccaattgtggttgccctcttgaggccacagatcaaactgagaagaatcttaggctgtgtccaaaatgtagcaggaaaaccacattgttgagacatgtaatcccggaggcaaatttggctgtttccagtgaaaattcagtgaattccacagacattcttgcagaagatagaccatcagccaaaacagaccaactaaccgttgtgtctgaactgcctcaagagactgatgtgggtaacatgaggtttccccttggtgaaccagatgctgtggaaattcaaacttttcccagtgaatttattcaggaccactcgcaacaaaattctctctcgagttcactggtggagggaagtaggcagatgcctgccaatcagcttgaagtggaccagtcaggggttgatgacaagaagcccgataatcattctagcagtcagcagttgtatctttccaacgacagctcaaatttgaaagtggacctcttggaaggcactggcatttctgtactactgaaaaggtcaagcagtagcaaaggacatgtaattcagggcaggacttttactgccacgacgctatcttatgatgatctgtcttttgcaagaagcagcattaacagtattagaagctcaactggacgtagcagttattctaccacttcatctgccgatttcagctcagcaagacattctgattttcgtgtccaaaggcagtcaagtggcaggaaattggatgtagactatggatatgatgttaggatcaggcctccaagccctggtttatctttttctggaatgtcaaaccattcttaccatggattaggttttgctacacaagaaacttcctctggcaatacagaatgcagcatcctggaagagataccccaagatctacgagaaatgcaagcttcagaaaatgcagtaacagatgtaattgattcttcctctatgggtttgattgttgtcagggaagataatcttgaatatcatgattgtggtagaacaactgatgcctgtagctcaggattagtaagccaagctactggtgttcagcatgatgacaattcagtgtcagcatttccaaatcatgggagttttatttcaaatgatagtattgaagaccagccgaataatgtaagcagtgtctcaaatacggaaacaacagttaaggatccagagtcatcctttgatgagaaacatgatatggagaactcttgtgttgatggactggatgctttggtaactatcaacacttctacaattgaagaatcagaaatagaaggggaaaactgttgtcagaaggatactggtgtggtggatgttgatccatcgctggtatcaaagtgccccattgcagactttcaggaacattctgttccaaattcttccagtgattgtcttgcagcttctgtttccgagctccatgcctctgagtactcccttggcatagagggatccacagttacggtggagtgtcaagatggaggaaatgctagaaacctgacacttgaagaggcaacaaatactatacttttttgcagctctatcatccatgatcttgcatatcaggctgcaacgatagcaatggaaaaggaacactcggaaccattggaaggttctgagccaacggtgactatattgacaaaacccaattccgatataaaggattctcgcagccgaactgctggcaagcgtgctatgaaaccccagaaggcaacaaggccaaagatggtggaagttgatgtaaaatccccttccaagattgagaatgacgaaaatattgacgagtctttgacacgcaatgttgggcttcctaacaaaatagacaacgtgaagccccttccaaataagcttgaatcaaagtgtaattgcgtcataatgtga

SEQ ID NO: 4360 - DNA, 789 bp, Glycine max var. Williams 82
atggagaagtacgaggtagtgaatgaggagatagggattgggagagacgcggtcgtaagacttatgcgttgcaaagaaactaaggatctcgttgccgtcaaatacatcccacgggaagacaggattattgatgagaaggtggcaagggaaatcataaaccttagatctcttcgtcatccgaatattgttcggttcaaggaggtggctttgactccaacgcatcttgcaatagttatggagtatgcagcgggtggagagctgtataaccgagtttgcaacggaagaatacgtgaagacgagtcatacctacttcattcgagaccccattcagtgattggaactccagcctatattgcaccagaggttctttccgggaaagattacgatggaaagttggcagatgtatggtcctgtggagtgatactttatacaatgttggtaggagcattgccatttgaggacataaaggataccgaaaatttccagaaaaccataaaacgagttatggctgttcaatacaagttccctgaaagagtttgcatatctcaagacagtaaaaatctgatatctcgcatttttgtggcaaatccagcaatgagaatcaccatgaaggaaatcaagtcacatccttggtttttaaagaacttgcctaaggaattgagagacggggctcaagatgtctactacaatgaagaaaatacaaaatatcctcttcaaagtatagaagagatcatgaacattgtcaacgaggccaaaactacaactgcaacttccagtccatatctatag

SEQ ID NO: 4361 - DNA, 588 bp, Glycine max var. Williams 82
atggccagaccccaacaacgctatcgtggagtacgccaaaggcactggggctcttgggtctctgaaattcgccaccctttgttgaagactagaatatggctaggaacttttgaaacagcagaagatgcagcaagagcatatgatgaagcagctaggctcatgtgtgggtcaaaagcacgcaccaatttcccatacaaccccaatgagccacattcatcatcatccaagcttctctctgccactttaacggccaagttacataagtgtcacatggcttccctttcccttcaaatggccaagcagaaaccaccacagagcaaagagcctcaaccatcacatgggtcatccaatccatttgcctttgccaatgtcattgctggatcaagcgctgacaccggttttcgatggccagataacagacatgaggaattcagatggcttgaagggaattgggttggtgtggaaggccaggttgaagtttcccatcaacagtttcagccagttcttgaagatgatcacatagagcagatgatacaggagttgcttgattatggatcaattgagctttgctctgttggcttaacctag

SEQ ID NO: 4362 - DNA, 225 bp, Glycine max var. Williams 82
atggcgggtgctgctcccaaacaattgttcggattcggagttgtggcgatgctcgccactctcattcttgctctctttatgcccgccgctgttcaggctcaatccgcatcccctgcacctgcacctactagcgacggtattcctcttcccagatctaacacaactctttatattcttcacttccatattccagttccttgctttgaaaaaccagaatgcaaataa

SEQ ID NO: 4363 - DNA, 1332 bp, Glycine max var. Williams 82; identical to SEQ ID NO: 1647

SEQ ID NO: 4364 - DNA, 900 bp, Glycine max var. Williams 82
atgaacgggaaagcctccatctccaaggagctcaatgccaagcacgccaaggtggaagatggtcacaggaaaaccattctcatgctgccactctcacagctgatgcttgggcacttgtctagtcaatctattagtaagagttcaagtgtgcagcccatacgcacaatttcccagttatcttctctttcccagtcatgtcgactaaaaatattagaaggacttcttaagctgcctgagaacagggaatgcgcagactgccggaacaaggcaccacgatgggcaagtgtgaacctagggattttcatttgcatgcaatgttcaggaattcaccgaagtcttggagttcatatatcaaaggtgcggtctacaactttagatacatggttgccagatcaagtttctttcatgcaattaatgggtaatgagaagtcaaataagcactgggaggaaaaaattccaccaaattttgatagaagtaaattgggaattgagaagtttatccgtgacaagtatgtggagaaaagatgggcttcaaaagaagaactgcaatcaacttcaaggacaggtgaaataatctataattttgatgagtcaccaaatggaggggctaggagtggtattctgaagaacaacaggagactttctcttgaagaaagtattcttgctaaccacgtggcacaaattctacctccaataacaagatctcgtgggggttttacttttatagacacgcaaaagaagaattcacctccattaaaaaggccatcctcatcagttgattttgacaagtccacaggaaagagcaatggcactggtgacattttcaacttgctttgcatctatgatgataaccagaacttctcaaccatgcctccttcaagttgggcaacatttgattga

SEQ ID NO: 4365 - DNA, 642 bp, Glycine max var. Williams 82; identical to SEQ ID NO: 1699

SEQ ID NO: 4366 - DNA, 4383 bp, Glycine max var. Williams 82; identical to SEQ ID NO: 1678

SEQ ID NO: 4367 - DNA, 1281 bp, Glycine max var. Williams 82
atgaagaggtctccagcatcttcttgttcatcatccacttcctctgttgggtttgaagttcatcatcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtaaacaagtttatttgggggcatatgatactgaagaatctgcagcacgtacctatgaccttgcagcccttaagtactggggaaaagatgccaccctgaatttcccgatagaaacttataccaaggacctcgaggaaatggacaaggtttcaagagaagaatatttagcttctttgcggcgccaaagcagtggcttttctagaggcatctctaagtaccgtggggttgctaggcatcatcataatggtcgctgggaagctcgcattggaagagtatgtggaaacaagtacctctacttgggaacatataaaactcaagaggaggcagcagtggcatatgacatggcagcaattgagtaccgtggagtcaatgcagtgaccaattttgacataagcaactacatggacaaaataaagaagaaaaatgaccaaaccctacaacaacaacaaacagaagtacaaacagaaacagttcctaactcctctgactctgaagaagcagaagtagaacaacaacacacaacaacaataactacaccacccccatctgaaaatctgcacatgctaccacaggaacaccaagttcaatacacccaccatgtcactccaagggatgaagaatcatcatcactggtcacaattatggagcatgtgcttgaacaggatctgccatggagcttcatgtacactggcttgtctcagtttcaagatccaaacttggctttaagcaaaggtgatgatgacttggcaggcatgtttgatggtgcagggtttgaggaagacattgattttctgttcagcacacaacctggtgatcatgagactgagagtgatgtcaacaacatgagtgcagttttggatagtgttgagtgtggagacacaaatggggctggtggaagaagcatggtgtatcatcatgtggataataataataagcagaagaagatgctttcatttgcttcttcttcttcaccatcatctacaacaactacagtttcttgtgactatgctctagatctatga

SEQ ID NO: 4368 - DNA, 2001 bp, Glycine max var. Williams 82; identical to SEQ ID NO: 1579

SEQ ID NO: 4369 - DNA, 1449 bp, Glycine max var. Williams 82; identical to SEQ ID NO: 1717

SEQ ID NO: 4370 - DNA, 1848 bp, Glycine max var. Williams 82
atgatttcattcactaatcttctttctcttcttttccctttgttcacaacttcttttgttagagtttttgcctctgaggtctcaatcaaaacaacaaatttgtcacctttaaattgctcttccaaaatcagaacatgtaatgcctcactctaccacatatcccaaaatctcacaattgaacaaatagcctccttttactcagttatttcttcccaaatcacacctataatgcatggcatcaaacaagactacctcatcagggtaccttgttcatgcaaaaacacaagtggccttagcggatacttttatgacacaacctacaaagtgaggccaaatgacacttttgcaaatatttcaaacctgattttcagtggccaagcttggccggttaatcatacattgcaaccaaatgagactttagcaatacacattccatgtggatgttcagaaagtaagtctcaagtagttgttacctacacggtccagccgaacgatacaccgatgatgattgctaatctgctaaattctacactggctgacatgcagaacatgaacaaggttctggctccgaacatcgaattcatcgatgttggttgggtgctatttgtccctaaggaatccaaagggctactactactacctagtgctactaaaaagaaacataataagtggacaacaataatcattggcatcttagggggcatgacattgctttcaattgttacaacgatcattctcattctcaggagaaataaagtcgacaaaatcagcatagaagattcacgccttatttctggaagatcaattgccaataaaactatttcctcaaagtatagtcttcataaggaatttgtggaagatttaatttcatttgaatcagaaagaccattgatatataaccttgaggacattgaagaggctacaaataactttgatgaaagtcgtaaaataggaagtggtggatatggaagtgtttattttggaatcttagggaacaaggaggttgctgtgaagaagatgaggtctaataaatctaaagagttctatgctgaactcaaggtcttgtgtaaaatccaccatatcaacattgtggagctgttgggatatgccaacggagaagattatctctatttagtgtatgagtatgttccaaatggatctctcagtgatcatcttcataatccattactgaaagggaaccagcctctttcttggagtgctagggttcaaattgcactggatgctgcaaaaggtcttgaatatatacatgattatacaaaagcacgatatgtgcaccgtgatataaagactagcaatattctacttgataacaagttcagagcaaaggtgggagattttggacttgcaaagctggtagatagaacagatgatgaaaattttatagcaactaggcttgtaggaacaccaggctaccttccaccagaatctctgaaggagcttcaagtgaccccgaaaaccgatgtgtttgcatttggagtggtgctttcagagctgttaacaggaaaacgtgcactttttcgagaaagccacgaagacatcaaaatgaaatcacttattactgttgttaatgaaatattccaagatgatgacccagagactgctttagaagatgccatagataagaatcttgaagctagctatccgatggaagatgtctacaagatgacagaaatagctgagtggtgcttgcaagaagatccaatggaaaggcctgaaatgagggatatcattggggcattgtcacagattgtgatgtcctcgacagagtgggaagcatccctatgtggaaacagccaggtctttagtgggttatttagtggaagatga

SEQ ID NO: 4371 - DNA, 1257 bp, Glycine max var. Williams 82
atgcttaacatggagtacttgaaggaagtggaaggaaaaagtgtccatgattatgttgaggtaaagatgggtaaaatgacaaagccaataagtgtggcaggaccagtgatagtgggtgctggtccatcagggcttgctgcagcagcatgtcttaaacagaaaggcattccaagcttaatccttgaaagagctgattgcttagcttcaatgtggcagctcaagacttatgaccgcctgtgccttcatctccctaagcaattctgccaactccctctaatgccattcccacaaaactttccctcttatccaaccaaacaacaattcttggcctatctcaaagcctatgctgaccattttgatataaaaccagctttaagcaagacagtgatcagtgccaattttgatcatggatgtgggtactggagggtgaagactcaaggtttgaaaaaggaggagacagaatatgtttgtcagtggctgatagtagccactggagagaatgctgaagaggttgtgcctcaaattgaaggaatgagtgagtttgaagggcctatcttacacaccagctcatataaaagtggtagtatgtttggtgggaagaatgttttggttgttggatgtgggaattcaggtatggaagtttgcttagatttatgcaaccatgatgctcgcccatcccttgtggttagagatacggtgcatatcttgcctcagcagatgtttgggaaatcaacgtttggtttatctatgagcttgctcaagtggttccccatgcgtctcgtggacaaatttttacttctgatgtcacatctcattctcggggacacagctcaatttggacttaatcgtcccaaaattggccctctagagctcaagaacttgtgcggcaagaccccagttttggatgtaggcacacttgctcacataaaaagtggaaaaattaaggtttgccgcggaattaaacaactagcaaagcataaggtggaatttgtagatggaaaaacagagaatttcgatgtcatcattatggcaactggttacaaaagcaatgtacccacttggttgaagggcagcaacatgttttgtgagaaggatggattgcccaggaaagatttcccaaatggatggaaaggtgaaaatggactctatgccgtgggtttctctaaacgtggccttcttggtgcatctattcattcaaagaggacggcagaagatattgaacactgttggaaagctgctaataccacgcgtgtgtag

SEQ ID NO: 4372 - DNA, 420 bp, Glycine max var. Williams 82; identical to SEQ ID NO: 3580

SEQ ID NO: 4373 - DNA, 171 bp, Glycine max var. Williams 82
atgcatttaatggtttggtcgtgcaagcgtggaagaaagaagtgtgtagtttggaattcaaagatgcgcttgttattggtgaaagagaagagaatggtggtgggacattgcttcagagcttggaagaagaaaaaaagcatagtctcagagcagatatcaatagggtattga

SEQ ID NO: 4374 - DNA, 1626 bp, Glycine max var. Williams 82
atgtgccagttatcatctccctccactctgtgtgaaagcaatgagggccatccaaacatgcccccaaccaaaattcatgaggagcctgacatgttcgtccttttgatccccaaacccccaacaacaacaacattcttcgaacaaggccaaaataaccaaaagccccataaaacccatttttccctcgccctcgacgaagtcaaatgcatagccaacatagcattacccatggtgctaaccgggttactactctattctcgctccgtaatctccatgctcttcctcggtcgcgtcggtgagctcgccttagctggtggctctctcgccattggattcgccaacatcacgggctattctattctctcgggcctcgccatgggcatggagcccatttgcggccaggctttcggggccaaaaggttcaaacttttgggcctcgcgatgcagaggacaatggtcttgcttcttctaacttgtgtttttatatcattcttgtggttcaacatgaagaaaatattggtcctgtgtggccaacaagaagacatcgccaccgaagctcaatctttcatactattttcaattcccgatcttgtagcacaatcattgctacaccctttgagaatctacttaagaagtcaatctataaccctgcctctcacatacactgcctctctgtctattctccttcacgtccccatcaactacttccttgtctctgtgcttaagcttggaatcaaaggcattgccttaggcgctgtttggacgaatttcaacctcgtcttttcgttgattctctacatctgggtctccggcgtatacaagaaaacatggcccggtgtttcgttgaagggcgtcttcagcggttggaaatcgcttttgaatcttgcaattccaagttgcatttccgtttgcctggagtggtggtggtacgaaatcatgattttactatgcgggttattgattaatccccaagcaacggttgcatcaatgggtgttctgattcaaaccactgctctgatatacattttcccatcttccctaagctttgccgtttccacacgtgttggaaatgaactgggtgcggagaatcccaaaaaggcaaaacttgcagccctcgtggggttatgtttcagttacggtttgggtttctcggctttgtttttcgcagtttcggtgaggcacgtgtgggcttcgatgttcacaagtgacgcggagatcattgctttgacatcgatggtgttgcccatcattggactatgtgaacttggaaattgtccgcaaacaacggtttgcggcgttttgaggggaaccgcaaggcccaagttgggagcgaatataaatttgggttgcttctatctagtgggaatgcccgttgcggtgaggttgagtttctttgccggctttgatttcaaaggcttgtggcttggtttattggcagctcaagcctcttgtatgttcaccatgctaattgtgttggctcgaaccaattgggagggtcaagttcaaagagccaaagaactcacatcatcgtctgattctagtgaggaggaggaggaacaagatcagaaatgcttgttcagttcgggcgccacaaaggaatgctctcattctgattcattagtttga

SEQ ID NO: 4375 - DNA, 582 bp, Glycine max var. Williams 82
atgtcttctgcagataaaaacgcaaacggccaacagttcatggaaaacggggacagccatagaaggctcaacaagtctctgctatgtttggttatgctgtggcatatgaagatagtgatcgatttgcttgttttggtacaacttgtacgatcatcatcgatgacctttcaagatgaacctaaaccatttgccaagaataaaccctcacagattttccctttgaagttgagggcacaaggagcaagtatagaagttgcagtcaacagactcaccaatgctgcaatttccatgagttttatttcaatctataatgcaatcaccataggtggggccttttttttatgtttgctggtatatctgtatgggcttggttgttcttctactttttcatgcctgaaaccaagggcatggccttggaagagatggagatgctcttcagcaaaaacaagggaaggaagccaactacagaaacagacccgaggcagaatgcatagttgtatatatatatgttttctgtggaggggaagaatttttataatgtcatctgaaaatcttaatttcataattgtactatatatttga

SEQ ID NO: 4376 - DNA, 816 bp, Glycine max var. Williams 82
atggccagccatgcagctcaaaaccctaaatctgttttccttatgaccttcctcttgctaatcaccagcgccaaatcagactcattttctttcaacctacccagatttgagccagatgctttaaacatactactcgatggtagtgccaagacaacaggtggagtgctacaactcaccaaaaaggacaaaagaggaaaccctacacaacacagcgttggcctctcagcattctatgcagcacttcatctctccgacgcaaaaactgggagagtcgcaaacttcgccaccgagttctccttcgtcgtgaacacaaagggtgcaccactccacggcgacggcttcaccttctaccttgcatcactcgactttgatttcccagacaactcaagtggtggcttcctcggactcttcaacaaaaaaacagcctttaacacttccctaaaccaagttgttgctgttgagtttgacagctttgcaaatgaatgggaccctaatttcccagagtctgattctcctcacattggaattgacatcaattccattaggtctgtggcaactgcgccatggccacttgatattcaaccacaagggtcaataggaaaggcacgcataagctaccaatcttccaccaaaatattgagtgtctcggtggcttatccaaatagtcctgtgaaactgaatgccactgttttatcgtatcccgttaacttaggggctgttctgcccgaacgggtcctattcggtttcagtgctgccaccggtgacttggttgaaacacatgatattctttcatggtctttcaattccttcttgtag

SEQ ID NO: 4377 - DNA, 1098 bp, Glycine max var. Williams 82; identical to SEQ ID NO: 542

SEQ ID NO: 4378 - DNA, 1512 bp, Glycine max var. Williams 82
atgaaacaccactccttgtcatttaaatggcttcttctgattttcctcacacactcaacccttctcaccgcaacacactcgttgacaattccaaggatgagtccaattcctgaatgggaaacaacactacacaaccaccctgcaattaatacagaggaagtgaaaacattttacttcaaacaggttctggatcacttcaactacaggccagaaagctacacaacgtttcaacaaagatatctaatcaatttcaagtactggggtggtgccaattctagtgctcccatatttgcatactttggtgctgaatcaccaattgataactcccctaatggcgtgggatttttaactgataacgctgcttccttcaatgccctcttggtatacatagagcaccggtattatgggaaatcagtgcaatttggatccagggaagaagcattgaagaatgcaagcactattgggtatttcaactcagctcaagccttggcagattatgcatcaatactcaaacatgtaaagaagacattacacgccaaaaattccccagtgattgtaattggaggatcatacggtggaatgcttgcttcatggtttaggctcaaatatccccacctggcgattggtgccctggcctcatcagctccaatcctatactttgataaaattacaccacaaaatggttactactctactgtcacaagggattatcgagaagccagtgagacatgttatgaaactgtactaaagtcttggtctgaaatccgcagaatagcttctcaaccaaatggtctagtcactctcagccagagattcaacacttgccatacattaaaccaatcttatgaattaatcgactacctaaggtcgacgtatgtttatgcggctcaatataatcaaccaccaagatacccagttagtatgatttgtggtggcattgatggagaatctcttggaagcgatatcctaagtaagatatatgcaggtattgtggctcttaggggaaacagcacatgcaaagttaatggcccaactaatgtatctgagacaactgtgggatggagatggcagacatgtagtgaaatggtaatacccatcggcattggaaatgatacaatgtttgagcctatcccttttaacctaacgaggtatgccgaagggtgcaaggaacaatatggtgtctcacctcgccctcattgggtcactacttactatggaggccataatattaaattggtccttcgaagattgggtagcaacattattttctccaatgggctaagggacccatatagtattggcggggttctggataacatatcagacagcatcgttgccgttcatacagttaatggttctcattgcctggatcttctgcgggcaaatcaaagcgatccaggatggttggtcgaacaacgaaagaaagaggtcaagatcatcaaaaggtggatcacacagtactatgctgaccttgatgcactcaaagacaagccaaaattccagagcaaatga

SEQ ID NO: 4379 - DNA, 624 bp, Glycine max var. Williams 82
atggttatcgcaaattatgggttcctagaacacccactttgtgtccctcaggactcattagaatgtttgggaatgatgaattgggaaggcatggattcaattgattccatgttttctaccccttgggagagtgaaaaggaaagattggaacaacctgaaaaggataaaacggagaggaaatcattcactgatgtgtcaaataaccaagctaatcatatgtctctattaacgcggctagacgacgagtcaaatttagctgctgagaagtctcaaactaagatcttgaaaacaaaaaacatagcggctcgatcattgtccaagtgcaaaattgattttctgaattcgacacagagtgggagggatgctaagatctgggagaaaagatgtggtcacaaggatgctaggatctgggagagaagatgtagtcattgtgacgccataaaaactcctcaatggagaaccggtccttttgggcgaaatactctgtgcaatgcttgtggtatacgattcaaggcagggaagttatatccagagtatagacctgcagatagtccaacgtttgatgtaagcaagcattcaaatgttcataaagagataatgaaaatgagaaaccaccttagttaa

SEQ ID NO: 4380 - DNA, 1023 bp, Glycine max var. Williams 82
atgaaatcatacctttctgcattcctattattccttctcctccttaagcttgttgataaatccatctcttcacgtgtccctccttcttcaaccaaagtaatattcaagaagattggtgagaattcattggacaatgccaaacaaaagttctctccccaacagccaaactcaccaccgaagcaaatcgaaggcctatctttcttgaaagactacttatctaacttcggctaccttcaatcctccgagccattcaacgattatttggacgaggaaaccataacagctattaagacctaccagcaatatttcaatcttcaacctactggtaacataaacaacgagacacttcatcaaatcttactaccacgatgtgctgttcccgacatgaatttctactacaacttcaccgacctcaagtcgtggcccaaagccgggaaccagtggttccccatgggcaagagcctcctcacctacggttttcaacccatgaatgaaatgacagccgaaatgaagaaggtgttcacagatgccttcacgcgctgggtgcgtgccacagctggagttttgaaactcacggagacaacctatgacaacgccgacatcaaggttgggttctatagattcgatggccgctttaagaatttgttgtttggtggcagcgttatcagatatcaacctgattctaatgtcaccacaggtgagattcgtctcgaccttaccgatttatgggccctgcctagagaggaggatatgctgtcacaggatggtgttttggacttggagagtgcggcgatgcatcagatagggcatcttctagggcttgaccactctaacaaagaggactctgttatgtacccttacatgttgccctcacagaaacggaaggtggagctttcggtttctgacaaggacaacattctacaacagtatgctaatggcaactcaggccacggtgggcgctggggagtgcttttatttaccattttgtctcttggatttgctttttttgtattaggctattag

SEQ ID NO: 4381 - DNA, 561 bp, Glycine max var. Williams 82
atgaggtgttccaaagggcttaaaatctgctgtggtgtcactgcccttcttctaattatattaatagtagtactggtggtcttgttcttcactatcttcaagcctaaagaccccgacattgttctgcagtcagttaagcttgacggtttcaaacttgaagtcttcccaactctgaaactaaacgtatcactaggcatagtggtgacggttgaaaacccaaaccatggaagctttacctaccagaacagcacagcttttctttactatcgaggaaatcttgttgctgaggctccactacaccaggacacaattccagctcgtaacgatcataatataagcacatctttgactatttttgtagatctcacaaaatttaaggatttacccagtgattattccgggggcgttataaattttacctcaacaaccaccttactggggaaagtcaaggtattggaccttttcaagatcaaggccactagttactccacctgtgatctctctctattcgtaaatgaccaaaccatcaattctacgtgcaactctgaaatcaaattctga

SEQ ID NO: 4382 - DNA, 1506 bp, Glycine max var. Williams 82
atggaagaaaacgtgaaattgaaggagtctccgttcactggacaacaagaaaagccatctgcactaatcacttatttgtacattggccacttcttagcaagatggggtgccagaatgtgggaattctctgttggcttatacatgatcaatatttggccagaatcgttgctgtacgcagcaatatatggtgcagttgaatctgccgctattgctgtgtttggtcccataattggaagatgggttgataagttgtcttgtgtgagggttttgaaattgtggttggtgacacaaaatctctcttttgttattgctgggggctccgtagttgccttacttgtccactcttctttgaagtctacaaatttctccattttcatcttgctggtgatcataatcaatgtctgtggcggcattggtgtgctttcaactcttgctggtacaatattgattgaaagagaatggttgttagttatatctgaagatcaacccccagaattgcttacaaaaatgaattcggttacgagacgcattgatctaagctgcaagctgcttgttcctgtcatttctggtttcataataagctttgtatcactgaaagcatctgctataaccttagcactgtggactactgtctctgtttgggtggagtattggcttttcacatctgtatatcatggaattccagctttggtgcaaagtagccaaaggagaatggaaaggcttatacaatgtgatatggaaatgaacaatcaaactatggagaaagatagcttgcttcctgttactgatgatggctcagaattggcagatagaaaagccagaaaaaaaatttctgagaggattttagagattccctatattgctgcatggagagtttatttacaacaagaagttgtccttcctggactggctctggctttgctattttttactgtactcagctttggaactttaatgacagctaccttagaatgggaaggaatacctgaatatattattggaatatcaagaggaataagtgctgtgattggaatagctgcaacagttgtataccctgtgctacagtctcgtatatcgaccattagaactggactttggtctatatggtctcagtggagtttcctccttccatgtgtggctgcaatatggatccaaaatggctttctatcatcatatattttgatgggaagtgtagccatatcgcggcttggattgtggatgtttgacttatctgtacttcaacaaatgcaggatcttgtttctgaatccgatcgtttgattgttggaggtgttcaaaattcgcttcagtctttgatggatttattggcctatgttatgggaatcataatatctgatccacgggacttctggaagttgactacaatatcttttctagcagtcacattagctgcattcctctactgtatccacacataccatgcacgaaagcacctcttccactttgaccaagtattgtggggtaaatgttttgtaagagcatcttaa

SEQ ID NO: 4383 - DNA, 345 bp, Glycine max var. Williams 82
atgcagggaaatttcgagatttcagcgatcgagggtaatattgtatggccaggaaacgatgacaataacaaaaagagccaggtgactgttttagtgtctggaactgatggtcagattcgaggaggacctgtgcgaagcttaattgctaaatcttctattaaggtgtttgttagcacaacgagtaagcatgatacacacaacatggcaagtgaagaatactacccgagggaaaacgatgaggttccattgttccaattccaggaccaagctgaacgtatggcagagatagtggatcagatctataagactacgttgaaggagctcaataatcaaacaaatatataa

SEQ ID NO: 4384 - DNA, 300 bp, Glycine max var. Williams 82
atggtgttgagaagaggcattgttgcaacagtagtggttgtgaatgtgatttttcagattcaaatatgcctatcagagatcaacaggcaaagctttcccaaaggttttgttttcggcactgctgcttcagcttttcagtacgaaggggcagtaaaagaaggtggaaggggcctatctgtgtgggatactttttcacattcatttggaaagatacaagatgggagtaatgctgacgttgcagtgaatcaatatcatcgttatgatgtaagatggatttcgatggtggctaaattaccatga

SEQ ID NO: 4385 - DNA, 1197 bp, Glycine max var. Williams 82
atggaagatccagaggttattattgggagcttgaatccaaatgataccaggggaaagaccgttacttgcaaagctgccgtggcatatggtcctggagagccctttgtggtggaacgtgttcttgttcatcctcctcagaaaatggaggttcgaatcaagatcctcttcacttcaatctgccacaccgatctcagtgcttggcaaggcgagaatgaggctcaacgtgcatatcctcggattttcggccatgaagcttccgggattgtggagagtgtgggtgaaggagtaaatgacatgaaagaaggggacttggtggtgccaattttcaatggggaatgtggggattgtaaatattgcaagtgtgagaaaaccaacatgtgtgagagatttggggtggatcctatgaagaaggtgatggctagtgatggtgccactaggttttctacaatggatggaaaacccatcttccatttcttgaacacttcaactttcacggagtacacggtggtggattcagcatgcgtcgtcaagattcacgttgatggcgatggcgacctcaatccctacattaaaagacttaccttactcagttgtggtgtatctacgggtgttggagctgcttggaataccgctgatgtgcattttggttcagctgtagctgtctttggtttaggtgctgtgggtctctctgtagcagaaggggcacgagccagaggtgcatccaaaataataggcgtggacatcaattctgacaaatttatcaaagcccgagcaatgggcatcactgacttcataaatccaagggatgatgagaagccagtatatgagaggatcagggaaatgacttgtggaggtgtgcactatagttttgaatgtactggaaatttaaacgttctaagggatgccttcttgtcagctcatgagggttggggattgactgtgatattagggattcatccatcaccacaattgcttcccatccacccaatggagttgttccaaggtcgcagaatagtaggatcagtttttggaggcttcaaagggaagactcaattgccacattttgccaaagaatgcatggatggagtggtgaagttggatgattttatcactcacgagcttccaatcgaggagataaacaaggcctttgatcttttaaccgtcggaaagtcactgagatgtcttctacacttctaa

SEQ ID NO: 4386 - DNA, 708 bp, Glycine max var. Williams 82
atggctgcaatcgtgtgccagtcgtcaagaatacacagacttatgttggcatccccaaaacctcctcctcaacaacccttcaaatcttgcttatgggaaaacaattacagttacaaacccgacaccacaacagcttggacctccattgaagctctttcaagtactgtgagcaactatgagtatgaggtgtcgctgctgcgactcagccccaagagtttggagctctgcactgagaacctagggaatgagacaggctgtgatgacatcataactgagactggcattgagttgctctcttcttcttcttcttcttcgacaagggagcagaaaagtaggaaagcgcgtgaagcagctcggagttttccaccgcctttgacaacgataagaggatcggagtcgatacgagtgaggccccacagagaaggtgggaggttagtgcttcaactcactaaggtcccatcttgtttccaagctcagaggagccctggacgccttcgcctctgcttttggactgacattcaaacacaagaacatgaagatgaagaagatgatgatgggcgtggatgggaacacaccaaaggctgcaacagttgggtggaaaataactatgagaggcaaatcagcaggtgcaaggaagaaggtcatgaccatgaaaacaacgatttcttaataaattggggtgaatctcgtttggtcgccacttcataa

SEQ ID NO: 4387 - DNA, 528 bp, Glycine max var. Williams 82; identical to SEQ ID NO: 590

SEQ ID NO: 4388 - DNA, 834 bp, Glycine max var. Williams 82
atggctcttacacttcaacgtgcattatctgaactactcaccctaatagctattctctcaatattcctagtgatcccttccttttgtttcaaccccaaaaagctttataatgcttcatattattctccatctagttcagattggtcacctgcagtggccacttggtatggacctgccaatggagatggaagtgaaggtggagcttgtggatatggtaacgctgttgggcaacctccattttcttctttaatatccgcgggaagccctcttatatatgactctggcaaaggatgtggttcttgttatgaggtgaaatgcacagggaattctgcatgctcaggcaaccccgtgaaagtagtcatcactgatgagtgtgctgggtgtggctcagatgctcaatatcattttgatctgagtggcaatgcttttggagcaatggcaatttcgggccaagatgagaatctacgcaatgcaggaaaaataaacattcagcacagaagaattgaatgcaactatcccggtaggtcaatagctttccacgtggattctggctcaaaccaagaatattttgctaccttggttgaatatgaggatggggatggtgaccttgccaaggttgaactcaaggaagcacttgattcagggtcatgggattccatgcaacaatcatggggtgcagtttggaaatttgacaagggctcaccactgagagcaccattctctatcaagctaaccacacttgagtctggccagaccattgtggccaacaatgtgatccctgcagggtggactcctggtcagacttacagatcgattgtgaattttgcaacctaa

SEQ ID NO: 4389 - DNA, 1521 bp, Glycine max var. Williams 82
atggaagctcaagcatgcttcatgtttactaccttgtttttcttttgggtattgcattggcttgcaaagtattattacaagccaaaaaccaccctttctcacaaactacccccgggaccaaagaagctacctctgatagggaacctgcatcaactagcaatggctggttcacttccacatcgtactctccgagaccttgcccttaaatatggacctctcatgcatctccaacttggtgaaatttcttcagtggttgtatcctcccccaacatggccaaggagataatgaaaacccatgatcttgcttttgtgcagaggccacaatttcttcctgctcaaattttgacctatggtcaaagtgatattgcttttgctccatatggcgattactggagacaaatgaagaaaatatgtgtgtcggagcttctaagtgccaagagagttcagtctttctctgatattagagaagacgagacagccaaatttatagaatcagttcgaacatcagaaggttcaccagtcaatcttaccaataaaatttactccttggtaagttctgctatttccagggtagcatttggtaacaaatgtaaggaccaagaagagttcgtgtctttggttaaagaattggtagtagtgggggcaggatttgaacttgacgatttgtttccttcgatgaaacttcatctcataaatggaaggaaggccaaattggagaagatgcaagagcaggttgacaagatcgtggataacattctcaaagagcatcaagaaaagcgtgaaagggcacgacgagaaggcagggttgacctagaggaggaggatcttgttgatgttcttttgagaatccaacaaagtgacaatctcgagatcaaaattacgaccacaaacatcaaagctataatattagacgtatttactgctggaacggatacttcagcatcaacacttgaatgggctatggcagaaatgatgagaaacccaagagtgagggagaaagcacaggctgaagtaagacaagcatttagggaattgaaaataatcaatgaaacagatgtagaggaacttatatacttaaagttggtgatcaaagagacattaaggctacacactccttctcctttattgctccctagagaatgctctaagcgaaccatcattgatggatatgaaatacctgtcaagactaaagtcatgataaatgcgtgggcgattgcaagagatccccaatattggactgatgctgagaggtttgtcccagagaggtttgatggtagctctatcgatttcaaaggaaataactttgagtatcttccttttggagcaggaaggagaatgtgcccaggaatgacacttggtttagccaacattatgcttccactcgctctattactctatcacttcaattgggaactcccaaatgagatgaaacctgagtatatggatatggttgaaaacttcggattgacagttggaaggaaaaatgagttgtgtttgattcccgttgttaatgatctttga

SEQ ID NO: 4390 - DNA, 627 bp, Glycine max var. Williams 82
atggcctcacaacaacacatcgagaagatgcagctccgccagaacttccgcaatctctggcactctgatcttttgagtacaattcaagctgacaccccttattgttgcttttctctgtggtgtgcaccgtgtgtatcatatctgctccgcaaacgagctctttacgatgatatgtcaagatacacatgttgtgctggttacatgccctgcagtggtcggtgtggagaaagtaaatgtcctgaactctgccttggtgcggaggttgtctgctgttttggaaattcagtggcctcaactcgatttctgttacaagatgaatttaatattcaaactacgcaatgtgataattgcattattgctttcatgtttgtccttcaacaacttgcctgcatattttctattattgctttaattgtgggaaatagtgaaattcgacaggcttctcaattgctatcttgtttggctgactttgtctactgcacggtgtgtgcttgcatgcagactcagcataagattgaaatggacaaacgcgatgggaaatttggaccccaatcagtaatgggtgttccccctgttcaacaaatgtcacgctttgatcaggcagtccccccttttgttgggtattga

SEQ ID NO: 4391 - DNA, 819 bp, Glycine max var. Williams 82
atggaaggtactcatcatctccatcaccatcaccaagggcatcaacaacaacagcaacaaagggttcttcctcagaatatgaacgtggatgtgaccgatagatttcctcaatggagcatccaagaaacaaaggagtttctggtgatccgtgaagagctggatcagactttcatggagactaagaggaacaagcagttgtgggaagtgatatctaaccgaatgaaggaaaagggttaccatagaagtgcagagcagtgcaagtgcaagtggaaaaaccttgttacccgctataagggatttgaaacaatggagcaagaagcgacgagacagcaattcccgttttacaatgaattcaatgcgattttcacagcaaggatgcagagaatgctgtgggcagaagctgagggtggatcaaagaagaacaaggcaacaacgcagctctcatcggacgaaaatgaagagagtactgaagccggtagcggcagaaagaagaagaaagcaaagataggtagtaggggtggtgataactgtagtggtagtttcaacagtttgaaggagattttggaggagttcatgaggcaacagatgcaaatagatacacaatggatggaagcgtttgaggcgagggagaatgagaggaggctgaaggagatggaatggagacaagccatggaggtgttggagaatgagaggataatgatggaggaaagatggagagaaagggaggaacaaaggaggattagggaagaagctagggctgagaagagggatgcactaatcacagctttgctaaacaagctagagagacaaggaatgtag

SEQ ID NO: 4392 - DNA, 1386 bp, Glycine max var. Williams 82
atggcttcgccctttctccccgccaaaaccaattccgccaccctctccttctccgccgcagtccccggccgccgcctccacttcgcggcgtctccgtcgcattcccctcgacggaggtcctccctgacggtgaagtcgaagatcagggagatcttcatgcccgccctcagctccaccatgacggagggaaaaatcgtctcgtgggtcaagtccgagggcgacgtcctctccaaaggtgacagcgtcgtcgtcgtcgagtccgacaaggccgacatggacgtcgagacgttctacaatggcatcctcgccgtcatcgttgtcgccgagggccagaccgcccccgtcggtgcccccatcggcctccttgcggagaccgaggccgaagttgccgaggccatggcagccgccaattctgctccaactccacctcccaaagcttccgatacttctccggcgccggcaccggcgccggaagtctctgattcaccacgtaaggcggttgcaacaccgtatgccaagaagctcgcgaagcagcacaaagtgaacataggttcggttgtcgggactggtccgtttggaagagtcactcctgctgacgtggagaaggccgccggtattttgccggcggagagcaatgtagctccggcggcggtggattcggctccaccgaaagctgctgctgcggctccggcggcatcctcggcttcaattccaggttctagtgttgtggcctttacgacaatgcaatctgcggttgcgaagaacatggtggagagtctctctgtgccgacgttccgtgttgggtacccagttaccactgatgcacttgatgctctgtatgagaaggtgagaaaaaagggtgtgaccatgacagcgattctggccaaggcagctgcaatggcactcgttcagcacccagtggtgaatgcctcgtgcaaagatgggaagaactttgcctataatagtaacattaacattgctgttgctgtggcaaccaatggtggtttgattacaccggttcttcaggatgcagataagttggacttgtatcttttgtcccaaaaatggaaagaactagtggaaaaagctcgtgccaagcaattgcaacctcatgaatataattcaggaactttcacactttcaaatttgggaatgtttggagttgacaggtttgacgccatacttcctccaggccagggggctatcatggcggttggagcatcaaaacctactgtcctagcagataaggatggtttctttactgtaaaaagtaaaatgctggtaaatgtaactgctgatcaccgaataatctatggggctgacttggctgcattccttcagacattctcaaaaatcattgagaaccctgaatgcctaacattgtag

SEQ ID NO: 4393 - DNA, 1731 bp, Glycine max var. Williams 82
atggagcagaaagaaaatcatgctagaaggaaaaagggagggctcatcacaatgcccttcatctttggtaatgaggtttgtgagaagctggctgtggtaggtttcaacacaaacatgattagctacttgacaacacagcttcacatgccattgaccaaagcagctaacaccctcactaactttggtggaactgcaagcttgacaccattgcttggtgctttcattgctgattcttatgccggaaagttctggactgtcacccttgcttccattatataccagatagggatgattagtttgaccctatcggcagtgctaccacagtttaggccacctccctgcaagggtgaagaggtgtgccagcaagcaagtgcaggacagctggcaatcctctacatctcactcctcctcggggcactcgggtcgggtgggatccgaccctgcatcgtggcgttcggggcggatcagttcgacgagtctgatcccaagcagacaacaaggacatggacctacttcaactggtactactttgtcatgggtgtagcaattcttgtggctgtgactgttttggtgtatattcaggacaatattggttggggaattggccttggaatccctaccattgcaatgttcctctcaattattgcattcattgtcggatacccgctttaccgtaacttgaacccgtccgggagcccgtttacccggttagtgcaagtggctgtggctgcatttcgtaagagaaaggtcccaaatgtgtcacaccctagtttactctaccaaaatgatgaactagatgcctctatttctatgggagggaagcttcttcacagtggacagatgaaatttttggacaaggcagcaatagttacagaagaagatgacaacaaaacacctaacttatggagattaaacacaattcatagagtggaggaattgaagtccataatcagaatgggtccaatatgggcatcaggaattctcctcatcacagcttatgcccaacaaaacacattctccctccaacaagccaagaccatggacagacacctaaccaaaacctttcaaatcccagctgggtccatgtctgtcttcaccatccttaccatgctcaccaccactgccttctatgaccgagtcttcatcaaagtggctcgtaggttcaccgggctggaccgtggcataagcttcctccacagaatgggcattgggtttgtgatctcaaccttagccacattggttgctgggtttgttgaaatgaaaagaaagaaggcagctttggcccatgggctttttgaccacccacatgccataatcccaatctcagtgttctggcttgtccctcaatacagccttcatggaatggctgaggcctttatgtcaattggacacttggagtttttctatgaccaggcccctgagagtatgaggagcactgccatggcattattttggactgctatcgctgctgggaactatgtgagtaccattatggttactttggtccacaagttcagtgctgggtctaatgggtcaaattggctccctgacaacaacctcaacaaagggaagttggagtacttttactggcttatcaccatattgcagtttctcaatcttatttactacttggtttgtgccaaattgtacacctacaagccaattcaggtccatgacaaaggggatagcaattcagaagggaaccaaattgagctctctaccacggtttaa

SEQ ID NO: 4394 - DNA, 975 bp, Glycine max var. Williams 82; identical to SEQ ID NO: 596

SEQ ID NO: 4395 - DNA, 306 bp, Glycine max var. Williams 82; identical to SEQ ID NO: 537

SEQ ID NO: 4396 - DNA, 1482 bp, Glycine max var. Williams 82
atgtctttggaagataaaaacgcaggcggccaacagttcatggaaaacggggacaaccataaagggctcaacaagtatgcctgtgcctctgtgttagctgccaatattgtctctgctatatttggttacgttgtgggggtgatgaccggagcactcatattcataaaggaagatcttcaaatcagtgacctacaagtacaactcctcgcaggcacattacatttgtgcgccctaccaggaagcatggttgcaggaagagcatctgattatataggtcgacgctacaccatcattctagcatccatcaccttcttattgggcacaactctaatggggtatggtccatcgtatctaatcttaatgattggaaactgcattgttggaattggtgtgggttttgccctagtagttgcaccagtttacagcgcagagatttcacctccttcttacagaggcttttttacctctctcccagaactctcctcgaacataggagtcctccttgcctttatgtcaaactatttccttgaaaatttgtcactgagacttgggtggaggatgatgatggtgcttccttcaattccttcatttggtcttgtcattctcatgttgaaattggtggagtctccaaggtggttagtgatgcaaggacgtgtaggtgaggctaggaaagtgcttttactagtatctaatacaaaggaagaagctgaacaacggttgagggacataaaaggtattgttggcattgatgaaaactgcaccctagacattgttcaggttccaaagaatactcgcagtggtgcaggagctctgaaggaaatgttctgtaatccttcaccacctgtgcgtaggatactgattgcagcgattggacttcactttttcatgcggattgatggatatggaggttttttgttatatattccaagggtgtttgagagaacaggaatcactgacaagagcacgctcatgctagccaccgttggtatgggaattaccaaagttgtatttgcattcgtatcaatgttcttgtcggatagagttgggaggaggattctcttgctgattagtgcaggtggtatggttgtgacccttttagggctaggtatttgtttaaccatagtggagcactccaaagaaaaattagtttgggcaacaaccttaaccgttatttttacctacatatttatgggcattgcgtgcaccggagtaggaccagtgacatgggtttatagctccgaaatacttccccttaggttcagagctcaaggccttggtgtctgtgtggttgtgaacagactcacaaatgtggtagtggtttcaagtttcatttcgatttataaaaccataacaatgggtggaattttctttgtgtttaccggtatcaatgctttggctttgttgttctactcatctttgcctgaaaccaaaggaagatcattagaagatatggagattatctttggaagaagttcaaagtaa

SEQ ID NO: 4397 - DNA, 873 bp, Glycine max var. Williams 82
atgaagaccataatggcagccaaatctcctcatgactcttcattctccttctcaaggaggtacttccattggaagaagaaggccttggatgaatctgatgacgaggaagaaatcctcaacttctcatcttcatcctcacatttccctgaagaagtcgatgacaaccaagaggaacactaccacccccaccacctcacactccaaatgccacaacatggtgccatcagcaccaagaaaaaaccctacttctccaagaagtccaagttcaagtccgccctcacggtctttaccacgcgtgtgccgaggctgggactacaccacaacaagaacagttccagtctcggcacgcgcgtggtagggacactcttcggccaccgccgtggccacgtgcacttcgccttccaggaggacccaaagctgggcccagctttcctcatagaactcgcgacccccaccagcgtcctcgtccgggaaatggcttcggggctggtgagaatcgcgctagaatgcgagaagaagaaaaagggtgacattaactacaacgccagcagcagcaaagtgaggctgcttgaggagccactctggagaacgtactgcaacgggaggaagtgcggatacgcgaacaggcgcgagtgtgggcctgaggtgtggaagatactgaaggcggtggagcccatatcgatgggggctggggtgttgccggtgtgcgtgaatggagctgcagggtccgaggaagaagctgctggggaggttatgtatatgagagctaagtatgagagggttgtggggtccagagactctgaggcgttttacatgatgaaccctgatgggagtggaggtcctgaactcagcatttacttgatcagagtttga

SEQ ID NO: 4398 - DNA, 612 bp, Glycine max var. Williams 82; identical to SEQ ID NO: 521

SEQ ID NO: 4399 - DNA, 1716 bp, Glycine max var. Williams 82
atgatttgtatagcccacattttggcaaataaaatcatgctcttcctctactactcacaagtcaatgcattagctgattgcaatatggaactcccacaaattaaccaagttcataagcttcttctcacggcatttgtgtttttctttcttgcatgtttgggtttgtctttccctttagagcctccaggcaataataggcaatggcacatgacttcagatgttaaggaagtagcaggcaagtcttatgactatattatagtggggggaggcacatgtggttgtccattagctgctacactatcagagaaattctctgtgctactcatagaaagaggtggttcaccatatgggaatcccttggtgatagataggaggtactatggttttccattgattaagactgacaaatacatgtcagtggcacaaagtttcacttcagaggatggaattggcaatgtgagaggaagagttcttggaggatcatcagctataaatggagggttttatagtagagcaagtgaggaatttgtatgcaaagctggttgggacaaggagctagtcaaagaagcttatgaatgggtggaatcaaaggttgtctttcctcctttttatctttcaccatggcaatctgttgctgaattcagcattcttgaagcaggagttttaccatacaatggcttcagcttggaacatatcaagggaaccaagatttctggaagtgtgtttgatgaatttggaaagaggcacacctcagctgaccttctgaatgcagggaacccaaagaacctcacagtccttctaaatgccacagtcaagagtatcatctttcatcacagtagttacaggaatgaaactagagctaagggtataaggttcatccagagtaatggcaccttggatgaaacctatgaagcatacataaacaaagccaagaattcaagttcaaggggtgatgtcattttggcagcaggtgcattaggtagtccccaacttatgatgctaagtggcatagggccaaaagaacagctgagaaggttcaacatatcaatagtacgtgaaatgaaaggggttgggcaaggaatgcaagacaacccttgcatagcagttttggtggattctaagccacagaataggctccctgatccaccccaaattgctggcataacagatgacttcaaaatcatagttgaagcatcaatatttcccctaagttccaactcatcaagggttaatgttgccgccaagatagcaatgcctacttccaaaggggtgcttgaactgaacaacacagaccccaggctgaacccttctgtgaggttcaactatctagcaagtgaagatgacatggaagaatgcgtcaagatgacaaaactacttgagagaattgcaaggtcaaaatctattgcatttttcctaggcgagtcaaagcaagaaaaactgacatcaactgacgttgatctaagaaacttctgcaagaaaaatgtgagaacaatctatcactatcatgggggttgcacggttggatcagtggttgatgagcaaaacaaggtttatggaataaagggattgagaatattggatggctcaactttttcagagtcaccaggcacaaacccaatggccaccattctgatgctaggaaggtaccaaggactccagattctaagggaaaggaaagcagattctggcttaaatgccaaagagcagacaaaatga

SEQ ID NO: 4400 - DNA, 1413 bp, Glycine max var. Williams 82
atggctacaaaagtgaaacgcaagactttttcaattgctgcagcaacatggatggtcttgtgtatcatcactatgatctgcaatgtcagtttagcagatagaattttgaaagaaaaagaattaggaaatgatgttccgaaagagagacaaggaattctcaaagccattgtgaatttcttatgggaggaaggaaagtcttcctatgaacctgtttggccgaacatgaaatttggttggagaattatagtaggatcaatcattggatttttgggagcagcattgggcagcgtaggaggggtaggaggtggaggaatttttgtgcctatgctggctttgatcattggctttgaccccaagtcttctacggccatttctaagtgtatgattatgggtgcatctatatcaactgtatactacaatctgaggcttagacacccaacactagacatgccccttatagactatgacctggctttgattttccagcctatgctaatgctcggaataagcattggtgttatatgtaatgtcatgtttgctgattggatggtgacagttttgcttatcatcctattcatagctacatcaacaaaagctacatacaaaggcatagacacatggaaaaaggaaacaattgcaaaaaaggaagcatccaaactgttggaagcagaaccaaaatctggtgatgactacaagtcactaccgagtggtccaactgagtcactatttgaggaggcccctttactaaaaaatatttattggaaagaattatcactccttgcgtatgtttgggtggcttttttcattgttcagattgttaaggaatacaccaagccctgttccatccagttctggcttcttaattttttgcaggttcctgtcgcagtctctgttacactttttgaagccataggcttatacaaaggaactagagtgattgcatcaaagggaaaggaagtcaccaattggaagattcatcagatttgtctctactgttccactggaataatggctggtatggttggtggactgcttggtctaggaggtggtttcattttggggccattgtttctagaattgggaattcctcctcaggtagcaagtgccacatcaacttttgccatggttttttcatcctccatgtcagtggtgcaatactacttgttggatcgtttcccggtaccttatgcttcctactttgcattggttgcaaccatagctgccttcactggtcagcatgtggtgagaaaagtaattgtagttcttggccgagcatccatcatcatcttcatactagcattgaccattttcatcagcgcaatcagtttaggtggagtgggaatagagaatataatcgagaagatagaaaatcatgagtatatgggctttgaagatctttgcgctttgtcttag

SEQ ID NO: 4401 - DNA, 555 bp, Glycine max var. Williams 82
atgccttcttctagttcaagccatgttgttggcgctgcttcctctgcataccgtggcgtccgcaagaggaaatgggggaagtgggtgtcagaaatccgcgagccaggaaccaagacaagaatctggctcggcagtttcgagactcccgagatggcggcggcagcatacgacgtcgcagcgttgcatttcaggggccgcgacgccaggctcaacttccctgagctcgccagcaccctgccacgccccgtcagtaacaatgctgaccacatacgcatggcggcgcaccaggccgctctcaggctccggacaaaccccgccgctcccgacaccgctggctccgccggttcctcctcctctgctcccctcaccgtgaggctctcccccactcagattcaggccatcaatgactcccccatggactcaccacaaacttggatgcaaatgcctgacactttcatgatgcatgatcagtccatgatgttcgcaagcaacggctattcgtttgaggacaacgagtgggagcatatgcagaatgattctctttgggatccttag

SEQ ID NO: 4402 - DNA, 753 bp, Glycine max var. Williams 82; identical to SEQ ID NO: 508

SEQ ID NO: 4403 - DNA, 519 bp, Glycine max var. Williams 82
atggttccaaggtcactagtaccaccacctcctccacttcccaaattctcaagaccaaaagcagaagagagtgtcacaaaccgagaaattgccaagttttggaggcaaaagaggatcgtggaggaggaccacctccttgctgctatcaaagctgcagctagactccgtgcacgcactctcacggagcaagagtacgagaggttcgagttgtccctgaagaccgataatgacaatgatgaaaccaagaaagagatggtgagatggattgtagggaaaaatgtttattgcaaaacagttgctaaggaccaacaagaagtgcgcatcggaatcaaggattggtggacaaaaagtaaatacgcgtatttgaatcaaccagccatagattccatggatcctcctaagaaacgaacctctacttatgttcccagttttctttcttaccagcccaagcctttgtatccttctgctattggtgtacatcttttaagccacaggaggcattccattgctgcttgttaa

SEQ ID NO: 4404 - DNA, 567 bp, Glycine max var. Williams 82
atggcttcccacttcctcaaatccctccttctcctctccacctatgccctcaccatctcagcagaatacacaggcttcgtgggaacactagacccaaagtccataggcatacaccacaagaaaaccctaagccacttcaggttctactggcacgaagtcttcagcggagaaaaccccacatcggttagaatcattccctcactccccaaatacaacgcaaccacaaccttcggctccgttggaatctttgacacccctttaaccgtgggacctgaggtgtactccaaggttgtcggaaaagccgagggcttgtttgcctccacgtcacaaacgcagtttgacctgttactgatttacaacttcgcgttgacccaagggaagtacaacggcagcaccatcacgttcacggggaggagccccctctcggagaaggtgagggagctgcccattgttggtggtagtggggtcttcaaatttgccactgggtatgttgagtctaggacgctaagttttgatccccaaacaaggaataacacggttcagttcgacgtgtatatttactattga

SEQ ID NO: 4405 - DNA, 306 bp, Glycine max var. Williams 82
atggcatctcatcaacaaaacaagcaagagcttgatgaaagggcaaggcaaggagagactgttgttccgggtggcactggtggcaagagccttgaggctcagcaacatcttgctgaaggaaggagcaggggagggaaaacaaggaaggagcagctggggacagaagggtaccatgaaatgggacgcaaaggtgggttgagcactatggacaagtcaggagaagaacgtgctcaagaggaagccattgacatcgatgagtccaagttcaggactggtaataaccaagacaagaaccagaacaagtga

SEQ ID NO: 4406 - DNA, 1845 bp, Glycine max var. Williams 82
atggagcctcgcaaagcttcaccattatcgtgggtcttgatcttcttccttagcatttccttgagtggagttaaggtattaagtgaagagcagcaccatgccaaatctcaagaaggacctgtggtggaaagggatcaaaggaggacattacttgtcactgaattcggagagatcactgccattgacatcaaggaaggacaaaaggaactgccctaccatcttcggttcatcacattggagccaaactcgctatttctccctgtgcttctccatgcagatatggtcttttatgttcatacagggagtggaaagctgacttgggcaaatgatgatggtactagtacgattcgtttacgcgaaggagatgtctgcagtctcaaggaaggatctgttttctatatacagagcaacctagaggctgagagaaggaaacttaggatttatgcaatgtttaccaatacggacgacaatacttacgatccatcaatcggtgcttactcaaggatcaatgaactggtcaaaggctttgatacgaaaatcatgcaagcagctttaaaggtgccggaagatttgattgaagcaatcattaacaagacggagactccagctatagtgcatgcagttccagagaagcggaatatcctccaggagctggaggcttcgtttcttaagaactttttaggcattgggtccaactccaagaaactcaaaacatacaacatctttgatcatgaccctgacttcaaaaatcccaatggttggagcacagcagtgaccaaaaagcaactaaagtcattgaagcggaccaacattggatttctgatggtgaatttggccatgggatcaatattggggcctcattggaacccgaaggcaacagagttggtagtgggagtagatgggggaggcatggtccgagtagtatgtggaagcagcaatgaagatgagacagaatgccaaaacatgaggtttaaggttaaggaaggtgatgcttttctggtgcctaggtttcatccaatggctcagatgtcattcaatgatggaccatttgtttttctcggcttcagcacttcagcaaagaaaaaccatcctcaatttttggcgggaaaggggtcagtgcttcatattctagacaaaaggatactggctacctctttcggtgtgagtaacagaaccattgaccagcttctgcgttctcccgaggattccatcatttttgggtgcagttcctgtgcagaggaagaggagaagataatgaaggatgaggaagagaatagaaagagagaggaggaagagaaggagaagaagaaggaagaggaggaagagaagagaaagagagaggaggaagaggagagaaagagagaggaggaagaggacgagaagaagagaaggagagaggaggaagaggaggagaagaagaaggaagaggaggaagagaagagaaagagagaggaggaagaggctaaaaggcaacaagaagagagggaaaagaagcgagaggaggaggaagctaggagagagaaagaaagggaaagagaagaggaggcagaaagggagcaagaacaagctaaaagagaagcagaagcagcagcacagagggaacaagaacaagctaaaagagagcaagaaaggagagaaaggagacggcaagaagaagaagatgaagaagaaccaacacggtgggagagaagaggaagaagagagaaggggaaaagtccagaaggagtagaatgggagcaagaagaagccaggagacagcaagcagagagtgatagacaagtggaagagcaaagccacaggaacagctttgaaggaaggagagctttgaaaataaggaacgtttga

SEQ ID NO: 4407 - DNA, 2376 bp, Glycine max var. Williams 82
atggtgaagttctcaaagcagtttgaggggcaactcattccagaatggaaagaggcctttgtggattactggcaactcaagaagaacctcaaaaaagtccaactcttaaataacgccaacaatacacaaaacaagcaccaagctagtacttctctacctaagtacatcttttcatcaataagaaactactctctatttggccaccaacatagagagcatggaccaattcaagtccataggaaacttgcctcatcatcttttaatggggacatgtatgagactgaattgcttgagcaattttctgacactgatgctactaaagaattttttgcatgtctggaccagcaactaaacaaggttaacaagttctatagaacaaaagagaaagagttcatggacagaggagattccttgaaaaaacaaatggaaattctccatatgctcaaaaccacattcaaggagctgcagagcaaagcaggctcttctcatggctccaaggatgatcaatctatctcatgcacattctctaatgaggaagactctgttaggagcagagcacaagaagaaatgatggacactactagcacagatgatttggaaaaaaatgaagcaccattttcagattcccctcgtgcagaagaacttgccaagtccatgcagattaaaagagaaaatggaaaattgaaaactctttctggccgtgtaatcaattgccaagggaagaatctgaggataaacattcccttgacgacaccatcgagaaccttttcagccataagctaccttctcagggaagatttgctcaatcagtcttcaaggcaatgtggtccagaaggtgtcaacaacattcacctaaacaaaactaatttgcaccatgctgaaaagatgatcaaaggaggtttcattgaactctacaaaggactaggatatctcaaagtttactggaacttgaacatgcttgcatttattaagattctgaagaagtttgataaggtcactgaaaaacaaattcttcccatctatatcaaagtggtcgagagttcgtatttcaatagctcagacaaggtgatgaagttagccgacgaagttgaggaactgttcataaaaaattttgccgaggaaaatcgaagaaaggccatgaaatacctaagaccaagccaacgcaaagaatctcatgctgttactttcttcattggactatttactggaaccttcttggcacttcttgcgggatatgctataatggctcatgtgactggtttgtatagaccacatcaaaattcagtgtacatggaaactgtctaccctgtgcttagcatgttcagccttgtgttcctacatttctttctttacggttgcaacactcttgcatggaaaagaactcgcataaactacagcttcatttttgagcaagcccctaccaaggaactcaagtatatagatatattcttaatttgcacaatggcaatgagtgctgtggttggggtaatgttccttcatttgactctactgacaaaagggtattattatgccaaagttcaagacattccctggcttcttcttctgggtttcttactattactagtatgccccttcaacattatataccggtcaagccgttaccgtttcctttgtgtaataaggaacataattttgtcacccctttacaaggttgtcatgctggattttttcatggctgatcaactttgtagtcaggtgccaatgctcaggaaccttgagtatgtggcatgttactatataactggtagctacaaaactcaggactatggatattgcatgaggacaaagcactatagagatctagcttatgcagtgtcatttctaccctattattggagggctatgcagtgtgctagaagatggtttgatgaagggcagacaagccaccttgtgaatctaggcaaatatgtatcagcaatgttagcagcaggagccaaagtggcttatgagaaagatgggagtgtaggatggctttgtgttcttgtgatcatgtcaagtgcagcaactatgtaccaattgtactgggactttgtaaaagactggggtttgcttcaaatgaattccaagaatccatggctaaggaatgaattaatgcttcagagaaaagccatttactacttgtcaatgggattaaaccttattctgaggcttgcttggttgcaaactgtccttcattcaagttttgaaaacgttgattatcgagtaacatccttatttttagcttctcttgaagttatcagaagagggctatggaatttcttcagattggagaatgagcatctaaataatgctggcaagtttagagcagtgaagatagtaccacttccttttcatgaaatggatgaagaagactaa

SEQ ID NO: 4408 - DNA, 867 bp, Glycine max var. Williams 82
atggctttccccaactcaaaacctaacctccttcaatctcttagtccccttatcaaatttttcatccctttcctcttgttgctacaacatcacagtgtcaagtcacaacaacaacccccatccccaatgtcagcatacgaaaccgttggcattgacttctcttttttcgacaaagatgatccaaacgtacttttgatcggcaatgcctcagtatctggtggggctctaaggttaaccaacaccgaccaacttggcaaaccagttccacacagtgttggaagagtagtgcatatcacaccgatacacctctggaacaagaacaacggacatctcgcagacttcacctctgatttctcctttgtcgtgaaccctaagggttcagcccttcgtggtgatggctttgccttctttcttacatcagccaaccttaacttcctgatccccaaaaactcaagtggggggtatcttggtcttttcaagccggaaactgcactggacccttctaaaaaccaaatagtggccattgagtttgatagtttcaccaatgattgggaccccaattcaccaaaccagtctcctcatgttggaattgatgttgactctattaagtcagtggcaactgtgccatggcctagtgaacttgaacctgataatgctgtagcacatgcgagcctgaactacaactccgaggacaagaggttgagtgtgtttgtgggttaccctgacaataggaatgccactgtctctgctattgttgatttgaggaatgttttgcccgaatggatcagtgttggtttctctgcctccactggtgacttggttgaaacacatgacattcttaactggtcttttgaagcagccttgtag

SEQ ID NO: 4409 - DNA, 1506 bp, Glycine max var. Williams 82; identical to SEQ ID NO: 517

SEQ ID NO: 4410 - DNA, 945 bp, Glycine max var. Williams 82
atgatgatgacgatgaacaatattgttattattccgtggtcaaccattggcgttgtgattgcgtggtacagttccaacataggggtcctccttctgaacaagtacttgctcagcaactacggcttcaggttccccgttttcctcaccacgtgtcacatgatggtgtgctcgctcttcagctacgttattgtttccgttacggacgcagttccgctgcagcgcgtgcggtccaggagccagttcgggaggatcgtggcgctcggtgtcgttttctgcttctccgtcgtctgcgggaacgtgtcgctcaggtacattcctgtgtcgtttaaccaggccatcggagccaccacgccgttcttcaccgccgttttcgcttacgccgtgagcgccaagagggaggcgtgggttacttacgccacgctcttgcccgttgttgcgggcgtcgtcgtagctagtgggggtgaaccaagtttccatctgtttggatttgtaatctgtgtttcatcgacagctgccagagcatttaaatcagtccttcaagatattttgttgtcctcagagggagaaaagttgaattctatgaacctgctgctttatatggctccaatagcagtgatggtattacttcctgcaacattgttgatggagggaaatgtgattcagatcacaatggatcttgccagaaaggatatcagaattttttggtatctgcttctcagttcatctcttgcgtattttgtgaacctgaccaattttttggtgacgaaacatacaagtgcacttacccttcaggttttaggaaatgcaaagggagcagttgctgtggtggtctcaattttgatattcaaaaaccccatttcaatgataggaatgcttggctatgcactcactgtcattggagttatattgtacagtgaaaccaaaaagaggtatagcaaaaattag

SEQ ID NO: 4411 - DNA, 975 bp, Glycine max var. Williams 82
atggcgttcaggaaaacccttgctcaacggctccttaacatcaccaaagtgtcatcacaagcgctcaccaattgtcggatttcctcttcctccgtcatcggaaggctttcaccgcgggccgacgagcccgttgatcccggagaaaatggcctcttccgtgcgccgcaactcgccggaaacctcctcgacaggctcaggacgatgggtattgcccacaaccggatccggttggatgggttgacgccgcctccgccgatggaaatggtggacacagtcaccgtcaaggacgcgagaaaattgctaaaggtggcgcaggtggagatggtgaaagcgaagctgagagagacccgaaagagttgcataacgttctcggagttcattgggatctgcgatgagcattgctcggatcaggatcaagcggtggagattgcaaagatgttggacaattccgcggctgtgattgtgttgggagatgtcgtgtttctcagacccgaacaggtagcaaaagccatccaaggtcttctccctgtaccaggagccaaggcgcacgagtcggtaagaagagaattcgaagtaatggagaaaaagaagtcagccattgacaagaaagcagacaccatggttcggcgtgagctctggggagggttaggttttatgatggtgcaaacaatggcattcatgaggcttacgttttgggaactctcctgggatgtgatggaacccatatgcttctatttgacctcaatgtactgcatggcaggctacaccttcttcctaaggacctcaaaagaaccttcctttgaaggcttctaccaagtccgtttcagctccaagcagaagcacctcatgaagcttcacaattttgacattgaaaagtataatcaactcagggctgcttgctctcccaccaccatgcctccaaagtttgatccctccattgctctcccatttgacaattcttccattcatcaatga

SEQ ID NO: 4412 - DNA, 837 bp, Glycine max var. Williams 82
atgaagcaagcaactcttttctccttctcactcttcctactcctttcctccaccaccatggccatttcaccagcacctgcagcagcaccaaaaacacctcctaccccaaaggcaacagcaccatcaccaaaaccattagttcccacactacctcagtctccagactctcctgactcagtccccgacgacatcaccagaatcctgaaaaaggcaaaaatgttctcagtcctaatccgcctcctcaaaaccacagaaatcatgaacaacatcaactcacagctcataacagccaagagtggcggcataaccatccttgcaccagatgattctgccttttccaacctcaaagcaggcttcctcaactccctaaacgaaggccagaaaatcgaattagtgcagttccacatattgccagagtttgtgtcgagctcaaacttcgattccctaagcaaccctgtgcagacagtggctggtaaagaccctgcaaggcttccgctgaatgtgaatgcattaggtaacagtgtcaacatttcaactggggtagtcaatgccaccattctcggagtagtctactcggataacaagcttggcatttatcatgtggacaaggttcttcttcctctagatttctttctaaccaataaggctccagctttggctccaacaactcttgcaaaggctcctaaagctgccaaggaaaactcttctgacgatgatcaagaagaaacagaccaaaatcacaataaatccggggcagtgagtttggttagccttggtggagcaatgttgatgtcgattgggatagctttggtcacagtggcaaccatgtggagttga

SEQ ID NO: 4413 - DNA, 2346 bp, Glycine max var. Williams 82
atgccagctggtattatgattccagcaagaaacatgccctcgatgattggaagaaacggaaccgttggtggctttggattatcttcagggctctctcttggccatattgaaaaccataaggcttcggaatctcaaagatctgtagaaatgttccagccaaacctgatggaagctggtcagctccacccactggacatgcctcagaacacttcagagagcgatgtccctagaatccgtgaagatgactttgacagtgccaccaagtcaggtagtgaaaatctagaaggtgcttccggtgaagaccaagaccctcgtcccaacaagaagaaacgctaccaccgccacactcagcaccagatccaggagatggaagcgttctttaaggagtgtccgcaccctgatgacaagcaaaggaaggagctgagtcgagagttagggttagagccattgcaggttaagttttggttccagaacaagcgcactcagatgaagacccaacatgaacgtcatgagaacacacagctgagaactgaaaacgagaagcttcgagcagataacatgaggttcagggaagctctcggcaatgcctcgtgtcctaactgtggtggaccaaccgctataggggaaatgtcattcgatgaacatcacttgaggctcgaaaatgctcgcctgagagaagagattgataggatatctgccattgctgcaaagtatgttgggaagcctgtggtgagctatccacttgtttctccttcatctgttcctcctcgtccactagaacttggggttagtggtggttttggtggccaacctggaggcattggaggggacatgtatggtggagctgcaggagatcttctaaggtcaataagtggacctactgaagctgataagccaatcataatagagcttgctgttgcagccatggaggagctcattggaatggcgcaaatgggtgagcctctttggttgactaccctggatggcaccactgtgctcaacgaggatgagtacatcaggtcttttcctcgagggattggtcctaaacccgttggtttcaagtgtgaagcttcgagggaaactgctgttgttatcatgaaccatgttaaccttgttgagatcctcatggacgtgaatcaatggtccacggtgttctctggcattgtctcaagagcaatgactttggaagtgctatcaacaggggtggcggggaattacaacggtgcattgcaagtgatgacagcagaagtgcaagtaccttcacctctggtgccaactcgagagagctattttgtaaggtattgtaagcagcacggtgacggaacttgggcagtagtggacgtgtccttggataatttgcgtcctagtccttcagccagatgtagaagaaggccctcaggttgcttaattcaagaaatgcccaatggctactctaaggtcatatgggttgagcacgtagaagtggatgacagaggtgtccataatctatacaagcagcttgttagctcggggcatgcatttggtgcaaaacgttggattgcaaacttggatcgacaatgtgaaaggcttgctagtgccatggcaacaaacattcccacagtagatgttggagtaataacaaacccagatgggaggaagagcatgttgaaactggctgagagaatggtcataagcttttgtgctggagtgagtgcatctactgcacacacatggacaacactttctggaactggtgccgatgatgtaagggtcatgacacgtaagagtgtagatgacccaggaaggcctcctggcatcgttctcagtgctgcaacttctttttggcttcctgtgtcaccaaaaagggtttttgaattcctccgcgatgagaactccagaagtgagtgggatattctttccaacggtggagttgttcaagaaatggcacacattgccaatggccgagacactggaaattgtgtctctctacttcgggtgaatagtgcgaattcaagccaaagcaacatgttgatattacaagagagttgcgcggactcaacgggatcttttgtgatatatgctcctgtagatattgtggcaatgaatgtggttctgaatggaggggacccggactacgtggcccttctcccttcaggatttgctatactcccagatgggaccactgcacatggaggtggcattggtgacattggacatggtggttctctcttgactgtggcatttcaaatattggttgattcggttccaacggcaaagctttctcttggatcagttgctactgttaacaatctcattgcctgcactgttgagagaattaaggctgctttatctggtgaagttgcttga

SEQ ID NO: 4414 - DNA, 1536 bp, Glycine max var. Williams 82
atgaaacaccaccccatgttgtctaaatggcttcttttcatctttctcacgtactactcaacctatctcactgtatcacattcgttgaaaattccaaggttgagtcccattgctgaatgggaaacaactttacacaaccgtgcaactgtggttgcaactgatacagatacagagaaccgcgtaacattttactacaaacaagttcttgatcacttcaactatagacctgaaagctacaaaacctttcaacaaagatatctgatcaatttcaagtactggggtggtgccaattctagtgccccaatatttgcctatttgggtgcagaagaaccaatagatggttcccctgaactcataggatttctcactgataacgctgcttcctttaatgctctcatagtatacatagagcaccgttactatgggaaatcagtaccatttggatcgagggaagaagcactgaagaatgcaagcactattgggtatttcaactcagctcaagcaatagcagattatgcatcagtcctcatacatattaagaagacattacatgcccaaaagtccccggtgattgtgattggaggatcatatggaggaatgcttgcttcatggtttaggctcaaatatccccacctggctattggtgctctggcctcatcagctccaatcctctacttcgataatattaccccacaagacggttactactctgttgtttcaagggattttagagaggccagtgaaacatgctaccaaactatattgaagtcctggtctgaaatcgacagagtagcttctcagccaaagggtctttccattcttagccagagattcaacacttgccgtcccttaaatgagtcttcagagttgaaagactacctgattaatatgtatgcttcttcggctcaatacaatcatccgccaagatatccagttactgtgatttgtggcggcattgatagagcttcttttggaagtgatatcctcagtaagatatatgcaggtttggtggctttaaggggaaacaccacctgcaaagttaatggtcctattattgtatctgagacaaccctgggatggagatggcagacatgtagtgaaatggtgatacccatcggcataggaaataataccatgtttcaacccgacccttttagcttaaagagctatgccaaggactgcaagaaacaatttggtgtctcacctcgccctcattgggtcactacttactatggaggccatagtatagaattggtccttcaaaagtttggtagcaacatcattttctctaatggactaagagacccttatagtagcggcggggttctgaaaaacatatcagacagtcttgttgccatccatacagtaaatggatctcattgcctggacattctgggtgcaaatgcaaatcatagcgatccagaatggttggtcgaacaatggaagagagagatcatggttatgaaagggtggatcgcccaatactatgatgatctcgttgcactcaacggggccacaaaatttcaaagcaaatga

SEQ ID NO: 4415 - DNA, 1275 bp, Glycine max var. Williams 82; identical to SEQ ID NO: 2317

SEQ ID NO: 4416 - DNA, 2520 bp, Glycine max var. Williams 82
atggcttccgattcttctcccctgaatttcaacaacggaccttcatcccccgacgactccctttccagccctatcggcaacaccttctcctcgccggcaagtagacgccggcgccgctcatccaccccctccgcattcgccaccccgtcggagcgccgctcccgattcgcctcctccgatgccaccccaaccgcgccgcgctcccgccagagaggtggcagtggaggcggcggagggcacgttcccgccactccgacctccaccaccgacgacgtgccggtctcttcggatggcggcgacggcttcgacatggacgatgccaggcccaccttcgtgtggggcaccaacataagcgtggaagacgtgaacgacgcgattaaaaggtttgtgaggaacttcagagaagcgtcttcgtcgcagggtggtgacgatgatgacgggttgcacttgcacaccgaagggaagtatgagaaactgatcagacaggttattgacgttgaaggagattctcttgatgttgatgcgcgtgatgtgtttgatcatgaccctgatctgtacactaagatggttaggtaccctcttgaggtgcttgccatctttgatttggtcttgatgaacatggttagcgaattgaagcctatgttcgagaagcacattcagacccgtattttcaatctcagaacctcaacctctatgagaaatttgaacccatctgatattgagaggatggtatcattgaagggaatggttataagaagcagctcaatcattccagagattagggaagctatatttaggtgtcttgtgtgtggattctgctctgagccagttcctgtggagagagggcgaataactgaacccactatatgtttgagggaagagtgtcaatccagaaactccatggcacttgttcacaaccgatgcaggtttgctgacaagcaaattgtgagggtccaggagacacctgacgagattcctgaaggaggaacacctcacacagttagcttgctgatgcatgacaagttggtggataatgcaaagccaggtgacagagttgaggtgactggtatttatagggctatgagtgtcagggttggaccaacacagagaactgttaagtcattgttcaagacatatattgattgtcttcacataaagaagactgataagtccaggatgtttgtagaggatgttatggatgttgatggtcaagatagaaatgcagaagttctctttgatgaagaaaaggtggctcaactgaaggagctctcaaaacggcctgatatatatgaaatactgacaaattcattggctccaaacatctgggagctagatgatgtgaaaaaaggtcttctttgtcagctttttggtggcaatgctttgaagttagcttctggtgctaactttcgtggcgatataaatattcttctcgttggtgatcctgggacaagcaagtcccagttacttcaatacatacacaaactatctccacgtggcatttacaccagtggaaggggaagttcagccgttggattgactgcttatgtgaccaaggaccccgaaacaggagaaactgttttagagagtggtgcccttgttttgagtgaccgaggtatatgttgtattgatgaatttgacaaaatgtctgacaatgcaaggagcatgttacatgaggtgatggaacaacaaaccgtttcaatagcaaaggcaggtattattgcttccctcaatgctaggacttcggtgttggcttgtgcaaatccaagtgggtcaagatataatcctcgcttgtctgtcattgacaacatacaccttcctcccactcttttgtccagatttgatttaatctacttgatgcttgacaaggctcatgaacagactgataggcgccttgccaaacatattgtgtccctacactttgagaatcccgagaacgtggagcaggatgtgttggacatttctacattaaccgattatgttagctatgcccgaaggcacatacacccacagctttctgatgaagctgctgaagaattgactagaggttacgtagaaataagaaaaagaggaaattttcctgggagtagcaaaaaggtgataacagcaacaccgaggcagattgagagtctgatacgcctaagtgaagcattggctcggatgcgcttctcagaatgggtcgaaaaacatgatgtaatggaggcttttcggcttttggaagttgcgatgcagcagtctgcaacggatcattctactggaactattgacatggatcttattactactggagtttcggcaagcgaaaggatgagacgagaaagtttgcaacaagctactcgtaacataatcatggagaaaatgcagattgggggacaatctatgcggttattggagttattggaagaattgaagaaacaggatactggtagcgatgttcatcttaatgatctaaggaatgcaattgctactctcgctgcagaaggatttgttaccatgcacggtgacagtgtaaaaagatcttga

SEQ ID NO: 4417 - DNA, 981 bp, Glycine max var. Williams 82
atgaaaatgggaagcaacttcaggtttttgagtctttgcctcttggcattgattgcatcatctcatgctcaacttcagcttggtttttatgccaagagttgcccaaaagctgagcaaatcattttgaaatttgttcatgaacatatccacaatgctccatcactagcagctgcattgataagaatgcacttccatgactgttttgtaaggggatgtgatggatcggtgcttctgaactcaacaaccaatcaggctgaaaagaatgctcctccaaatctcacagttagaggctttgacttcattgacagaataaagagccttgttgaggctgaatgccctggtgtggtctcttgtgctgatatcctcaccttggcttccagagattcaattgtagccacaggtggaccctattggaaagttccaacaggtcgaagggatggggtcatctctaacttggtggaagccagaaataacattcctgctccatttgacaacatcactacgctacagacactctttgccaaccaaggacttgatttgaaggacttggtcctgctctctggtgctcacacaattggtatcgctcattgctcatcattgtcaaaccgcttgttcaatttcactggcaagggtgatcaagacccatcattagacagtgaatatgctgcaaatctgaaaaccttcaagtgcaaggacctcaataagttgaacaccaccaaaattgagatggaccctggaagtcgcaagacatttgatcttagctactatagtcacgttattaagagaaggggtctatttgagtcagatgctgcattgttgactaattcagttacaaaggctcaaatcattgaattgcttgaagggtcagttgaaaaattctttgctgagtttgcaacctccatagagaaaatgggaagaattaaggtgaagacagggacagagggagagatcagaaagcattgtgcatttgttaatagctaa

SEQ ID NO: 4418 - DNA, 1632 bp, Glycine max var. Williams 82
atggttgaatctcagcccaagttcttcatccccgactcgatcaatggagtgaatttcgacgtggcggcgcagattaagatggtgtgggaagtgatcaaggcgccattgatcgtgccactgctgaacctcgcagtgtacatttccctagcgatggcactcatgctcttcatggagagggtgtacatgggcattgtcatcatcctcgttaagctcttctggaagaagccccaccagcgctacaagttcgagccactccaagacgacgaggaactcgggaactctaattaccccgtcgtgcttgtgcagattccaatgttcaatgaaaaagaggtgtacaaggtgtcgattggagcagcttgcaatctttcatggcctgtggatcgtctcgtgatccaagtgctcgatgattctactgaccctaccatcaagcaaatggtggagatggaatgcaatagatgggcaagtaagggcataaacatagtgtaccaaatcagagaaacaagaggagggtacaaagcgggtgctctaaaagaaggcctaaaacgtaactatgtgaaacactgcgagtacgtggcaattttcgatgcagatttcaggccagagccagattttctcagacgttccattcctttcttggtgggcaaccccgacattgctcttgttcaagctcgttggagatttgtgaattctgatgagtgtttattgacaagaatgcaagagatgtccctggattaccatttcacagtagagcaagaagttggatcagccactcacgctttcttcggtttcaacggaactgctggcatttggagaatagctgctatcaatgaagctggagggtggaaagacagaacaacagtggaagatatggaccttgctgttcgtgctagtcttaggggatggaaatttttgtaccttggagacctccaggccaaaagtgagcttcctagtactttgagagccttcagattccagcagcacagatggtcttgtggtcctgctaatttgttccgcaaaatggtgatggagattgtgaggaacaagaaagttaagttttggaagaaagtgtatgttatatacagctttttctttgttcgcaaaatcatcgcccacatggtcaccttcttcttctactgtgttgtgattccccttacaatcctggtccctgaggttcatgttccaatctggggagctgtttatattccttctgtcatcaccattctcaattcagttggaacaccaaggtccattcaccttctgttctattggatcctctttgagaatgtgatgtctttgcaccgtaccaaggcaacatttataggtctcttagagtatgggagggctaatgaatgggttgtgactgaaaaacttggtgactctgtcaacaataataataagaataaatcaggagatgctgccaagaagaataatgccatcaaggccacccccaaaaagactcgatccaaatttgttgaaagacttaatttactggagctgggatttgctgtcttcctcttcgtatgtggatgctatgattatgttcatgggaaacacaactacttcatctatctcttccttcagaccttaacattctcaattgtaggatttggctacgttggcaccatcgtgtaa

SEQ ID NO: 4419 - DNA, 909 bp, Glycine max var. Williams 82
atgccatcatcactatcctctttcctccatatggttcctattctctcccttcttgtactctcatgtgtgatttgttctagtagtgctcagggaccaccttcacctggctactaccccagttccaaaattagtcctgttagtttttatcaagggtttacaaacctatggggacctcggcatcagaggctagaccaaggctcattgacaatctggcttgactctaactcaggaagtggattcaagtcacttcactcttatcgatctggttacttcggtgctgccattaagcttcaacctggttacactgcaggagtcattacatcattatatctttcaaacaaccaagaccaccccggaaaccatgatgaaattgacattgagttccttggcaccacacctgataagccatatgtcttgcaaacaaatgtatacatcagaggaagtggagatgggaatattattggaagagagatgaaatttcatctttggtttgacccaacacaggattttcacaactatggcattctatggaaacccagtgagataatattttttgtggatgatgtccccataaggaggtatcctaggaaaagtgaagcaacatacccctcaaggtcaatgtatgtgtacgggtcaatatgggatgcatcttcttgggcaacagaggatggaaaatacaaagctaattataattaccaacccttcgttggtaggtacaaaaacttcaaactgcaaggttgcactagtgaaagctctgcctcgtgcaagccaccttctttctccccatctggctttggtagcctcagtcctcagcagtttagggccatgcaatgggtccaaaacaactacatggtctacaattattgccatgaccctaggagagaccacactcttatcccagagtgctaa

SEQ ID NO: 4420 - DNA, 1938 bp, Glycine max var. Williams 82
atgcatgaaacaaaatggcgcgattctggtttcaagcaattcaagttcatggatccaaccgtttcaatttcaagtcgcaagcgccccaacagtgacccaatgaaaaggagagtcatgggagatggattagagagcatcagtgaagcttcttgtcggcctgaagtgatcatagaagcaaatactctcttagtaattttctctttcttcatatcacaaaaggagctgggggaactaaagcaaaacattgaatccaagaagaggcaatatcataatatggatcttcaaagttctttgactcaagagatttttcagcttcaaaaacggttacagcaacaatttgtgatacgacgtgcattagagaaagcatgttatgtgcctttttcacaggatgctacaatagaaaattcaatacccaaggctgcaaaggaactgattaaggaaattggaatattagaattagaagttgtgtatttggaacaatacttactctctttgtatcggaaaagatttgatcaacaaatttcaactctatcaaccaaggaaagaagattggaattagcttcagacactaaacaaggaacatctgcagtgcctggcaatgatgctatctctgacaaagaaatttcagttgtgcactgtagtaatgtcatttcacccagaaattcatctgggtttaagcttaaggaattcaataaccagttggaagccgaaactggtttagactctagtattcatcgatgtcactctgcactatctcaacgaacaacatgctcaattgaagcatctcctgggaacattgagactaaagctgcgattgactcttaccattctctaccattatccatgttagagcaagctcagtgtgctaaatccagttcaaccagcctggcagagcatcttgggagtagctatgttgataatgttccagaaacaccaaattggctttctgaggagatgattaagtgtatatcagctatatattgtgaacttacagagcctacttcacttggtcataaaaatgcttcatcccctatttcattcccatcttctggtaacgagttatcttcacagagtcagggtagtaagtggggatcacaatggaagaagcattcatccttcaatttaaactccactaaccctttccatgtcagagggtccaaagaatttagtggaacttattgctcaatgataaggatacaacaattatgcacagatagccagaaattaaaagaaattgagtacatgctacgaagatttaggtcacttgtttctcggctggaagatgttaatcctagaaatatgaagcatgaagaaaagcttgccttttggattaacgtgcacaattccttggcaatgcatgccttattaatttatggaatttcagccaacaatgttaaaagaatgtcttcggtactgaaggccgcatataacattgggggacatactataagtgtagacctgatacagaacttcattctgggatgcagattgcctcgcccaggacagtggttgcggttgtggtttccttcaatgacaaaaccaaaggttagagatgcaagaaaaggatatgccatacatcgtccagagcctttattactatttgctctttgctcaggaagccattctgatcctgcggtacgtttgtacacatccaagcgagtctttgaggagctacaatgtgccaaggaggaatacattcagtctaccatcaccataagcaaggaacagaaaatagttcttccaaagatggttgattcctttgcaaaaacttcaggtctaggagcatctgatttgatggagatggttaagccttatctacccgattctcaaaggaagagcattcaagagtttcaatcaaagacaagctggaaaagcattgaattaacccctcataacttcactttccattacttgatttcaacggaactagcttggtaa

SEQ ID NO: 4421 - DNA, 909 bp, Glycine max var. Williams 82
atgccattgttaacttcctctttgtttcacatggttcctctcttctctcttcttttactctcactcatgattcgttatggtacttctcagggtccaccttcacctggctactaccctagttccaaaactaatcctgttagctttgatgagggatttagaaacctttggggacctcagcatcagaaactagaccaagactcgttaacaatctggcttgactcctactcagggagtggattcaagtcacttcactcttatcggtctggatactttggtgctgcgattaagcttcaacctggctacactgcaggagtcataacatctttatacctttcaaacaaccaagactacccaggacaccatgatgaaatagacattgagttccttggtaccacgccagataagccatatgtcttgcagacaaatgtatacatcagaggaagtggagatgggaacattatagggagagagatgaggtttcacctttggttcgacccaacacaagattttcacaactatgctattctgtgggaacccagtgagatcatatttttagtggatgatgtcccaataaggaggtatcctaggaagagtgatgccacgttccccacaagagaaatgtatgtgtacggatcaatatgggatgcatcttcatgggctacagagggaggaaaatacaaagctgattataattaccaacccttctttggtagatacaaaaacttcaaaatactaggttgtaccactgaagcctcaacctcatgccagccaccatctccttcaccatcaggctatgacagccttagtcctcagcaatttgctgcaatgcaatgggtccaaaacaactacttggtctatgactattgccatgatcctgggagagaccatacacttactccagaatgctaa

SEQ ID NO: 4422 - DNA, 1635 bp, Glycine max var. Williams 82
atgaagctgattaataaaccatcgcaactacgtgccctcttctgctccattttgcttcttttggaattcgctttcgttgctgcggaggacccttatagattcttcgactggaccattacctacggtgacatttatcccctcggagttaaacaacagggtattcttatcaatggccaattcccaggccctgaaatctattccgttaccaatgacaatttgatcattaacgtgcacaataacttgaccgagccgtttcttctatcatggaatggtgttcaacaaaggagaaattcttaccaagatggagtttatggaaccacatgtcccatccctcctgggaagaacttcacctacacactccaagtcaaagatcaaattggaagtttcttctattttccatctcttgctttccacaaggcagctggtggttttggtgccatcaaaatccttagcaggccaaggatccctgtcccattccctgacccagctggtgatttctcccttcttattggagattggtaccaaatcaatcacaagaagctccagagtgttctagattttggacacaaacttccattccctcaagccgttctcatcaatggtcgtccaagtggcacaacattcacagctatacaagggaaaacatacaggcttagaatatcaaatgttgggcttcaaaacacactcaactttaggattcaaggccacgacatgaagttggtggaagttgagggaactcacaccatacaaaccacgtattcctcgttagatgttcatgtgggacaatcttattccgttcttatcacagctgatcaagcacccaaggactactacattgtagtttccactcgtttcactaataagatcctaacaagcactgccatccttcactacagtaactccctacaatctgtttctggaccaattcccggtggcccaaccactcaaatcgattggtccatcaaacaagctcgttctatcaggacaaacttgacagcaagtggaccaaggccaaatccacaaggctcctaccactatggtttaataaacattagtaggacaattacactggtgagctcagcagcacaagtgaatgggaagcaaagatacgcagtgaacagtatatcattcagaccagttgacactcctttgaagctggcagattacttcaacattggaagggtttttcaagttggaagcataccagatagtccttctggtagacctatgtatcttgacacctcagtcatgggtgctgattttcgagcctttgtcgagatcgtgtttcagaaccatgaaaacatcatccaaagctggcacattgatggatactcattttgggttgtaggaatggatggtggtgtgtggacacctaatagtcgtaaccaatacaacctcagagatgcagtatcgaggagcaccacacaggtatatcccaagtcatggaccgcaatttacatggcattagataatgtgggtatgtggaacgtgaggagtgaattttgggcacgacaataccttggacaacaattctatttgagagtgtattcaccagttgggtccattagggatgaatatccaattcctaagaatgctattctctgtggcaaagttgcaggcagaacaaccagatga

SEQ ID NO: 4423 - DNA, 1650 bp, Glycine max var. Williams 82
atggacgagaatggatgttccaacgagcccaacaacaagtggaagatgcctctctttgttttcttcagagatgcgagacttattttcaagctggatgccctttctcgagagatattagggattgcattccctgctgcactagctgttgttgctgatccgattgcttctttgatagacacaacattcataggccacttgggaccggtagagcttgctgctgcaggagtttccattgctttattcaaccaagcttcaaggattaccatattccctcttgtcagtattacaacttcctttgtggctgaggaagatactatccaaaggttgattaacaaagaaactgaaactgataacatagaaaatgaaacaataaccaaagaaaatgttgaggctccaaaaaaattcaagggggaaaccgacgaatcaaacaatgttgtagcgaagagtacttttacatctggggatgtggaaaaattagctacagggaacatgggcataaataatgaaaatgttacaagtagtaccaaaagcaaacccaaagttggaaagaagcgcattgcttcagcatcaacagcgttactttttggcactattctaggcctccttcaaactgcaatcctcacatttgcagccaaacctcttttatatgcaatgggtctaaaacatgattctcctatgctaattccagcagagaagtatctaagattgagatcaattgggtcacctgctgttcttctctccttggccatgcaaggaatctttcgagggttcaaggacacaacaactcctttatatgtgatcgtttctggatatgcgttcaatgtcttactggacccaatacttattttttatttgaaattgggcctcaaaggtgcggccatggcacatgttatctcccagtacatgatggcaatcaccctccttttgttgttaatgaaaagagtacatctcgtacccccaagcataaaggatttgcagattttccgatttcttaaaaatggtggtctattgttgacaagggtagtgtcagtgacattttgtatgaccttagcagcatcattggcagcaaggctaggttcaattcctatggctgcatttcaacctggcctacagatttggttggcatcatcccttcttgctgatggtttggctgtggcagtacagacaatgctagcttgttcctttgctgagaaagactataacaaggcaactgctgctgcaacacggacactacaaatgagttttgttttaggcgtggggctctcttttgcagttgcacttgggttatactttggacctggaatattttccaaaaacgctaatgttgtgcacttaatcaaaataagcatgccgtttgttgcagctactcaaccaatcaattcattggcctttgtctttgatggtgtcaactatggggcatccgattttgcatattctgcctattctttggttttggtgtcattagtaagcattcctatagaaatccttctcttcaggagcaaacaattcgttggaatatggattgcactaaccatatatatgattcttcgtatgttagttggtatatggaggatgggaacagggacaggaccatggtactatcttagaaaaggaccatggtgttatatgagaggccactcattgccatag

SEQ ID NO: 4424 - DNA, 624 bp, Glycine max var. Williams 82; identical to SEQ ID NO: 2327

SEQ ID NO: 4425 - DNA, 453 bp, Glycine max var. Williams 82; identical to SEQ ID NO: 2330

SEQ ID NO: 4426 - DNA, 1257 bp, Glycine max var. Williams 82
atgagtgacaatttgatgggaaaagtcaacgctttgggggagcgtctcaaaattggtggggctgaggtgggtcggaagatgagtgctggcatgagttctgtgagcttcaaggtcaaggaatttttccaagattcaagccatgctggtaaactcgttggggaagctacctctgaggccctacatgagcctgattgggctacaattcttcatatatgtgacttgatcaatgctgatcaacttaacactgctgaattggtacgtgcaattaagaaaagggtcgtggccaagagtcctagaggtcagtatctggctttggttttgcttgaagcgttggtcaagaactgtgacaaggctttcttggaggtggcaactgagagagtccttgatgagatggtcaagctcattgatgaccctcagactattcttaataaccggaataaggctttgataatgattgaggcatggggagagtcaaccattgagcttcgctatctgcctgtctatgcagaaacttacaagagtttgaaatcaaggggtattcgattccctggccgtgacaacgaaagcttggctcctatatttactcctcctcactctgccattactccagaggctgatgtcagttttgcagatcttattcagtatgatattcatgggcaaagcttaacctctgttactcctcctcgttctgccactactccagaggctgatgtcagtcttgcacatcttatgccgcaagatattcatatgcaaagttttaagtctgaacaaataaaggaaacatttgatgtcgcgagaaatagcattgagcttctttctactgtgttgtcttctacaatgcagcagaatgtgttgaaggatgagttgaccaccacattagtacaacagtgccgtcagtcccagactagtgtccatagaatcgttgagactgcttgggataatgaagcagtgcttgttgaggccttgaatgttaacgatgagattcagaaggttttctccaaatatgaagagctgaagaaggagcagaaggagcctaccgttgttccatttgaagctgaaccggttgttaccaaagaggaagcactgattagaaagccaggttcaagaattggagtccatggagggagccacgatgacatgttggatgatcttgatgagatgatttttgggaaaaagggtagggatgatgcatttgaaggagggcaacatccaaagaaacaacaatcatcatcaaaagatgacctcatctccttctaa

SEQ ID NO: 4427 - DNA, 231 bp, Glycine max var. Williams 82; identical to SEQ ID NO: 2281

SEQ ID NO: 4428 - DNA, 1530 bp, Glycine max var. Williams 82; identical to SEQ ID NO: 2323

SEQ ID NO: 4429 - DNA, 132 bp, Glycine max var. Williams 82
atgaagttcttgttccagtgcccttgctgctcttgcttttgcttcatgaagccaaagcaagggaaggcaaaggtcaaggaagtcaaagaaaccaaggtggaagaaaaaaaggttgaagaaaagaaagactga

SEQ ID NO: 4430 - DNA, 852 bp, Glycine max var. Williams 82
atgagtttgactggaactgtgaatgatgcaactgctacaaattctccgtgttgttgttctgaggcttcaggatcgggatcttgttgtggatgttcatctaacaacagctccactcatatttgcttcaagtgtgacttcaattgtgatcctttactcactcttgaaaatgaagactccaagtggatctcagattcaaatccttatggatgttcatctgcgaaaccttcatctcctcttagcaccaatggaatacattgtgacagatcaaaagataatattatttcagtggagcatcttctagaaatagaagacatgcaagagtttaatgttgatgaaccacttttttggccatttgaagcgaaattgaactggaattattctgaggaatcctggagtccattttgtatctcacctaggaaaagggttgtctttggttctagatcaatgacatcaaggataaaggaaagtaaacataaagaccctggaattgaatgcagtgtaacatctgaaccttcaaggataaccatgtcatctaaaggttcagcagagatagtaaattcagagttgaatgatgagaaagttgtactgaaaagcagagaagatggcaacaaactaatatttgttgacaatcttaatgaggatcatgagccaaactatgaccttcaattagctagaggagatttttctttggatcaagagcctgagattccaattgagacattggtggggctcaaggaatttgatggacatgaagggcttgattcagaatttaatggtgatgttttcatgctggaggattctctcttaataactcatgcaagtgaatgtgtagtttccaaaaaggatgaatag

SEQ ID NO: 4431 - DNA, 522 bp, Glycine max var. Williams 82
atgaccacccgaaaaagcctcgttctttcgctcctcctccttctgggcctctccccgctctgcgccggcgccgctccgccgcaggagctgtggtgcgtggcgaagaacaacgcggaggacgcggcgctgcaggctgcgctggactgggcctgcggggctggcggcgccgactgcggcccaatccagcgcggtgggccctgctacgaccccaccagcgtgcagaatacggcgtcgttttccttcaacgactattttctgaaacatggcatgaccgacgatagctgcaacttcaacaacaacgctgccgtcacttccttgaaccctagtcatgataattgcaagttcccctccggcaagacggggagcaacgggagtttttctggatcaacacccacttcatctgttggattgggacccagtgaagatttcagtgggtgcacgagagtttcttgggggtggtggtggttttggcctttgagttttattgggcatttgatgtttatggtttctgtttttggatga

SEQ ID NO: 4432 - DNA, 1494 bp, Glycine max var. Williams 82
atgggtttcccgcaaaggttgctgtttatattggcagcaggtaccatattgagtgtaacgggtttggagcataactatggagaagctttgtcaaagagcatattgttctttgaaggacagaggtctgggaaattgccaccaacacagagaatgacttggaggaaggattctgcgcttcaagatgtctatatagtccctgctgatactactgtcttacctttccttcgtaataaagttgacttggttggtggttactacgatgctggcgacaacgtgaaattcaactttccaatggcattttcaacaaccatgcttgcctggagtgtgatagagttcggaaaattcatgggtccagaccttaaacatgcgttagacgctattcgttgggccacagagtatttcctcaaagccacaagcatccccggttttgtgtttgcacaagtcggtgacccatatgctgatcacaattgctgggagagacctgaagacatggacacccccagaacagcctttgccgttagcagagacttccctggctctgaagtttcagcagagatagcagctgcacttgcagcctcctcaattgtatataggaagtatcatttaggttactctacaagacttctccaaagggctataaaggtttttgattttgcagataagtacagaggatcatacaatgacagcctcggaccgtgggtatgcccattctattgtgattttagtggctaccaggacgaattggtgtggggagcagcatggttgttcaaggctactaaacgcccttactacgcagattacattgacaaaaacgttcataatctgaaaaactttgctgaatttggatgggactcaaaggatgctggcatcaacgtgctcgtgtctaagcttctaattaatagtagctctaattctaagcctttcatcctcaacaatgctgacaagtttgtctgttctgtgctacctgaatcaccttcagtattggtctcatactcttcaggtgggcttctattcaagcctggagggagtaacttgcagcatgcaacagcaatctcatttctgtttctggtttatgctggctatttgaaacagacaaataaagagattgactgtgggggtaaagtttttgcttctccaaagcgactcaaacaaatagcaagaggccaggtggattacatactaggaagcaatccagcgaatatgtcatacatggtaggatacggagcaaaatatcctgaaagaatacatcatcgtgcgtcgtcattgccatccgtggatgagcaccgcggccacattggttgcaaaggaggatcattttattttgacaaccaaaatgcaaaccccaacttgcttgtcggagctgttgtgggaggaccagatatgaaggattcatacgcagattctcgagcagattttgtacactctgaacctacaacatacatcaatgcaccccttgtgggtgttttggcatacttcaattcacatccatcctag

SEQ ID NO: 4433 - DNA, 624 bp, Glycine max var. Williams 82; identical to SEQ ID NO: 2295

SEQ ID NO: 4434 - DNA, 1425 bp, Glycine max var. Williams 82
atgcgattgctatgggggctaaggctgcccctactcatactgattcaacttttataccccaacaaatcaacctacaaattatacgctgaggctttgttcactttcaagggttctattggaggtccacaacaattaggatgcagcattgtgaaatatccatgtcaaatgcaatggccttgtcttgactgctataaactaaaagatccaggtggaataacagcaaagatagatgggaataacgacgttccaacacttacacctcttcaagaaactcaagttagaaaaccaggaggaacaagggctgctgccatagttggtattcttgttgctgccttagtcgtcattgtcattttggtgactgtctgtatctgcttgatgcgtgttaaaagatttatgaggcaaacatctgaggctgcttcttctatgccatctcccactgttgagatgggaagagtcaacaacactcagaatgttaatgctttccctccacattatacgctgaacacaagacagttaacaattttggaactagaacaagctacacgaaatttcagtcatagtaatattattagtgaaggtggatttggttttgtatacaagggcttgcttcaagatggatccattgtggctataaaaaggcgtctatttgctctgacacaggatttcgtccttgaggtgaatcagatagctcatattcaccacacccatcttgtgaagctcataggctattacgaagatagctatcaacaattacttgtatatgaatatctccctaacggcaatgtagggagtcacttatatgacagtgaaggtttacctattggaaggttagacttgtggcgaaggatatctattgctttaggcgcgtccaaaggtgtggaacatcttcatagtttggtccctcctttggttcacacaaattttagaactagcaatgttctgttagatgaaaattacacggccaaggttgctgtttatggattctgcaaattgcaaacacaagttgataatgctggctcatcttcacatgtagactgctttctagacccagagttgagctttccacaaaactattcggagaagagtgatgtacacagtttcggggtcttcttactagagttgattagtggttgtgaagcacaccgcaaaagcttgtcaaacccagatgaaaacatagtgtttaaggcaaaaaatagcgttgacttggacaactttgttgacataacgctgggagagcaagaaaagcatggtgctagacgaatgatgaaattggcattgctatgtgtggatgtgactagtagaagaccatcaatggcgcaaattgtgcaagagttggagcagattcaaagagaaattgctccagtgtattctcaattcaacgaggagattggtgccgtgactctagggagtgagctctttcagtaa

SEQ ID NO: 4435 - DNA, 630 bp, Glycine max var. Williams 82
atgatgcaaattgaaaagaaaaaaccctctagaccaatgtggtcatatgccattcgtgatgctcttgcatgtgtaggagtcagtgggtggaagaaagctttcaagtgcgagaacctgataatgcaatttcaagctcaactaaatatccaaaagaataggaggcgtgttattattgtgcaatcacgtgcagatattgctcaactgctcgaaatcgacaagttagagagtgctttttctagggtggatcagctatgtaaagacacatgtttattgactgcatatgatctaattgataatttctgtgaatgcctcatcaccaacatgtccttcattagcaaatgcagttctgtacacaacttgcctataaatgttgttgtggcaattgcaagtctcacatatgcttcttcaagatgtggtgaattgtcacttttgcatctgataagaaacttgttcagagagagatatggaagggaatttgacattacaaatgtggaactatttgctggcaactatgtggacttgccgttgaggaaaaacctgagcaactatagtgtactagaagatgagaaactcatgttattaaatgaaatagctcatgaaaacttcaaccaacaacttgagagactatga

SEQ ID NO: 4436 - DNA, 402 bp, Glycine max var. Williams 82
atggctgccactgaggaaaaaattctctctaggattgaccgtttggataatgtgttgcggcatttggaggaaattagagggtgcaatccatctccgaagagctcgtgtgcatctactccaacaagtggaagtgacggacacgtgtcgtccactgatttctccccaaagagtttagagaagcactgccgtccgattgaaaacattatgatggagaccgaagccaaaggaacgatgatagagaggctcaatcaggtggaggatcgaatgctaaagctggaagaagagttggtagcaaagaagaaagaggaagggaagaaaatgaatagcccaaagaaaggttttaaacagcttgtgaagcaaagtatgaaacctaggggaaaacatagtaataaagaagcatga

SEQ ID NO: 4437 - DNA, 780 bp, Glycine max var. Williams 82
atggctgtggccaacaatgtgctttgcattttcttcattatctccttaacatgtatggttcaagctcgaatcccaggggtttactctgctggtgcatggcaaagtgcccacgccaccttctacggaggctccgatgcttccggcaccatggggggagcgtgtgggtatggaaacctgtacagccagggttatggtgtgaacacggcggcattgagcacggcgctcttcaacagcgggcttagctgcggtgcgtgttttgagataaagtgcgcaaacgacaggcagtggtgccactccggcagtccttccatcttcatcaccgccaccaacttttgccctcccaacttcgctcttcctaacgacaatggcggctggtgcaaccctcctcgccctcacttcgacctcgccatgcccatgttccttaaaatcgccgaataccgcgccggaatcgtccccgtcgcctatcgccgggtgccatgcagaaagcacggagggataaggttcacgataaacggattccgttacttcaacctggtgctgattagcaacgtagcgggtgcgggtgatatcgtgcgcacgtacgtgaagggcacccgaaccgggtggatgccaatgagccgtaactggggtcagaactggcagtcaaacgcggttttggtgggccaggccctgtcctttcgtgtcaccggcagcgaccgccgcacctcaacctcgtggaacatcgctccacccaattggcaattcggtcaaactttcaccggaaagaatttccgtgtctga

SEQ ID NO: 4438 - DNA, 1098 bp, Glycine max var. Williams 82
atggcttcctccttcttctttctaacattgcttctcctctccattatctccgccgccaccccctgcccgccgtcagaacgggcagcactactggccttcaaagctgccctgaccgaaccctacttgggcatcttcaacacatggtcgggcaacgactgttgccggagctggtacggcgttgcctgcgaccccaccaccggccacgtcaccgacgtcaacctccgcggcgagtcccaagacccaatgttccagaagcttggccgctccggctacatgaccgggaaaatatcgccggagatttgcaaccttagcaacctcacaaccctcatcgtcgccgactggaaggccgtctccggcgagatccccgcttgcgttgcctcactctacactctccaaatccttgacctttccggaaatcgcatttccggcaagattccgacggacatcgggaacctctggagtctcaccctattgagtctgggtgacaacgagatctctggcgagatcccaatgtcagttgtaaaccttgccagactcaagcatctagacctcagcaacaaccgactcactggcgaaattccctatgatttcgggaaactcgccatgctgagtcgggcgttgctgagtgaaaaccaattaaccggttcgatccctaagtccgtgtccagaataaacaggctcgcggacttagatgtctcatcgaaccggttaagcggttccatcccggtagagttgggaaaaatgaaggttctctctactttgaaattggatggtaactctatgacgggtccagtaccctccactttattgagtaatacgggtatgggtattttgaaccttagccgaaacgggttttcgggtaccatacccgatgtttttggagcaggttcctattttatggtccttgatttgtcgtttaataacttttcgggtcggattcccggctccttatccgcatccaagttcatggggcatttggatctgagctacaaccacttatgtggaaccatccctattgggtctccgtttgaacaccttgatgcggcttcgtttagtaacaatgattgtttgtgtggaaacccgttgaaggcttgttga

SEQ ID NO: 4439 - DNA, 2904 bp, Glycine max var. Williams 82
atgcgtgtttcctggcaaaccatggaaggcgttcagttagaaaaagtagtcttcttgttatgttttggtctaataattacaatgagttatggggctacaaacccaaatgatgtcaaagttttgaatgatttcagaaaagggttggagaatccagagcttttgaagtggccagaggagggagatgatccctgtggtcctcctttatggccttttgtgtactgttctggagatagagtaactcagattcaggctaaggatcttggtcttagagggacattgcctcacaactttaaccaactctcagaactcttcaatttgggtctccaacgcaacaaccttagtgggatgttgcctacttttagtggattatccaaattgaaatatgctttcttggattataatgcatttgatgcaatcccggctgatttctttgatggacttagcagtcttatggtcttgacattggaaaaaaatccactgaatgtaagtagtggctggtcgtttcccatggatttagaaaaatcagttcaattaacgaatctttctttggcgttttgtaatttggttggaccgttgccggattttctgggcaggttgccatccctcacacaactgagcctttcaggcaacaaactgactggtgccattcctgctacttttgctcaatcttcaatccaggatttgtggttaaataatcaagaaggtggagggttgagtggtcctattgatgttattgcttcaatgattttacttagacatgttttgctacatggaaaccagttcactgggccaattcctcagaatattggaaatcttacttccttgcaggaactcaatctcaatagtaatcaacttgttggcttgattccagagtccctagcacatatggaacttgagatcctagtgttaaataataacatgctaatgggtccaataccagaatttaaggctgccaatgtttcttatgataacaacttattttgtcaaccggagcctgggcttgaatgttcccctcaagttgctgcactactggattttctggacaagctgaattacccttcatttctcatatctgattgggttggtgatgaaccatgcacacgcagcacagggtcatggtttggattgagctgcaattccaactcagaggtatctgttatcaatctacctagacacaagctaaatggtactctaagtccttcacttgctaagttagattcactccttgaaattaggcttgcaggaaacaatataaccggttcagttcccggtaattttaccgacttaaaatctttaaggttgttggacttaagtgataacaaccttgagcctccattaccaaaatttcataatgacccgaaggttgtcactgtgggtaaccctcttcttcctaaccaaactggaggaagtcctagtcctatgcctattaacaacccaccttcaccacagaatccatcacatcctccatcctctcatgagtcacctgttccagatcagagttcaagatcaaatcaatccaaaccaaatgacttgaaaatattcaaagcagtaggaattgtggctggagttgctgtgtttgcagttgtagctcttttggttgtttatcccttcttatgttgcaggaagaacaaaaaagcctccttggatgctccaagttccatcatggttcacccacgcgatccatctgattcggataacatggttaaaattacggtttcaaacgccactggaagtttgtcaacaaagactgggacaagttctcagagtaacattagtggtgaaactcaaaactctcacataattgaggatggaaaccttgtcatttctatacaagtactacgcaaggttaccaatgattttgcttcagaaaatgaactaggccgtggagggtttgggactgtttacaagggagaactagaagatgggacaaaaatagcagtgaagagaatggagcatggggttattagcagtaaggcattggaggagtttcaagctgaaatagctgttctttccaaggtccggcaccggcatctggtatccttgttggggtattccattgatggcaatgaaagacttttggtttatgaatatatgtctcttggagctctaagccagcatctttttcattggaaaagcttgaagttggagcctttgtcttggtcacagaggcttgcaatagcactagatgttgctagagggatggagtaccttcacagtcttgcccgtcagacctttattcatcgagatcttaaatcttctaatatcttattgggtgatgattttcgggctaaaatttcagactttggtttggtgaagcatgccccagatagtgagaagtctgtagcaaccaagcttgctgggacatttggataccttgcccctgaatatgcagtgatggggaaaatcaccacaaaagttgatgtgttcagctacggtgtggtgttgatggaacttctgactggacttgtggcacttgacgagagtcggccagaggaaagccggtacttggccgaatggttttggcgaattaaatcaagcaaggagaagcttatggctgctattgatccagttctggaagcatctgaagaaacttttgagagcataaccattgtagctgaacttgctggacactgtactgcaagggaagcacatcataggccagatatgggtcatgcagtcaatgtcttggcagcattagtggaaaaatggaaaccagttgatgatgaattagattgctactctggcattgactacacaagaccacttcctcaaatgttgaagatttggaaggaagcagaaagtggagagtttagctatgcttcttgtctcgagaacagcagaagcagtattgcagccaggccttctggttttgcagactcttttacctctgctgatgcaagatga
